United States Patent 9,487,797 (GENOMIC PLANT SEQUENCES AND USES THEREOF) - sequence listing, part 95

SEQ ID NO: 82528 - DNA, 31737 bp, Oryza sativa
agatgagtgcgacatggatgactctatacacttcatccctgctgaattcctcaagtcttgggtcaacaatcccgagtgcttgctccttttcatacaagctccaagcctgtaaattaacataggcaaatctttagtaactagaagataatatgaatgaatgaactaatatgatcttggattatattgaaagatcgttaaatcagcttacccactcaaagagatagatcttactttcctcaagagaattgtcggtgttcgaccgaccagcaacaatctctagtgctaccaccccgaatgcgaaaacatcaaccttttcagtcaaatgtcgtctcatcgcatactcaggagccagataaccacttgacaaaaggttagataagtttaagttagctttgtttgtaaggtacaaatataagagaaatggtgaaatgttcttacaatgtgcccgcaattcctgtactaacatgagtcttcttctcatcataaagcttggcgagtccaaagtcagagatctttggggtgaggtctgtgtcaagtaggacattgctagctttgatgtccctatgaacaatgcgcacgctcgactcctcatgaagataagttaggcctcttgcaattcctaaaatgatctcgaagcgtgttgcccagtccagttttatgctaccgtttcctgtaaaaaaataactttaaggctctgtgaactaaatgatggcaaaatgaagagatgagttctcccaaagagcatgtgaagaaaaatacaattttgtaggtgttggttttgagcaaaagtgaactcaccaaataatgctttatccaagcttccattcttaagatactcataaactaataaaggtgtgttactatcaatgcagcaaccatgcaattttacaagattccgatgttgcacagcagaaatagttgcaacctctgtcacaaactgacttttgccctgatgggatgattgggaaagttgttttacagctataactcttccatcaggtagcacaccctaccagaagaacattgctaaagttatatgtatatttcgaagcatagaccaacaagtttgcaataaagttaaatttaaaaacaaatcaattgaaattgcatagtactaaattagtggaaatagacaaccttatagactggaccatatccaccttccccaagaatgttttgagaactgaaattgtctgtagctaacttgagttcagcattactgaagacatcaggctgtccaactaggttgtataattctacatttatttttcagggcacaccagaaacaataaatcgtattaaaattttgatgtctgaattattgtattattaaaaactattaccttcttgctgttttgccattcttcttctcttctttatgaccataaatattccgaataagatagctgatcctaaaaccgaggcagcaatcacaatcccaacaattgcacctgctttacttttctttttgggtacaccgtttcgcacagtaggactaaaatctgaaagaggatttcatttattggaatccaatgcaatcatttttatgttaacttaattattacgcttacttggagtgatgcttaatgctgagatcaatggtccgtagtaaccttgaataggaatacaacaagtgccctttccagcccagaatagatggatttcaagaaagttttttgacacagttgttgtgtaactcttgtaaacagcagtgaaagattttccaccagccatctttcttatattgaagtccttttcttttagttcaccctgtagaaatgtcaataatacattgatataaataagaaaaagattcagtaaacaaattactatataatggactcaatttatacctggatatatatgtcaaaaaatctccttcctaagctttgccaagttggcgtgtctggaaaacctaactctgcaaatttaagcagaacggtgtaatttccattctcaagtccaaggccatagtatctcagagacgacggcgacatccttgcagtttggaatagttctgaatccactgcattctggatcttctcaccactatgtattatcttactgtcatttggggcctggaataattttcctacattactaacgccccatcttgtttgacttgtaacataatatgatgagtccccaaggtttgtggaatccaattcgtacatagtattatccgaaactctgatagatctattactaccacagtctaccgcaaaggaataatctgcagtcatgacgtgcaaaattataatagtattagaatttcaagacccaatatatcagctgctatggttgaggaaaagtgagacatatacattttggagaaccacgaaaacatggagtatcttcctggaggcagtttagccctggaggtagcatgctgtggagatagttgactcgaaattaaaagtggtgagagagaaattagtaaaaacttatgaatgtacaaataaatgccataagtacccaatgttggtgctgccaagaataaagttgtttgccaccaaattccttgtaaaaaataaaaggttgagtataacatattttttcccttggaaacacaaatttgagaactttcttcttacaattgcagattgttctgggtaacccaggagggaaagctaccagtgagctggttgtatgagaaatctctgcaaacatgaaataaatgcatcattctaattttagctgtattacagggatgaattgtttactcacaagttcgttagcgaagggcttatcccatctggcaattctcctgttaggctgttgttgccaagaaacctgagttggaaagaagacaagatgatgaaacgtggtcatcaattataacatgtgtttcagtagatagtaataacccccagaaagaattccttacaggaatataagcttttgtagattcagaattgatttaggaacattccctgagatattgttaaaactcaagtccctgcgccagaagacagcatacttgaacagacacttacatgaaatttaagaaaaattaccaaaagtttcatggactgtgctatgacccataatgaaaaacgtacaggaaagttaagtttgcgaacttcgaaaaatctactgctccaaggtctccagatatcttgcagttcctcagtacgctgtaaaaaaatatttggtattaacaacttatatctttgtcaatatataaaattgtaagatgtatagttagaatttaaaagtgtcacatacagggtatccagagatgtcagactgctgataaaggccaatgaagagctcccatttacaatatcaccaatccgcctgctcatttgtgtttagtacaccagttatcgtgacaagaggggatgacaatgttgccactgaacgaagtacttacaaggttgtcaatttggttagattagacaaacttgctgggatcggtccttcaaaagaattaccttggaaagccctgtgagttcataatttaagaaagacaaaagttgggagatttaaggtccattagaatataggaaaaagtaacatctacatatcaagacactgttgaggtatgcgcatttcttaaaagtgatgaccaaacagaaaaaaaaatgctacagtttgaattaaaatagatagaacatttgcagaaaatttctgttgcaattccacttgtcttgtggtaaggataaaatcaatgatgtgttaaaaagctaataataaatcttacagatcttccaaattagacaagctcccaataaaatcaggtattgttccagtaaaattgttatctgatgcccgcctacaagcataaaaacatgtttagtgttgagcatataaaaacaaaatgaacatgaccactgtggttctgtttcttgaacttacaggagttttaggttcttaagccttgagagcgtagaagggaatgggccactcaacccagcactatcagtatacctgttattaaaacaatgcagaaatcattgatgtttaactgtaagtatcttgctggtccaaattaaactttgttcttctagaagtagcatctttcaagttagaaagagggggattacaaacttacaattgtcgaagtttggtcaagttgcccaattcttcaggaagttgaccagaaaaattggtcaaactaatgcctctgaaacaaaatgaaatatttcaggagtgatataatttagaaacttacaaatatttaagtttgctcaagttgcccaattcttcagggagttcacccgtaaaattggtcagactaatgcctctgaaaaaaaaaaaagctcaagagtgatataatttccgtgcatgcaatgctactagttgagaaaagtagcattgtatgtgctgacgagccttttgatccacaatattcacattttggatttcacacaaatttataagacaccatttgaaaagtaaaattacactggtgcttaaattttatttgtgattttctagaaatttgtagaaagaacttatgcatctagatttttccatataatgaaatactttagaccattattaatctgtgcaagaagggaacacttacagcaaattgaggttcgtgagatttccaagttcctttggaagtgatcctgagagtggattgaatcccacgtgccttttttttattacaaaaggaagaaggatgattcaaacaaaacactaactaataaggacaatgcaggaaaacttaaagtacaactcttacaattctgtcaaggcagtcaattgcccaatgaatgatggtatggggcctgacaagtaattttgatccaggttcctgaaaagaacaagaaacatcaagtcaattagcagcgatgaatttcaaacatgaggttcactttgaattgatgtcttgctgcaagatattaagaatatgtagtatatatccaacagtagttcatcatcaaggcagagccgagaaaagctagataccatacaagtaagttaggtaggtgaggttctgcaattctgcaggtatctgaccgacaacgttcaatgcgtataccctcctgaataaataaacaaaaaaagaaaattattcacatgagaaaaatactccattcatcccaaaatatagcatctagatttcaaattttattctaatatagtagcaatttagtacttattttaccattgaactacccataataacccttggtttaattatcatcatgcccatgcctcatctccccaaggcaaatcaacaagtccttttacctgtctccttaatggctgtgataagagctaatttctagagaacttttacggtacaatatactaccagtatatactggcagtatataaaagggcatattaggaatttgatagaaaataaaacaacactttagtaatttttggtttaaattgaatctaattgagagtacccggtcctggatcttatcgtgcactaggggaggagcatcctgagcgccatttgatgacaaagcacgtgacgatagcacgatttgattatagaataaccaagaaaagacaaaattaccctttcaaactttatattgcaatctaattaaataaaaaattaaatcaatctacaccattagatcatatatactttttactatttagtccaatatatgagctaactcttgaccaggcacacatagacagccctggtcccccacagaaaaatgggaaaaatacacacacacatcccaacaatattgtttggtcacagaaaatctgcttgggagttgggtctaatttctactatggttgcgcaccatgcgtagaattacaaaattgacgattgattagtttgatctctccagggctgcctggacttactcaaccggatcccagccagatccaactataatggaaggcagatggcagctgtggaaggttaagaactaaagatcttgcaggaagctgaacctcagattccagtacttggaccagtgaccaaagagcagtattaacaaaaaccgatcggtttttttaaactgcccgtggtcagtcatttgtggaagccaaacggttttagctggttttcgtatggcgttgaccaaaagtcatccgtttttgccgggtttcagcttgtgatgatcggttttcaatttaaaataaaatggtaaaccctgccaaagagatcagatttttctggccatgaggcggggtggggtgttgaaataacctggtttcccgattggaggagtaaaaataaaatacaagtcatcatgctttactcctaaatgaaattcggacccacaacagaatttcgggggacataaatgaggctcctctattcctaagtagtgaaactgaaacctgtggtcctatgcatatgctcaatggtgtggtcttgcaaaagttgcaatttcttttctttttctttttttttgcgaggatcaaaagttgcaatttcaagttaagtttccattagaacttatatatccagacgccaatggcctcctgttcccgtaggcactgcgtcgagcacctggtgtgcgtgcagatgaacagagccaaggaagcaggatgggagcgtatacgtacagctgggtaatatggcagacggtgccgctgttgtaggaacagtcgcacttgatgccggggttgttcttggggttgccgtcgaggtcggtgctgccgtcgacggggacgccgcggcatggctcgccgctcatcctccacagcggcgacgtcgtcttgccccatctccccaggatcgcctccagcgccgccactgcaccgaatgtatagtaccagagtaataataagtacaataattaagcttcgcattgcattgatatcaagactaattacgtgtatatatatatatatagcagcatgatttgattacgtgctttgattataccttcgattggatcagttgttgccgcttgctgggcatgaacagcggcgatcagccatgaggagcacatcacgagcaacacccacaccagcttaccactaacaccacccatctctctctctctttctgctgccgaaacaacacggaagcttgttaaatatatagatggtgtgtttgtacgatgcaactatatgcaaagggaggctctgtattttagggcgctcatacgtactctctacgtctcataaaacaccaatctaaaataggacgagacataatttagtacaacgaatttggatactctctctgtctgaaaataattacagccctatagttcaacacttattttggaacgtagtgagtaaaaatatgtccaaattcgttgaattagattatgtatcatctcattataagttggattttttggacggagtgagtagatgagataatccaaatagttcttatcatcactaccttattactaggaaaaatgtctatatttgacgctctttcggattcgtagtactcaaattgtctaattagctattaggtttgctatattttagaatggatatagtatttgtcatcacttcttaataagaattttattaagcagatgaaaatatttgactataacaatgtgagtatctaagcatcaaaacattgtaaactacaaggtcacaaatatgcgcaaaagcctgcttacggtttatatttatagtgtgaaattgaatatgatttgtgaaaaaaaatgaaactttcttatcattatattttataacagtgtttattatcctataactaaaagaaaatcaacggtagaaaatatgaacaggcctataaaaattagccatggagcatctctagcaaactaccaatagtcactactatatagtcacgttgttataatccataggtatctgtttcggtgccaacagctattattcaacaccaataacttggatcattggacatatgtgacaatataggtgctaggggtgcaccccttatattagtgctaaaaacccgaaaaaaataatatttttattagggacctatatggtcatatttaacttctcacgagtcacatgactttttcaacccatattcatgggcatgcttcaagcaatatttgaactcaacccacctctctccttctaagcctccttatcatctaacctacaaacgcttataatctataattaacaccatagataagtcttgttgagatctacaaatttgatataaaatttatgttcatccgattttatatgaaaaagttagataaaaaacacacatatacgagttgtgtcatcgtgccagttttaaacgtaaactagcacctatgggcttataagtgccctttttttaattaagaattggcacatgtgtgatgcctatatatatgtcggtttatgataaataaaaacctatacctataacattgcacttatagatgctaatttattataagaactcgcacctataacttgggggaatattggtgtcggtttttattacaaactggtataaatgagtggttataggtaaaagatggaaaaagcttcataggtgatatggttttaggcaaaccgataagacaggtctctatgtgatgttttgtagtggtgaatgctatcctataagttgttcacggggaacaaatagttttttttaatgaactatttctttggtctgaaaataaatttatctttgcttttcttgtttgtcctaagtaagttcattttgagctatcattgcattggactttgtaaaagaagtggacaaatacattgtaatagataaagtgggaacaattacattaggattcggtaagttggaggatgttattttgctttattattggtatgtgtggatgtgtgaaaaatgagcttattatggaaggaaggtagtatttagtttcgaatgggggcactactttaaatgactacgaagaaataatctgtcttagtgttttctttatttctttttttttcccatgcatgacagttgacgtggggtgggtggacagcgatcaagtcccttataaacgaaagaacaataattcatactctctgtcaaaaggacttgatttctagccatccaaaatttagtaataagaagtaaagagcaatgagtttctcgttaacactatagtagtattgctaggtgggtatataggcaaggtgtattaaagggataagagtcctttgaaactcttcgttttgtgaaaaaatggtaggcaagagactagaaatcatctcgacacattagaaatcaactccttttgagatacttttaaatatctttagtctagattactgttaccaaccagtactaaaaattaaattttagtttggattagtcttactaaccagagctaaagatcatcaagcattagtatcggctggtgttaccaaccgatactaaagatgtactcttagtaccggttggtaacaccaaccgagactaaaaatatttccaaagacacttttagaactagtactaatctaactaagatattggtggttttgtgtaccacgacgaaagattagttctccaatagtgtcggaaaatcaaaaaagaggcaacgtgacctttggacatgacctgatccaaagaatcaattgaaaatatatactagtacgatggtgccacatgcatgtgccggaaatatgaataagcacttgtcattaaaatacgttgacaccaattactttgtgaaaagactacatttatttttgaagaaattaatggaatccatttagtaccaaattgcccaattggcatgactgccaccgcacctactggcactgctatcatactatagcttagctactgcattcctgcaactgatcagaggagttaaactactgttaactaatcagttccctgttgtcacgaaggtataccctccctcgcatccgatccatgcattgtgtccatatatactagtaaaatatttaccaatacttctgtagtacaaccgatgatatttaattgggtaaacattaaagtaaaacctagggctaatcaaacataatatgtatacggcatgtctgcatgaaagacaggggttttctctgtcctcaattactgatcccgcatgattttttttcccgggtcagcagaaggaaaaagatggaccaaatttcattaagatttatagaagctttttacatgagtatggtcctataacattaatctgccgagttgagagtggctcaacactctcaaaacatgtaaacgaaagacaagaaaaacaaaggtaaaggtactcctctcaggattgaaaaatttcgacggacttccaaatagagatttcttcgttcgcatcactgaccagctgctccggccttttgaacctgtgttcaaacactcttctgtttcgctcttttcagaggagccaacacaccatcaagaagagtgaatcgaacgccatcttgtagcttgtccgaaaatggcgacgctcctgctgccaccaatctgcgagcagccagtcgccatggcccggagacggaagtccaccctaatccagtcccgaagcaaagaccaaaccctatattggtgtaggcacattggtgaactgcaggttgttgcagtcctcgaagatggcgttacagagggcgcaaagctgtttcgtgtggccacttaaattcagatttttacaataccattttaaattttgaagtataaaccggtccctgtaggttttccaaaaactagcaaaaagttgatatatgatttttgatcagttctgtataaaagccaggtaaaactgctcggattcagaaaccggtgtccaacgttttcatgaaaaccaataaaatttcatatagttttcgatcagcattgcaaaccttgcataatttcatctctactcgggacatccatgtgtccaggccggtaatctatctagctaggtcaggggccgggaggagctcgtctacgcccgtcattttcccaactactccctccatccaaataaacaaacttatgattagacgtgactaatataataaatatggatagattcttagctatccagattcatggtaataggatatgtcagtcacattaattttagagcaattctacggtccttgagtaggtaccatgaggtaccaaaattttagtgtaaaatttggtaccacctcatagtacctaggtaccacgaggtaccaaatttacaatagaaaaaatggtacctcatggtatctcctcaaggtccgtaaaattgatcttaattttaggttatttttttaagatgaatggagtatgttaaacataaaggtaattagcatgttaccatcatgggggcactgcacgctggtactacgacacttgagctagctagtactcccatcgacgacctgagggttgacgcgaggtgtgcatgcatgtgtcatgctatcaaattaattaacaaagcgacactacatacggcgtacggctatgtttggccgcgtaacgggagtggttagttgcaggggagaggctctctctggctgtgttttgcatagcataactatactttctttatgattgataaacactaacaaatattagaagctaatggctaacatgtaaatcgatcagctttacatatcatcattcattaataattagtccgtactattttagagcattttaaatcttatgcaatatacgtagagcttaatatataagtatgtcaaatcatttttctcacatcattttcacaatgtttcaaattttatcatttctataatatttaacatatattcatccataaatttcgcagcaaattaccacggggtgtcacgtagtaaatatatagatattactctgcccgtgctttttcacctgtcaaaatgcacatatttttatcgatagctactaatattttgcacaaatatatttcttattatatatttgtaaaaatgtattggaaatattaattatatgagtgcattttcataaaaaatgtactgatattattttaacgtatcaaatcttaatttatcttttaatttatgtctgatttaggattttttttatttcttgatcgtactcatctactctaaagattgtatctatttgtcgacgcaatgagtatgtatgaatattatttatacatattggtcgttggttcatatatatattaaaattttatcagaatttatacacagcattaaaagtttatcagaaattacgtgtaaaggtcgtatttggtactcgaaattactgtgcaaggaaaaatgtactttctttttagataataaggcaaaatgtacttttaatcatcctgtataaaaaccagataaaccactcggttttcgtaaaccagtctccagctctttcatatagctttcatgtattaaaaccaattgattttcatatagttttcagatctcctttcagttggcagttcatgatcacgtacacaacgatccattttgaaattaattagtaccaccaagtggcaggccagttgttaattaagcttgagtactatctctattccaaattaattgtttatttacgttaattcaaactttatgttgaaataattgatcataaagaagtattacttgtcccatcaatcacttataattcaaaatttcacttctctgtgtacactcagccatcattccacattgaactatacatcacataataaaaggtactataatcttttttctaaaaccttagcctatgccaaataacccagaacgataattaatatgggactgagagagtaacatatgtagcagaaaccaatagctccccagcgatcgatgtagaatgtaatatatacgtacgtgtactgcggccactctgttgaaatggaatggttttgctaggctgctagctagtactctctctgtttataaataatgcatgatgcattgtacttttagatattggtgttttatttacattttagtacagctattaaaaatattagtcaaggttaaaatatctttaataataaaacaaatccaaacaaaataaatactacgcaaatagtttttaaataaaacaaatgctcgaatgtaaaagtcaataacaatgtactaactccttttcaaaatgtataacacggttgattttcctaataacatttgatcattcgtcttattaaaaatttaatataaatatgtaaaagtataagttaaaattatattttatttgatgttttagtgacaaaaataatatttatataataatcaaacattacgtgaagagttaaccgcgtcatatattttaaaatagtgggtgtgcattttgaaattgagatagtgcatgtaagcatgaccgggcgggcgggccctgtacactgggacgatgacttgacctagttgaatcagatggacgacttgacccatagttgtagaatgcacacgtgtaacaaagtagtgctctcttcgttttaaaatataacaacttttagcctttaaaattatatctcaaaatataacaacttttttgtcaacattttcttcctaatgaatcacaactctccattatttgattttctcacctactttcacttcttatccaatcatatattttttctctatttaattctatctattttcttaataaacgtatcacacactaaaaatccttatattctgaggcaaaagtagtatcatattattgtttattaggtatacggctatatatgtttggccgcgtaatcggactggccgttggaaggaggctctctgtattttgcctagggatgatatatctgagaggaccgtaaaattgctccacatctgggcttgatggattactctatcccttctttcttcgcttgtcagtaacttactaccggttcttagcagcaaaattcaaatctaactatagatttatatttttataagtaatcaaaacattcgattcaaaacttttgctaatatagcttaacatagatttaatttgtcaaacctatatagatttgtctctttgtttgcttgatgtcgcatcgtgtacgtatagatcctcgtatcaacgtactctaatacccatactttccggtctacgagtatccctcgtcgacagacagcattgacgccaatatgccactagctagccatgaccactgaattataatactagcacgtatatagccggccgattgttaagctcgacctagctagcatgcagaagctgcatccacaacatagctacctcgtactaccatgagacacaaacaagttggccatgtgcacgcgtactgcagctagcgacactctttgttgaaatggaagggttgctaggcttcatgtaagcatcgtgagcagtgagcaaacgcttggtcaatcaatgacgacgacgacatgagctactagttgaattaagccgatcgacgacttgaccccaggccggccagatgcatgcatttactgtcatactttgagaagagctgtaatcgcagcaataagtactgaaaggatggattaattagtttacagccccattggctgatatgaggaaaatgcgaaatagcatatttacagatgaaaaataatttatgaataaaacttttatatatgtgttcttaacgatctaaaagcaaaggctaaaaaataaactacgatgaaaaaaaatctcaaaatcaactctaaatttaagattgaaaatttaaattttgactgataagtataagcataagtgaaaagatgaggccgttagtcagttgagcagatatgcatatatttcaaaggaaacttcttcaagccgacgaacatggaggaagtatttaatgagaaattaggggaaatggattctactctttcgatgggatatgttcccttgcaatgatggagccaagatatattatcactttcagcttagggcttgatgatgtattcttaacaaattattttatctcttaagagttaacattttgatagattttaataggtgttaacaccaaaatttggacaacagggatgttgggtctaagagtagggcttaattaaatcctagctgcccccacacttgtctacacccctattgtctcatgtaacctgacaatgtagagtatagcgatatctagtattaattccaacaaaatcaatttcaaattcaacctacgcatttgacaaaaaaaaagacaaataccaatgaatagtaccactactatttatatgggaatttgttttttatatcataatttgtgagttgagttttctatatcatatatatatatatatgtgtgtgtgtgtgtctatatatatatatatatatattatgtaatttttaccggggttgtctaaaaaatcttaaggacaattctctcaaggaacccctaggaaacgggagtaatactacttaagagaaatcgtaaatttttcatgaaattagatatgacaaatggacctaaatattcaatacaagctctcaaatcttttgttttagaaaaacaaaattttgagtttttgaacgacctcggatggagacatgctttgtatcaaaattatagagctcgatgggtctataactttgtagttaaaatttcttttatttgagatcgttgatgccaaaatattcataacggtctctcgtatctatatgtttttgaagatattcagtaggaagtccaaactttgaaacataattttaaatccttatagtatctcctttaatgacttttggccaacattttcttagtatatttcctataattgcatgtctcacaaaatgcttcatatcacccatctaacgtgagccctatatccccaacgcttcacctaggaaggtcccaccgaacccttctctctcatctttacttgctcactagacaccaccaacccattcatttctccacaacagctccaatcttatctcatctctccctctctctctctctctctcccccttatctctctccactatctcatcacgagcagtgatgaggctctcgtcctcgacaacggtggcctcttactctcatcctcgatggcggcctctcacgctcgtcctcgacgacagcctcctcagcttactcaaaggtggctcggtcggcctcggcttcctcaacggcgatgcggcacaacatcagtagccacccgtcctcaatggcaacgggacgagcttggccttggcttctttaatggcccacgcagagcacaacacaactgcagtgaactagtgccaagtctagcgatgcccggtcaccgcagaggaggaagtagttgagactatttttttcccattttttcaatatttaagccaatatgttttaagtgttcctttgtattggatcaaaatgttgcagtgagtttttgtgttgtttcatattcttttccttttatgggtgagatctgtggatgtttcaataattgaaacttgatgtttcaaatgctacactaaaatgttccacgatgtgatccgattgtgtttcaccattttaatttattaaaatatatatgttttgtttgagagctgaaacattttcattcaagcaataaaacatttttcccgattgataaaacatctaaaacattttcaatgaataaacatttttcaacaatacaatgcaacaccgatgttttacaaaatatcaaatgtccgatttgtagcaatcccccatgtgtcgtgctatcaaattagcaaccaccgttacatgatggtggtaacatatgactttgtttggccgccgcgtaactggaattaattattgcaccttggaaaattcttatatatattagctatgtttcaccatggatacacatgcatccgggcgtgttgatcagttactccgtttgtgctttttttcagtgtcaatgcacatatatgtagtatcgatttgttctaataatatgtttgtaaaaaatatatatattggaaatatagttatacatagcttgtaaaaatttgattctgccatccgttaggatttatcaacattctttggaaactattctggaacatgtaacttttaccacatatgtttactccggcaaaattggatttctcacacactatttggaaagatcgataaagggttaactaattaatatttatatcaactagcttaatgcccgtgcattgcaacgggaattaaaaagggaaccaactgtacattgtaaagcctaaaaaattaaaaaaaaaatatttgcatcgtaaaataaattttcattgtttgatggcttagggttgtgagactgtttgagggacccacatggtagtggactagtggtggtgggtggtggcagattcaccaccatcaccattggaatattttaaaagagtatggagtatagatactccacatcttgaattttgaagtactacacaactttcttcagaagcagtgatccctcttttgccatagactgaagatctttgctgcaagaaagccattgcccctcgtaggactgaggtccatacaaccttataactgtcacttgattcatttgccattcattttaattaatttatgcaatgccaagcatctgtgattacggaagtgtgctctagccaacaaattcgtcagtcatttctcaaaaaaaaaatcaaaactaatttaactaaatgaattttaaagcacccatgcaaatacaactggcatatacaaattaccaggatgacttggttatgagtatggaaaatattcagaacaaaataaatccatatatttgttgcaactccacaatgtccaaaaatatcacttgaagctaaaaccagaagcgatttgaacatatttgcattcaccttccatcatatgtgactccggttatcgttggagaaggggtgagtggggaagtctccctctgctctctaaattcaccagtagtagatccagagctatagttgctgcttatatagctggtgttccctcctctgagttgccactcagtgatgtagctcggcttcgtcaccatctcagtcatctcaatgtctccagtaagaattgccaggaccctagacattggtggtcgctggtgtggtgacccttgagtgcacaaaagtgcggcatagatgactctgaaggcttcctcactgtcaaactcatcgagttttgggtctacgattttgattccttgctctctttcatatagcccccaagcctagtataaattatcatacggacaacgtgttgattgtgagaaatagaatcagccaatgtattttcttggatgcaaagaccattgatcaacttacccattcaaagagatagatcttgtcattatcaagggaattgtcggtgtttgatcggccagcaactgtttctagagcaacaactccaaatgcgaaaacatcagccttttcagtcagatggcctctcattgcatactcgggtgccagatagccgcttcaaaaggtcagacgagataaaattagcttagacttcaaaggtaaactcataagaaaagaaagggtgaaatgtgcatacaatgtgccagcgattttcgtgctgatatgggtctccttttcatcatagagcttggcaagtccaaaatcggagatttgggggctcagatcagtgtcaagcaagacgttgctagctttgatatccctatgcacaatccgaatgctggactcctcatgaagataagttatgcctcttgcaatacctaaaatgatctcgaagcgtgttggccaatctaggttcaagctaccatgtcctgaacatggagaaataaggccttgagaattgagatgatggtataatgcagagaagaaaagttcttgacagtacatgaaaggaagaaggtcgcacaactgaacttaccaaagagtgcttggtctaggcttccgttttcgaggtactcataaaccaacaagggtgtgctgctgtcaatgcaacagccatacaatttcacaaggttcttgtgctgcacggctgaaattgttgcaacttctgtcacgaattcacttttcccctgatgagatgattgagaaagttgtttgacagctataattcttccatcaggtagcttaccctgtcaaagaaagatccctgagttacatacatattttgattttacaccagttgagttgcaaaacaattttagttagtacacaataaggtaaatcctcatagattgattgacgacttgtgggaaccactaaccttatatactggcccatatccgccttctccaatcacgttttgagaactgaaattgtctgtagctaatttcagttctgcgctactgaagatattaggccttccaaccaggttgtatagttctgcattttttttcacaacacatgagaaagaataactcatttgaaaattttggcacctaaagagctgcacttaaatgataccttcttgctgccttgccgcttttcttctcttctttaccaaaacaaagatcccaagtaaggctgctgatcctataactgacgcaccaatcactatcccagcaattacaccagctttacttttcttttttggaactccatttctcacagtaggagtaaaatctggacaacgtgtttcagtaatcagaaaaaaaaaactatcatacattcttcaagttaactaattcgggtactgagcttacttggagtgatacttagtgcagagatcatgggtccatagtaaccttgagtaggaatgcaacaagtgcctttgccagcccagaacagatgtatctcaaggaagttttttgacacagttgcgttgtatcttttgttaactgcaataaaagattttccgccagctgttttccttacatcgaagttcttttctttcagatcaccctatgcagatgccaagttggacaaacaaatatgttaataaagggtacaaaataggtaattgaattattgtactatgcgctcaatatgtacctggacatatatgtcaaaaactctccttccgatgctttgccaagtctttgtgtctggataagcaaactctgcaaattgaagaagaacagtgtaatttccattctcaagccctaggccatagtatctcagggacgatggtgacattctggcagtctggaacaattctgaatccaacgcattttgaaattgttgcgagctgtacattaggtaacttccatttggggcctcattgaattttcctacattgctgataccccatcgtgtttgccccgtaacatagtatgatgcagctccgagacttgtagcatcagcttcgtacacagtattatccaaacctctcacagatctattactaccagagtctactgcaaaggaatagtctgcatgcagttaagatgaacaaaattataaccttttattgaaaatcctgagatattttcttaaatgctaaaatcgatgaagagtgcaaaaatatacattccggagaaccgaggaaacaaggagtgtcttgctgtaggcagtttagtcctgaaggtagaatactgtgcgcataacagaaacaagaaataaaaattatgaggaaggtgacgtcaaaaataaatatttgcaaatatgttataggtacctatcgttgttgcttcgaatattaaatttgtttgccaccaaattccttgtacaaaaaaatacgtctaacttgtcaggcaataatttcacataatgtagagagtgtctaaatcaatatatatttgtctgaaatttcagaactttcaacttacagttgtaaattattattggtagcccatgaaggaaagtttcccatgagttggttgtacgaaaaatctctgcaaaaagcctaggattacgaacgtatgaaatgaatatatcattgcaatgctgaaaatcattttagcatacaaattatttagtgaggagctcttcacatctggcaggcttcctgtaaggctattgttcccaagaaacctgaattgagtttccattcaagacgatgaggcatggacattagcttaagatgtatttctataacagaaataatcgccataaaagaattccttacaaatatcgaaggctgttcagattaaggatggactgaggaacttcgcccgtgatattgttaaaactcaagtccctgtgccatatgtttagcaatattacttgagtaaacacttcacatgaaactatgagaaacaataactaataacataaatagtcagtatgccataaagacaaaacctacagcaagtttaatcgagaaagcttagtaaaatttactgctccaagattatcggatatcttgcagttcctcaatattctgaaacaaagaatatgttgtctcagaaaatactactccaatagtactttgcaataaaaaaaacaataatatctatcgttagaacttaaaagcaggacacatacaggacatttaaggacgtcaggttgctaataaaggccaatgaagagctcccatttacaatatcaccaatccgtctgcatatgtgtatttggcactattaagacaagtttggccttcccaacagtcaagggacaaatgtggccaaagaacagaatacttacaagcttgtcaacttggttaacttagaaaaacttgctgggatcggaccttgaaaagaatttccttgcaacctcctacaagttcatgctttaagaaattaggaagatgtaaagtccaccttaagatatacattttaacatcttgcatgaatagataaagaaaatgtaaatttattcataacgtagcatttatgtcgaagttgaggactaaaaaatgaataacgttgttctcttaattcaaatgaaaagaatacatacagaaaagttatgttgcaagatttctattcatctccttgataggatataataaatgattatgttaagaggttgacaaaaatcttacaaatcctccaagttagtcaagctcccaataaaatcaggtattttccctgtgaaatcattatctgatatccacctgcaagcacaacaacatatatagcattgagtgtatgaagacacaataaacataataactgtggctcagttcttgaatgtacaggatcttcagcttcttaagttttgaaattgtcgaagggaatggaccagagaagccagaactatcaatatacctgttattgaaacatagtaattagcatgttcaacaatatagatcttgcttgtcagttctttctgaagtagtgttctactggttaattaaaggggggaggggggagatttacatttgctcgagtttggtcaagttgcccaattcttcaggaaggtttccagtaaaattgttcaggctgatacctctgaaacaaaaggaaatagttgagtaacataacttatttgtctgcaacagtgttgatccataatatccaccacttttgagacttcgttgtttgggtttcagtatattaaacacactaggaaaggaaaatgaaattgaaatgattaagtaacatgagaaatcgtggaagggatatcttacaatgagatgagatttgtgaggttcccaagttcctttggaagtggtccagataatggattgattgctaagctcctttttaaaataaaacaagaaagaaagaaagaaagatgattaagagaaagcaccagcagatattggatggtacaaaaatatataacttggaatttaactcttacaagtactgcatgggaaatttgccaaagaatgatggcacaggaccagtcaagtaattttgcatcaggtttctgaaacaacataagaatcgccaagcaagttagacagagtacaaaaaggaattgtatacctgatttctgatatctatttatccgtgttttgtctggcaagtgacaattgaatgttcaaagaatgggactgaattagtatttactgcagaaacatcgttcaacagattgtgttcgatcatcaaatgttaagacagacatgtgttccgtcatcaagacagaggcataaagagttaggcaccatacaagttagctagatgggtgagtttctccagctctgcaggtatctgaccgacaacattcagcgcgtacaccctcctgcataaacatcatcagtaaaattcctctgatgacaagtaaaaaaaaaaactatatatgctttgctaaatgaattaggtgatagttatccaaattcaattcatcgtcacttgatcccagagcattcctgcaaccaccagcatcctaattttggaggatcgcatggcctctctctttcagtcaggcaatgcgtcgaacaccttgcctgcagctgagacaagaggtttgagttcaggggaggatacgtacagcttgacgatgcggcagacggtgttgttgttgaatgtgcagtcgcacttgatgccggggttgacgatggggttgttgtcgatgtcggtgtcgtcgacggcggtgccggtgcaggggtcgccgccggtgatgttccacgttttgggcggcttcgttccccatcgccccagaatcgtgttcagcgccgccactgcgttgacatttgcacacgaatccaatcaatttttttaccttttattctctccgttttatattataagtcgttttgatttttttacaactttaactaaatttataaaaaaaacatattagtttttttaaaaaaaaaacttattatcgaaatatattcgatcttagatttaatgaaactaatttattatttttaatgtttctattttttctgtaaatttgatcaaacaagtttatctacgaaaaaggtcaatttttaatgtttctatttttttctgtaaatttgaccaaacaagtttgtgtagaaaaaaagtaaaaagactttaatttgaaaggaaggaagtatgtgtgaagagaaaactagcaaaaaaacagaggcgagaaaacaacgtcagaaagagagaaaaaattgactttttaacggtcaccaaccacaccaaacagaactcctctcctccattagtcaacaaaacagaaacagcaggaagaagcaaagatttggatggtgtatcaaacttgaacttgatcactgaacttggaaaacagaagatgtctgatgctgttcatcgccgtaatgatgaaattcttgctctgaactttttcttttactgttcatcacaaaaacgtgggtgttctgacctttggtcttctcttcaatttaaaaaaaaaaaacagtaaacggccaagaaaggaacgaattaataatatccgaggaatccgaggattaactctcactgctaactgctaatttgtctctaagctgttgcaatttgcaagttgcgtcaattatatccatgctaaatgctacacatcaactcatcaaacatgtagtaagtttcatgtctctctaaagtcgcaaggaaaaggaaagaagatccaggcccatctctgaacctccaagaattagagacccctaaatattacagtttcaactgtaatctgttgcaagttgcatcaactgtacccatggtagatgctactacaaacaaggaagcatcatcaagcatgtagtagtcataactcataagccatgtctctctgaactccgaagtctcaaagaaaatggaaagaagagaggaacatgcttgtgtgcaaccatgaaaatctatgtcttttctccaagaacatctctccagcagaaaagaacagcggtgtctctgtaatctgtgaatgcatgtaattaactgataaatacatatatacataccttcgactggatcagttgttgctcctgccggcttctgagcctgagctcgagctactgcaacccatgagcacgcgatcaccagccagcacaggatgagctgatgaccaccatggccgccgctgctgctgctgctgcagcgtatcctcatcatctctttgcctctctgtgtctctgtgtcacgttatctcgctctgatcactctgtctgcctgtctgtctgtctgtctctctgctgcctaaaaatcgattcttgtgacaggtatatatgtacaaattaatgtacttttatcagcgtgtgtttctgggtttaatttagtgatcgatcacatccaccatcatcatatacatatcgatcgggaaggacgacgacggggtcgtccgatattttttttccaagaggcgaccttctgtggttatatcaatcggctacttgcaacccatcgttgtggctagtactgttgcactggactctaaaatgtacaccccggaagaatgacgaggtcatcgtccaatctctctcaaggacttgtgcatggctgggtgggtgccaatctcggtcctaaggctcagccactcaaccttgctgggacacagggccgtcccgtgaaattccggggccctgtacatatactctctccgtttcacaatgtaagtcattctagtatttcccacattcatattgatgttaatgaatctagatagatatgaatgtgggaaatgctagaatgtcttacattatgaaacgggggaagtagtggataaaccaaataacgtacacattaagggcttattcgtttctaagaaaaaccaaaggatttccaaaacagaggatttgaatcctgtatacagcattcggtttacaggattgagctataggaaatttgaagggaaatttccttttgtgccagctgtatcggtaaaacacaggaatttttgcatccagtatgacctcttgaaaattttcctggcgcgaaaagagcgcgccacgagcgcactgcgcgcgtaatcttttcgctctcacgacaaaaaaggtaggtaccgctgaaaggaaaataaaaaaaatcacaggaggcaaacagactcgcatagaagccatcgcctttgatcccatctcctctaccacttcctctcctgtctccacgattgggtactggacctcctctcccacatcgatcgccggcaccggatgcaccttcgccgcctaggtgacaggacgcaacggcaacaacgggaagagccacggcagagatcggcaaggacgcgttgattgcaggtttggtgcctcctcttccgttgttatgcatagatctgatgccccatgctgcttctttgcatacaccttagcatttgggtcgctgcggatggggtcgtagctgtaacacacaagggttcatagtgtctgcccaatggcaatcttgtttggttcagagaagttgttgccggcgggcggcggcgatgagcagcaacaagtagtaggcgagctagccctgttcatagtgtctaccgtacgttctgccgtacctatcggctgccgctgccatctgtttgtctacccctctgtcggctgctctcatcctttgctgtggtgtactgtggtctgctccttgattcgtcctgtgcttcagcgattgaccgctctctcatgatgagtattgaattttagggcttattcgttttaaaggattttttcattcataggattaggaaaaatgaaggaatagagatggttgtggagttcaatcctatgggaagctaaacctcaggaattgaaaaaaaaatgtgcattcggatacaccacaggagaagtgtaggaaatctgccatttgaaatatatttttttaagtttgcatcaactgacatcggccctcaactagctgttagctttgaagtgcataaatagccctcgttagccttgtgcaccattctcccctgttctttctatttgctcatcaactgtggaagaagcttgctgatcctttgttcttctcttcactatctgcataatttttccagaagctttactcatcgtctagccaccatagctagacgttacttgctcgtgtaacaacaaggtactacttgttcatctggtgcaccaaaattgttttttcctcagcaaaagtcttgatttttagctctcttctatgtgagtttacagcatcagtttggtagcatctgcacaccatgaatccaagctaccgacgtatatcagaaagtgatgatgagttcattcattttgttctgcctactttaggagattcatcacaatcatcttgtattaggagaccaatgcacacgtcaaaacttacagggggttgccgtgtacatgagattttaacaggacatgaaagattatgcaaaagaaacttccgtatggaggtcgacatttttcatgcactagtcaataagttacgtgagaaagagtacctaactgacacaatatatgtttcagtagaagagcagattgctatattcttatatacagtggcaaaaaatgcaaccaatgaaacacttcaagattggtttcagcatagtccagatacaatacatagatatttcaaagcagtgctggaagcagtcacaaatctcacatctgtctacattcgtgcaccatccctacacccacatccaataggggggcccctggaaaatgggaaccctattcggtcgctccggccgcgcgcccttagggacggccctgctgggacacttgagtggagggtggtggcgagggccaatgcctggctagtttcgtgatgcaaaccatacaacaaccgtgtgacaatcgcgatgaaaaagatagcatcccgataataatgagaatccgtacgcactacaacaaaaaaacatactggggagacgttttatgaatattgtaaaaaacattattttaatattgcattctagctaacaatgcttcataatgagttgtcatagttaatgatgagatattttataaaatgtctttacgcagcattttttttccacatgcatttttattcttataagattataattgtcggcaatgcactaaccatctcaacctaatctcatgacttgtttatctatgtgtcatgttgcttatatctccctatctagtataaattaacctcctaaaaatccctctctatatatatatatttaaaatatacctcgatgcctttgcatatgattgcataaaaatgcctcaatttagcaaatatatatataatgtgttaaagttgtctcctagaataaacaatatcataggtagaataccttaaaaatgtctctatctctgtatgaaaatcccaaatttagaggctctcctttgaaatttgccattagagaggtatatctaatcacttctttctatgaagctaatgcccactaagcacgtaaacctcagcatgtaagcatagtatttgtttgccctcctaaaatctacatgcaagcatgtcacatcaacctattaaacatgcaagcatatagtaattatatttataatttatttcattctaaaactaaacatgcacatgcaaaatcatcattctcaaatcattttcataatattacaatccaaatcattttatcatttctccattatctaatacatatatctgcaacaaagcgcggagcattatatagtgtttgtaatgacaaaggcaagtgcacatcacaaacagcggcaagtgtgcatgtgccttttttactcgtgctagtgcaaaatcttagactggatcggaaccagtgtgcagcttccaccataataaacctagccatgtcacctccaaccagtgaatttggaccaatctgaccccttgctttgtttctagaggctagatgtagccatatcacgtcttttcaattacacatttacagcagaaataattctatctactttttttagtccgtccattcagatcaattgtctcggaagagcatcatggagtaaaaaataattatctttaaacttttttaagtgagttgttaaaataattaacggtatcgagacctttatcgaactcattcatcctaataatcgacagaacaagaagcttctatcggtgcaatgtttttgttttgtttgttcttatctaattgttgtcagaaaagtttgaaggtaacatgttctctactatactagataacgttttttatagactctacattatggctgtgttcttaagtccaagttctcaacctcactctctcatttactgtgcgctcacttttcaaactgctaaacggtgcgtgttttgcaaaagttttctatagaaaagttgctttcaaaaatcatattaatccatttttaaagtttttaagctaatatataattaattaattacacattaatccattgctccgttttccctcacctaagaacacaacctatatttcttttgactagaaaaaatacccgtgcgttgcaacgggtgaagtttattttaatcttattattattatatggtttagttaagatgaaattcactgtaggagttctcttggatatatatatttttagaaaatcatgagctgcagttaggagagtccgatcgtctcaagttagcatgcgagttttttttaaaaaacagatttcttatatgattctttctgtattatcaaaagtgaacgatcttaaaaaccgaatcaaatacgaatatgtattttcaaaagcaaatgaacttaaaaaccgactcatacatggatgaagtaccaaaataccggcaaaaacatcttcaatttttataatagtggagaaagaaagtaggctagtagtaaccaggagagaagggattggatttaatctaatccatcgaattaaagggatggcttggattaagtaaatccacctggtggatttgaaggcaactccagggatccacaccccaaactatatgtttatcctcagctacgcaatattaattttaacatgatagtagcaattaagctaggaaggtttcatatgaactaagtgacgttagtagaaattaaattattagttgacatgacgttgtcaatctatcccattggatatgcacatgatggaaatgttaagcatttcaattttcccaggattaattgatgatatcaagtactttttgactcgatcggcctcgattcccattggatgcatgatggaaatgttaagtatactctccctctacactttttgactcggcctcgattcgagaatagtactggcacaatttttactacacttatagactttatatatctttttaatcgtatatttataaagattagtaaaagtatatatagggtccttattattcgtgaaaaacctattaatattgtttgtatataatgaatcttaactttttttatttcaagattttcatatttgaccatacatatctaaatgtgaactctcgttgtatgacttgtgcctatatgaacgacaaaaagatctctagctgaaggaacaagcagtgctaccaacagttgactataggctcattaggttcatagggtttttttcagtgaaatatctatgttgtgtttcctgaaatctcatgaccctaggaagattattgaatgctagctaaattatggagtaccatgttaattactatatgagtcaataattagataattagtacgtgtattggtcattcttgttctagtttgaccattgggcttttgaatggattttcgtaggattggtaatttctttgggtttttaactgtttatgtactcggttcacatgactcgcacgcaggaattttagaaaaatgccgtagcaaccatgtgaaaattatatgtccgcaatctataaatatgtacaactccaactttactctataaatatgtagcaacctactttggtgaaccaatctaaataattaaatttgagattactttttttccaagtggacaactaatgctgtggtttctactttctagtaccaattgggctacaacatctatgtaactaccacatagatcaacggataagtgttgagaaatcttgatagctagcggcccttaaaaaataaaaaaaagatttaattgaaagtctctaggtttctcaaacattattttatttatttatttattttctcaaacattaattactcgagacaatgtactctactgaaagagggcgactgatttggattatatgggatatatttggatgttgtactattgaagttaaccctgaaaaggacggaagtaccttgctaatagttgtcggtattattttaatttggctctagtttactcaaaatatagtactatctcaaacatttatttactcgagccaacatactcttctgaaagatggcgattgatttggatttgatatggatttggctctagtaaacaccgaaaaggactgcagtaccttaatttattgttactaattgtcagtattattataatttgctggacattgtgcttgaacgttagttatgttttgacaaattcaatggaacgcgcgttaggtatttcataacaccaacaaatatatatgtagattgatagtgacagaggatggcatttgagcaagtatcttgtctgaatattatttttctaaacaacaatcttgtctaaatattaataaagtttttggcaatacacacctgcttaattagaagttaatactccccctgtcccccaagatatagccaaccttgtttaataatgttatattaagcaacctactaaggtcatcgtacatgttttacacatagtatcactgatcgtatctctttttatatagggctttgatgggtattaatattttggttgttacaaacattgagttcgtcagaagtagcaatcccctcttctctgtagattagatcttcactgcaagcaagccattgcataattatgatccatacagccttgtaaagctgtccatttaattctttgttattttttttctcgaacgagcagaaaaactacgtatcactatattaagaaaatgtctaaaagactcctatacacccattaacattaggaaaaagtacgaattacacccccgaactatcgcggtcgtctgaattatcccccgaaccacaaaaccggacattcttcacccccaactatgaataccggacgaattacccccctcgacccaatctgcggtggttttggtctacgtggcgtacacatggcagttcagtcagcattctatttataattttgtgggacccacctgtcattcacaactctcttctctctcacttctctgtctttccctcttcctctctctctccctctctctctcacggggtcagcggcggcagccgcggcgcgtgacgcggcggcggcggcagcggcggcggcgcgtggcgcggaggccgcggcggtggtggctgccgggaggcggaggcggtagcagccggcacgtggaggagcggcggcggac

SEQ ID NO: 82529 - DNA, 933 bp, Oryza sativa
taatagtctacgtttaatatttataattaattttcaaacatccgatgtgatagggacttaaaagttttagtcccatctaaacagggccttaagctgcgtttgttgggtgatcggagagaaagcacatcgttttccgtgtgcacgcttcccaaattactaaatagtgtaatttttttaaaaaaaatatagagaagttgctttaaaaaaatcatattaatccatttttcaaaaattaaaatagttaatactcaattaatcatgtggtaatggctcacgaacgttttgcatatcttctcaatcttctctctccccttctccccaaactcaaccttagtcgcatttcgatcggtatatacttaggccatgtttagttcgtgtgccaatttttttttaaaaatatacaggcgcacatttgaaatattaaacgtacactaataacaaaacaaattacagattccgtctgtaaactgcaagatgaatttattaagcctaattaatccatcattagtaaatatttaatgtagcatcacattcttaaatcatggcgcaattagactcaaaagattcgtctcgtaatttacatgcaaactgtgcaattggtttttatttttatcgacatttaatattttatgtatgtgtacagatattcgatgtgatggaatttttggaagtttgaagggaagccttagtcgcgtataaataatgttggcgactttggagcacgttgaagatgggagcaacagggacaacgtgattaaactgcagagtcgtagtttgatcgtcagtgcttacgcagcatgcacgcttaatttcagtatttcacacgcggcatatatatatgtgtatatatatatatatatatgtatatatatatatatatatatatatatatatatatatatatatatatatatatatacatatatatatata

SEQ ID NO: 82530 - DNA, 8395 bp, Oryza sativa
aaacgtccaaacgaacacagaggcagtcaatcagctacggatggatggatgctttggctcttctcttatgctccatccgtcttattataagcagagacggtattttccgtgtataacgtttgattttcgttatatttaaaacaatataaacaataagtcacacataaaatattattcatgttttattatctcataataataaaaatattaatcataaaaatatttcaaataaaatggtcggtcaacgttggacatagaaatacacgattttatcatgattttcgttagcacgtctgaaataatttttttatatacaagttatttttaatatagtattagataaatagattttttctaagtttaaaataattaaacctcagtaatcacgtgctaataacttttttgttttttcccctaactttatctttattttaaaaaacgaacagcaacttactttggttcaccgatttttccgttggtaaccaagtggtaaaattactattaaggggcggagtatttttttcttgggaaaattggaacagataaaattacccttttttcttttaccaaacggtttttcaagcctccttacatgtttttgttttacactcgacttcttttagtaacagataaaatttagcttctgcttcaacatgagctactattatttattaaaaagtttttggcttaaaaccaattgtaaaaacatctatcgaagaatgaagaaaagaaatgttgaataaccaccaagtcaccaacaatgagaacactgtacaactctttcgtacagcaaatcattttagttctgctaaaaatttatcgacatttttttttaagaaatcactcgattttccaccgtccaattggtattaagattttgtgctagcgtgaacgttccataaaaaatatctactactcctgggcagcgggattagatccattgatcggattattaccaactgcaaggctctaccaactgagcaaggatgatgtgttgtcaagttagccaaaacaacagctacaaattagttacactaaagttaaactgtgaagattggagtagagaaggcttccttctggactttttgtgtgagtttcagggctggcttttcaattgcaattaatgtaattagactgtaggtgtaagtatagaataattagagtgtacatttttttaaagaaaaaaaatagtataagtgttgacaaggagatagttctaggccttgcagcgtcatgtagtttcgagtttttaagttgcccatgtatacttatttattttaacctggacaatacgctgcttataatctaggcagtatgttgcttgttagatggttaaaaaaaatccgagcatttagaatcatcatctatattctctatatagctaatatctactaatttctacatttcaacatacaagggtgccacatcatcacccactaggaattatcattatctagagtatttaaaatcacatgcaagcatgctacatcatcacccactaatagttattattatttagactatttcaaatctcatgcaaacatgatatagcatttatgattctgttatatttttagaagtcaatatataggaaatgtcaaactatcatctccacatcattttcatattatttaaacatatacatattttctacaatacaacatacatccgttcacatatcccgcaacagagcaagtaagtgttattccctctgtcccataatacaagagattttgagtttttgcttgcaacatttgcccactcgtcttattcaaatttttttgaaattattatttattttatttgtgacttactttattatctataatactttaagtacaacttttcgttttttatatttataaaaaaatttgaataagacgagtggtcaaacgttataaacaaaaactcaaaatcccttatattgtgggacggagggagcatcatttaatccccgtccaaaattgtagggcagatatttttttttcacggccgacaaaggtggggcagagtctaattacctgctacgttacagcctgcacaaaaaaactggacccagagcgtacatgcatacccctgtcacggtggggcgccccacccgctcatctcatgcaacccaacaaaagacctgagcgctgcgccaatccaaatatccaatcccggcgctgcaccgtccacgcataaatccatcatacaaattcaagtacggtgttcgattaaaatacatattttattttgattttctttaccttgttttttaaactgtacattttgtatttaattttttaatatagaaattatttttaaatagtagataaaaataattttaaacttaaaataattaggtgctatttttttttattttacgtgtttatacttaatatttatcttcatcatattgaaataggaaatgtcgaacccatagtttggaggcgaggatcctctatcataagctttactttgtttagttaccaatttttttttccaaaaaggtcgtatcgaatctttgtatacatgcatgaagcattaagtataaataaatgaaaaaaaattaattgcacagtttgcatggaaatcgcgagacgaattttttgagcctaattagtctatgattagccataagtgctacattaacccatatgtggtaatgatggattaattaggctcaaaagattcgtctcgcggtttacatgcgagttatgaaattagtttttttattcatttccaaaaactccttccgacatccagtcaaacgtccgatttaacattaaattaaggccatgatattactaccgttatagtcaccgatatgtaattctcactctcctattgtctcacacgacggtatgtataatgatagtgctactacgatagaggatagaggatgtgagccccatggtccggacaccccgctggcaccgctcgtgcacctataaatttgctttgccatcgcgtcgtcgggatcgtgtactcgtcgtagccaccacaccgcccacacacccacaccgccggtagcgaggcagctcacatggcggcgacggcgacggcgacggcggcgccggaggaggaggaggggaagagggtgatgacgagggcgctggagtgggaagggtgcgtggtgtcgccggtgccgacggcgacggccgacgaggcgtgggctctgctgtcggacttcctcgccttccaccgctggcacccgcgcgtcgccaagtgccgccccgcctcgccgtcggccgcggcgagcacggccgccgccccgccgggctccgtcgtgcggtactgcgagggcacgccgcgcggcgacggggcgccgccggactgggcgcacgagacgctgctcgagcacgacgccgcgcgccgcttcttccgctacgagatgaacgacaacaacatgggcttcggcgtcttcgtcgccacgttccgcgtcgtccccgacgctggcggcggcgacgcggacgcgccggggtgcgagctccggtgggagttcgagggcgaccccgtgcgcggcacgcccaaggaggccctcgtcgcgcgcctgcaggccggcctcgacggcatggcggcgcgcgtgcaggagcacctcatgtccgcccgcgccgccgacgccgccgtcatcgccgccggcggcgtcgaggccgccgacgagctcaaccgggacaaatactctatcgcggtctgagtgttcgtccggtccgtcgatcgatcggtacagtacaccagtatatgcgcggttgctggtcaactttatacgtgaactaatttggctgcaaaaacgtatattgttcgatgaaaatacacgaactctgtcgccgtcttccgtatatatgtacgtacctacgtatacctacctacgtatacggtatactgtgtttgtacgtgcttggggtatgggaataaacgttactaagtactgaaaaaaaaaccagtctctagcttgtctctcctcgtgtactgttcgatcgtggcattatttggttttgtaatttaatttgtaaattttattatatggaagtcaatgcaaggattaattttaatgttgactaattcacatgtactttcctgcatgtgcttgccatgtgctgtgcttactattggccgctgccattttgcctcccctgagccccctccgtggaatcaagttaatatgcagctgagtgctgacgtatgcaattgagaactgtattttttttttggtctattttgtaaggagtgttatgtattcacgatgtaaagattatttatctatgagtttcattgactttatgaaacatttttttttacaatatcgtttcccttttgtttactaggcctagagttgtgtgtgactttgcacaagccagcgcaacatgattccgcaaaattgtatagggtgtaaattagctactgctcgaagctaccccttcgtttatttttttccagtcaaatttaaaaaaactttgaccaagtttatatacgtgaatcaaacatattataaaagagaaattcaatgttgtatttaatgaaactaatttggtgttataaatgttgctattttttataaacatagttaaatataaagaagttttattaaaaaatcaaaacgacttataatatgaaacgaaaagaaggatttgcttttgagatgacatccacggtgaaaatcaacttgcatgtcctcctttgctggttagcttatatcagtcgtggtgaaactaaaatttaaaattttgatataagaatttattttgaagttttttccgtcgtactttattcttcagtattattttaaaaccacaaataacacaatataaaacttttacttataagttatttttaagttacttaatttatcttattagccgtagctcaaacaatttgagagcttaattgcgactagagttataagcattacatgtaagagcaagtttaatagtatagccaactactagcttcaaatcatctatagccaatgtaatagccaattcatataatagttgcttactataatattaatatctggtcctacctgtcatacacacattacgtcttagagtccgtgttgcagctagctagatctgtaacccactgcttttctctcccttctttatctctttaaaatatgtttatagctggcttatagcctgctattgtacatgcttttactgtgctcgtaacgataagcattacctgttttattagcaagattggttccatgatatcgagagatctcgatttcagaaatatccatatattttatctcatgttaatttttaaagaagttgtggagtcgacgaaccccagaaggtaccatagaagttgtggaccgatctgggcataagggggaaaaaggtactacaatgatggtatttttctttatcgctaagtaggaattgcgagattgtagtgtactagagtaggagtattatgaaaaaaaaatgctaaaagaaatgcacatgttgtccctgttatttttttattctggatttttcaagatactaaatggtaacgttttataaaaaaaatatataatatttttcttaaatacttatctaaaataaaattttaactgtgtactaatttattattcattcgtttatgccttcaaataacaatcacacaaattaaattattcattaactttagctaccttaaacaagggggttaattgcattatactccatccatcccactgtagacatttgtgcactcattgatgtttgtatatccggtcgattttcataccctcgtcagctaggaaatgtgggcgcctgttgaccccaagagtttccatgctgtaatcaaagaggatttgcacatccatcgccatctgccgttgttgatgtatagtaaccccagcccaagaaattgtccttatctcctcgtggcaattggcacgccccatatatgtcatgtgtgtagaagagtcaaaaaccggtaagccgttacatattaatttagtgacatttcggccatgtgtttgcatattttaaattttcctagctaccactagtttttactactattagacacgtgtattaattaatttagacgaataaatatgtcatactcctccctccagctctataattcttgacgttgaagcgttctgcgttgtggccaggagttcctattgtttgagctcgaaagtggtgtttttggactgttttgcccaatggtgatgtttcaaacaagataaagccgctcatcatttgctatttggttgataagccgtagaacaatgaacgaagaaataagaatattttacaataaaacttttatatatttgtttttagtgatttacgattaaaaaactcaaaatccactataaaattaagcttcaaaaattcaatttttggctagggttgataagcaaacatatttacggcattccttgcacgcttgaattagtggacatgactagaatgagagtaaagagcaccgatgtccactccggcaagtggaacgaagagcgaagattagattgccgggctcaccaacgacgttgagatgtccacagagcagagtgaagatagggttgctaggctcaccaatggcgacgaattgaatctagttctacatgacaaagatctatgttcttaaccagctgagtgtacctacacttttaccaacaattgaatagtactttgatcctttttttttctcgctactggcctcttgcctgtgtttagtgttggacggagttttgaactcataagcaacccgactcattgacggcgccactccggtatatttaataaagtgcaaggcagggaatagataaggtacataagttaatcactcatttaagaccatataccttttgatagagatagaaaatgtaaactatttctattactaaaaagatagtcactcctggataagtgaggattacctccgaagcaacgagtattatagcactggagggagtatcatatattactccctccgtattttaatatatgacaccgttgactttttaatcaacgtttgaccactcgtcttattcaaaatttttatgcaaatataaaaatatttatgtcatgcttaaagaacatttaatgataaatcaaatcacaatagaaaaaatataattacataaattttttaaataagacgaaaggtcaaacatttatcaaaaagtcaaagacatcatacattaaaatatggagggagtattcaattgattgatgaatagtcaactcccgtttgcttttcctctcgtccgaaaattaaagagacggccagtacccagtgttctttgagataataaccgagtaattaattaaccagcggagtacacagtagtacagcaccgtctgctcgccggaaacgatgggccatagctaaatttaggcgatcaagagcaggtttaactgtaaagggactcatatcttataatagagagttattatatattacagatgagttataaggttatttttattttttctcctctctctatcctttacttatatatttaatatatttatcttaagatatgtgtttacttatatatttaatatatttattttgaaatatgtgaatagctagttcttttttattttttaagttttctcttctccttgtaattataccatcctattaaacttactctgaacgtggttttgggttatagttaggatgtgtacgtgtgcgtgcgtgtgacggcgacgtggttgaaagagagagagggatggacggaacggcacggaggacgtgatttattggcgatggcggcgtgagaggctggaggacgcccgtgcagcgaccgcggcgacgacggcgacggcgacggcccacggatccaccgaagccggcgccgcagcgaacatacggccgcacctgcccgcgcgcacgtcttatctggtttgctacggcccaaattatcagctgctgccgccgccgcactgcgcgcatccatcatcatccatgcgcctcgccatgcatgctacacggtgacgcaaaagaagacggcacccgacacggcaagcaacatgcatgtagagcctccatcttgtgattctccctttttcgcttacggcagcagcattctttttccttttaaatgtgcaaggtatgtatatgtatactgtcggtcttaaaaaagaggaaaaattacgaattaccctctcccccgaagtatcgcggtcgtccaaattacacccctgaaccacaaaaccagacattcttcacccccaactatgcaaaccggacgaattacccacctggacccaatccacggtggttttggtttacgtggcactccagtcagcattttatttattaaaaataggtgggccccacctgtcagtctctctctcatctatctcttctctccttcttcagacggcgcggcgaggcgagtctctctctttctcctctttcaaacggcgcggcggcggctgcggcggaggag

SEQ ID NO: 82531 - DNA, 22362 bp, Oryza sativa
attagctgtgtaattaacgagcaatatgctgaatgccatggagtaatacgctgctgcaggtctaggagcccgggcacctgcccatgctggccgggccctggctccaccactgcatctaataaatattctcaatttgcctaaaaacactcaatcttgaaaggaatgaatagtgtagttgattaagaaacataggataaacctgatcccatagaaatgtcaattgaagggataccaatgtgttgaacaaaggcagaataatctgatcctccacctcctattcttccaatcttaatctgcatgtgtatcatcagcatatggttaagagggatagagactagtataggctatacatgcatctactctttacgcgagcatgtgtaacaacaattgctctagctgaacttgaaatgcttaccatggaagaactatcagaagccatccataagtcatacagactttgtgtctcattatctggattttgaaccttcccaagtaagatacgagacgtagcatatttagagaaccgatatagttgatagcgaaaaaagtcaaactaacaataaaactatagttgattgatattcataccaacagaaaaaataaattagatatctgtatcagtaaccaaaaaaaattgcagcaaagatcacttgtaactttttgtcatgcaacattctgttattgactaaaggaaattcatctaaaactggaatacctgtttactcgcctccttaagcaactcatcaagttgaggagtagctgatgcataaaaccctgcaccatacactgcagaatcaacattcaggtaagcaacagttcttgaagttagcatagccctgttctcttcaacccattcagtggatccaaccttcattttcaaacaaaagaaataagaatatagattgacatgtgaattacttctgataatagtcacagagagagagagaggtaccagtccatactcttcggcatcccagttacacaagatgatggtccgtcgaggcctccaacccttcttttgtagctcagagaacctttgagctaactaaatagccacagatcataagttcaatgaaataaaaagtgtcaatagggtaaccagatattgcatacctcaagcaaggctgctgttccactgttcggatcaactgccccaaaagtccatgcatcacgatgattaccaaggattatatagctgcgtgagtttcataattattttactgcattgttttcttattgactcataaattcatcactactaggcacttattcagaatggtgatttttttttttggactgaagaaggtagagaggctctaccttgtaaccattttattaatggtagtcaaggtgttacagcaagagtacattagagtggaaaaacaacggaagacaatgaaaggaaacagaagaaggaaaaaggaaacagaagaagaaaaaaagaagaggaagaaaaataataataagaagaagaagaataggaagaagtaggaaataaatgttgattttttgatgaaaattcagaatggtgatcaacaacgaaatgtaaaacagttctctttcagtttctatggttccgctttattaaatgagtagggcatgaactttacactcttcaaggcgaacactgaacagtggccgagttggggatattgaactctccggacagaaaatatgggcagtacagtattagagcataaagtttaccgttcaggttcttctttcccttcgatcactgagatgacattctgaatagtagccattgtctcgttcccctgcaaacagtgccacccaaatatcatcactacctcgagccataaaaggattataaagcatctcacctttacagtccaattcatcgacagcaacttacaatgtaggtgagattgagcaccgccggcccgggcccgagccggtaaaccggcgagccatctccgccttgccaatccttgggcgcgacatcaccgccgataagctgtagtatagcctccccatctcttcccgacacaggcagcgccggtatccccggcatgtcgtcggtggccatcgcctccgggatgctcacgcgctcgcacccttcggacgacgcccacatcggcgtcgtgggatcccccacccccttgaacgtgctcccgacctgcacaccggtgggcggcatccatggaccatccgggaaggcctcccccgccgcgtagtccttggcatcggtgtatatgaccgccgccgccgcgccagctttccgggcgtttatcacgatgtcgccgcggtacaccttgccgtagcgcgcgaggacgaccttcccggtgacgtctacgccgcgggcggcgaggtaggcgaaatcctccgggcggccgtagttagcgtagacggcctcggcggcgaccgagccggacgcggcgtaggcgaggaaggtggggacggcctccgcggagaccgcggcatagggatcaccggggtatgtgtcctgcaccagcgcaaagggggtggtggcgtggcctggcgccgagagggagagggagcggtggaccgggtaggcgaggaggacggagtagggcacgacgcgggtggggaaggagagggaggagagcgcggagacgacgtgctcggcggcgcgggcgttggcctcggtgcccgcgaggtgggggcggagggtgagcgcgtggaggtgggctgccgcggtgtcgttggatccgagggagaggaagagcgagcggtagtacgacggcgcgggcgcgacgaggaggtggtacgatgcggcgaaggccgccgcaacgaggagcgggagagggtggagccgcgccaccgctcggccgggaggaggaggtgtggggggtatgagcggcgtccgcgcggaggaggacccgtcgtcttcgggcggcggcggcatggccgcgtcgggcaacgcggcggtagactcgccgttacactagcttgagtgcttgactaccaccagggtggatggagacgccgagcagagtgagccgaggtgattcaggtgacaggtcaggtgagccgtgaggccggccgctgggaggagctgagcgcgtgtgccgctgacggtgtggggcctaccactaccagggtggatgctttatccttcgccttttccgacggcgtgggcctagatgaacggtggagacgtggattgattcgagttgggctattttttacgttttctttgtgggagtgggtttcatgtgacgtgtgcaaagcatcttggataaaactatagataagtatatttacatcccttaactcttgctctttattgaatctcatctcccaatcggcaataccgaaattgtggtcgagggatgcgattcaatcaggagcaagaattaaaagaggtaaaatagacttatttctaaaactattgggctttcaatgtctcgtttgaatggaataagttcgtctgaggtcccttaacttgtcaacgaattcgattttcgtccctccctcgactatcaaaaccggtgtaaattaagtccctcgacgggtttaagggtggttttggctgacgtggcgcctacgtggctaatttgactcggtcttcatctgacgtggcgcttacgtggcaattcgatctagaaaaaataataaaactcatgagacccacatgtcagtttcacacgcaaattaataaaaaatggtgggggcccacacgggacccacatgtcatcctcgcccctcctcttcttcctcctctctctccccgactccccttcatctctctcccctctcctttgtcctctctccaggcgtgagtgaggaggggcggcgcgcggcggccgacgggtgaggagggagcgacgcgcggcgccggtgggagacggaagagttggcagcggcgcggcaccggtgggagaggagggagtgacgcgcggtggtcgacgagatacaggagagaagggagcggctagaacgagcaagctcctcgccctctccaccgcggcggtgctccacgcgcagctccagcaagcggaggccgcggcacaggcgagaggcaaggcggtggaggacgacgacaacgacgctggcgccgcggacgacgtcgagcaaccggcggccagcccacaaacgacggcacctccttctcccttttcccctctcctctcgtcgccgtggatccaaagggaggacacggcagcctcgctccccagatcagcgtcggcgactcggcggagctcggcctaggcgtcgaagacgccgcgtggccatgatcctagcatttgggatggcatccgctgagaaaggatcgtgtccacgtaagttgggtcatcgtgcccacgttctgtaatcgcgtatggataaaagggaaagaaacagaaaatgtcacaagcaagtaatatgcagcgccaaaaagactttcccaattggtttgttcttctcgcgtccaagcgtgtgtgtgttgcaggtttcactgcagttgctggagtttagctaacatcgtcccccacctcttcatcgacggtggtggggattgagacgacgacgacaatggcgacggccgtgaggcggtgccgtggcgcgaggagaagcacccaaagacacggccaatacccatatctacaccaccattgacgcaatcccggcgctgttcaacggtttccccctcctcaagggtgtggacaagccatactggtttgaggacaccgacgacgacggtggcgtccttttagcctcatcccgttgccatctccaagagctcgcctgccactcgccccctctctgcccgccgcccctctgctgcgcccaccacctttcggcgccgcagtgccgccgccctttcccgtcgcttgtgccggcttgctccagccgccgccgcttagctctgccggccggccactccgctcagacctgctccgcccaggtgagagagagagaggatggagaggagagggatgacatgtggggccaaataggtcccaccatttattattattttgtgagtttttttacagtccatcaggacttttggtacctctaggtacctacaatcacagccatccattgaggtagatccaacggctatcagtccttggtactgctaggcacaataattccctcgatggtacctccccttcgtcgaacaagtggaagggtaaaactgggatttcgcatagttcgttcgctgattccgcaccgcacgctcctcccaatcgccagcaagctgccaccctcgaggcgcctcctctgcatccttcctccatggcggcggcgcggctaaactcgtggccaaatctaagctatcgggacacctccgccaccctcgctgcaacctgcggccacgacgacgacctcaatacgacaacgaaaagacggccacagtgatgtgctcagcgccacagacgcagcggtgcagccttctccccggcgctagtacagctgaggcggctgttgggcgacggcggcgacttcaggggaacctcctgactgccctccccataccctcccaacggcgccgttcctgcttcctccctcctcccttctcccttctcccgatccaatctcaacccattaggaacaaaaccgaggtcagcaatagatgcaaatccagcttcatctcaatccatcagcaacaaagccgagatcagcaacagctaagttataagcctcttattacgatgtgattcctgacttggtgatcgatgtgattcctgacttggatcttcctctcatccaaaatcataagaagccaatcgtggagaccatgatcaggggctggacgaaatcgaaatcgagggcttctgctcctctgcaggactgcagccacagtcgggtcctggcggtgccgccgccgtcgcgcgaggatagtaggaggtcgcgagtcacttgattcctttttttttcctatcgtgcccttgcttattcaacggttggatttcgtttgatacctggtggtaccaggaccttgaggtaccacttgttggaccgtagcaaaactcttattttgtatgtagctgatatgtgggtcccatgttttttatttttctaaattaaattgccacataaacaccacgtcaatgccacgtaggacgaagatctagtcaaaagagccacgcaagcgccacgtcagccaaaaccgggcataatattgccgagggacctcttttgcacggttttataagttaaaaggatgtgttgtacctggttttgcacttaaggaatgaatttcaaactcggcgacaaattgagggacctagaatgaacttattcccgttcgaatctggcagtaggttgatacgggccttatttgggctttattacgttagttggcctgcacggcctggttgctaaggttgctaacaagcgtgtccgatactcgcttctgcaggccacacactaatccctatacgcaactgatatggttgatcattcgtccgtaaataatcagatcggttttgccgatcattaaccatgtatacagctattacggttgccgagagcttgaagatagaaaggctgtgaaaattttctactgcaacggaaattgcatggccagggtcgccatggcgcacataaaagctgcatgggtcatgctcatgcactccattcatgaaaccgatcactatggccggtgagacataaaggaaggcgaaaggagaaagatttgcaacgtcatccgtcgcccatttatgatttgttgccgccatccgtttcaagctttcaacgctagcttcttcttgtcagtcgtgcaattaaaaacagcactgacgtcgcactgaatcgcttgcaactttcagtcctggagggatctgcattaccagaagcacccaagacggagaggtgtatggcggctttgattaccctaatcatccagacccattcgaatgatgacagaaagcaaacatcagtttttgttggagccaccaaatccacttgtgtacttctagagttgcaccaaattcagagcgcgcgcttcattacgtgcaagctgatgatcatctaattgtcatcattttgctctagtggattctgatgatctgatcaacctgtgaaatagcatcacaccgccaccacgaactgatgcacttttattttcttgtggttgggaaggtacttacgaagtccggaaacagtcctaacgctcttaagttaacgcaagtactcattggcaggcgaaaataaaaaatagaatgaaatagcaatgctactccatgcttaagagacaaacaaaggatccagtctattctggccctaaaccatgaagcagaaaacaagtacaggaaacacaaagcgttcaaaccatcatgggcaaattaaattagccacacagttaggtacgttttctggagttacatgtttagccatttaggtacgttttttaggtgcaaactcgaagacaagtatctaaaaaaaccattagagctaatatgttgtatgaaaatatttccaaatacgaatctagtgacactgtgtgcaaacgtatatattttaaatttagattagtcaaataaatagttgttgactttaggggaaaaggtattatattttcaaacaggcgcagtatacggttatatcgatttctaccaccctctctctattttctctcacctatatgtttaattaatgcatatctcttatagcatttgcgaagaatagactttttttgcgaaaattgcaaaaatcgcctcataaatcatttgaagtttgacattccacccccataagtcattttgttgcaaatacccatctcctatttaggtttgttgcaaaaaccaccctaacacgcatgtacttaatcaaatcagtttgtttattgttgatgtacggttatcacaggttaaattagtcaagtcaatattatcctagtgtttgcattagacttattttctatatttgattgaactttttttttcatatatagcgaaactcagtgtgacaacgtttaagctctcgtctgtaattttatttgtggaatctcaccaaaagagtatcaagaatactctgtaagtatttaattttggtaaaggccatattaactgttcacactttatgaaaacatattgattcggttacgcatgtatttattggggtggtttttttaacaaaaatatgtaggtggatggacatttgcaacaaaataacttacgaggtggaatgccaaattttaagtaactttatgtgatggtttttgcaattttcttttttttttcattccctcctttttcacatgtggaacaaaaaaggatcatcttacgcagtgtgacaacacacgcgcgtggcgtactggaatctgggcgtagaaacggcgtccgccgtacgcgcgccgccgttccggccgcgaggcccgcggcgtcgtgtaaagccagatggtttggctggtaccgcggccgtgtcgccaaaagccgcgagcagctgcggcggcagcgcagcgctgccgttatcagagcgccccgccgctccgggagccgcgccgttttcgttctagtactagcacagagaaggcgggcgctcacggagtcgcggtcacgggccggcggcgtgcaaagcggcaaaataacgtacagggagaaacagaacggcgcagcggacgcattagcgctttgccaggacaggatggcgggagaaacaatagatggaggaataatcaggggatccacctaccgtttactattagtgttgtagagtcttcaacgtgtcccaaaaaaactactactagaaaagaacggaagcgattttgtcagatatgttggacagttcatatttcaagttggaatagtaagtgtaaaattggaccacgggcataagctgaaagtagcatggatggcaaaccatgccagtttagtagtttacattagtatcaaactatcaatcagcctatgaacttgtcatgtgtatacaacatgcacccacggttcgtatgctggctaaacaaggtttgacaagtcaaactacacttctctacgtgacaaattacagttacgaatgaaaagatcacactcgtcacatggtgacatggaaaaggaacatacatatccattatcctgcaacaaattaaacttcttttcctccctgccgtgtagatttcgaaccaacgccatttgcaaacttcatttccccacgcacgctggcgtagttcatcccaacgtcatggccgaaccggggacggtacaagagtacccctccaactaaaacaataaacccattcaatcacaaggagaaaataacactctaatacacaaaacgaagcaaggacaacgtaccgaagcccccaaaacgaaccgtatccgcactcgcgagcccaagaaaatcctctgctacgctgcgaatttagcgcgcagaagtcgccatcagtcgccgggatgcgcgcgggctcgagtcgcgcgacgccaagagcaagagcacgagagctgtgacgaacgcatgcatgcacgcgcgcgtacgtggtgggtacgggctcgcgtagcttgggcggcgctgccatgccaacacgcggcgccagcgaccagcgcaccaaccgcacttccgcagctcgtgaacccgcggccttgctctcgtctcgccctggcgtacgttgtttgtgtcacgcttctcaaatcccttggtgttctcctcttgtccctcccttgccccgtgaaccgtgatcgatcggtcggtagagccgcgagctccttaaatttccccctctcgtttcgcctgcctccatcaccgaacccgcccggccgccacacacgcctctctagctacccggcgcccgttcgagtagcctgtaggcgcgtggcgtcgtaatggccgtggcgcccgtccggctcgtggcgtgcattgtcgccctggccgccgtggcgccgggcggagtggcggggcacacacggggcgtgcggccagggagggcggcggggaagcagcagccgtcgttcccggagaacgcgacgcgggtggaggcgatcgagcggcagttcatggagtgggtacggtacatgggcgggctggagcacagcacggtccaccacgcgctcgcccgggcgttcccctcctactcgctcgtcgtcgacaagaacccggcgttcggcgacttcaccaccatccaggccgccgtcgactcgctcccgatcatcaacctcgtccgcgtcgtcatcaaggtcaacgccggcacctacacgtacgtgcacgcgcgcgcattgggactctgatcttgttggtgcttacgagagagtactgaccatgcacaacgacgatctcgcagggagaaggtgaacatatcgccgatgcgcgcgttcatcaccctcgagggcgccggcgccgacaagacgatcgtgcagtggggtgacaccgcggacagtccgtccggccgggcgggacggccgctcggcacatacagctccgcgtcgttcgccgtgaacgcgcagtacttcctcgccaggaacatcactttcaaggtaacaaatccaccgccgtaattctgtcggggctgtatggcttcgttctcctcaattcgcggtcatgatattgagcagaacacgtcgccggtgccgaagccgggggcgtcggggaagcaggcggtggcgctgcgggtgtcggcggacaacgcggcgttcgtggggtgcaggttcctgggcgcgcaggacacgctgtacgatcactcgggccggcactactacaaggaatgctacatcgaaggctccgtggatttcatctttggcaatgcgctctctctgtttgaggtaacactgtctcctctgctgttctcccgtgaaccctcccccccccccccccccctccattttgtgcgaaatcactacgttgtgttttatgtcatcctgtatcatactgtcatatgtcatgcatgcgccgaggtgcaaatatggaattcatatgcaaatgtttcgggaaaggttcccaggcgttaaatttttttttatcgccatagagtatacagagcaaccaaaacagagcacgtcagagtggcatccaaaaggagtgttccttataggagtgatctgaaatttacgccagtttcctaaaaaaaaaaatttacgccagcacgtttaaatactaccaacacgaagtacgaaccagcttaactggagttcttttcgtacgccatgacgacttgacatgtcgttgttaattatgcgctgaccaaattaggatgtaccgtgtcaattcccgtacatccccgtttaaacacatcaaagtacgtatttttagcctcggttttcctggcgtgcacgctggaccatgtgtcaggtttcaaccaacgccaatgtagcaacacgtgcacctcgaagcggtttggttcggtgttcggcccagcacaccccacaactgacgcgacagctaaccgcgttctctttgccggtgtccgcttctgtttctgccgccgacctcgcggctggccgccggccctacacccacgggcgtgcagagtgggggacgctaatgaacaacctctcgtcgtatgcctactaggcttggctgttatttgagttccgttattttgcactttttttttccttttggcttcggttcgatgcatgtggtgatcggaggtatatgtgtatgccctgcactgcaggattgccacgtgcatgcgatcgcgcgggactacggcgcgctgacagcgcagaaccggcagagcatgctggaggacacggggttctcgttcgtcaactgccgggtgacgggatccggcgcgctctacctcggccgcgcctggggcaccttctcccgcgtcgtcttcgcctacacctacatggacgacatcatcatcccccgtggctggtacaactggggcgaccccaaccgcgagctgtaagacatctcatcgctctctccgaacttatctgtgaagctgctagcctgttacgtgcgatcagagtgaagtttgtagaaacagttttgtatgtacagaagcaaagtcactttaattccctagccaaccgaaagccgcatcggtgttgcactgttggtctgttgctgtttgcaaaagctcggtgtagctaggcgcatggccgtgtgcgcagagaagaatcgtagacatagcttccatatcaataatttgccagtgcacgggaaaagggagagcactctccccttctcggtgcatggcgttgcacgggtgcatctcccccttttgatctctttggaactgaatcatacagcttttgagattcgatgctctgttactaaacaggatcggcaaaaggcagtgacagtctgacagatatatcggtaaaactcagtagtttcctgatgctgtacgcaccactgaccgttgttgctgtattgctcctgctgctgttgcaggacggtgttctacgggcagtacaagtgcacgggccccggcgcgagcttctccggcagggtgtcgtggtcacgcgagctcaccgacgaggaggccaagcccttcatctcgctcaccttcatcgacggcacggaatgggtcaggttgtgagagatcgatccatcggtcgatcgagttcattgtagcacaccgcacacggcatcatagcgtcacacgatgtaaaaagaaaaacagacgaatatatatacagattcatttgcagtctcgttggagattgtcttctttcagtttggtgtgagtttgggtgcaccggcttgcatttactatcagctagtagctgcgaggctctcagcatgtggtgagcgtgtacggcgtttcctgattctccaccgaaagaaggtaattaggctgctagtaatcggggacttataaacgccgccgtactatcgcactctcttacctaaacacgcgactgcaccgttctatactcgcgagcccttgttggtgagaaatcaagtactcaactggcaccactgcctgacgcgacaaagtaatacaagagcaaagccaacgctgctattagaactagcaagttgcaactcaactaatcacgactcgattgaatgcttagggagcgttctttctagtgagttaggatgagaaagcacatcgtaagtccgtgcgcacgcttaccaaactactaaacggtacgtttttgataaaaaaaattatataggaaagttgctttaaaaaattatattaatccatttttgaaatttaaaatagtttatactcaattaatcatgcgctaatgactcacctcgttttacgtatcttcccaatcttctcaatcacctatccctcaaactcacccttagtcgattcatggatgtaacagatcgtatcacagtatgggcctctgacaagaattgtgggctacagatgggccttgtaatagcccaataacgtaaacactgccagctactggttttcaggctctattggctatttcagttagcgtaatcatctgtagactaccaataaaatcaataaaatcgatcattttagtgctttactaacctgattagaggtaaggttagttagtatttaggttattttccgttgttcattggaaaaaggtttttatatcgattcagatcatatcgcttggctactcgacggcgcatccttccgctgctggtcggcaactcatcccgtcgggtgccgacggctccggtggctgcgttcacaaggccgttctcttcccgcctcttcttcgcctctatttgttgcccggtttcagatacgaacagagaatactccctccgtctaaaaaaacaaacatataataatatagtacaacaaatctaaacattaagttatttttttttggaacggagggaatatagaagacatgtagtcgttggcaggaaatttcgtcccttatcggcaagcacatatctcactcgaaaatttcgggtttttccattttccagaatttgatcaaagtttatttaaattcattaaaaaatcatcaaattttcaaaaaaaaaaaattgaaacttcggttcccccacccccaacccgggccgcgccaaaaatacaatttcgagattgctaacccatgtcgttggttaatcgtaaagcatgtgctttgaattataacagtggggactctattagatgtctcgtagtttagagttgtgctccatctttttcatattacaaggcctggtttagttcccaatttttttccctaaaaacatcacatcgaatctttggacatatgcatggagcattaaatatagataaaaaaactaattgcacaattgggggaaatcgcgagacgaatcttttaagcctaattagtccatgattagtcataagtgctacagtaacccacatgtgctaatgacggattaattagtctcaaaagattcgtcttgcggtttacagacgagttatgaaattagtttttttattcgtgtccaaaaaccccttccgacatccggtcaaacatccgatgtgacacccaaaaacattcttttcgcaaactaaatatgccctaagttatttgacttttttcttagtcaaaattctctaagtttgatcaaacttataaaaaaaattagcaatatctacaacaccaaattagttttattaattaacattaaatatgtttgttttttattgcaaatcttattatatttttctataaacatggtcaaatctaaagaaatttaactaataaaaaataaagtgacttataatatgaaacggtgggagtatttaattgaagctgttgagcaagagagtagaaacttcgctatgatatagcagtagcagtaaagggcagagctagagtattcccatgaaccgggtcaagaaaaaattatagctatacctgacctatttttaccatatgtacacccctctcaatataaatttagacacccgtattagcttaaacttgatataaaacagagtaaattaaacaagtggcaacccctctttctcgctatagctccacccgctgcagtttaccacgtcaagttcaaacttttacctttatctcttggtaaattttgggtgtgtttagttcacaccaaaactaaaagtttggttgaaattgaaacaatgtgatgtaaaagttggaagtttatgtgtgtagaaaagttttaatgtgatgaaaaagttagaaatttgaagaaaaaatttgaatctaaacaagagcggctttataatgtttagtcctgattctttccgcaggctggagatggccaaccaaagaaataagctatctatcgctaatcagctgtcggcgacgggcagcggcaactatgccagccacctccgctcctagctctgtgtagtgacgccaccccgcaccgcatggtcgcccttgcgaggcgcaaaacttggagggtttccaactgatgtgtaaatttaaaaattatcatctcatgtttctactaccgttacgttaaatatagtgatagtacgaataggtcttatcaatcaatctatctattatataataaaaaatcattaaacttcctataaacgctactaggccgccacgtggcatcctataaacgctcataagccaccacgtgacactctaataaattagagaaattcttaaaatgacacaacatctaaccgttgattttttttattaaatttagtggaccaattatttataaccattagatttattagaaaaaaatcatctccttatccctaggcccacttcggcctgttggcaattgcaagtacgtacgtacttctgctcagaaaacccacctcccttttcatctattttttcttctattttcgtgcttttagaaaagcataattttaagtcaaacaattaaccaaatgtaacatctaaattagaatactaatatttgatctgcttatatcgttagatattttacatttaaaaacttatatccactttaattcaacttcaaagagaaatatgtcatattaattggggctatattttctaacttttgtgtgccatttaagtaattataaaatataaaatataatgatatatattttatcatcgtatataacttggtgataattaaattatatctaataaaagtaaaatgaacatatctttgagtaatattaaaaaacagcccccccaaacattgtaacacaataaaaagtacacatcttataaaagctcctaaaatattatgtcattctcttaaatcggaaaaaatatactcttaaatcggaaaaaatatactcttaagatattacgttgttctcttaaataagagaaaatcctaaaaattctaacaagaaaacaaaacattcgaccatcagcttcgacttaaatatctgacacattattttagtttgttagattaattatttagaaaaaaaatcccaaacctccattcctccttgccgtgtacagcgtgcgtcattcttctctctattttctatctccttatcaactgaaatgaaaattatatatatgaaaaaaaacacaaataaacctccatctattacttatatcccattaggcgtctaacgactttctaccaacttaattaatttcacttaacatgcatatgagggctatgtacctatacaaattggccttgatacttttaaaatgattttttaggagataaataaatattcataagaaagatgatcatagcatcccaattacacatatgatctatgaagtcactaatattcatttagcaatatagacaataggttgaaaataaaggcgtggctggttgaacattataccgataagcatgtgaggtgcacataggaatcttaacagtgaaacaaccttgaggtggcctttacaataaatcgagtcaattccatataagaattaaagatcatgcccttttttaaaattttatgataaattctgctacagtatattgtaaaaatcttgatgcacaccaatctagaaatgtgtgtatttgttataagacactccactttagtgatgattcgctaaacacactatacactatgaccattacttcaatatttcttgagagaattttagaacgcatgcctttaccccatgccatgttatatgcacttatattttcgtcccaaattgcaaaaatcaaatcatttcaaggatgattcatagaatgaaaatctcaaaaagaaaatatgaacatgaaataaattaaaaattaaataaatgttgctagatttaaaacctattctaaatagaaaaattcaaatatcctactgtggagttaaaatatctaaattttcttataggaacaacctcctttgtttcgacacaatattttctcatcaattcaaaaccgcatgttctcaagtaattttatttttgaatttatatgttgcaatggtaattatgagaaaataaccaacgttcaaaggacacaaaataaatttaattttagtttagaatataataaaaatattttagtaaaaagccacccacacataaatatttataataaaatttcatttacattatataagaaggtgcccacgtatacgcgggctacttttctagttgaataaaaaagaatcaacaatttagatttatttgtactactagtagataacactgtactaggattcttcggttaagagtttgttttgaccctgatttttctttgcattttgcaacagacatcgaacatcgataagaggttggtcgactatatcattattaagaaggaataactgttcttcctccaacagctatcaaaattaactagggtaagtgccggagcgagatatgaaaacgaagaatggaacaaagcaatcaagggagtggacaagttattttgatttttgaaacatgttttattccgatctttcctctgtgctgcattaacccgtgactagtattagcagcaagtagcacttaatgccaagtaaacgccaccgtacttaaagttcagatctagatctatcaccgggaaagaacaaaatctccatcccttggtttggatccgccaatcagctgcagaatatgcaacaaatggacaaaaataagaagcaaaaacttcatcgctgagcagtaaacgtaggactaacacttggtgtccaaaagggtcgtttccaaacgaaaaaacttgtcggttaatgtccaatccatgtacacagaagcagaacagttccgtttaaacgacctgctcagtcacgagacgccttacctaacaatgcaacgatatagttgtctccacgtcttaaacaaagccttaaagtacctgaaatgtaaacatccggttggaattgcaccgacctcaatagcctcgaagggtaaagattgatggcgtatctgtattacagtaatagtacaattaacagtatcgaaggtttatgacacgacgagcatataaaaaaacaagatatgtatattgtatagtacaatgctcctgttgttgggagcaatttttccaagatacgaccaacacaactacttcactgctcacaactcaagtgacaaaaccgtcaatgtgactggcgagtattacacttgaccttactcctagacccaccagctcgtgactgttccaagagtcttgtaaacgttcatgaccaaagtacgaaatgaacgtgacaatgatagcaacggctgccggatcatgagacagaacttcttatttgaaacgaaggatcgtgagacagaactagcttgatgcttcacatcagtcgcttgcttggggtctagccaatccgaaggacaacgtagcacgcaactacagattttgtcttcactgaggcagtaaaagaactccacaagtgacaggactactaaggtcatttgttggcttaagtagagaatttcattccctcatatgccataaaacattttcattgattcaaacttgtattatgccttgacctaagcacatttggattagtatgtacgaaattttggagactctagattttgagcactagtaacatgacatccaaggcaaaacagtcttgcatctggtcaccacattctgtccaagtagtaatctctggccgcctcgtcgctgagctcctcggagtagccggggcgggagtcctcggagcactcgaagcagaagccgctgtcctgcgtcgtccgcgagcacgatctcctcgacctcgccggcgcctcggcggcctgtcgctgcctgggcgcgctctggcaccgcgtcctcgccgctgacgaggccgtgccggccatgtagcgcgggctgccgagcgcgtcccggtgcgagagccgcgccctcgccatgccgtcgacgctcttgttggcgggcgagctgccgtacggcggggcgccgaggcgcggggtgttgtgcgccgtcttggcgtgccgggtgtcgcgctcgtggtgctggctccgctggatcgacaggcgtgggggctgcttgatggagatcggcgacgagcacgacagcggcgccggcggcatgggcgccggggtgaggcagtccgacgagtgatcgcgggagtgccggatggctatccgggaggaccgagagcggcggtggcacgtgtccatctcgacgatccgcgggctgcgctcgtagttggagtccgcgctgtcggagagcctccggcggtgccccggcgtcgtcgtcttcaaccgggtctcctccacagagatcctctcctacacgttgcaataaaacgtaccaaacgaaacgatcagattcattctgcattggctgcattgcgagatggaatgcaaaagcttgacatatcggcacgaccatcacctgctccatggatttccggtaggaagctctcgtggcggcgcgggaggaggcctgctgccgcatgagcgcctgcagcctgtgcagagtcgtggcagcctgcttcctcacgaggtagccacggaccagagcctgcagcttgacgagagacctgagagcgcgaagcgctttcctagcctacggtgtaagattcaaaaattaaacaaacacaaatatttcactaaacaatttgcattaaagaatcgcggtttaggtgacaaggcttatgtcacgctacgtaattaactgctctgacagcaaacaggaactttattataggcagaaggtcaccgctaacgcagagtaaacaattgtgtagccgatcaacgtgcagattttgtatgcaatgcaagcagagtaagagagctactccaatagtctagtagactagttctaacgaccggagtatccattattatggaacggaacattagaggtagtgacatcatatacaggcatatagcaatgcctagcctactttacatactagtagccaaatagagtaacaaaaaagaagtagaagaatctaacaaaaatacggtgcaactgtgcgagcagtgtgcaacttctgactgaccaaaacttttcaaagataaaaaaaaaacgatggatctacaccgtcacaactaacttctactgtgcattagaactctgtctctcggtcaaaagaaaaaaaaaatgaagaaagaagactgagcagcagagccaacaagaaaccatgaacagatcaagtttgaagaacatagtctgatattcagtatacgtggatcataccaggtagcctctgtaagctttctggatcaccatggccgccttctcccgccgagctatggcattttccacctcgccacaatggcacggccgcctcacttccgaaggctctactgctactgcggcgacggcggctaaggcggcctccgatggccgcctgccgctgtctaccccactcctcctgtgcttcgcgaagctccacctgctcttctccttctccgccccgtcgctcacggcgtggttctccttgaggcctttgtgtgcttccttccggccagtcagtagcttcttgagccatctaatgatacgacccatgccgctatgattcctctctacaaacaaaaacacgagaaaaaagagttaaggaacgcgtcgcaaccagatgaacaaatgttacagagagagaagctgagcaagtggtgctgtggtggggtagtactaacttcagaagaagcaaatgtgaagaaagagcttctggccggacaagcgaaggagaagaggcctagagcaagaaacgctgcataaagcttttctcttgtaccgtagcccagggctcccggcagaaaaggaatggcgaattgtacgtgcaatccaggaccgagagacttaaaaaagaaatcccaaacgcgattctcggaaaggcacgggattaaagcgagagactttgcaggacaagcagcatgcagcgaaaagaagcaggaaattacaggaaacggcgaagtttacggcgacgaccggaggaggaactctaggagaaaactctgccacctctctgcagcgatcagtacgtcccccaaaccgtcaaaattcaactctagcggcagcggcggcggcgaaagagcggagcggatatgcgggcgaagggattaggcccgggcgaacttgacgcgtgggttgcagcggcgcaccagctcatgagaaagattccccccaagaatcacacggagagggaagccaacaaacgcgctagccaaggagaccaactcatagtcccccccggttactagctagcgtacagcgccgcggccactccaggacgaagcggcggcgcccccactagcagcttagctcgatcccccctccccacccctgcacgagtaaaacgacgatcggtgcaagaaacaacaaagcttgtgcagcagaggcaagtaggtagtacacggcaaccatcggacccccgcaagggatcaagatggatcgggggatatggtagtaagcttttgtacccgtggggtcgtacggcagggcggcgcggcggggacggcggctcgatcagctttacgccgtggcgccgagcggagcgagcagtccagcacgtcgccgacgctgctgacacggatcagcccagcttcttcttattctacaccatgcagtgcctggccccatgtctgtctgaaacctctgatcatgcacagcacagggaagtcctctctgctagagtagagaagatatactgtactgtagatgagtaggagtaaaatattgccgcctgctggatgatcatcgatggcgtggacactgaacaatagtgtacgcaatatttgctgaatacacagtacttgttctcggtaaggtgtggtgcagtactcctactcgtttcttccctggcgtcacgagacagttcgcaggactcggctcaatacgattctctcgttagagtacataatccctccggcctaaaaaaaaaaaaaccctggattttttttccaactttaacagttcgtcttatataaatttttttttataattcgtattttcattgttgttaaatgataaaacatgattaatattttatacgtgacttgtctttttaattttttcataatttttttaaatataagacggacggttaaatgttggacacggaaagcagagtttgtctttttttttttttttgacggagggagtatactcatactacagtacagtacagaggatcctcctaataagaagcaccagaggtaggtaccgggtgctgggcgtgtcctctcggtgctcccttgcgcggtgtcacagtgcaccagaacggagcaggtatcctgccttttgcgggaaaatggg

SEQ ID NO: 82532 - DNA, 1200 bp, Oryza sativa
cacatctatgacactaaacatatatattgttagcttgattcttagtcaaggtttgcaatgttgattttcttaaaattgtggcatcttatattttgaaacggagggagtatcttcttaatggcaaaattgcatttgaggtccgcgaaatattgcctttcgtctatcaagctcgtgtactttctagtttgtacagtgaatttggctttgaaacttggcaacatgataaatatagttggtttcagtgcaggtcaactgtttcagtatttttcaataccacacgtgccatattttgcaaaagatacatggggatgcatcctaaaagggggatatattctaatctttcagatcataaaatttcaaatctatattcactctacaaaggcctgtattgtatctggcacatgggccattttgtcatcaacagcaggtgtaatgaagggcctaattaaacatattcaagtagttgagggacttgagctaacaaatttaaagtattgagattttattagacaaaatgcagcagtccaggtacctcaattgcaattttgcccttttgttttcagagtcgtgtttgagaatcagacaagaatataactgtttgctctaatgtttacaacattgtcatggtttatggttgatgaccttttgaattaagatacttctattatttatagtctgttgctttctttcttgttttaggagctttctgtcattgtggcaaggagcagagacggttctacggtgtgctatcctgttgttgaaaccatccacaagtaagattttcttttatgattaccttgtgttattgattggcattgtctgtgttgtgcttttgccctttggaattcccaaaatatgaatccttagattggaacatccagggataacatctgccatgttgttgaggctcctgccgaggtgcctgataaaataaagaagttggctactaatgtagctgaaaaggctatcaaatcattggaaggtgctggtgttttcgctgtagaattatttttaacacaagataatcaggtttgctgggaacatacctgtatcataagttttaatccttcttgagtggtgttggcatatttatacccatgttgataatttcactaggttttattgaatgaagtagctccaaggcctcacaacagtgggcatcacacaattgagtcatgttatacctcgcaatatgagcaa

SEQ ID NO: 82533 - DNA, 2154 bp, Oryza sativa
tttacaagccagttacattttgagcttgctctccttttcttttggctattgatatgcaatagaaacacggtaattatcttttatcaaatctaaaacaattaagtcatcaaagtttttacctgatacaggatatgcatccagttcgcatcccttggaccagggacatgtctcaagactataccacacttctcaaattctctcagtaccaagttggtatcgccaggtaaaaaactggaaggacaaagacaggggcaacattatcaaagtgaattatgtaaaacagtgtaatcaaatatgcaccaagtcaggggaactattcgagatagagtaagacgaggacaaacctaagtacaacaatgagaatcatattctattgaaagctaaattaagggaacaatatgtacagagcgaatgcatggtcatatgaatacattcatgacgattcccccaaaagaaagaatagcatcaggatgctgtttctgactgtctagtgcacgtgaaattatatattaattcatcccaagaaaaaggtttgctaaactatttaactagatttttgggatctccttttccaacttcctacactcaaaaccttaaaattttccaattactgaaatgaatcacgatctctattctctacttcagcatatcgattcaactacaacagaaacatcaagacaacatagcatccaatcacatactcactgatcaacttagacaatcatcgttttgcagtactatgtagatttaattgaaatatggcataacacatactcaactatatgaacccaatgccacaaatttcatcaaacttatactagtttataacttaatcatcctactatcataacagtaagaggagaggccacatacccaaaaacggtgacccactcctcctcgtcgacacggccagcggaaggtgtcgaatccttcggcatctccggccgcgcaacttccctgggtggcggcagcgtgatgagcgtcaccttctgctgctgcgactgctgcccagacgccgtcgtcggagacggctgctgctgcggctgcacgacaccatcgaccggcgagccctccctggccatctcctccctcgaggaggaccaccacgcggccggggagggggacccattggagcgcagcggggtggaggagaagaggccgccgcggtggggagggggaggcgaggggctcatggccgccgcctgaggtggggtggcgggcctcggcgagggggagtggtgggagaggtcgtcgaggaacagcagcggcggcggcggcggcggcggggtggtggaaccttgcgtctcgcggcggagggaggccgggggcagccgcacggccgaggagatcggcgacgagaggtcccggagaaacggcgggtggtgccgccggtgatccggcctggatgcgctcatctctgatccggcggcgacggcgacggcgagcggcggcggcggcggcgagaaaccctagtggagaagcgagtgcccgttcgtgtcagtgactcgtgtgcgtggcctttgggtttatcaaggatagatgggcccacctgtcagtgggacaacagaagtctgaccagaaagcgtaaattcgtcaatacgtaagctcgcttcggaggcgtagttatcaataggacaatgaaatcctgctagaaggcgtagagttagaatacgttattccttttagaaggcgtaatttagttttattttgggcttttagttcaaactgacagcggagcggagaagcgtcggaggagatggaggttgcgacggcgacggaggcgtcggcgccggcggcgagcaggcggagccacccgttcccgtggctagacctggccatctccgagccctactacttcctccacctcgtcgccttcttctcctacttcgcggcccgcagcacggtgccctcggccgacgacggcctcctcctccgccgggtgagatactgagatgagataccggatctatttgcagtgtaaacgatccggatcgtgccgtttgggtggtgatcgaactatttcggctcatgtggatcggtggtggttggtgtgtttttttttctgctgcaggagatccaggcggtgctcacgttcctcgtgctcttcgtcgtgaaggtacgatcgttctcgtacggtgtttcgtgacgaatgct

SEQ ID NO: 82534 - DNA, 1378 bp, Oryza sativa
tggtattggatgatccactgaatgcttacgagcgaaacaccaggaacactggctccagaccgaccgggtgatataccagtatgacaccctgatgatcttaggctcggtacaatacaaattctgtggaccaataatgtcacttcggtgcgaaaaacccaacaatggaaatgttatgatcagtaatcctggatttgccttggaacagccaaaagaataacagccagtacttggtaacaggatttagaggccgaacatcacgtccataactttggacaatactgattttgtgggtgaagcaatggcccccgaagcaccacggccactcccgttgccgattccatttggcatataattgctaggcaaaggtgctagtgcatttctagttgtaaatgaacttggtgctacatgctgtgatggaaatggatctgttgcaccaacttgaaagttctcatttgtcttctcattcaggtactgccgctgccatgggtccacttgcttcacaccgatgataagaacactgtttaactgttgaccgtgcttggtgagagctttttgtgcatcatgccggctctggaagatgtcgaacaagatagagatcagcaattagaaacatacataacaaacaatggtcagaactggcaacaggaacattcagtgatatctcgcatatatttgtagtttgtaatcatgattgaattaagcatatggtcaagccctacatacgaacattattgctggtaggaaaagctcatcacatcaatgtactgttatcatactacatctgaattctgcaatctatcctaacaaaatacacatgacgatcaaatgaaagggaaatattgacccttgagccacattgtcacctcatagttcatgcatgagatattgtcatgtactaggtccacaaatcacaaactgtgcgtctgtgacaccatccatcttttggtttagtgttgatttgttttcacatctaaacaatttaaattctgaaacaaatgcagagagaccaaaactagcagagagcaggcatatgagaggatctccaaaagactacgtgtatgactagccatcccaaaatttggctagcgtagcaaaaaaaaaaaaaaaaagaggtcctccaacagactagccattggttgggccatccggctagccattccccacctacactcactattatggcccaccaaaaaatatgaactatggagagtgtgatttgggaatttggctagtctgttggagtgcacaggaaatatggctaggcactttcttggctagctagccataagaccatttggctaacctcttggagatgctcttagctgcttacataattacataatgttccaaacttttcataatcatgtcctgaccaaaa

SEQ ID NO: 82535 - DNA, 12961 bp, Oryza sativa
tcctaagctgtgcccaagtatactactgtactgggaactaagagaaagccattagataagcaacgaaatagctgcattatcatatgaaattcatttccatgctttcatgtaggtagcatgtgctttcaactagaaatccaaatggcatatgagtatctcaatatcacatcagttttaggaaaatgtcacaaacagtagttgagtaattattatgaccacaggtggttctattccacatgaagataacatgagggaattattaaaaaaaaaacttagttgaactaggaatttcacaaggatttgatagaaaatttacagaaagcagtattttcatctctacataaacataagaaatttcatgtatttcaagtgggccttacagagagcatttcaatgtggtccaaactgtccctttatttttgtccttcgagctgtgtttgatctggctgattgggtgtacaaggaggctaaaatttttactgcctaacctggaatcgagaccagaggcatgtcaaagaccatagggtgaaaagaaagcggtaaaaagaaaaaggaaagcctgggtgaaaagaaatttgtgagagctttgtttgatctgggtgactgactgggttatgaagaggctagattttttttttttaccgtctatcctggaatcaaaccaggtagggtagtacactatactccatccgttctattttaaatgcaaccataagttttcgtgtctaattttaatcgttcgtcttatttaaagattttttataattagtatttttgttatgagatgttaaaacatgaatagtttactcgtaacttatgtttttaatttttttcaaaaaaaaaattaaataagacagacggttaaagtttaactcgaaaaactatggctgcacttaaaaacggcacagatggagtagcaaagtattagcaaatagcaatgcccaaagaagcggtaaaaagataaaggaaagcctggggtaaaaaatattttttacggtggccgtggtgatacggaatctgcgtggcggatcagggtccaagatgcggatcgccgcctttaatcgggctccaaatgccgagaaaatccgctttttctccgggtcttctgcctctacacaacccgacccgataatattttaaccgtcctcctccccccctcgtgccgttcaaaaatccaaggacaaagaaaactgctgctgtctccaatctcgaggaaaattctcttggtttcactcaggtatccaagtccaatcacatatcctcttttccttttttttcccttttccgttcgctaatgacaaagagaattgtccctaatgacaaagagaattgtccccaaatcaaaaaaagtaataatgaaaagaataagagaaaacagttatatttgcaggctaaatatttagggagaaatgtgagtttttgctaggagattttcagtgtttttataaggacgaaaccagaggcagttcgtgcaaaggagcactagatcgaattcacgcaaatccacgggaaatatctcctaattatttatgggatcgagaattcacgccctgactcagggggagaatgtcttgagtacaacgctagtaaaaatattaaaaggagagcaaaaagaaaaaggaaaagagattcctttaagcacatctaaattttatttttttttcctcctcttctctcctctctctctctctgggtgtgatgggagaaaggaaaagatacagattgtattctaccgatggaagaaaaagaaaagcttggaatctctaaagcatgtgcagaaagctttcaattatttgcgtaaactatctgctcgttaatttgttaatctgccattaacttcacctcaacttgttactccaagaccatgtttattcagaatatgttccccttctaaagtgcatgtcatttaaattcaaaatatgacggttcgatataccacggtcaaaacgaatatgaaaaatattctcaagcccccaaaagtttcatattcgagtcttattcagaccaaatgcttttcttaacaaatattaataagaatttcacatgaaccaattcaattcacacggaaatcagagaggttaaagcatttcaaagaagcccccttacagaaaggtaaatgatacacgtcaaagaaacttatttacatgcgtcttagaaaaactgatgtggcatgctacgattgtttcttgatatttcataactaattgcttactaaattcaaaaaactgtttataaaagttcagtaaggttttgtaagtacatactctcgcttctcggtcccaaaataagttcatttttcacctattacacatataccagtataaaataaacaaaactataatactctcactttattaaaagtttttacgcgaacactttattaaattttaatataattagttctatctttatttgctctcaatgcatttattctctactttcacaaaattcgatgtagtaaatactcagaaataaacttattttggaacaaacgggaaatgataaaaataatcttatgagggtgcagtatagcattactcttacagaaatgcctcgtggaagagttacacaccatggtcttaggcgggcctcacaatctctgatggtaaagtgataatgacacacgaagatcatcataatgttttgatggatggatggatggagagtactcctacgaaattacatgcgccaatctcctataacaatctagaatgattggacatttcatagtatccgtccagattcgttgtaatatgaaatgtcttatctaattctaggttatattatgggatggatggaatataaaaattttttgaaaaaatgtttgtttttttttttaaaaaaaaaagaaaattacatgtgccaaatgtgcattcgccggcgacgtcgcagccgggaactttcctttttcccgcaatttattagcgcgcgcgcgccgcgccaccgccgtcctcgcgtttaaaggcgacgagacgacgaacaacacgaagctctccttccccccctcacctcgatgtcgccatcgagctctacgccttctcggctatagcctagcttgcttgcattgagctcgatcgatctggcatggtggcgtcggcggcggcgatggacgcgagcaagtacgtgaggtacacgccggaacaggtggaggcgctggagaggctgtactacgagtgtcccaagccgagctcgctgcggcggcagcagctggtgcgggagtgcccggcgctggcgaacgtggacccgaagcagatcaaggtgtggttccagaaccgccggtgccgggagaagcagcgcaaggagtcgtcgcggctgcaggcgctcaaccgcaagctcaccgccatgaacaagctcctcatggaggagaacgaccgcctccagaagcaggtctcccagctcgtctacgaccacggccgccacggcgtcgccgccgccgggatgatgcggcgagttcctgccttccctcctcaggccgccgccgccgccggccaccagctcgccaccgccaccgacaccagctgcgagtcggtcgtcaccagcggccatcatcatcagcagcagcagcacaacgtcgtccagccgccgccgcgcgacgcaagcccagctgggtacgtgacgtcaccacctgcgccatcgttcttgcaggtgcagctctagcttactcgttgttgcgcaggctgatgtcgatcgcggaggagacattgacggagtttctgtccaaggccaccggaaccgccgtcgagtggctccaaatgcctgggatgaaggtcacaacaatttgctcttcatcgtcaccaacttctcaattgcaaaagcttgatttgattttcgtcgtcgtcgtttgcagcctggtccggattccattggaatcatcgccatctcgcatggctgcgccggcgtcgccgcgcgagcttgcggcctcgtcggcatggagcccgctaaggtaattaaccttcttgtcactgtcacttctgcaataagcaacagtatttctgatcgatcgattgattggttggttggttgattgatgagttgtggcaatgatttcatcaggttgccgaaatactcaaggatcggccgctgtggctgcgcgattgccggtccatggatgtggtgaacgtgctccctgctggcgccaacggcaccatcgagctgctctacatgcaggcaagaacacacaagcctgaaaattctgaacctgaacctgaaattctgaagctgaaatttgtattcgatcttcagctctatgctccgacgacgctggcgccggctcgcgacttctggctgctgcggtacacctccattctcgacgatggaagcttagtggtgagctgctctgatcatggagcgtgtaaaacaaattatccatgtgtaattagtaccaaagtatttgtgtgtcactatgatgtcctgcctgcttgcctgaacgttcttgctctgaattctgaaggtgtgtgagagatcactcagtagcaagcaaggaggcccaagcatgccacttgtccagccttttatcagaggtgagatgcttcccagtgggttcttgatccggcctagcgatgttggaggcagcgtgatacacatcgttgatcatatggacctcgaggtactaaccattacaatttcttgtccaaatagttcattcatctagcagaatgaaatttaagccattttgtggtcgcagccttggagcgtgcctgaagttgtacgacctttgtatgaatcttctgccatggttgcgcagaagatctcgatggcggtacagtaattatagcactctgttcttgcttatttgtagaaattcttgactaattcagttatgcaaaattcaggctttgcgctacctgaggcaggttgcacacgaagatacacgttctgtgatcacaggatggggaaggcagcctgcggctttgcgtgctctgagccaaaagctcaccaggtaggactgactcctgaacagcagatgcttcttggttcttgccatgaatcttctccagctcaaaagtgtgaattttttttttgcatgctctcttttcagaggattcaatgaagctctcaatgggcttgccgatgatggatggtccgtgatcgagagcgatggcgtcgacgatgtttgcatctctgtcaattcatccaaagtgatcggttgcaatgcaacattcagcagtggactccctattgtcagtaccggtgttctttgtgccaaggcatccatgctgttgcaggttagcttcactatgaaactagaattaatattttttttgtttggttgatcatgtccagtttttttcatacaatatttctgctgtttgctaggatgtctctcctccatcactactgcaatttttgcgcgaacaccggtcacagtgggccgacagcaatttagacgcattcttcgcctccacgatgaaaccaaacttctgcaatttacccatgtcccgtcttggaggattcagtggtcaggtcatacttcctttagcacacacgtttgaacctgaagaggtaagttcatcttctactgtctgtcagttacataaaaggtcctgtccaattctgtcctcctgctcaattattttgatgcaaccatctattgtttttcagttcctggaagttatcaagctaggaaacgccagcaactaccaagatacactggtgcaccgtgatctgttcctcttgcaggtgacttcttgattcatgagacttatcaccagttgaagaatcattttcttttttttttcctctgtaaaacttgtgttcttggcctgattgcaatggcagatgtacaatggagtagaggagagcagtgcaggaacatgttcagagctcatctttgcgcccatcgacgcatcgttcagtgatgattccccactgctgccttccggtttccgcatcatcccaatcgattctcctctcgtaagtaaatctcacacaatagtttcaaatcaaatcttctgaatttttatgtttaaaaagaagttgttctgaatattctttccctgcaaatgtcaggacacgtcgagcccgaactgcacgttggatctcgcgtccacgctcgaagccgcgacgccacggagcaggatcagcggcgtcaatggcggcggcggcggctgtgctgctgctgcggcgagctctagctccaaggcggtgatgacgatcgcgttccagttcgcgttcgacggccacctgcaggacagcgtggccgccatggcgcggcagtacatgcgcaacatcatctcgtcggtgcagaggatcgccgtggcgctctcgtcctcccgcctcgtccctcccggcgccggcgccgccgccgcgcagctctcaccggtgactccggaggcggcgacgctgcccagatggatttgccagagctacaggtctgtggcttcgcagctgcttgtgtgatacagttcatatctgtcaagaaattttcacttgccatcatcgcaagattttttaaaaaaagttcactcttttttgaacgaaaaaaaaaagttcactcttcataactgatgatgctatgcttatacagatttcattttggagatgaactcatcaaatctgtagatgcaaacagcagcaatgaatcgattctgaaagcagtttggcatcatccgagtgccatactctgctgctctctcaaggtttcttcagccccctttttttcttatttagatacagattttatcttaatttttataagcatgttaattaaactgttaaactgtatatttcgtacgaaaatttttatatagaaactttaaaatataagataaatctatttttaaatttaaataattaaaatttaattaacgagatgttaaatgttaataactttctcattttacctgtccgtaatcttttatcttaaactcgaatggggccagtactcatactgctatgcatggaggattgtttgttctctgaatttatttccgggacttatgaatctttgctacagctcgactgaaattttgttttgacacaaattcaccttaaagttgacagtgtaacgcaccatttaaccatctgatttttcatgtaggcgatgccagtgttcacatttgcaaaccagtctggcctcgacatgctcgaaacaactctggtggcgctccaagacatgacgctggagaaagttttcgacgatcaagggaggaagaacctgtgcacagagctccccaacatcatggagcaggtataatcatatcacaaactgacatgagataagtactaatgcaaaaattatttttcatacataaaaaaagatacttttagattaataagtaattttgactttgatcaaaattaaactacttcaagtttgatcaagtttgattaattaagtttgtagataaatatagtaatatttacaacaccaaattagttttattaaattaataattaaatatatttttataatatatttgttttaggttaaaaatgttactacttttttcagtttgactttgaccttaagtcaaaaatgagttataatctaaaatggagcgagtacattacatggaatgcattaataatcttatcatcttatcaatagaagatacagtaagatttcaccgaggctttcatcagttgcaaattgattaattagtggcacgcgattaactaaattgcaggggatggcgtgcatggagggaggggtgtgcgtgtcgagcgttgggagggcggcgtcgtacgagaaggcggtggcgtggaaggtggtcgacggcgacggcggcggcgcccactgcatctgcttcatgttcatcaactggaccttcctttgatttcatttcattatacaccccaatgcaaaacggatatataatattacaactagtgcaatttacgtacgtaatctcatgaaacagcgtgtacaaatgttttggattttgagaaccgcggtgctagtttttgtacggatcgatagtggatacattctctgttcggagtagggataaaaatggcttcttctttttttttttctttgaaatggaatcagaacgatagagactaactcgggaacaacttattgtgaaggcaaacaagctggtcacagtcatatgcaaactttataaattaacatcgtatacgtaattattagcgaaaattcaaagaagcaagtaactaatttaagcactccattatatattttgtattaacatcggaaaaagttgttacaaacaggcgcaacaactatgtacgctccacctagatgggcgctcctgcctccctcgagagcatggcctccgatgttgctagctccgctattccctgcatggtcttgcattaaccattgaaaacccggttgtttcgttacttccatatcgtgtaggccatcaagatgatgatggtgtcaaaccctcatctttgggccgctatgattttgtctcggcgtctcaccataatatggaaggattgctcatttgatccagtgccatatagaactatccaccatagctatagtgtttatcggcattggatcagaaggttggtcaattgactcctcactttgattacaaaagacgcatttctacggaccaagcagtgtcggccctcacttgctcagcctatcaccaatccaacatcaacggtggactaccaaccaattgaaataccgatatcgtggcggcgtgtggttcttctatatttgcttgtcaagtaaggattctctccttagcaaaaaagcgtgataagctgatctagaggagtattgcttcgaggactcctagcaccagaggagcgtgtttcctagtggagaaagggtttttgcattgatccgtgcccatacggcaagattgttcatcaaggcagttgtctcattgactggccctaaggagctcgatgggattggcatcatcgatctccacttgccacagcactgttgtattatgtgtttcttttaagatattaacgtgcacttcataacaatcaacacttacagcactagcgcgttcgtaaaatatcatcgcatgatatcaacactgacaatacttcataacaatcatatactatatgtaactattttgatgaaacacatcagacttattttgatggtttagtttgtgcgataaatttctctcgaaattccggatggaaaaaaaaaagatcatttaaggacggtatttggaatcgaaataaaataaccgtgtaccgtttcacccctattttcgaagcaaacaaatacggcgccgcgcaaacgagcttcggcccaccgcgacgttgggctgggccgaaagcctgaaatcccacgttgcaaaccacaggccgcgcgtcaaaccaaagtttgctacgtcacgcatgcaatgacaccattgatttttttttcttttaaactaagtttgatcattcgtctttaaaaaacatagaaaatataaatcgtgatgaaagaatatttaatcataattaaatgattttttagtaaaatatgaattaattggttaaatgtatctcacaaaaagttaattgtatcgtatattaaaaaacggatggagagagtacaatactcatgtagctagacactacagtgcactcagatcatacaatgcaactgatccacatacgtacatgttcaatattaggtaggagtactaacactactgtctactgggccgcactgatgcagtgacagtacactaccgttggatctaagctagctagcttggttaatatatagcgtgatatataccctatctgccaaaaaaacgaatcgaactagatatgacacattctaatataacgaatctagacaaagatatatctagattcgtagtattagaatatatcacatccagtattagattgatttttcatgaggcggagagagcatttacttagaaaatacgattggttacacatatatacaaccacatactaacatcgatagagagcgatcgagttaattactatcgaacaccatggagctcgatcatctgcaccgatcgccgggaggagcgccgccgttgatgacgtcggcggcgaggaggctgcagaagcgcgggtcgcagctggcggacctggcgagcgccaccgccttggacgccgccgcgccgaggcgccgctcctggcacgacgccgacgtcctcttgtcgaagctccgccgcgcgatgcggcgcatggagcccgccagcgacagcgtcgggttcagcctcgtcgtcgcgttgaagtccctgcactccgccgcgtgcgacgccagcgccgccgccacgccgccgcccggcgccgggtcgcgccgcgccgtctccttcacggcctccgagcacagcccgcacagccagtcgccgcagaacgccgcgcgcacgccgccgatgtacgccgccgtgcactcctccgccacgccgcagcacgcgcaccgcacggtctccacctcgccgccgccgtcgtcatggcgtgcgtcgccgctgccgctgccgctactcttgatgatgatgagcttctccatcttgtttgagctttgtgagtcgttggctacgtgaagctcttgttctccctgaaaaaacgcatgtgtgacttagacttgtatatatggacgcatgcatgagaatatagaagtgtattttcatttctggatgtctcattatctgtctctgcttgtcaaattaaattatattagtgaatcaacaaattttattttgtatagaagaatcaactactatgtaaaacttaatatgctattagaaccaaatatagttcttcttttgacagtcggcagctacaactattcccagaataccagtccggattcacatttgcattctacagaaccagaaaatgaactagtcaaaaatttggtttctccacattctcaccatctcgatcgatacgtactagctaattctcaaaatctccgtatatatctctttaagtagggccatagtcaatttgagacttaggataattcaaaatcattccacgtacgatgctcaaatttcaacttaattattagggtggataactaatttgatatatgaataaatacatgttatgttattgtgcttcgtgcatatccacagtattggccaatggccagtcaatgtgaaactgacgacatcagtgatgatgtgttgtgggaattagagcaaactaactacttagatggtattaagaatcaacacaaacaacatatatatgcagagtctaatatttatgtctacaacttcaaaatgatttgtctttgggaagaacttgggagttgagatttttcttttaccttgggagagaacctgcttgtgtttctttggataactgcagtttcctggtgctgcatctatctgatcttcaggaacctgtgtatatgttagtctgatccacaatatatgatagatgcatcaagatgtgatcatgtccccatatttataggcacagagtgatgagcatctaaccactcaaaagtggtaactaaagtttaaaaagtgcaacttgaatctcatcttttaaaaatttgcaacctagaagaaggtgacaggtgatactctcctagctagttgcactgcatgtagctagctagcttgtaaaggagcatgcaggttctcctaatcgtagggcaccatatcttatgtgtgaaagggaagcttgtgacaggggcaatctctacagttcagttaagaggccggaaagggtgtaaaagattgcactttagttaacatcaattcactaatatgtggcactgtccatgtccaacatgcaatgcaccccaactgagccgcaaagcaaagttccctaggaaaacgaaggcatctaggctcggttcatgcatcccatgcaaatggcagtgttgatgtgtgtgttatcaacttatcatcacactatcaatgagtaatcatgcatcatgctaaaggtgtaaagagagaagaaaagcttatgttagctgatcacaaatggatgcaaggaacatacccaattttgggttttaattagctttttttatatatgcaaggataaaaattagtacacttctcgcgagcgaggaaaagaaaggggaggggggtgcgtatagtttatacgaaattaataaaagtataaagcaactatagtaaagattaaatttaagcgctttttaaaaagataatggatgaatcaggcgctccgcccctagaattaagttcgatcatatgctacatacaccgttattgagttatattcacgagtcagttataccctaaaaacataaaactaattagaaagagaattcaattcaatactccctccgtcccaaaatataagcaattttagcatagtatcaagtcaaacatttttttaactttaactattaatagcaaacaaaatataaaaaatatcaatcatgtaaaattgatgttattagatttatcatccttagacaaactatcataatatagaactcttgttatttaaaacatcttttatagatattgttggtcaaagtagtatctcgaagattatgtcgaagtccaaaaatacttatattttgggatgcagtgagtatatacttatactcaccttccggaagaaaccccctcatgcctcaaacatgaaattaaactgtattttatttttattcaacactactcccttcgtccctaaatatttgatgccgttaacttttttttaagtatatttgaccattagtcttattcaaaaacttttgtaaaatatttaaaactatatgtatatataaaagtatatttaacaatgaaccaaatgataggaaaggaattaataattacttaaattttttaaataagataaacggtcaaacatgttttaaaaaatcaatggcgtcaaatatttagagacagagggggagtatatttgtgttgcaagtatgtagtagcattcaatttataaaaaaaacttaagctggtgagtaatggtaggcgtcgtccacagtaatcttgcttgatccttaaaccacacatccaacacatcaacaaatcaatcatattcgagcaattgggtgaagtgctccaacggtgcaggcaaaaactgctaa

SEQ ID NO: 82536 - DNA, 2486 bp, Oryza sativa
ttccttcttttactgataatgacgctagtgctttcccagtcaatgtctgataattagttaataatcttcaaagtacctttttttgtcctgagtatagtatatttcatacttttttatgtaatcttgttcacactttattaatgcagatactctaacaagaacatttcgtttggaataattgatcttgggcattttccaaatgctgcagcaaagtttggaatatccatgtggggtaaatttctagtcttattctgtgcagtattgctcttctcaacttgatatggagtgcctgcatttctttactgtattgtgttcagaattttgtgtctgtttctttcaaaatggttccttattctcatttgaatttcgtttggcagatcatcttcccacttatatactctttgacaaggccactgaagttgcacgattcccagaaatcatgaatgaatcaaaagtatttgtgccaaaaattacaaaggttgtttttttcccactgtgctttcttatttttgttatgagttatgaacaaaataagttgcatcatgtttgcatcttatttcgggtagactagtatgatttggcacagttttgcaattttaacctaccctgttgcagaagatttaacattactagtaccatatgattacttacacatataagcaaattaggcctatgcttaaactctcagcatcaaaccaacataaatataattcctcaaaagtaatctagatgctgtctatggtgtgttgcatcaccctttaaatttgaagttcaaattcaaagtatgatgctagtacttactagtaacaaatgtgataaattctacagaaagtaacaaatggaactgaacttgaaatgttataataagtagggtattttatatgcgcatccacattttcttctcatttcatttcatttctttatgtgtgcatactggggcagggcgggaggcagcttttgcactaaatatacttttcatacggccaattattccagttgaaggggaaataggaaaccattgttcctgaaaagaaatgaaagaagacacacataggagattagctagtgtgacaggataatggtgcttagagaaacatatctcccacttattgaaatgggtggaaccgataaaaataaaatgaaatggccagcctaaaaaaaggtgcgagagaggatcatatgcagtacagtatgacaacacagttcctttttggtttggccaaaacatccaggttggttacctggcactgtacttcaatcgaaatagtgagaactgacgtgacaaatttattgaagccaccaatgatagaattcctgaaacatcagttagctatcgagtcgtcctcaataacctaagtgtgaaaaattgactgtatcaagtactgctgatgtggtccaattttgtggtattgctttttgtgggggattgttaatattattcttataacttctcttacagaaacttctctgccagcacttcgaccttgacaggcgactgattgaatacctatctagatgtaagtcagccagagattactttcactgtctttttctcttcaccatcaatagaacacctgttaactgaatgcatactgtcgcaggacccatcatctatcccagctgtctcaaaaagaaagcgccaattcccttttgtcgacgaaccagatgaatgaaccggacagttgtgcggcagcaatcacttcagggggtatcttcaagcttgttttattctatgagtttacttgtacccatccaatcaaggacagtatactttagggtagggtgggggtgggcaggattatgatttgcatcttactaccatatgtcacctcttgaattacggaatgttaccacacctgtggagatcttgcaatgatatgccaactatgttttccactgcagttagtgatcaattcagacaccattcgtttccagggcaggcagtgtctcggaatttgttcgttgacaccctttttccgtagtggtagtggcctgcatggtaggtcatcctggctcccctccaattccattgcattacctgccatgcctgatgcttttccttgccaatttacatcttaaatatgcctagtgctccctgataaccttgattaaaacacaaagccgttgcatttgggcaccaccattatcaagtggaggaaaagtgggattttggtggtattattaacaaaagctgattgtccagtaaaaggagggattggtgatgggttagaataacaaaaggctgtgtatgttgggtgttcaaaaggaggagagggaggggggtgtttgataagatcaccatagaatagttttgcaaatctggggaggccaaatggtagcatggatgggtgatttggcttagaataacacaaaaggtgtgcatatccaggccatgacacgtcagacccaggtaagtggttggtagtgggataggacaagctctagcttttttagcttttggttatcgtctctttccattttcttat

SEQ ID NO: 82537 - DNA, 6671 bp, Oryza sativa
cctgcagccctgctgtcaggcgtctaacgactttctactaacttaattaatttctcttaacatgcctatgagggctatgtacctatacaaattgaccttgatacttttaaaacgatcttattaggagataaataaatattcataagaaagatgatcatagcatcccaattacacatatgatctatgaagtcactaatcataataggtattcatctagcaatatagacaataggttaaaaataaatgtgtggccagttgaacatcataccaataagcatgtgggttgcacctaggaatcttaacagtgaaacaaccttgaggcggcctttacaattggaaattgagcaaatgttgctagatttaaaacccactgtaaatagaaaaattctgtttgaatgaatatatatatatatatatatatatatatatatatatatatatatatatatatatatatatatatatatataatacaatcaatcaaaaaattgatattattggatttttttggttgtaagatatcctactggggagttaaatatcctgaattttcttataggaaccacctcctttgtttcgacacaatattttctcatcaattcaaaaccacatgttctcaagtaattttattttagaatttaaatgttacaagggtaattataagaaaataatcagcgctcgaatcacacaaaatacatttaactttataatataataaaaaatattttaataaataacaccaacacataaatattcataataaaatttcacatattatataagaaggtgcccgcgcatgtgcgcgggctatctttctagttgaaacaaaagttgttcaacctggctagggtcagggatcaccggtgtcgtcgtattcgtcttcgatcggggggctgtattccgtacgcttcaccttgcaaaccacgtcgccactattactgtccttgtcgacgccggcgccttggattggtccattactcagcgccatcaatccagccacagcgtcttgagcggcaagttcgttggctgctcgctggcgacaggtgaactgtaagacatgcatgtctttcacattgatctacttatgtctttcggtgggaggcaacaggtgcccatgcatacgtttagctaattaccattgatcaactgctgtatacattgtgttcatacgtactttatcaggataatggaattcaacggtctcccaggagtcgagcagatagcagcagcagcctccggggaggacaacaaccttcggcctcccaaattggaagccgccaatggcagcgtcctctggaatcgatgcgggcggtcgtgagggcctcccgggggcaggcgtctgctacagcctcccgatgttgaggcaaacggtggaaggaggcaacggcggcggcggcaacctaccctagcgccgccgtaatttttcttccttttttttctttcgctcggttcgctgcatttgaagtggctacaccggtctagacgtcgtttggattagcgtccatccgcggacgctgtttacaggagcgtcctgatgcggaagctgtttagaatagcgtccttcttattttggtaaatactcacaaggaattactaattatttaatttaaatattattaattattataaataaaaaattcggctatttttttaagctacgctcaatttgcacttggcgacatgaatctaaccagttgatctatatttactgtgactctaaccagaacctaactagttgagtgtctttgcacttggtcacattatgacactttttttttacgtacctcacttcgcgcttggtcatattatgactatttttttttgaatcactgactcaacacgtgtacatgagtctctgactaaaaaaaaatgcctattgtttggagagttgcttataagggtaattgtgcatacgtgtatatgaacgtatgtatgtgttatatgttttttttaaagaaacaatatgtcacatgtcatcttgcattatacgaaaagaaaaacatcatgtcaaatgtgaagaagacactgtcaaaggagacaaatagacgatggatgaactgggacacaacaatgattttgtaggttaatgaaaagcacgcaattttttcatcttttcctttcgatcggatgattgtacactgatgaagccgtggtgttctctttttttttaccacaccacgaagactctcccacacgacacaaaatgcaccaacctcgagtcactgacaccccgaccccaccaccaccacccttaaaaatctctccctaatccccaccattaatttcgtcattttttttactgtttcccccctctaacaagttattaattccattatactacacgcaggcacacgtacacgtatacgtatacgcatacacgcctcgcttggtacacacgtacgtacgtacgtactagtagtatactagtatatatatagtacaagatgcgaagaagaaatcgtagccgtctgatggatggatggatggacggtgtggatcagtggaggcatggctcggcgtcggccatctcgacgccgccgtcgccggcggcggcggcgcggccggccttgtacttgtaccacctggcggcgacgaggtatacgaggaggttggcgaggcagacgccggcgaggagccagtagaacttgtggagctggcccttgttgaggtcgtcggcgagccaggggtggcggtcgccggtgagcttgtggacggcggcgacgagcgccgagctgacgaagaaccccagcgagagcgtgctcaggaacagccccgtgctcatcgtcttcatccccttggggcactcgcggaggaagaagtcgagctggccgatgtaggtgaacgcctcgccggcgccgacgaacaggaactgcgggatcagccagaacacggtcatgggcacggcctcgccgccgccgacgcgcgcgtccctcgccacgcggagccgcctcacctccgtcagcgcggcgcacaccatggcgacgatggacagcaccagcccgacgccgatgcgctggagcggggtgagcccgtgcgggttgccggtggcgcgccgcgccacgggcacgacgaggcggtcgtagatgggcacggtgaggaggatggagccgacgaagaagacggtgagggagcccgccgggatctggaaggaggcgccgatgtggcggtccatggtggtcgcctgggacacggagaaggtggtcatctgggcgtacaccgtccagaacatgatcgtcgtcgcccagatcggcagcatcctcgccaccgtcttcacctcctccacgtccgtcagcgtcgccagcgtccacttgctctgctcgccgtccggcgcgtcgttgatcgccgcatggtccaagaacctgaggagaaaaacatttgcaacttttgttaagcttacttgcagaagaacatcagttttcagttactaccaagtttcagccatttgtattgtactgtacatcaagttctttcaggttaagtttcaatcatcatatgtattgtaacatcaagtttgttcagtttaagtttcaatcatgtgtattgtgcatcaagttttttcagttaagtttcaataatatgtattgtacatttaagttttttcagttaagtttcaatcatgtgtgtgtacatcagtattcagtgaagctgcaatcatgcgtgcatcaattttcagttgagtttcgatcatgtgtagtacaattgtcagttgagtttcaatcatgtgtgcatcaatttcagtcaagttgcaatcatgtgtagtgcagagtttattaagcttacttgcaaaaagaaaaaaaaatcaatttccagttaagattcaatcacgtgtgcatcgattttcagtttaagcttcaatgatgagtgcatcaattttcagttaaaattttcaaccatgtatagtttcaatctttgtgtgcattaactttcagttaagtttcaatcatgtgtactacagttgtcactgaagtttcaaccatgtgtccatcaattttcacttaagtttcaaacacgtgtacatcaattgtcagttcagtttcaaccatgtgtagtacaatcgtcagctaattctttcaatcagcatgcaggaatttcgaaggattgagttgttctcttcagagttcagattcagaaacctcatcagcaatttttgcaaacttggtaacttttcaaaaagtttaggcagtgattgcagaaaacatataaagtaagacttttgcaatacttgtgtctatcattgacctattttaattgaaacaaaagctattgcaatgttcttttcacctttgggaccaaagaaaaaaaaaggcaacaaggaggtcgtgtgcaagctaaagcagtggtcacagaaacaagatgcttcacaagaacaagacacaaatccaatcataacactaaaacaattttatcccagttagttgctctgattatgcccccattaacatgaccatctataatctattcgtcaaattaaaatcaccctctcatttcgtgagggaatcgtcgtcagcagctaagtcttccagggcttatctttctgaaaacaacatcgtcagagtttccagccaaaactaaggactaaacaatttgtcaagtgtgtctcatagttggcagtattcttcccatttgcacaagttgatctgatctgtcaagctactaattagtatcaggaacaagcaacatgttttcatgtgatttgatgcaatgttgataataatcatatacgcatctgcggctctatacatccccagataaactctgaagatgtgagttcataatctggagacactgacagatcgaacagagactaaacaaccatgtagactgacaccaacctatcgataagataaaacataatctcataatgtttttattcaaagtgttaatctgacatgactttgattgttactgttcaaaaaaaggagctgaactttatcatgtggaacaccatggggctgaagagttcatggcagggaagttgccatgaaggcattttcttgaactctgccctactatatccgtgctgaggccgactaccatggctaaaatgaatgtgatcacgtgtgcctaactaaaataacagtcatgaatctcgaggtgagtgacacgacaagtgtcgctcgcaggcttaaaaagtgtaattaattaaccacgaggtgtacctgaattctcacatatcaccactgctcttttgacttaaaaaggcggctttttaatctatgcgaacaataataataactacggagggtagatttggtttctcctatcaacctcaccaacataagataactataggggaagagaaggtaacttttttatcgatgcggacaataataataactatggggggtagatttagtttctcccatcaacctcaccaacctaagacaactataggggagacccacaatgctaaaactacactgctcacatgcccctccttccttttctcaagctacttttgcatatggtccaatccatggagatgaatgatccccattgcttttgaagcatcaagaaaatggacagatgtgcaatgcaactccaagtgagccatgccaaaatgaaaggctgatgcatgtgagaaagagaaagacaagagagacagagagaggtttgctgcttagatctccttgtcctgatcacttgcaagatggagattgcctacacaaaatgatacactagctcttgttaagctagttgtggcttctagggctaactttcttctgtttttttctacctttttcctggcctctaactttcggtgtgcacacgtctcggtcctgttcagaaacagtctgctaataattgagacgatatgccatatttttttactagttgcttttggattagctttctaatggcccacaatggagttctcatcatggaatttcttgtacacacgtgtatgtttagtcactattagtaactagtgattcttgaatattttcttagttctaatgcttgatcctactgtactgtgtttgcaatagtagcagataagcacagcttcttcaaggcttcaaagagaggcttaacctctctttgaagcaatgtcactttgatttgataaataatatgtagaaataagactttttaggttatatagtttatttatagagcaaatgagatttgactttcacaagctaactccatgatatggttaaatacttcaagtgataaaaagttgatgctgatgagacatgtactggcatttttgaatggtaattaggttaacttttgttttaacttgcaaagatcaaatcatcaagaagatgacatgaggaaatgacagccgatttactctctcagaccagatgggagaccaaacagaagtactagaatacaagctttttctcttgagaagctattccaaccaccgtactagtccatgacacatgtgagctaaatgctttagctaacaatattcttgcccccactctaagttaatacttggttaactttactatgttcatgtcttaatcacactgaagaatggtgttctaggcttcgctaattattcgagatttatttttcaaaaatcaggtatttttctaataacactttaggaccaaggaatctgaatcaaccttttgctccaaaacgtttccagctatcataaattgcaggatgttgagagcaccaaaacatcaaagcactattgatcctatttt

SEQ ID NO: 82538 - DNA, 2948 bp, Oryza sativa
tttaagagttttaactggtgcaactgtttgacattctccataatcttttattctttctttctgatcaatttatcatcatactgttaaactttaaatttctcttccagtcacattggcaggcagtgcttgatctcatatattattagcttgtcagatctttaaacatgaactctatgcaattgcaatgatgcaaatctagcattcatctcatatcagatcatatcataccacaagtgttgaacatgtcagggtaaaacctgagagaagttaagagaagataaataatgtacaagcattacttgtgtgctgctaccgttggatcgtcagaaaatcttcaggttggaacgaagcaaagttcaggcgacccgccgccgccgccgcgcttcaggaacagcatcgccgccgccgccacgaccacgccgacgacgaaccctagcagcagactcagcacgtgccagtgccacacagccggagacgtcgtagccgccgccgccgccgcaggcctctccccctccgacgccgtggctatcaccgtcgacgtcgacgtcgacgacggcgacggcggcgacgagccactctccttcccgccgctgccaactcctgtcatcttctcctcctccgccgccgccgccgccgacgcattgccgccgccggcggtgacatggtcgccgttgctgccggacatgtcgccgtcgcgattcatctgtgcggcggcggcggctggcggtgactctcttctgtatacgatacggcggcggagagtcgcttctggtctctcttcttgaggcttcgtggggggttgtgggccgtcggatcgggtggggaggcgacgtgggccgtcggatcgccaactaactcccggatttgtaggctgtagcctacgccgcgcctttctgggaaagtggcacacgctttttctttgggagtttgcatgcacgtttgtggggttttttttgatttggtttggagtttggatgaacatgaacacaagttgagtgaaattggagtttttggggatatttcttttttgaaaattcatgggccgggttgcctcgttgggtgtggtctatttcgtaggaaattacaagggaacaatgatgaagaggtttcatactctagttagtttgttcatgccgccaaaagggtagtttccatgctttctcaaaaggacaaaatatagctcggatttactttcttaaaacaaaactatgtagcttcgtttaactatgcagtttcctttctttaaaacaaaacatttataactcacacataacattagtggtaaggatttaaacccttaaatgtatagttgtgtgataattttattattaaatctgtagttttgtgatatttagccttaaacttgtatagtttatgataaatgtattgctaaatttttagttttgtgatacatcatcttaaagaaactttgtagcttggatttcctttctttgatggagggctagtttataactatatgtagtttactttctttaaaaaaaaactatgtagcttggatttcctttctttaaataaagtatggagttattatttttcactgtttaattattttgaataaatttgatttgatggtatctccaactcaacatgtcgaatcggcaacacctattatattcttaacagtattcttcaatatgatttaaccaagtttatttaaaaatttccaaatgcaaattcgatactccctccatcctactagcatataagtatttttagctttgaatcggaacacctatgagcatctccagaagactgagccagtatatcttgatattaacgaagtcaccacatgcacctcaacaccggaacatgcacccaccacagcaactaaaacaactatgagcatctccggaagaccatgccggtatatcttgagattgacgaagtcaccacgagcgcaactcaccacaaggaacctaatcagttgagctatgctcacttcgcacttggtcacaagaacctaaccagttgagctacgctcaatgtgaccctaaccagttgagtgtctttgcccttggtcacattatgactattttttccaaattttttatttataataataagtaatatttaaattaaataattagtaattctctaggaggattaactaaaataggatggacgcgggtagaaacagcgtccagacttggacgctcattcaaacagcgtccagacatggacgctactagaaattgtctggacgctactagaaacaacgtccaccttcctggtgcagtcagaccatcactacgccaccaatacgctaagagaagtatctatctatctattatatactaaaagtccattaaactttctacaaacgctctcaagccgccacgtggcgctcctacaaacgcttctagatcggcacgtggagctttaacatccaaccatcggttttcatttaatctagtggacccattatttttaaccactagatctttattttaagaaaaaacaaatcaatctatctaaaagaatcccacgttactcggccgtgtcccctggacctatatgtccgtatgtccgatgtacgtacatatcccctccatgtccttttctttttccttcttatatacttagattagatgaaaaactaaaaagttcatgttaaccatatgttttaagttgtaaaaatatatgttattttaagttttattctaaatagcgcatctcattgaaacatccataaaaaaatattaataattaacattatagactatatgattgtatatcacaattaaattggacttataattaaaaaagcaatttaaattttgagtagcattttaaaaatttactcacgccctattgtgtaatactgatatatccaaatgacattattaaatttatcaagaatgtattttcatatattctatgtttctgtattcatatattttttttggaaaattaagggctgcaggaat

SEQ ID NO: 82539 - DNA, 7124 bp, Oryza sativa
ttagaagcaccaagaaacagaagtaaaagaaatttttggaaataaacagcaagtaaagttggaggatctcagtccagagttttgaatggatttaagcgtctttcatagaagaaacaagtctcaggttaacgagaaagacatcacagaagcctccatacaacttaagaaacactaagaaactgaagtaaaggaaattttggaaagaaacgggtaagtaaagttggaggatctcagtctagagttttgaatggatttaagcgtctttcatagaagaaacaagtctcaggttaacgagaaagacatcattgtaacctccaactttgcaacacaggtatttacatgccgggatgcaagtcacaaaaaagtatacaaacaagattattaggaagtaggaacacatggtacacccctcaccacgctacaatatcagcaagatattaaagctgctcagataagttttggaatggatagatatagtcctcatggtagatctcaggttaacgagaaaaccatcattgcagccaccaaaaataataagcaaatcgtagtgtaaaaagatgttcacttctatgcattataattgaatagaaacaattgtgagaaagacaatgagcataggatactccaaagggaacaaaacaataaatatgctcaacaacagcagaagaatcaatagaactggaggtgctcagcactttcaggtaaaaatgaactttgtatcatcacttctagcaatattgcttaacaagaagccattattgccagtactcttgaattcctgagaatatgtatgtgtgtatgcatgtgtgatgactgacaggttgccttccagatagatagatagatagatagacagacagacaggcaggaaggcagccaggcaggcaggcagagagagagagagagagagagagagagagagagagagagagagagagagagagagagagaggagaccatttggcaagagtacccggattagaaagaatcatcacagcaccctccagttcccgcgtgttttaacacatgaacatgtcaatgaacttacgaaaacatcgaaaagagcatcatagtaggcttgaagcctcccactttttgaagaaaaagataaatgtaagcgctcactattgtgttcatcatgacacttcaatcttgtataccttggtttgaaaaatcatgaatccttttcaaacaaaaaaaacaactttcaaaacacataagattatctacttgccatgcaacttaaatatattgtcttaaaacatcagataaaacccgtttgttgcttacacgaaatgaacgctttagaacaaaacaactcaaagcaaagtatttcagtaccttggttgtgaagttatctagtattaaatgggggtacgcttctgacattttacccatggccttcctatctttaatatcgtggcgtgtacctgttcaacaattatatccagggttaccaaaagtattgcctcgcaacccaaatcgtacatgacgaagactcagcatacattgataataacacagatatgcactacttaccacattgagcaacccaaaatatgcagttggcccaaatggaagatggcagacgattaaaccatcgggctggccacgatgttcatgcaccaaaacaaggtcggtgatatcatgcgaacggcaagactcaacaatttccgatatcacctgccgaaaagaaactatagatcagtaagatgcacctgaaccaagttcacaaaagcttgaaccgcatttcccaactattcactcctagcaacccaaatctgaattctattcaagcacgcgcgacaaaaagagacaacaacatggagtattgccgaattatacctgaccaccacggttcattctttgcgagttagggaagacgactttgagctcctatcaaatggacagaaacggctggtttagcttcatcatccaaatgcacccattttcaacttatcgagaacccaaaaaaaaaaaagagaagtccacgaatcaaaagccgcaccttgacaaactgagtgaggggcgcgctgggattgcgagaggtggtgagtaggatcttgggctcgcggagcgccgcgcccgcgtactcgtcatcgatgaggctcctcggaactgcatcacaacatcacagggccaaatctaaggcgacggggagcgggagaggaaggggaggagggaaggggagggagctggaccagcggagtccttgtcctcgaggtcgatctcgcggcggagggcgagctcctcgttgcggagctcggtggggatgggcttcccctcgtcgagcgcctcccggaggcgccgcttcttctcgtagtgctgccgctccttcccctcgaggctcttgcggtacaggtactcccgccggagccgcgtgttccgccgcagcatctcgccgccgccgccgccgcgtgcaaaaccctagtgaagtggtcggagcggcggcgataaaccctagcggcttcaccggcggcgacgccggacaagggcacgtttatgtagacgcctagagggggggaatgcgtgggtgtgggccttgatgggcttggcccattaggcccatcatggtatatgggccgagcccataatgtcccgcttcttcttttttttttttaagacaatgtgtcaatgtcttgttttttttgttgtccaccccataatatatatagcaacatagttacgcaaatgaaacatatcataatactggagtaaatctatacatgatgtgtctcattccatactagattgctatattatgagacgaggaagtagtatgattttcgtacgagcgaaaattgttcaacaaaaagaaaatcttttgaaacactaagtctatgttttatactatattttcccaatttttacttccttattttcttcgcgacgtttctcggatggttaaacggttcgttttttcaaaaaaaaagaaattatataagaaagctagtttatttttaaaatttttatatctaatatttatttaatcacgtgttccgctccttattttaagtacctgcccaaggaaaggattcctagcccaccacctattgtaagtgcgggagtacaagtgaattgtacttcttttatatagttgaaaaaaaatgttcaatgaagagttggaattctcaaaaagtgtttcgtttgagattcgttctaccaaacggaatcgcaaattgcagcgaatggaatggaagatcaattttatttgaatttgagcaaagccatcgtcaatcagtgagaggcacacacgttgtttctcccacctgcactttaatctatttatttactgacgggtggggccaccctcgcacgcccattaaagcgccacgtcacgcctcgccccagctcagcctaaataccatccatacccctcacccccttgcgctcacacccacccaaaccgagggcattatcgtcattttaccgcagggtcccaacgaacaccaactcattcattcactcgacgaaatttctcccatttttaataaaagcttccatccatccatcgcggttgcatccacgagctcgcgagcggagattttcccccacgatttttgctgttcatccgtgtgggggaggagagattccgcgtcgattggtggtcggatcggagcgaggagaagcccccgtgttcttggctttttttcccccgatcgaatccggtggaaagcgagcaataaaaaccacttcttttctttttcgtttctggttttctttttcttgttgggtttctcttcctcctgctcgagtttgatctcttgattcgtgaggagtgtggccagatgagcgcgagtttcctcgagatccagccttcggagctctcattcccctgtaagtttttggcccagatctcgcctccttcccctccccctgctcgaattgatcgatgtgagtcgttgatggatcttggtcaaagctttggatcttgggggtggaagagaggctgtttgctctctgtttgatccgtgtcagcttgagattcgtcgagtgctgtggtcgattcggccattggatcgtggaagagagaaagagagagagagagagagagagtgtgtgtgtgtgtgtgtgtgattcttgtggtggttgctcttgctgctactgcatgtgtgtctgccttgtttgttttgctgggatttgtgtgagctaggtctcgtgtggttggttgatgaatcgatacggggactaaatttggtgatggcctgcttcgcatttgcgtagaatcatcgtttggtagctgtctgtacttccaggagttttgggatcttgtcagctagtatgtgccttttgaccatgctgatctgctcctgatttgtcgggaagctcgaatgcaatgtccatgcaattcttcatggttattgggatttgattcgatggcagttataagtcttagattgatatagcatgcttagtatgttgatttttttttcatttttttacttaagtttgttgcttcttttttcattttgtcctaaaatgatagagtatgtctttgtagcgaatgtccggtgggttctattgtgttttttttttttttttgcttcagatattctcttgaaactaatttactgtttcgtatatgcagttgaactactgaagcagagctcatgctccatgcaactcaccaataagaccgaccattatgttgcatttaaggtaatctacttgagatgtcacctctcacacgtttctagttgtcaccattcatttctgaatgatttaaatctgttacctcatccatggctggcaggtcaaaacaaccaacccaaagcaatactgtgtgcgccctaatattggcgtcgtattgccggggtctacatgtgatgttacaggtagctgccactccattacatagtgaaactataggataataccagtacaagtctgtttaagatagatagctcagatatctatttagaagtctgcttaacatttggttttattagtgacgatgcaagcacagagggaggcacctccggatatgcagtgcaaggataagttccttgttcaaagtgttgcagctgagaatggtgcaacaactcaagatattagtgcagaaatggtaactactttgcagctcttcattttgtgttgtttcaatcaatttgctatatgcatctgttacaacatctcatcccttatgtttttattatgataacagttcaataaggtggcaggaaaggttgttgaggaattcaagctacgtgtagtctatgtgccaacgactacatcctccgcaatgcctgaagactctgaacaaggaagttctgctcggccatttgcacaagaaaatggtatccataattcaacaatgccacaacctgtaagtcgatcatgtttcctcatttctttattttgtgctcttgtttgtaatcagacttcggaggatctattttttaattatttgtaccgatgtgcaacatttaggtttttagatcatctgctgaaccaacaaaggagaggcccacagaggtagtctttttatcttacttttgtagttagatatttaattgaagaatcagtattattatagaaaagtattgcaactttctagatgaactaagtgtcaaataataatgttggaattatgtgatgtgcccttgttcttttcgactttacttattgtgctcaagtaactaataatgcacagcttatgataacaaagttaagtaaaactggagataattgcagagcataagcccaggcatcctggatctgagtatatgctgtagttgaattgcaagtgatcatgaatcctgactgccgcgcagcatgacattttagtgtttagtatgctttcatgagaccaaaattatagcttttgtttgctttcccagcatgcccctctttaaaattgaattgatgagcacaattacaacatatatgtggagatgcgacatgtacttataagtaattcatggatggcatgtcaccacatatatgtttattatctcactgaattgatttatgcaaaatatctgattacttgctaatatctaatctgaaagctagaatcaacttagctttaaattcagtactacacaagtcaatattttcttttggaaaaccggggcgccttggttgtttatgattcatatgaacttgtctatttgctgcaagcttttccttgctttagccatgaatgacagagtgcatccaatgagtgatgagcttggcacacaggaaaatataggtcatgatagtaatcaggcattttacgtaccgtatgagataattcagtgataatagaaaagccaaaatacaggaacaggagctacatttagttgttagcatgtctttatattccaaaatgcttttaagatttcttttgataaatcacttgttgatgatttatattcttatcagccatcgtccatgatctccaaactaaatgaggagaatagggttgctattcagcaaaaccagaagttacgacatgagctggtaagtacttcaaccattatgaaacagcactagtcgtaccatcattcaaaggaaataaataattgcgatcacaagaactgatggttgacattgctaaaaggcatatcaagaagttgctgctttcttcgtacaactggacttctactttttttttttatggactgtgaatttcaaatttgtgacccattggccattgtttttttgttctgcttaattcaattaaaccaatcatatcaactgtcatgtgatgactagaatctggtgactaagttctcactgacaaatccagatttgtcgatttggagacaaaacaaacatgcgcaatacaaatccggctgctaaattctgcacttgctcaatgctgcattttatctatagcttgcacacgcctgtgaatttaatggattctacgaactgaacattgtgttgatgaaatctctatttatctttcaatcaggagctcctacggaaagaaagcagcaaaagcagtggcggtttctccctcaccttcttggccatcgttggtcttctcggcatcatcgtgggctacatcctcaagaagacatagaagaggtagaggttcccaacaaaagttatactcccaggaaaggatacccctcatattggtatgccgcgcatcgtgtttttttccctcctaaaaggagcacctgtcctaa

SEQ ID NO: 82540 - DNA, 6674 bp, Oryza sativa
aaaaattccatgaaacaggacatgaaatttctctgaagtttcgactagatagcagcagtagtaggtgtgagacagctttctctccacaggaggaacaaggtgagtgatagatagactgcaaatgtactattactcataaaaaaaacatgccaattaatcgaagtcttaaatggccatttggcatagcctgccgaccagcctgatgagtcctgatctccaatatcttctgactagttttatctttcagaggatagtgttctgtttcagagtctgcatttcagtgcagagcatcaggcacaggatgacatgttcatcaggattttcaggatcagatggaggtcagtagcagaactacaggaagcatagtccgtgacacatgctgcccgattagaatacatgcaattattggctggtcactgccaaattttctgtttgtcttctcctatatggaagtccatgcatggttgttggttatcctagatgttatattctctagggccatcttgtcttcaagaaagggatttttcgaaaaacagttcaattctcgtcggaatccagaaaattttcctcttgactctcccagaatctagaaataaaatctcttaattctcgtatccggaaaaaaaattccctaactcttgtcggaacccaaaaatttctcccttatttcaccggctgtcgtagccgacataccatttgtcggcaactattatagccgacatcccacttgtcgatgacccaattgatagttcaagttagtaccatgatgaataggtgacggatagaaaccacggcgagacggatccaagccctagaggaatatggacccgtccgcagaattcctacgcggttagcaataccatagatggtactgcatctaagaaacacaagacacatttgcggattggtaaataactacaaatgcaccaaaatgcattcattggtgtaaggtgaacatcatcatgtgacattgcaacttgggagaagatgataaaactagctggagtagggggacaagatgaacagtgcaatctgaatctacacccaacttgcaaatttgattggacccctcaatgttgtacattaaaatctataaacaattctcctcaagtcttatttttttgttgtcttcctctcctatggttaaaaaaagttgggaacaaccatggtcctatatcactacatcatcagtgtccatgcaagtttgacccatatatactcaagcaaccaatggctgaaccatgtgctaattaatctatgattatcacaagcaaacggtgcaattaggagttgtttaatactaataaataattaatcaatcaattatcatatatactcaagcaaccaatgcccaaatcacgaggtaattaatctataatcatcatcagaaccaaattgtgcattcaatcaaacaactactacctctgtcccatataaattgtaatttatttagcatatattaaattttgaaaagaaagactatgatgcatcttattaaatggtgcataggtaagaatggaagcgtagttaagggtaaaataaggagacatttaaatggaaagtgattaataagatcattaatactttatcatgacaattattttgaaacaaattttaaatatgggacagaggtagtataagaaaaaatcatcatcaattacttaagcaaaaaactaaaagaaattagataaataattacctgaattgcttggtgtgggggagtcgctgcttgagcttgctcttcttggaggaggcggccagctcgacctcggcggcggcgagcttgccgacgtcgatgtcgtagagcatggcggggtcggaggggagctcgaggcggcgcttccgccacgcggcgacgacgacggcggcgatctgcgtcagggggctccccaccagcttcttgaacctgtacctccgcgtcccggcgaggaacacgacgagccccgccgcgatggcggcggcgcacgcgccgtacccccacggccggccgaggttgtcctggacgtagacgagcacggtgacggcgagcagcgagccgaggctgatgaagaagaagaaccagttgaagaaccgcatcatctgcgacttctcgccggagtccgactcgtcgaactggtcggagccgaagccggagacgctcgacttgagcccgccggtgcccagcgccgtcaggtagagcgccaggtacagcacccccatctgcgcccccgtcgcgcgctcgcacgccgccgaccccgccgcgcacgccgccggcctcagccccggcgccgccgtcgagatcgtcaggatcgtcaccccctgcacgcacgaaattatttttattaatttttatacttattataattaattgaattatcatatgatgaaaaatatataagcaaaaaaaaaagttttcaatcttggcatgtgtagtacatggagtttgtttaatatttaaattttactaccacggaaaattactgacattttgtactgtaataattaattagtcatatgaaaaatatgtgagaagaaatgaaattcaatcttggcttgtgtagtattaattacatgatatgatggcagctgctggtgatggttagtccagatacttgatttatttaacaattgattaatactgttgttgttttggtgcatgttattttcacaagagaatctcccaaaaaaggtttgatccttttttttttactgctccactatgcatggtaaaaatccaaaaatggagaaaaatactggatattttctgctcatcgaattaaaataactaaccaaccatccatccatccatcctcaaaagataaaaagtaaaaaaaacttttcaagataaaaaaaaaagcagagtcagatttaaaaacaaaaaaaaaagcaccatctctcctgagttgccggagagctcagctcgctccggccatggcggccggctcagctcgcactggtggcacgaacgccaaagcagttcgcacgaacgtcaaagcagtgagcacgaacgtcaaatcaggggactgaccgaggcttggacggcggtgaagatggcgatggtgaggtagcggccgaggaaggagtcggcgacgaagccgccgaggaggcagagcatgaaggaggtgcccatgaagttggtgacgacgttggcggcctcggcgttgccggcgtgcatcgtcgccgtcaggtaggtgaccaggttcacggcgatccccagcgtcgtcagccgctcgttcagctccgccaccagtatcatcgccgccgcgccccacctccccgtccgcgacctcgccgccggccgcccccggtagtcccacgcgtcgcccagcacctcctccgccgccgcctgcgcattcgtctccggcaacatccccaccatcttctctctctctcttcttcttcttcctcgccgccggcgacaaacgcaggtgagagtgagagggaggaggagctcgtcggaggcgagtggtggtggtggtgaggttggaggggaggtggccatggctatatatacttcgccgagggagagaatctactatgctacccccaggtgggggcccacgtgtgggggtgggcctactggaccgtggtcgttaaattagatggtggtgatgattgattagtggtgagattaagcttgattaatcctcacttaccgttgggttgggtttttgtatcaacaaggggaagatagatagatagattatagatagatatatactccatacgtcctaagatagcaaagtcttatccagattagttgtcttaggatataatatattctgtcttaaaattatgatttttaggatggagtgagtagatggatagatagatagatagactgactagggatataaccttgaaaacaaatcatgcctggatcagggcactcactgcttcacttggttcagagtgaaattggacactgcttcacttagctcagagtgaaattggaggcaactatgaaaaataaggattatggatgaaacttggctttatggtaggatgggtttcacttgcttagcatgtgtttgatttagagataaggtgaaatgagttagacttatccttgttttttttatggtggtcccattatcagtttgccatgagggatggagtggttttgtcttttttaggtatgggaggttatggcccacatgtcaataatagagagtaaatgtgttggattgatatgctagattttaaggtgtgaagctaactcggatttcgggggaatattctcgttacggaatcaaccttatcccacctatcttcaaactaaacattttgaaaattggttcgatccaacctgacctactctacctattcaaccaaatacatacatgatagggttatagatggaattgagtttactgtagttatttaaggacataaatggatgaattaaataaaagtgaaatgttggttttgtaagaaatgctgataaataacttattttttaaaatatgcgttgtttaagtagcttgagaagtgacatatcataattaataatccttaagaggaaaagaatggccctaagttgtggcagtagttatatattttttggatagaaaaaatagttacatgtttttgtttatatggaatacacatactatctacaagtgtgtcttccttaattaacaattactaatgaaatgaatatcttgtgctagagcgtattcaccaataatacatagtagcaaaaaaaaatgttatagcaccttctttttttttatagtaatgttatagcaccttcttggtgaaaaagaatatgtattacatcaccttgaaaagttatgcaccctccagttattatattattatattttatattaataatgatgggataaaaaacgcataagcattcaattactattggtgacttctaaaatcataacagacatgctagatatattcttgggtttgaaagcacttcttttcccaagtacaattccgacgtatagatgcatacacatcacactcatgcccaacgtatatgttgttcagattcgttaatatatagaagtttttctagacggatggagtacgtctaaacgagattagagaggatgaaataggaagataacacacaaatgttattaagaacaaaacattgcaattacgatgcaattaaacatcatacacctcaagaagaaaaacaaaaaacaaaaggagtggtcttacgtgggagatcgaacgatcaatcatgtcacacacagtcacggacttggatcgatttgggtctcttctagacgctatcagaaaaaaactagaaatttcgttacatttacgttaattctccggtcataattgggacaagcggtagttaagttgttgtaatgtgaaggttctttgagataagacacctacaccattatttttctcctagttaagccaaaaagagtaagacaggaggatggggatttgcctgcgcgatgaggtggggcatgctttgtgtgcgggcgctgggcgtttggagtttgtcagtgatgctatctcagctgaagcaaaggcgtgtttggcagctttattagccattctggcgcaaggtgtttcggtggttgatattgagtctgattcggaattgttggtgtcggcaatcaagtcctcttcgcatgacttagctactggtgctacaatcttcactgagataaaaacggttctccaatttcagttttctagttttgatttctattttgcgccacggtcttataataatgttgcgcatgaacttgctcgacttggtgtgagttgggatccgggtcaatcttatgtgtgggttgaccccctcccaaggtttgtaagggccaaagtgattcgtgattccactgaatccaggtattaataaacaacccggtggtgaagttcaaaaaaaaaaaagagtaggttttaatttttcacatgtttttctaattatttttctggtgatgataatgatgcaaaaaagaggcaatatacaatcggaatgtactaaacaagagtcatcgatcaattggataggatcgaataatagtaaaccaatgttttttttttcttgtcaatgcatgtaattatcgaataaccatataaattcctttgttcctgtaggatcgtaaagggctttttccaccccaaaagctagccattgaggtgaggggctcccccacttatatcttaggtcatttgcccttccacaaccaatgtgggactattcaacaatccccccttcacacattggtgtccctcagcccttcaccgccccttcaccgtatccgggcccccaccggcccacggtccatcaggtatacgggccccgcaggcacccacggtccatcaggccttcacacgtgtcattgtaaaatcaaaggtgtttttgattattattctgtgatgaacgattgggcattggagattattggttttgttatttggaatttattcacgaagtggttttggagatgattggatttcacaggtgaatatatatgtgggaccggtcagaccgggcttgtgctgccggtcagaccggcgtgtaatgcgcggtcagaccggcgcagcctgcggtctgaccggccgacactgtgtcggtttcggtttcggattgtttatttggatatccgagtttattccatgattatgacttctagatggatactatacgtatgtaatactattgtttgctgctaatgagtcaagttggaaagggctgcaggaat

SEQ ID NO: 82541 - DNA, 3748 bp, Oryza sativa
attcctgcagccccatgttatttaaaatccttgacaaattcacatatcctcttaggagtactattggccatcgtttcaaacctctaatgtaaaaaaaagtggtatcgtccacattttaaattactcaaattagtacaaactaattagtacaaaaataaattgtatattaacaatatgtcgtatgaacaaatttaaattctctgagatttccaaatttaactagtacttactgttatgctaaattaattagtacaaacaaatttaaatagcgaaactaatagctacttactattatgctaaattaattactacaaacaaatttgtacaaaatttgatttgttattatcaagtagtgcactaattgacttccttatttcatcgacatgttgactaaaaaaaatggaaaaggcaaacatatcctccactttttttaaaaaaaatgttaacataccctccaacatgttatttaaaatccttgacaaattcacatatcctgcaaaattgaaacaggctgtcagtgtgaaacaggctggtggaagatatactttgccattcttttctccttcttgagggtgtaactcttccttgattcccatctcgactaggtccatccttgattgcagaccatctttagtcttcttcggcatgtccaacaatgttccaactatgttgtcaaacacattcttctctagatgcatgacgtctatggtatgccgaacctccagatctttccagtacgggaggtacttaaaaaatatggaatgcttcttgaatgggggagggagtttatcatctggcttcgaactgtcatcttgcttcttactatcccctcccttcgtattcttctcgggcttcttccgatttgtcccctttgatggtttcttagtcatttttccaaactcacaaacaattttctctatcattgcacacacattttctcccgatgtaggttttggtgcaggatcagtctcttcagtaccatcgaactccgccttcatcttgcggtacttgtgatttgtacgtaggaaccgccggtgccgcatgtacacaagcttgttggaacccgggagatacctatagtacgttccattcaagcagatcacacatcctgttttacctttaatttgacctgaaactgaaaacattgctggataatcgttaatggtcacgaagatgatggccttcactgtgaagtattcccttaagtactcgtcccacactttcaatccctctttccataaatcagccatatcttccaacaatggttcaagaaatacgtctatatcaataccaggttgatggggtccctgtatgacgatacagagtagtacgtattttcgtttttgacaaagctaggtaggaagattatacatggtgagaagcactggccaagtactatgtgaactgctcatgtctccaaaaggattaactccatcagtactcagggcaaatctaatgttccgtgggtttttagcaaactctctatactgagcattaaagtttatctactgatgagcatctgccggatgtcgaatcatcccatccttcttgcgcccttcttcatgttagcgcattagttccacatctcgcgggtttgagtatatccgtttaatgcggtctttgacaggaaggtaccacatcacaagctgcgggatttttctctgtcgtcccttagttgcttctgagggttctaggccagtattgctattcgacttgtaccggcttgcaccgcatgttggatattcatctaaagaagcgtactctttcctgtatagtatgcagtgatttacgcacgcatgaatcttttccacaccaagtgaaagggggcatatgagtttctttgcttgatatgtgctggatggtagtgagttaggcctcggtagcattttctgcagaagttctaacagactgtcgaaactggtatcagaccatccatgtctcgcctttaacctcataagttcaagaactgactggagtgttgtgaactcactgtcacagcccttcgactcatcgtacaaaacttcctttgctgccttctgtaaagcttcaaagtaatttaaccctctagctgaccccatcagcacctcaggttctgcatgacgtaacatttcctctaggtcgattttgtcctcaacagaaccatcgtcatgcaccatgtcttcaacttgtgtcggaactacattttcatgcccgtccacttgttcttcaccatgacgtgtccatatttcgtgcttgtccataaatccacgagttactaagtgctccttcactttaaaagcatcgtcaaagtcccaggatatttcattcttacagtcagcacatgaacaaattatcttcctcatattgttcttctcagcgtgtgccttggcaataccaataaatttagccacttcgtttctatatggagacaaaaacctcggccaatgatacatccattcccgactttccatatctctaaaaaaaatatacgtaaaatatttgcacaattaataccaaatttgtagggtttattgaaaaaacttatcgctattcaaaactaattaactaaaggttaagtgtaaagtaataaaaaatcaaagtttatttcaattttttttacacagacatgccaaattagtacattaggaaaatctaaaaaaatcatatcatcggcatattacaaaatactataactattttttgattgcaccgaataaatagacatttaaaattttattctctctctatatatgacaagatctagatctagatctagaactaggtggtggatgtgatagcaaaaataaaaaaaagagaatttatgttaccatattaaaccactacaacaagaggcatcaagtattacacatacatctaacatcaacatatgaaaagaaataaaattaaaaaacatggagctcttccttcacaattttggatgcataaatccatcacaaattaaggtctaaaagcttaaaaaattgcatacctagtgtggaaatgagtagatctaagtaccgtagaaaattcccccgaagatttgaagttcaaaacctcccccctatatttaagtcactttaggagagagaaacgtcggggagaatgaacagggctcggggaggaaaaagactatataggggtatctttgcaggcgggccatataagcgtcgcctgcgaagatcgatcttcgcaggcgcctgcaaagatcaatcttcacaggcggaccgccccctccaccccaggtactttttttgccggcggggttttggctccaaattacatgcccgcctgcgaaaatcaatcccctacgatgccgaaaatgagttttctagtagtgttctctagccaaattataatacttggtcaaaactaatgaacatctttttttcatctaggccataacagttggtactagtttgtgtacttgtgagattgcaaatataggagtatatatgaatatatagtcttggttgtctttgaataaacaaagctttcgcgtaaaaaaaaaacacaaagcttgattaactagacacctggcataaattgattggttatgtatgacaatacgagtccctgagcgactacaaatacctatgcgaaatctccaaaccgcgtcacattccaaccccaaccacgcctcggatcaaaataagaccagaacaaaaaaaaaccctcaaaaatccttgtagaaaaaagagtcgaggactcagaaagggagtagagaaaaagaagccgagagatcatgcgctgctcttgcatggtctgtctc

SEQ ID NO: 82542 - DNA, 3313 bp, Oryza sativa
  unsure (1)..(3313): unsure at all n locations
tcaggtcgggggcggggggggggngggggggctgagtttgggtggatgggtgaacttgctagcttaagattgctgttgggcgagtttggcatcacaagttccaattgaacgtttaccaggagctcgaaatgtttcaaattgggaccattgtttggtttgagtcgctacttcgatgtttcagggggaatgaatttatcatttgtagcgtatgaacaaccatgtgtaacttcaaattttgtgcactacaattacaaggaaacggtgttctgtttttgttgtaacttgtaatataaggtgtgtagtgaagcaattaggattgaacctgctagcagtgtacttataatgcaagcaatcggtggaacatgtactgttgtcataagttgtgaggcatcgaatcgaatttgtactttgcagagtcattgttgtgcggttccgtgtacctgttgagttgggaagctctgatctttacaatgaagtttaaatttttcagtacgcccgaggtttagttattgtgttgataataacatggactagatggatttgatagtattgagtcatcaggtttaatggttctgcttcagcaatgtgttatgtgcttcattacaagattaccattgcatgtgatgtgtgtaaaaaaacataatttttggggtggtatttgatgtggtttctgtgttgctttgcatctttgtagaggcaaatgtcagtggtgcagatagagcatgcagaaaccatggaaagggggaagcccaagcctggtggcttgagtgaccctcggttggggactattgaccagaagatcaaatgtgagacatgcatggctgggatggcggagtgcccaggccactttggccaccttgagcttgctaagccaatgttccatatcggcttcatcaagactgtactctccataatgcgttgcgtctgcttcaattgttccaagatccttgcggatgaggtacatggaccccacttctcgggtttggctgttttgcaggactttgttatatgaaaaatatcttaacaaaggaggcaccattgattttatgctacacatgctaaactggaactgaaccctatttattctgattcctgactattcatggaaacacagctatacttgtaatttgccatttttaactctgttatgttttgcatgttttgtgtttgcaaactaaatctggtaatatccttttatgttacactcgtttaacatgtgaaaatacaatttttttttgcgacttacttttccccttctgttgtcctcttttttactgttaaggcaaaaaccggaagatgcctttgttttcaatgctggacatgctaaactggaatcatattgatataaaatgtttattcggactatacatgcaaacgtaaatcttattttatctttgtaccggatctagctcttacgttttccatcttttctcaactctgagtttatttatcaatgggtgaatgcttttgttgcaggatgataccaagttcaagcaggctcttaaaataaggaacccaaaaaatagactgaaaagaatatatgatgcttgcaagagcaaaaaagtttgcgcggggggtgatgacctcgatgttcaggagcagcaagatactgatgagccagtaaagaaaaggggtggctgtggtgctcagcagccaaatatcactgttgatggtatgaagatggttgcagagtttaaagcaccaaagaagaaaaacgatgatcaagagcaactccctgaaccagtggagcgaaagcaaatcctctcagctgagagggtatgcacacaatctttactcaggttcaatacattatttttaagaatatccatttaactatgtggttcctgtttattttgtacttaggtgctcaatgttcttaaacgtataagtgatgaggactgtcttctattgggtctgaaccctaaatttgcccgccctgatggatgattttgcaagtccttccaattcccccaccccctgtgaggccatctgtcatgatggatacctcttccagaagtgaggtgagttatatgccacacttttttttaaccttcctactggatgattttaagaatgatgcaccttcatgaactctctgctattctttacaggatgatttgactcatcaattagctatgataattcgacataatgagaacttgaggaggcaagagagaaatggggccccagctcacataataacagagtttgctcaattgttgcaatttcacattgcaacatactttgacaatgaacttcctggccagccaagggtgagcagattacagtcgttttgccattttacttgatgcaaataagttatcctgattatctttttgttggaattttcaggccacacagcgttctggaaggcctattaaatcaatttgcagcaggctgaaagcaaaggaaggccgcattagaggaaacttgatgggaaagcgtgttgatttctcagctcgtactgtcatcacaccagatccgaatattaacattgatgaattgggagtgccatggagtattgctttgaacttgacatacccagaaactgtcactccatataacatcgagaggtaaaaaaaaaaaacatctttactgttattgaggcatgatcacagttctttaatgatcacttacacctaaattcaatgatctcagattgaaagagcttgttgaatatgggcctcaccctccccctggcaagacaggtgcaaagtatattatcagggaagacggtcagaggcttgatcttcgttatgtgaagaaaagtagtgatcagcatctggagctgggatacaaggtgaataccaactttattgtagaatctgctttactgatgttcatatgacaatattgtcttctatattagtcccctcatttggtgttctatttcatcaggtggaaaggcacctcaatgatggggattttgttctcttcaaccggcagcccagtcttcacaaaatgtctatcatggggcatcgcattaaaatcatgccgtattcaacttttcgcctaaacctgtccgttacttcaccatacaatgcagattttgatggggatgaaatgaatatgcatgttccgcagtcatttgagaccagagctgaagttctagagttgatgatggttccaaaatgtattgtgtctcctcagtcgaataggcctgttatgggtattgtccaggacacgcttcttggctgtcgcaaaattactaaaagagatactcttattgaaaaggttagcaagtctgcacatgataccttaattagttcttttctgctcagttatgctcatcattccctttttttctccagga

SEQ ID NO: 82543 - DNA, 8774 bp, Oryza sativa
ctagagtcgacctgcaggcatgcaagcttaattaattactcgctccgttttctaatagttacggttgttacttttgaacgatcattcgtcttatttaaattttttatataaatatataaggtataaatcatgctcaaaatacttttagacataaaataatttaaaagataaattataattagataactttttaataaaataaatcgttaaacgtgtgataaaagttaacggtgttaccttttataaaacggacgagggagtaacacatttttgcacaaccaaagccggacgagaacgagtgttgttgctaccagctgacgtcatgagaacgacaaattaaaattcgattaccgtgtgctagggccctgtgtgctagcacacatgttcaatcctaagggccggatacaacgactgttttggatatgctcgtacgcattcatgaaatatgctgctccctctttacatttagggctttttttcatgggactaatccactagtccttccatatattctagtttttttagtctctaagaatctaatctaaatataggtgactaaaagggactaaaagtgtatattgggactaaaatccattaatccctctttacttataagatctaaagcggcagcctttctcttctctctccctcagtccacatgactttagtctttttagtccctggattcaaatggggactacagtttttagtccaaggactaaagtatacagggactaaataatccaaacgggaccttaatttatgtatgatgatgtttagttcatttaaagagagtatatatgctctttggtcatagatatttaatgttaggataaagttttattaaacttgtgaaagattgatctctaattttatattagaataaattttgaaattccaataaatttatgatataacttcccgagccaaatctcaacatgtccataaaaagaatttaagcatctaatgcatcaaagtttaaaaggttgacagaatctttctctatgcgtcaaatatttataactaaaaagagtattagcgctttctaaccagactttgcttaatggttaaaccttttccagttggttaatttgaatttatatatacggatctatatttcaaagtgatttcaaataaaggattggctactattaaaaaaaagaggagactttggagggataagacatccctccaaagtccaaacattttttaagaagaaattgtgagcgtccacccttgaccctaccttgaaccctaaaccttaaattgttgagtcgctgtcggttgccttagttcattagaggcactgaagctagaggagaacgagctctcgcacgaattgtgaagcattccctaatgtaagaaaactacaagattatagctagcctccacctttttttttttgttaaatgtgatgtagcaattccgtctaaatgatgttggtggctgttaagttgcaactaagaatacaaatcacaagaaatcaacggtcaggattaatagtgatttttttaaaagaaaaaaaaacgtcctacagaagaatttaaggacggtcaacctaaagctttgacctttcttgttttgagaggagggttaaatttgggcttgtaacaggcctttcctaactagtcaggttaccaaattgggcttgggcctggccacgcactggtgatttacattagggcccgttcaataggtctttacctggcccattaaaggcccatgacagacgtgtcttcctatctgaaaagaagattgtttgtttttagaactgaaaagaagattgtcacttagcccaaaagttattgcttatcacccaacgttctaatacttaaataaaaaaatatatttaagatatccatgtcaataatgaaaatatccatgtgaatattaacatggcatcccctcggtctcttcattttctctttagataatggataaaccccgacatttgctctaacagaatctatagccattcttgctctccatcatataatgtataaaattaaagtttcagaaagaaaacacaacatacaatttcacctatgcctcaaattatatgtatactcaaattatcttttggtgtatccgaataatgtgttctctagccaaattataatacttggtcaaaactaatgaacatcttttttttcatctaggccataacacagttggtactagtttgtgtacttgtgagattgcaaatatagataggagtatatatgaatatataatcttggttgtctttgaatacacaaagcctagttaattagacacgtggcataaattgattggttatgtatgacaatacgagtccctgaacgactacaaatacctatgcgaaatctccaaaccgcgtcacattccaaccccaaccacgcctcggatcaaaataagaccagaaaaaaaaaaaccctcaaaaatccctgtagaaaaaagagtcgatgactcaaaaagagagtagagaagaagaagccgagagatcatgcgctgctcttgcatggtctgtctcctcctcttcttcctcctccacctctccgtctgccacgccaccagccgcaaccaccgccgcctcttcgccgccgctccggccgcttcgccgtcgacggcggcgctgtacggcgacgacgacattaccgccgccatggtaagcatgagtggagaagtgttcttggttaataaattaattagttggattcttgattttgattatcttcgtgtgcgtgtgcatgcagcacgtgtggaggtctccccggaggtacatgcgggcggcggcggaggagcagcggggatcgccggcgccggcgccgctgccggacggcgccctggggctgcagcccggcggcgtcgagggcgcggcggcggaggcgaggacgacggaggaagaggccgccggagccggagccgcgatggcgccgttcccggcggcggcggacgtcggcgggaaagatgatgacgattccggcggcggcgatggcgcggcggacgacgccggcgtcgactacgcgccgcccaagacgcatcctccgtctcacaattaaaacttagtcgatcgatcgtctcttgatacgaagaagaagctagacgtacgacgacgaattcgaagatcgatgcatgaggacgataagttccatgcatgtcgtaaagtatatattcgatcgtgtctcaattaattagctagctttatattttgcaagagttgtcgtaaacaatctctctctctctctctctctctgtgtgtgtgtgtgtttaatttgttgatcgtacgtgttgtgttcttcattgtgtggagtcctatactccatgagaaataatgaattttggcaaaccttaggaagaatgaaagcaaaaaggaaaaaaaatatatagatttttctcctacataatcattctatcccaaaacaaattaacttatgactgtttgtgtgccgataggttaacttattttgggacggagaagtaactaaggccgtgtttagttccaaagttttttttcaaacttccaacttttctacacacgcaaacttccaatttttccgtcacatcgttccaatttcaaccaaacttccaattttggtgtgaactaaacacagtcgaagtagtaattgggaaattggaaaaagtgtttttctaaatacaactaggatggggatgatactaatcttgcaggtctcatggatggatatgaagttgatgaattgactgaagttgatgatgattggccatgaaaggggctagctagctggagtagtaggatccaggagctaagccaagctaagctagggttttgaaaactagaagccttgggaatgttggagaagacaagcatagctaacctaagctagttttacccccttcgttgcgacatgcgtgtttgaatgagctatataaccctctggttagagcaggtacaatagcaggctataagccagttgcaaatatattttaaggagataaatcaggagagagaagaacagcgggctacagatttgtagccagctgtagcacggactccaagacgcagtgtgtctatgacaggtgggactagatattaatagtgtaggttgtaactattgtatgaatgagctattagattggctatatataaattggagccagtagttggctatactattaaacttgctcttagtggttacaatgcattcagagatgcatggcaagttaaagaagttgcagacttccatggactagctagctatagctagtatagtagcttcattccaattttccaattcaccattaagtatattcgtagttatctccactggtaatttttttcactaattactgtgaaatagagaggtgtaagctaatgtgaaagaaaacaagcaatgttgtggctttatataacactggtggagagatggtttgtagtcccggttggcaacccctttgtagtcccggatttccaaccgggactacgaatcccggttggtgttaccaaccgggactaaagatagcagcacagtcccggttggtcaccattttttttcttttttttattttcattgtttctttccaaatagttgctgcttcccaaatctccccaaatatcccaaaatcaaagtatcatccccaaatcaatgaatcattcacatcacaaattctcaaaaaactacaactcaaattcttaaagaaatacatcacagatccaaacatcaaatacatcacacatcatatacatcacagatccaaacatcacagatccaatgaatcacaagtttttagatccaaatgtatcaaaaatttgggaaaaaaaaaagaaaattgtgcttccgcagaggagagggcgccgccggccgccagctcccgccatcgccgcgctacctgccgctgcggcccgcggccgcgctccctgccgcccacggcccgccgccagcgccgccgccgcccgggcacgctctggtagaggaggaggaggagaggggaaggagaaaggggagaagagaagactctgtggcataatgccagatctgatctgaggttgttgtttatgagagctagggagtagagagagagaggggaaggggatggaacgataagatcgagactctgtgccgcgcacgggaggttatatttttagtcccggttgtttataccaaccgggactaaagataattagggcctgaattcgacccggtgactttttgaaccgggactaaagataccaaccgggactaaagatcaacatttttttaaccaggacttaaaaatcgtttttagtcccggtttttaatggaaccgggactattgtggaatttggtggaccgaccaaagatggtttctccaccagtgtaagcaattccaattaaaactcttgtttgtgaaggcatttttctgaagaatgtggtgtttactttattttttttccctaaactaacttacatactatcaatatatatattcagctttctttaatttccttggaaacgaaaagaaaaattaaggtgagttgcagagttagcaatgcatgctctgatgagaaaatctcaggcgctttgatgtgcagcaaacctgagaggtttagccaagctgataactttcctttagtcatgactcatgactgaggtagctaggagtgcttgtaatcttcaacggttttcttgcacatgtaagagcttcgatcagcttcagactgcagttcccccccctgtccctgcacttttacttgtacttgatcatagaagaaaaaaagcagagtggttattttgtactatgtcgttatatcaggacatagtaattagctctcggtgagagtaattatttcgagttcttttttggttaactgtgtttaggcgttgatagtacgtaggaaataaattgcaatgtggtttctcaattagaaggttctattagccagaagggttaagaagctttcctctccagctttccttgtcgtgtttaaggaaaacaaggaaaactcaggaaacttacatttgcggatacacggcaaactgattttatcacagttatatagattttatcacagttatatactatctccgtcgaaaaaaaaaagaacaatttcagctatcatctaaacatgataattcttgctatgcacatagacatgcataccactttcttttacaaaggtaatatatataacacatcctatctagaagactaaaacaatatataaggcatgctgtgaaccatgcaaaaacctctcacgggctgcatattagtaaaacggttataatcatacagttgagacgattttagacatgtagtttgcattacatgtttagtagtttatctccttcttcctcacatctcatgtgcacggtgacctctcgcatctctctcaatcacaacccattgccacccctcaaccatggcatcatcctttccctattagcattggcttcatctctttcacgccgatcttaccacccaccttcccttgtcatctattgcctcaatgaccttagtctcttgtctatagatgaccctctcttagggatatggtgccatggtggataggtttctgatggccttaaccagctcaatcttattgtcactacatctccatcaattttatccctcttaatccatccaatccacgatcctgctagacccaacgtttctataaactttggcccactagatccatacgagttgcagttaacgacacaatgatgaggtttacgtaaaacttgaactcatcaaccttgcacatatacaacctatacatagtcaccacaaacaactctagccaccggaactagatgagtcatggttgaggacgtgagcaccatggtaatattgtattggtgttatctctacagccatagatcgaactaatgttcagtccgtgtcatgctgcctcacctttgttagtaaggttaacaaatatgtttgtcttggactttcttatccctcaatttcgtttgaatcgataaaataaaaactgtattgctgtccaatatttgtatagggtaacattaattataccctcatgggtaatgccactatataaagtatatgctgtagagcacctattttttaagataataaaatcggattatatctctggcctctgcctcattgccaacaagtttcagaataaaaaaagggaaaaaaatgcaaatgtacaacatctctcttttttttaaacacctctttgtttccttcgttgaaagaaaaaaaaagatgtgtcctgttggaagaaaaatgcaaatgttaagacacagcactgcacaaaaagacaaaacggtccttccgcattgaccgtaccagacccacacaagctcctcgtgatctctgatctccaccgtccactccccatccaacggccgaaacccaaactcaccccaccgtagtcggtttccccaccttccgtgcaccgagttcaccaacaccctactccccaactcccgtacaccgcgcccacgggtccacgcgccccgcgcaccggctcacgatagcgcacccggcgcacgatacgtctataaatacgcccctaccccccttccccttccggaaccggatcctctaacgtaattcattctacgtcagagggacgttcaaccacggatcgtcgttccttgcgcatccgacggcaaccaccgtttcagtccgtccccgcctcagaccccacaagcgcgatgtctctgcttgctctccggcccattcgttgatagcggcagcggcgccgcgccggccagccacccggaagctcaggcagccgtgcgctgccgccggcggggaggtcggactggaacgcagtgctaccgccgtccgccggcgaggtcgagggcgaggactccgcaccgcctcggtgtctgctgttggtcccatcgcccagcaactgctgtttctcggaaccatcgccggcgaggttggattggaatcgatctgtagtctatcgaacttgcatcatcaggttgccttttctcatggaagaggcagctggttgaaattcttgctaaggcattcgtgctgtcattagcttgtcccagaaactaccaagtaacctgaagaaataaaatcagagctgaaaccagaactttgccaacagattcatatagaatgcggcatagcaagtctgcaattgcaataaaaaattaccaaaaaagatggtttttctccttgaagaagagatcaatcgagtgcagatgttaaccaaggaaagaaatctcatggcacgaactgaagagaagatgagtaatttttctgttctttttgttccccgtgtagctcaccgaggacggttccgagaaacaccgacagcaaacaccgaggcgggcggagtcctcgccctcgacctcgccggcggacggcggtagcactgcgttccagtccgtcctccccgccggcggcagcacacggctgcctgagctttcgggtggccgaccggcgcggcgccgctgcccctatcagcgaatgggccggagagcaagcagagacatcgcgcttgtggggtctaaaggcggggacggcctgaaacggtggttgccgtcagatgcgcaaggaacgacgatccgtggttgaacgttcctctgacgtagaatgaattacgtcagaggatccggttcctccccttcccctttcctcagacgaacccttcttcctctccgcgatttcccctcacctcgcggaggcggcgaggcgatctgcgcgcgatcccattcgattcgccccgaattagccgccaaaaacactcgctgctgctctgctcactgggggggtggagcccacgcgggtgggcgaggcccggtggtgctcgcggcgggtggggggagggggcg

SEQ ID NO: 82544 - DNA, 2382 bp, Oryza sativa
cccctcctgaaagctaggatattttacttgtaccaaaaaccaagactggttagaaaatctttagccaggatccaaacacaccctgaatgtcacaggttgcaaaaagggggggaatgttccatacataccggcggtgaggcagatcatccagagatagaggaattccttgtaaggcaatcccctgtagacctccttcttgcgatcgtaggcacagccggggcaaccttggtggtagtcccccttgagcaacggcacctcctcttccatcccctcctctcccgcccggcaagggcaatgcgacccccccagaacaaacagggaggctcaccctcaccctcggctatcaatcggcaaaagaggagaagctcggcggcgagggagggagggcctgagattgagaggagaggaggaggcaaacaaggagagggccaatggccaacccaacaaggaaagccagcaacaagaagaggtggaagaggaagccaaaacgaagccgtggtcgtcgctaaaattccacggcgcgcattgccacacacaagaatatgtttagctccatggaggtgggtggaagtggaagtcatttattaatactagtattaggattactagcacatcagcacaagagaacaacagatttgcaactcatttattatgttccatcagcacatcagcatgagaagaaaacaaaagatttgcaacctcacactggcttgatgtggaatttgtgcatttttcatattccgaacttcatactcgttctgaaactttctaaatattcaaatttaatattttttttggacttggcatttttcgtgtttcaatttgtactacttatgcctatatatgtacactatactcaaatctgtgtatgttcctattgtatgttcgaattttgaacatattttttagacttgaatttttttccttcaactttttcacgaacacattcagatccttacgtctcccagacatgtacaaacagtaccgtcacaatcatcttcaaatattttctgtggatttcaagactcagaatattcagagatcgagcaatagtaaatatttgatgaaagcgaacttaacacatgcatgtacatatgggttcgtatattgtaccatctccatattttaatgtataacactgttgactttttatcgaacgtttgatcattcgtcttatttaaaaaaatacgtaattattatttattttattgtgacttgattcatcaacaattattctttaagcatgacataaatattttcatattttcaaacaaaatttgaataaaacgagtgatcaaacgttggttaaaaagtcaatgacgtcatacattaaaatacggagggagtacgtgatacacgccaaagttcacatgagccaccaacagttggacaaagcgacaaaaactctatccgacttgggtggttggagctccacgtcacatatagctccatgcatatttggaattagcatgcaatgctataaactcacattataccacgaaaagtgaaaataattatttaagggcacaaaccaataattagatgttaaaaagtgataaaacagattatagaaagtatatcatggaatttctatataggagacttttgtaaaagtcatggtgtttaaccgatcgaaaagtgcacctttatcatagaacatgattgaaattatgggcgaacaggctttagggtgtgggcagtgagaaatcacatgttagtgggtttttcttaaagagatagtgcttatacacacatgtaaggacgtacgaaaagagtgcaaacgaaccggttcgctttttaagtagtagagatatcatcttacgtagacttcacttaaaacttgatggtctacttaaaaattttaactccactggatatgcttttgttctcaattcgatcatgagccggttatataaactagtatacaattcccttaatatagcaagtttattaaacaactcattttattgttgcacacatgcagccaacggcggaggcacttcccgaacgggttgggcggccgcgtgaactccaccgctactgtctctattaccgttagctacttatacgagtataatacaaattgaaatatcgtatgagccgctatcttgtttttctttcaaaatatgggagacattatgaaaaaccatacggccaggttaataaagtaaaaaacaaatttacagaaggtaacgtggatgaagtgaagtctgagtaagcgctaatcatgcatggagcaatggttggcttgtgctaatcaagaaacgagaatataggtagtacaaaagcaatgaatgaaccattaagctcacgaatttaatctcagcaggtcaggtcatgtgcgagtgtgcgaccgtctgctacacatgcacacgcaccctg

SEQ ID NO: 82545 - DNA, 1068 bp, Oryza sativa
ttcaaatatttgatttgatagaaaagttaaagtatgagaggtaactaaacacacagccttggtagttatttcttagagctaaaaaattggttttctagctttctacttctattttattttgttaattcaacaactataacttattagagtacgaacgaaaagttaaatcgcttgaagagcttctgattatcataagaagctacagctattcagaaacccctcgaataagccattgctaaaattgaacggttgtatgaggtgcacaaatcttaaaacaaatcataaaattagtaattattaatttgatgattttgattaattgaagggactgtatgtatatatatagctctccaatgtggctgcatgatcaatggagaatatatatatatatatatatatatatatataggagaaactaattaagcagactcatcatgataaaactcgctaaaatatggagatcaaatgagaaagagaggaacggaatcagctgcagctgcagatcgatgagagcgcgattgatgatgcatgtgggtgtgggtggaagagagaataaatgaagggaggctattacctgtgcagagcgtgacaatccagacaaagaggaagctcccgtaggggatgccgtagctcgcggccttccgccggtcgacgacgcacccggggcacccctcaatgcagtacccatcgtccacgccggtgccggtgctgcccttcttctccagcagcggcgccgccgcctgccgccggcgtccatgatcacccatcaattcaccgatctcgctcgccgagatgtcgatctctctgactcgatagaccttgcttctgtctgaatggctgtattgtattgaataactgatgggtagttgttgagatcgattaactattgcctgctgatcgatcgatcgatcgatcgatcgggaatcagcaataaataaagagagtgaatgggcacgtgaggctcgcagctagcagagggacttgcttgcagttgcagagcagaaaacgcatggaacagaaaagccggaggggagaagacaagtcgaaacaggctttccgttgtccaaa

SEQ ID NO: 82546 - DNA, 1643 bp, Oryza sativa
tctcttacatagatactaaatttataaacatttttaaataggaattaatactcatgttggatccgttttgggtgtagcatttaatactactatatgatatggctatcttgatgatatatttatcaacaatattaaattcggcagtatttgtttttcgtgaaagatagcatatcttgaagatatatgcgttgaatctcgttaaatatgcatctatatggtatcgatcttagaagatttgcatccacgtcatccatgatatggcctcaatgttttcacccattgttaagtgtaagtacctagagctatttcctaaatgcaatcctgacaaaataaattcaattcaaggtgtcaattgggagcggattaagacggcccattttgtttgggctggagaatctagctagcaccatgttactactcatgacggcccagtgggccactctttatccaagtattcggccttggcccagctaagctagcgcctattagggctcgcccccctgcccgtgcgcgccgccacttccaagttccaacctccgccctctcttctcttctcctctctccttctccccgagctgcccctcttctcttcctccgatgggtcgcaagatcaaagtcaagaagaagaaggcatcgagcaaggtgagcgattggtgctgactgtctcgcgatattttattttattttattttattttcatcatggtttaattcgagcctaactctgcctctactctttcttcaatctttatcggtgggtggattgaagaaagccgaagcttcatcgtctagggtgccttcttgcccagccaaggtgagagggcaaatacatgccaattattacaagcagatgcacacatatttttcttttcttttattttttttggtagttgcagtgagaggaaaaggttcgatgtgtgattagttttttttttctcctatagttttaatttcctaagctaaggcaaattgctcctgtcactgctcttcgaatgaaacactgacccgattggtatttcttttcaggtatggcaacctggtgtggatacactggaagaaggggaggagctccagttcgatcctcaggcttacaattatctcagagggtttaacattggctggccgtgcttgaggtaaaagttcaccatggcagccattgcgcgctccttatccgaggccaatatgcgcatcattgtatgggttatttatcctcatcgatttgttatctgttgcagtttcgatgttgtgcgggatcaacttggactcgtgcgatcggaattcccacatacattatatggcgttgctggaactcaggttgcattctctctataatgctttccttcaaaatttacatgatgaatatacatatattttcctattttgattaatgaattctgtcaacaacaaaattaggattccagttcgtttccatgtcaactgtgctctgtcatgattcatgggtgcatttgacttttttttttcctagtaacattccttttcaatcagtggttttgcctgctcctgaattgatggaatcaatcttttgtcaacatagtttgtgtaattatgagtggtgcctgtgttttcaggctgagagggcttcatggaattatataggcattttcaagatttgcaacataaatg

SEQ ID NO: 82547 - DNA, 5371 bp, Oryza sativa
ctgccgcccctccaagttttataccttatgtttaaagtgtgctgaaatgccccaaaaagaatgctttctttactattttctgacttgcatttttcaatcctgaattgtttgtgtacagaatttgggatctttcattggaaaaagatgctgaagaggaggcagagttcagggcaaggatgagagaacaggctgatgcccctgaagatttacccccacaacttctctttgttcatcaggtactgttaccacacttgttttatgtttacttcctctcattttcatatcattgtgttcaccattccttgtgtaattaaaatacatgtttgtggacctcgagatgtatttcaaaagtacagacactgttactgagtgaaatcataaatgtgatgttgattgttttatgtgcagggccagaaagacttgaaagaattgcactggcatccacagatacctagtatgatcatatctacggcagctgatggattcaatatgttgatgcccagcaacatcgatacaaccattcgagaagctgacgcatagatttctacagtagttgtttatctgaatcaaggtttcatgggttttttttttttttgaagtggatgagtgtaatgatactgcatgtctacaagtatcagtttttgatagcttgtatcctagtttcgttgtcattcatagtggtaggttctcagttttgcactgatgtcgcccgaatgaggataatcaaaagtatctcgatcaactgaaatgacatgttatattctacaagataagattaataattgtgcatctctgtgtttgcattaggtaatattcacctcgatcgtttgtatatttttgcctgataattaagttggatattaggtccatcggccagaaatctgggtcttgcagcaaaataagttgcccaagcatcattcttgctgtaaaatcttgttcttagaaaaccaagtggcatgtacctggtggtgttaatgacaccaaaggtgccaatataagttgtttattttataagttcctttatcgattgctcgcagaatgtaatcatgttctcctattatagcttggatgcgatgcgccactttcggcacttgacaatcaactatctgatactcctattaatcagcaaagtttctgacactgtaatctgaatatttgttactgttatggcatcagaacgtgcaattcgctgactagaatcaggatggatatgttgtgtgtgaagctctggttggccatttgatatctttgacaaactttattcgtttccgaaaatttggcagccgcccatgttgcctttccgaagatgcttatgctgttggttcgttttgtgaaaaaaaatcagaatcagaatgtcatcattctccctgaaactagtagaaaagagcatagcagcagcagcagcagccatcgatcacgatcactgcactgcaagccttcaacctggagcaagtgagccatgccatattggcatacgatacgcgagcaagtgccctcctttttatagccaacagcaagagcaaggcagatattagatagaatgaaagttggggaatcaatcagcggcagcttaatcctctcgtcatctccatcaatccatcgtcattaatcagagaatttgcttcttgtgttactaataatctttgaggggaggcaattaatggaccacctgacaaaggagcagatcgccgagttccgggaggcattcaacctgttcgacaaagatggagacggtaatccaatcaatcaatcaatcaattgcatgtgttcttggacgatgatcaatcaatgaatccagaagaaaatgcaatgcagggacgatcacgagcaaggagcttgggacggtgatggggtcgctggggcagtcgcagacggaggcggagctgaagaagatggtggaggaggtggacgcggacggcagcggcagcatcgagttcgaggagttcctgggcctcctcgcccgcaagcttcgcgacaccggcgccgaggacgacatccgcgacgccttccgcgtcttcgacaaggaccagaacggcttcatcacccccgacgagctccgccacgtcatggccaacttcagcgaccccctctccgacgacgagctcgccgacatgctccacgaggccgactccgacggcgacggccagatcaactacaacgagttcctcaaggtcatgatggcaaagtcagtctctctcttcttccttcctcccatttcatttcttttctgctttcttgatttctttttctttttcttttctccatgtagattattactagcactggaattacaaatcttttctagattatcattatatttcttcttcctatttaatctgcaaatgttgcttctgctgaactgtacataatgtagtgcattcgtcatcagataatcatatttatctgaacaactttggtgctatcatatgcaggcgaaggcagaatatgatggagggacatggaagtggaggccatcggtcaagtaactcccacaagaaatccggctgctgcggcccgaattcctcatgtaccatcctctgaaaaagatgtaggtttcaggtttgcaactgttctgatgaggattgtatagttcagagttttttttttgtcacctcaatttctggttacacttgttctggggctatgcaaacaagaaaatcaaacaactacacagtgtaaatgaaaatgaataatgctggccaattaatatacttgttcctcacaagattctgatttacatacaaaacttgacacacaaaacccattgagtgatcagcttcacttgagctatcacaagggttctctgacaaataagagcagcatttacaacactagtggagaccaaacatagtttacagggccactcacatctaattacagatgcaatgaacatgctttctgcttttccagcctctagaaatgggaatgctgattcaaaagaatgggatgctaaaatagttcacccattcctcctctcccaagttactctaggaaagttgattttgaagatcatctgatttccaaacaacatcctttaaggttctggagaggttcttgtagaactgcaacacattacaagtttgaagtgattcagtacaagccattcaaccaaatgttgcaaaagaaaaaaaaaacatagtcataattctgtgagtagttgatccaatcatcaaagcactgactcaattttccaatgataattcatgagcatcaacttttaattggcatgatctaccttatgaaattcgagggtgtcgccttttgcttttcgtacttcaaccatatgaagagagggtgcaacctgcagtatctgaataatagtgcacaataaatgttagattgaagaagcttacacaaaccagattgcagtatagcagttcttcatattacctcagtagcaacattgagatttccttttctccctgcttttaccttttccaaccttaactggtcaatcaataaaaaaaaattcagcacgtagaaaatatatatttgaatttgctataaattgtccctagaacccattactttaaaacggatattcatgcagatagttgttaggcaaggggagcataccttgtaatttttcttctgaacatcaaatcctagaggttttgcggcttcctcaatcttgcggacaatttcttttggtggacattttgatgtgaaccttgtttctcttttgaattcctgaaatagtgtgaacaaaattaaagtacagcagaataagttgcaaaactataacaaagttatggcagaattatgaggtgcaaaaatcaaaagacattctgaccaatgaactactacatatattctgggacttgtgacatgcagcattctccaaccatatgattgagtaaattgacaaagtgccagtgagccagtttacatgtttccagcttgatttagggaggtataagttgaaccaaaaacaatgacgcttaactttaagttacaggttcgttcataaaaataatacagggagaataggttcaaaaggttgttggtcaatattgattaaatagggagatcacgtacctgctctgaatcaaacaaattcccaagattgaggcctgctgacattgaaatcagttcaaatgcattgagagcttctggttcttctttcttttctgtcacatggtgctcctggaggaggtcaaatcacagtggtcaaaccatttagcaactggcatgcttttatcttcatgtcatgtgaaacagaaattcaagtgcatattgcagtttactcacttcagagtcattgaagacagcataaacatcatccaatgttgtgtcatatttttcgtcaaactctgggcgtttgtagccctttttgaaccactcatcctctaatatttctggaattgttactctctacaacagtagctcaagtagttagcttaagaaatcatccaatgttgtgtcacgaagaaagatgatattattttattagttattactatctgttttaatgattattattaagcatagaagagctttctaaaaggagtgctagcccctgtagaattgagtattatctggttgatgaatgctacaggcattacaggatctactgtgttattagaagacacattacagtgccttcagtgatgcattatacctaattatctactatgttattcagttgttctagcataccgtcattgggtttggatcaaggattcttgttaacaacctcttggcaggaaaagacgtccaaggtggaaacgtaaactctgcatttgatatctgccaggaagtgcagagaagaatcaaataagcatgaaatattaatacaacaaaaatgatctaaaagtggtacaattctcactttcttatacaacgtcataagattagagtcctcaaaaggcaaataccctgctagcagaacgaacaggataactccacatgaccacaaatctgccattgctccatcatatccttgatcttcaaggacctatcacaaaggtggatgaaatgtgtgaattattaatggcttctgatgaaaaatagttccaagtatggtaggttaaaattctataatttctctttctgacattacctccggtgcaacataatttggtgtcccgcaggttgtgtgcagcaaaccatcatcctgaacaaggccacaaagaaaaaagaaatattaattgaagagacatataacgattatctaataatttctgaactgtaatatttgtagcctgttggtacatacttagatgatacagtataaagcaataaacctttaccttaatttgctgagaaagtgcactcagcccaaaatcagagaccttcagattcccatatgaatctagtagtaaattttctggctgcaagtattgtaatttagattgtttcttttggaagg

SEQ ID NO: 82548 - DNA, 22937 bp, Oryza sativa
gacccgagaatgaggacgtagagttgggaatcaaaaatcatgttgtagatactctgccatgcgtcgtcatcttcatgcacgttacaacgttatcatcttccagtggagtacagtacacgtacatgtagagggagtagtatacgttttctgttcgttccgggttcgcaagactggagaggtagctgaacgagagtgacgcaatgagctgcaatgcaccacagcagcagcacaaactctgcacatgtgctgctgcgaatgcagagttggccgtagagcaatgttgtgctgtactactactggagactggactggccgtcgccattctagcaaatgtcatttgtaacaacgatacactggagtatgcacagtggtgtaccgtgaaccagcaaggacgtgcgaatgcacagtgtgtaacagcaaatgtgccccaggcagaggtagcaagccagaaagtccaacactacactgcataaagttttggatctttataggattctcccaacacatgatgagtcgcacgcagctactactcctacagtagcagctagggacaatttcttcttcagctcaggctcagctgctgagccggtcgcgcctcccaacgcataggcatgctcccgccggccccgtctttcttgtccgccattacgccaaccagccgcagtaactcagcgtactactctactcctactccttttctttcgtttaatagtatagtcaactactaactttaaatcaccattaacttaatagctacttcataccatacttagagcagtcccaacccttcacttaggatagtgtttatggcattaactacattgcaatgtaggacttttagcttatgtgacactatattaattaaaagagagagtgaagagaggaagaaactgggtctcatataggacacagcttcaacacgagaatatatgcactatacactatcaagttttacattgagagataatagtgtctttataatagatgaagaataaatatgattggtagagaagagagatgatgtatttattaatggcccattttaagaaaccatgggttgtagagtgtagtttctattgtaatgtcttattaacatggcaccatagacacggtttatgtatactatgggttgtgactgcctttatatactacactattaatacttgatcctatttatcatacacacattgcgtcttgaaattcgtgctacagctggctataaatttatagccctctgctcatctctcttctctattatcttcttaaaatatatttatagctggcttatagcctgctattatacctgctcttactcgctgcagcattgctcactactgtactctcttcgttaaaaaaaaaattaaattctggccgtaaacctgaaccagcgtaagccacctatacgtataccaggtttactaaggcctgcttagttccaaaaactttttttaaaaaatatcacctcaaatctttagatatatgtatgaattattaaatatagataaattaaaaaactaattgcacagttggaggagaaatcacgagacgaatcttttaaggctaattagtccatgattagccataagtgctacagtaacccacatgtactaatgacggattaattaggctcaaaagattcgtctcgcggtttccaggcgagttataaaattagttttttaattcgtgtccaaaaaccccttccgacatccggtcaaacgtccggtgtgacacccaaaaattttcttttcatgaactaaacaggccctaaaccttgaggtgaggtcattgccacctacggagtatgaggtatgatttaacggttaccacgaaatatatcggttttaaaaactaagaagattatcgcacgtgatgtcgtgataattgtacggttttataaaccttgtatatgactctgtagtacaacttatgtacaattaaagacatgtaattatagattaattaaaaaataacatgttcatatgtctgtatagttgtttataatcgttaatcaaatttagtgataacgtgagtcaaacagttagaccgtatgcataatattttttttttgaccgaggatgtactcccaacccagacgagccaccaccatgctagctgctgctgctgctagcgttgcccagtgaccttgcagctcgccatgctagctccgctgctgcttttgcccaaagctgcaccccctgcattgcccctcccctgaccaccttgcctcatctgtatctccgcccccccccccccctctcctcaacctctcttgtgcttgcttctccattgcagctcacctccatctcctattctcctcctccttgttgaaggagttcgtgtgcctctaccaagaacaataagaagccttgcattggtagccatgatcacggtggtggacctgtaccacgtcctgacggcggtggtgccgttgtacgtggcgatgacgctggcgtacgcctccgtccggtggtggcgcatcttctccccggaccagtgctccggcatcaaccgcttcgtcgcgctcttcgccgtcccgctcctctccttccacttcatctccaccaacaaccccttcgccatgaacctccgcttcctcgccgccgacacgctccagaagctcatcgtcctcgccctcctcgcgctctggtgccgcctctccgcgcgcgggtccctcgactggctcatcaccctcttctccctctccaccctccccaacaccctcgtcatgggcatcccgctgctcaaggggatgtacgccgccgccggcgccgcagccggcgccgactccggcagcctcatggtgcagatcgtcgtgctccagtgcatcatctggtacacgctcatgctgttcctcttcgagtaccgtggcgcgcggcttcttgtcatggagcagttcccggacaccgccgcctccatcgtctccttccgggtggattccgacgtcgtctcgctcgccggcggcggtggtggagccgcggagctgcaggcggaggcggaggtcggggacgatggcaagatgcgagtcaccgtgcgcaagtcgacgagctcgcgctccgaggcggcgtgctcgcacgggacgcagtcacactcgcagtccatgcagccgcgcgtctccaacctctccggcgtcgagatttactcgctgcagtcgtcgcggaacccgacgccgcggggctccagcttcaaccacgccgagttcttcaacatcgtcggcaacggcaagcacggcgacgaggagaagggcgccgccggtggcgggggccactcgccgcagccggtggtggggaagaggaaggacctgcacatgttcgtgtggagctcaagcgcctcgccggtgtcggagcgcgccgccgccgccgccgctgccggcgcggtgcacgtcttcggcggtggtggcgccgaccacggcgacgccaaaggtgacgacaccttttttatcatcttttcgtgcactttgacttccctttttgttttgcccgcgtgtattacactgttgtttgcttctgcacaattaatcactcttgtcttgtgctcttgaccatccgatcagtataatcaacggtccagatcacactggtctgctgattgtttggagaactcaactgcgtatactgatttaataccacattcttgaagtgattctttttcacaaacttaccttcttgaattgttaattcatgtaagcttttctgatcttaacagtgacattgactgttaagtagagttgaattgtacagttaagacaaaatcttaacagtaaactactgatttgacaaaagaaaatgttctttgatggatgcacaggtgctcaggcctatgatgagtacagcttcgggaacaagaatgagaaggacgggccgacactgtcgaagctggggtccaactcgacggcgcagctccggccaaaggacgacggcgaggggagggcggcagcgatgccgccggcgagcgtgatgacgaggctcatactgatcatggtctggaggaagctgatcaggaacccaaacacttactccagcctcctcggtgtcatctggtccctcgtctcctacaggtcaattaagcaaacattttactcacacttttcacattgccatgttcatcatcagtcatctctgtttgttgcatgtgttgttaatcttgtgaacaatgtgatgtaattcaggtggggaattgagatgccggctatcatcgcccggtcgatttcgatcctttcagatgcagggctcggaatggccatgttcagcctaggtttgtttgtgcatctctgatacatgctgcattgctgtaatcttacatggttccatgtctgattgcaatgactgaactatgttctggtttgcaggattgttcatggcattgcagccacggatcattgcctgtgggaactcccttgcttcgtatgccatggccgtcaggttcctcgttggtcctgccgtcatggctgcggcctccatcgccgtcggacttcgcggggtgcttctgcacattgccattgttcaggtaagctgcaagttcaggcttctgcaccaaaatgcatccttaactgcaaaagaatctatcgtaactcaacaattgtcattgaactctcaggccgctcttcctcaaggaatcgtgcccttcgtgtttgccaaggagtacaatgttcatcctaacattctgagcacagcgtatgatctctttaccaccatttttttcagtattggagaaatgtccccattttgaggtttcttttcttttatgccctgaaatctctcgccctgtttcccggttcccttttccattgtatcacaaacgccatgcactgaattttctgaaaaggggcgcatcttgcagcttttgatgattcctaatcatattgttttagactaagaaatccatttttactcatgatttatcatccacaaaggcagagtccataacaataccattaaccatgattctataacactatcattgtatctgacatgaccatgaactcttgttctgcagcgtgatattcgggatgctgatagctctccccatcacattggtctactacatactgctggggctctgaagagctctccaagtctcaactcaactgtgcaagaacttgatgttactgacagtttgattaggatttatggtctgttttagttgctcagattttgtttggatgataggtcagcttagtgatgctaggtggacaattatccgagaacttttgggttcaagtgacggccagccacggtttctgattgaagattaggaacatagacatcacattagtgataacaggcatccaatttgtaagacattgagaaggtctgtttcaaattactgacaatgtagtaagacattgaacagtgcttatttagcattccaataactgatggtaatgcgcttacttaaggagctactctgaaggaatttatttttaatctcttgagagattagctccggattttccttttcaaatgtttctgagtttgagggctccttcggaagacaagattctgaaaacacgggaataatcgtaggaataggatgtcatgctataacaaatattataggaaataaatttataaatttataggattctataaaaagtattgttttgtagtaccataggaaaatcaagaaactttaagttacaaggatgagaaaacatgaggtctagtctcatgttagttttctgtcaaaattcctacaaaatgagcaataggaattttaaaggattttggggaagccatttctatgtttcaaaagatcatatggggaaatttttcaatggattttaggggttgaacgctttatcatcacttgccaacaaaagttattacactttgtttaaggtgaggtgaataaattcttagacataacttactaagggcaacaacaatgtatatagcaaaaatagtccatataaataggacctatatatgtgggttttaactattataacattcacaatgtatataaatagcaaatagtattaggaggagagaaagtagagacaaaaaatatattttatcctatatgagaagcccatatgcttatgaattttttttccttactatggactagttccacaatgttgttaggtgactggataaaatattgtattagttatgaactagttttacactatagttatgaactatattgtattagactgaataaaataagtctaagggaatcttgccacattttttaagttattaacacatgagactgactccctctatttcaggttataaaacgttttgactttggtcaaagtcaaactactgtaagtttaactaattctgtagaaaaaaaagtaatatttacaacaccagcatagtttcattaaatctataattaaataaaatttcataatatatttgtcttggtttaaaaatattactacttttttctaaagaatttatcaaacttatagtagtttgactttgatcaaattgaaaacatattataacctgaaacggagggagtagttagaagggaatcttattaacggtggttacaatcaaacacttaccaaattgattaaatttgtctaaccttaggtttgcagactatggtaaaatgtagcttacaaccaaacattctctaatcctttaaaattttctctatgtttctttttatctacttttcctttgttccaaagaatcggaaagatggaatctttttgccacttttttcaagtttcaaatgaagaaaaacatgcgtagcattttgagcatcttttctagtactactcccaagtataacaaaaagtttgggcccaaaattaaaaggctaatggctggcctgtttgctcgaaacagcaggacagaaaaatgattgtgttgggagtcagacaaaagtgttggctttaggcatgcgcacttgaaggttgaagcagcaaccgacgattatactccactcttctcgtcctgtgacagacttgacacggttggatgtctctgaagcttataaccaacggtaattttatcatttttgccgagacatatttcttattataaaatttggtatattagcatatcatgatataaaaaaatttagtataaaatttatatacttataaggaccgtaaaaattctttagtaccaatgcatggatcttgtgaagaagattttttttactcttcatcacactcttttagatcatctgatatagtacacggttaccatgggttcttttagatcatctggcatagtacacggttaccaagggttattagacatatccacggacctaatttacaaaatcgtggaataaattggtcaagtttaagagaaggtaaactcaaaatatagataaaatttatacaatttgtcaacgaaattgcaacggtttttagagcaagtagtttttattattttttcggtttagatcccaacctatgtattttgaatttgttttatatctcttctatagagctgggtattctttttacattaatatactcccttagtcttgtagtatagcaacctatgattggatgagatattttagacctattcaaatttattataccgtgaaatgttccatctggtcctaacttggataaagggagtaggggtgaaaacgggatggatatttatatttctgtccagtcgcccgctcgtattattttggagcaatttcgggtaaaaaatccgggtactcgggtgtttgtacagatatcgaagccgaattcggatacattttggttgatacgtgatcgggtttgagagggtggtatccgatggatacggattatccgataaataatacagatattacacggtgtctgaattgatacctattcgttccgtatttatgaccgatattatccatgtttgtatctgtattcgatactatctatgtctgacccgattccaattattaaatatgggttaggatatgggaaggatgcgatccgacgaaaacaaccccatttcacccgtaggagggagtagttggtttgattgttttttcgattgtgtagaatttgatttttgtaaaagattgttgtcagggtctcgggtgggccacacatgggctgtcagcccatcaccaagaagtccaagcaagccccaacctgaagtaatacatagcagcaacagcttacaggagaggacatcgatcgatcaattggccaaggcggcaaacggcggcggcggcgacctggaggcgggcttgcctccttgtcgatctctaccttccctcttcctctgcttgtctagaagttactagacctttctagcccttgtattcctccatcttccaccccaaaaccttccaatattgtaacagattcactagctccttgtgttggatttgataccactacttctgaaattgcattgttgaagtgggtcgctaacaattgtaaaaacgaaaaaaccccttgtcgtcttctccattgcggcactgaaactcaggcggcgccaccagccagcgtaccacgacgttgctctgctagggtttgctccaccctcctcccacctcgcgccatcggattccaccttcccaggtctccctcccctcccgtcgccatgccgcacctcgtccgcgagcgcctcttcttcggcgacatcaacgacgccatcgccgcgctcaccaccaccaccgcggaagccggcggcttcacccacctcctctccgtcgtcagctccgccttcatctccttcatcaccgactgccgcccgggcctctccatccccaccgaggaggtccgccgcgtggtcgccggggaggagggcgcgccgccggtctccgccgtggcccccgggcggctgatgcgagtggtggagcgcgctggggtcgggctgcgggtcacgcggatggccgtgccgctgcgggacaccgaggaggagaacctgctcgatcacctcgagccgtgtcttgatttcatcgatgagggcaggaaggaggggaacgtccttgtccattgctttgctggggtctccaggaggtacgattaatatttaccaacactaatattccgagtaatctgtgcttttttgtaatctttagtgtcgtgtgctaatcaaagtgaagttcattagatatttttagttctggaatgttacatatatctgttaggcatacttccgttttagccaaatggacattgtgaattttgttccaagaatttatcaattaatcataagcatatgatggaatgtgaatccctgtatcatgctctgttttgacaagttggatatttttgcctgtcctgatgcattggttataacaaatatattggttaacagcgatgtatctcctgttcactgttgttcatttgtaagaaaattaaatacttgtaaatttatctgtatcttgttgcagtgctaccatcatcgttgcttatcttatgagaacagaacaaaaatctctggaaggttcgattatttcaacaaaatgggtgatttttcagtcgttgctttggttattactccagatgaatacctgagctgtctttttgatacactctggtgacatgccatgcttactgtcttgtttcagaagcactagagtctcttaaggaagtcaatgagtcagcctgcccaaatgacggttttcttgagcaggtaaccctttgtgatctgtttgcaccctattgctcttagctttcttttatttatttgttgaatgtgttgtaaattgcagttgaaactgtttgaagaaatgggcttcaaagttgatacttcaagtcctctatacaagcgtttccgtttaaaattgctaggttagtcataattcatcttggattctttgttactgttggacaggttgtgtggttattatgtcagggaaactgtgaagattctggccactggttagcatttatttaaaaaatggagatgtaaattctttgttttagtaaatttcaacattgcatgtctgtgaatcatgatatatttgatgttttcctgctttttttttaattatccatgactaagagtgctattcatgcagtcctgttgaaaataaagcagtcatacacttctcaatattgcttacttttgtttcttacttatgaaaaatctttgacaaatggacagatttgggtactttactgtttcacctttgtcctttctcttatgcatagtctcttactttgccacttttcactaaacttgtcaattttttttacttctcacaggccaatcctacaaaattggagagaaaataggaagctatgtatttgaagatgatcctggtctttctggacagcctaattcttctactcagaatttaccaaacaagcaaacccaacaaccagcataccgctgcaaaaaatgcaggagaattattgctgtgcagggcaatgttgtgagccacactcctggtgagggtgaatcttgctttcagtggcaaaacaagagaaaaggagagcgatcatatagcaaagaacaagattgctcatcgttgtttgttgagcctctgaagtggatgactccaggtaattcaccctcgtaattcagccctttgcagttacctacggtcacaaatgacttctcagattgatctcctattgatgtggctcatagcaaatctgtgtttactgctgagtgttcgtccaatctgttatgtaattctatttgttttatcatttctaattggtgcttttgttattgatggaacagtggaagatggtgctttggaggggaagctatcgtgtatccactgcggagcacggctaggatatttcaactggtcaggaatccagtgcaactgtggcagttggatcaccccagccttccaaatttccaagagcaaagttgatattagtaccacttagatagttgtcagaggctagtagattatttcaggaccatgtgagctggtgtaaataccgttttatcagaaggatttacgaactcgaaggatctcgaccgaagattttcagatccattgtgcactagatagataccatgaagaaatatagtctcagaaaccaccacttgtattgctacttgctgttagactatgccatcaattgtaattgttggttctgatgatctgaaatgctatcagcacgaatttcattttttttcttctcttttttcgagtacgcaatgcatcgtagtacgtatataaatccgtaatgcagttttgttgtacatgagtgcatccattgaaaacaatactgtgtttctcatgttccgttttatgccgctgaggtggcgggttcggagtttttgcttccggcccagccaataatgctctaagatgggcttgctcaccaagggtgtgggctcgacgtctaattgtgggccttgtattcggcctcagccacgtacgtgggctttatattgggccgcatgttccttgaggcccatgtacaccatcaagtcaggaggagaaatccccttccacgccgcacactctgtcacacgccggcgcgccggccagcggcggaactcgcgacacccgccggcgaaggagcagcagcacaggaggtggacggcgcgccagcgaggtcgcccatccagcctctgcgtttagttgtttgaccaatcgggaaagaaggcgaggaagggaggagaggagcggagaggaaaggaggaggggaggatgccgcaccacgcgcggccgatgacggggctgctgctgttcacgggagtcaacctggtgctcctcaacaccatcacccccgtctatgacttcgtctgcttccacccctactgggaacgcagggtacgccgcctccctctttcttcttcacccaccttatccccccattccgatctcccaaggctacgctttgatcctgtcgccctactacaccctggccaagccttttccccacagttcgatccgtgcatctgttgattgtttcttgtctcgagcatgcgcgccagctgtttgtggaaatgcctcgcgtctgtgctgcaactttcttcaattttatgatttcgggaacgaactatccctaacacttcctttcgacagacaatttggtgaagaaattccatattcgctagccagaaatttttacaattgaagagtgctcttataggagcatctttgtgctattatgatgtttttcctttctatactatgatcttgatatattgcatacaatttgaagttttgttgatgtgtaatcttgtgaccaatttagagagaacgtcgtcaaaaggagcgtaaagcactacaagccaatggttctctacaaactgctaaatgattttattcctaggtatgtgcgtgacactccttgagaaaaatctgtttgatggaagtgttcatttttataaccacttcaggagtagcttcacaatttggtggatgtgaaaggaaggtgagaatccccaatttatctggtaaaaaacttgagatatatttttgttcatcctagtgatagtgaacttgcttttggtatgctttatttatgcatgcatttgtttaactttgaattgacatggtatattttaaattttcagttgttttactacttggttagttggatgaaaccctggattcttcattgatatggagtgaagaaaattttataggcaggtaatattgtgatgctcttcagatatgagtagatctccgcactccaggtcttgctttcataatgctactcaactgcatcatcacatccttgtaaaattaccgaggaaactagatctgatgaatattgtttcttgaaactacctttatgtatctcttatcttctcatactcatctggctataacatagtaaatgaaaaccactgtttggctcaagccatttattctgatcaggatcctattaacttagttatttcctggggtggaaggaacatatgtttaacaactgatcctgcagagtgcttcattacgtgtttgaaagttctgaaaacctccaaccattttactgttcttccctcaacggtttatctgtcaacaagcagtagaggaatgctttctctgttcttgttgaatgtaccagtaatcttttgggctttctaatcaggtaggattcaatcatgtagtgtacaagatgactgaacagaaagaaggaacaaatccatcttcccaacaactagccaggacaatgtgcaagaccaaacatgaacctgagcccaacctgaaatgtaaatatgcaattggaaagaaaattccattgtatacattacactcgtggtaaatgcacatcatgtttgaaattgtgcacaaaccagccactatacacactaccctgtttcgctatagaactagatctcgcctcttcttctttgggtttgttgcttctgcacagcctgatcctttcctcatcatggccacaaactctgaataatctatcctcccatcctacatgtgcaaaatgcattcagcgtctcttgataggacaaatattttcagctttatcgatttcatctgttttgcatgaacacaatttaaagagcatttcttccttacattattagagtctgcatctgtgatgacatccttgatctcgttggcgtcgtataacccttgttccttcaaggcttgctcgagctcttcctttgtgatgtacctgcaagagggatggaataaatgtgtacaaatccctgaagttcagaattcagttatatcagtttttgctatccttaacttacccactattatccttgtcaaagtactggaatgccgtgtaaaggtgctcttctcgatccattttgttcatgtgcaccgtcgcggtgacgaactcctcatagtcgataattccattgccatcagcatcagcctgaaagttgaaaggaatttccaggagtcctgtcagttttagcatttcatctcgaactgaactgaagtttgtagcttcactatgaggactcactgcttccataagttgctcaatttcgttgtctgaaaacttggtgccctgctttgctaacccatttttgagctcctcaagcgtaatggtcccactattgtccttgtcgatgttcttgaacatctccttcagccccttgatctcctcctctgacaggcatccggctataatctacagaagattcaaaacaacaattaagatgcatatatctaccctgatgatgtgattaagagtaatatttaccctcagtgcagctttcttgaactggttcatggccctgaactgcttgagcctgttgagaacaacattgtcaagtggtacatcaggagcatccccatcttctttgatccacgggtgatctgcaaatccaaattgatccaaatgaatccaaatttaattctgacaccaattaagggaaaattaatccaaactgtacctctatatgaaaaaaaggagcagatttgagtaattaatctgtaacaaataaacttactgagcacttggaatgctgtaagcctctccttggggttgatgttgagcatcttcctgacgaggtccttggctccagaggagatcttcggccatggctcactggcgaggtcgatctgtccgcgaaggatggcggcgaagatggcgttctccgactcggcccagaagggcggcacgccggcgaggaagatgtagagcatgacgccgatgctccagatgtcggcctcggggccgtacttcctcttgagcacctccggcgcgatgtagtaggcgctgccgacgatgtcgcggaacacctcgccttccttgaagaagacggagaggccgaagtcggtggccttgagcggcgcgtcgtcccctttgctcagcagcaggaagttctccggcttgaggtcccggtggatcacccccatggagtggcaggtgtgcacgatcccgacgatggcgcggaggagcgccgccgcggcgcgctccgtgtagtggccacgcgcgatgatgcggtcgaagagctcgccgccggcgcagagctccatcacgaggtggacgttgtgcttgtcctcgtaggcgccgcggaggtcgacgatgttgggctggccagagaggtggtgcatgatctgcacctcgcggcggacgtcgtcgacgtcctccttgttcgccagcttccgcttcgcgatcgtcttgcacgccagcttctcgccggtggccttgtgggtgcacaggtgggtcacgccgaactgcccgcgcccgagctccttgccgatggagtacgtcgtgcgaacctcctccatcggccgctccagcacctcgccgatggggcctgccggcttcttggacgacgacgccgccgccgccgcttccgtcgccgccgccttggccgccggcgagcacggctgctgcttggcggacccatttttggaggaggtgccgcggctcggcggcgccgccttggaggtccctggctctgcctcgtcgccggcgacggccttcccgccacccgtgcagcactggcccatggcgtcgggggatgcgcgcgtgcctgctccggcgacggagaggcacggatcggagagagaatttttggtagaaggaagaaatggatgtgtgagtttgatgggttgagaggaaatggcgggaagaagtgagcggtagttgtttcggtttggattttcagcgtctcgtaggtttggtcgctggctattcttggctgctaataattgtttctggttagattttcctgtgaccaatcatcaatcgattagctgctaatagttttttctgattagatttttccagtgaccaatcaacaatctgcctttacaattgcctaaaaaaatgcgcctttgcaaacactaccaaactagtcaaagcttacaatatcaagcgtctcctctgttatgaaagaaaaaacaggccctaacatcttaagctctcatttctgcagaagcaccgagagcaaatacaaggatacttttcctaattttggtgtgctatgtatgtattttaactttcaggatacactcacaatttgttgattttagtcctgcattagtatgtcaccgcaaaattcaagaagaccatttaatcatgtaactgtataaggtgttccactgtcaatagagtgaaagcttcttctggaatttctattgccgtatgcaattctccctcctgaataaccacatcagataatgttctcctgaagctgtcaatagcatcctctggatgccctttcgcaatggatgcctgcagtggtgttgataaccgtaagcaaataacctatcacaagaccaaaactagaagtacaagagccaaagtttaggcactgtagatgatgcgaaaaattcagacataccaaatgcatttcatcaatcttgaaaagccaaaacatccatttcctagcctcttctccatcaatacagagagaaatattagtccaattcatatggtggaattccaaacgttgcagcccgaatccaacgccagcacctgtagctttgacaaatgcttctttaagacaccaatacctacagaaacagacaattgttaactccacaaattttggcttgtaaacatgatcagcaccctgcacttgttctgaaaagaaaaaaatgaacaagaacaaatgcatacctgtagaactcagttagcataccatcatgactgtctgcagtaacaatgcagttccactcatgatctgtgagataggaagtgaaattgttgatgaactccagggcagtttctcgttggggcttggagatgcacacaatgtccaggccaacgaggcagagaggctcagatgctatgccaacgtactccccctgatgcgacgtgttgaagttgaagccaggaaggttgacatttttattctgctgcaacaacaagacgtgatcgattccaatttgggcttcagaaactgacagaatgtaaacgtgaaactgaagatatggatttgggatgaattaattgatgagaatatctactagactactactactaccagatagggcttcccttcaagcgtgcggttgatgcgaatttggtggaatggcattccaagggcatggtgcacgagcgagtacttgagcaggcggctgacgagcgctcgtttcctgtcttcttctctgacgaacctgcaccggtgaggtcgtgaggacgaggagaaaaatctagaggctgaattcaattgcagtagtgagtgggtggaatcaatggggagaaagaggagttggttggaaaaacctgtggatggcggggcggtcgtgcggcgggaggacggcggcggcggcttggaactcggcgggggaggggcgccaccggccgacgtcgacgagccacctacaccgccaccgccccccgctgctctgcttctctccttcctccatcatcaacaactcgatcaacggacaacggtcaactcaagagttaaggcagagaaagccgtagaccatggcctggccggccggcaaggaaaggaaaggaaaggaagagggacgacgacaacagagaggggaggttaggatgggcctttctcacgaggcctgtaaacttttgaagctaaactaggcccaaattgcatatgtgcatcttgccatggtgccatggcagagacatcagcaaattaaacagcaacagagacataaccatagccatcagtccatcaccatctgccaatctctcacattcaataacagtcgccattgatacgctgagtgttgtgcactacattgattttttcgtcagactcggaggagatggagattaattgagctcgagtgtgagactaacagcaatgctacgcaggctaaagatcgcaatagtaattaatggcgaatcgagccaacgtcagttcgctatcgaccgacataataaatcaggttggttgtgaaccgagacatctcatcatctcaccctggagtcaggagctcaggaacagcaaagcaagaggaggaagaagcggagatggctgcaggcgacgctgcgacgccattgctggagatggcgtaccaataccatgagggctgccccgcctgcgccgtggagcgcagcaaggcgctcaaccccggcatcccctacatgcgcttcttccacatctggatcatcatcctcgtctcatgtacgtacgcgcctcctatatatcgatcactgcttcatttatacgtgttcatgcatgcttcgcttcctgctctgcttgactgcctctccagtctccttattatctattattaacttatgaagtctcatgttcgctctcatggcctaaaaattctcacattaatcggagaaaaaaaacagtctatataggaatctacctatattattttactacttaaagttcaaaatatttccatcgtcataaaaaagaaaaaaaataagtcggactcaacatgcgagaaaaaagattctctcgtcagtaaaaataggaaaaaaatatttcgtagtaaaaacaacgtccgactcattataacagaaaaaaagaatctcccccataaaatacatccgattccttaaaaaaaagaaaaaaatatcgccagtaaagaaaacgaaaaaaaaagtccaactcccatagaaaggaaaaaataacttctgacatcctactcccataaataaaggaaaaaaacatgtcctactcaaaatcgagaaaaaacacatattataaaaaatcccgtttataaaagaaatcgattcgaaaaaaccacccgactagataaaaaaccgaaaaaacacagattataaaaaatcccgtttataaaagaaaccgattcgaaaaaaccacccgactagataaaaaaccgctccgaaataaaccatcagaaaaaacattgctgaaaaaggatcgaaaaaaccatccgaattcacacgagaaagaaccgccatatataaaaaatactaccccgaaaaaactgtctgacccaacacgagaaaaatcccgcgtttataaaataattccgattcagtactgtgcaatgcgaaaaaaaactgtctaatttcataaaaaaaatccgatttcatgaaataagatccgtattgtttgtattgtccatcgtctaccatgtcgttttggtttttccatagcgtcgtcgaatgttcagacgtgtggatctaaaacaagtcttgcttaggcttgtttttctcggaacaagatcaaattgatcgaggctttgggtcagataggattctcgatttttccatcatctaaaaacttggtttgtgttccacgattatattctcctctattggagactctacatgtctctgtatgcaattattatactactggtaagtatagctaatattcttgatagcttatcatataaaaataataataataaataaacatatttttaattgttattaagagaagagtgcactgaggctctatttatttagacttgacaatacaagacaatgcaggatttgattgatcctattattattgcaagaatgagattgaaagattattttagattatatgtgtacaaccacataaataatccaatttgtttgggtaaaacatgcattgttaaggttgtcatagtcaagattgggtcattatattacagatgtttcaattttccttataatatgtcttagcaacaacgatcgatacgattattatcatgggaaaattgaaaccatgccattataattttgcaaaatttgagatatgacatcctgacccacatgtcattgactcatgtgggtcctacatgtcattgagataccgatggcatatcttaaactttgcaaaattataatggcatggttccaatttaccctatcatcattgacataattatagaatatagctgaaattcggaatttaaaataaggaacacaggaagaaaagactagagtccatactggcataccatagaactaatggaaatccggaactagaaaaataagaaaactaaaagtagaggttagagtccatatagaaatacaatttagctggaatttggaattagaaaaataacaaaactgaaagtagaggttagagtccatatagaaatacaatttagctgaaattcgaaattaaagataaggaatataggaagataagactatagtccataccggtatacaatataactaatggaaatttgggattagaaaaataagaaaatttaaagtagaggttagagtccatatagaaatacaatttagaaataacgaaaattcaaaattttaaaaaataaggaatatggaatgaagtatatagagtccatataaaaatacaattttaaaataattaaattcgcaattagaaaaaataaatactaaaagataagtttagagtccaaatacaatttagacataatagaaactaggaattaaaattaagaatattggaagaagagtatagagtcatataggaatttataattaactaaaatttgaaataaaaataataaaactaaaagtagagtttagagcacatgtagaaacacattttacaaataaataaataaattataatgaaaaaaagaatattggaacaatagtccataaagaaataatattgaaacatgagtccataaagaaataaaattagaaataataaaaatttagaattaaaataataagcaatagtagaaaaagagtctagagtccatataaaaatacaatttataaagaaaagaaattcggaattaaaaataagaaatattggaagatgagtataggaatataatttagaaataactaaaattttgaattttgaattagaaatataggaataaaattataaataatagaaattcatgattaacaaaatgaagaatgttggaagaggattctagagtccatatagaaatacaatttagaaataactaaaattcgctattaaaaataattaataattgtcatttatatacaatacattacgaatattacacattggttagtttgatcaagttagtacaaaatttaaaattatgttgtccttttaatatatttgataataaaatatgaaatatgctattatatgagagaaaatataagaatgctagctgcgcaatttacgcgggccaccatgctagttcatgttatgttcgaaaaagctaatggacgagcgctcgcgttcacctgcccccacgcgatcaatttactctgaccaatcccatgccacacgaagtatagatggccaatggattgcccggctccgcatggcccaagcacggctgtgcctgggctgaggtcagtcaggcaagcacggcccaacctacatgtcaggctgtgtcgtgccagctcacgggctgcacacacattccaggcacggccctatatgactcgggtcatgccgtttcggctgtaaggcacgataacccatcgtgcttcttcatagaataagtctatttttcatcctcaactctttgggctgtcttatatgactataaataagtctattttgtattcctcctctcttttggcattgccttatatggttgattaagtctattttggatccctataatattttcttcgatcgtgccgtgccgggccagcccaccgtgccaaggcattggcctaagcacagcccaactgtcgggccatgccgtgcttaggcccggccaaatggtcgtgtcttcggccgggtcgttgggccccgggccatatggccatctataacatgaagcgtcatattctttttggctctaatacgaatatagccacttcttccattttcggctagtcctttttcttttcggctttactctttcccatttaattttatttgaccaagttgaattttaggtgagaccaaccagttaggcctcacaacccgcatgcatgatttttctttttttattctatgaattcattttaatttgtatatatgatacaaactttatacgtatgaagtttctatacataaagtttatatgtataaaatttattgcatattttttttgggacagattaacatgtcgttgaattcatttgaaatttatgtttataaaaatttacatgcacaaatttctatataaaaaatttctctttctatatatgtatatatattttagatatgtaaagtctatatataaatatattttctttactgggccatgttgcttttgttgggctgaattctagaaaagagagaaaaagatgcacgtggaagcctacgagcgtggaaacatgaccgagaaatctgagtcgtcgcgctcgcgccttagcaattccttcttaggtgtgtaaacgtaatcgtgcacaccgtggacccatggttgctaagtattagacggaccctattatgtttgcatatccattttttttccatttccaccagcattgcaagatgtgaatgctttatcagtcatttctagttcacctgaatttatcttatagaggattattttgtactacctccattttttctttttatatagatgactcatttgacttttggcataatgtttaatcattcgtcttatttaagaatttagtataaatatgaaaaaaatatgagtcatataaattttattaataagagaaatggtcaaatgtcacgttaaaagttaaaaaaataaagagagtattagtgtctaaaattaaggggctaaaaggaaagttcaagcttgtaatcgttggtcgaactattgaagcaaaattctaaattgttgtttcttgcatctcttttgcatctttatttatcttgtcattggcttagcttgttccattgatgcgggcctgtgagcttttcatggtagatttttaacctttcatccttacaatattttttttactgaattccatccttataattgaatttcaggtttgccaatatcatcgttatttcccttcttatacttcatggtatgtatttatgattgtaaaatttacaatagcaccaaaagtatactctacattgtataagttttagtgtaaattagctgtttctatttctcattagcggaatttgtaccttgcataattttatcatttggttccgtgaaatgttgttcatcattcatgtagcaattcaaatttctctagtttccatttatattaactagttttttagtcttggaaacggaaataacagtaaagttaccacctaattcctaattcttcaagctatgtatagtcatatatatgttgctatgtatactcatactcatatgttttggctaatcattgtttgggggtgcaggaa

SEQ ID NO: 82549 - DNA, 1415 bp, Oryza sativa
cctgcagccccgtattattttgtttctggctttccaatatttccgatattattttcgtttccgactttaccatttttgatttcgtttctgagaaaaatatgattatggaaatggttgaggctgtttttcgatcgtttccgatcgttttcatccctagctgagacgtactctaaacacacacagtttcggttgaaatttatggaactgctgggtttaggctgcagctggttgactttagttaacagcacacaatttgcctaaaatttaaggaattactgggttctggcagattaattagttctcttacaattgcagcagcaatggtgcctccattaagtttttttttaatttgtatgtacgtaatctgtcaatgggatgtacgatagatgaataatcttgaactacttctactttttttaaaaataaacttcaactaaatatttttaattattattattattattattattattattattattattattattattattattattattattattattactactactactactactactaccatatatatactccagtttggagtagtacatagagtaccgttgaagaagattggcaacaacggcaggtgacaattccgacttggaatggtgcagatatatacatgatgtatacatgatgaagaaatcaagtcagtgaaacctgcatgtcataatcttgagtcaatagttatgcacctgttcactaactttggatggagattcacaaatagaattcaataatttttatgatctttttatgctgtgagttcttattagttcgtgtatgcttttgtttattctagtgtgagtttttgttgaattggtgtaataattggttgtagctctttgagcaaagcccgggattatattccattatctaaaaaaaaggtggaaaagtctattcgtctcgagggaacaccctttatttttatatatcgtttacaaatcataaaaaaaataacaagatgtagatcaatatacaatatattaataaataaaatacaagctcaaatttaactagaaatagaaataataaattgattccgaataaaacatgtcattcatattgaaatttattttttaactatatatatctaattgaatttacatatttgttgagtgacatatcacatatttaataaatcttattatatttttattaaatttattaatgatattttaagatgacatacaccgacatgcacaagtaaagaaacatagcaccgatatatatatagggtttagggttagagttagaatccccttatctctaagaaggaaggcaacactatgatatgccttggtaaggaactaggcataactttgagtgatcaaagagaatcattcgaggagctaagctatgtttacattttcaaaatcaaatggaaaaacccaagt

SEQ ID NO: 82550 - DNA, 6172 bp, Oryza sativa
ccccgttcacaggttcatgtgaagcctggaataacttgtatgcatgtttcatatcaaggagatgacccatcttggtctttaaagcttttctcgaggacgagtaaaggactaaagtgtgggggagcttgttggcggtccttaactcatatttccaactgccaactctcacataaaatctgcataaacaaacaccaaactttgcaagacttacacataaataactaatgaattccacgagttttggtgattcaccattgtttgcaagacttatacataaatatggtggaattataaagaaaggcacattccgaaaagcataaatgtagaatccgtgcaaaggaacaagatgaaggcccaagtatcctacgaacatgggccaaccaccgacgtaggagaggtcctggctgacgcaacagccctccacgtgaacatggtggtgagggggagcccatagaggggcagccgcacccctggtgcgccctaccttctcagccctccttcgtgtggcagtgcattccatacatgggttttccatgtatatttctcctatataccgacctatttggactataaaagaagagtagaacatccctcatcatcatcaacatccaggaagaagagctactagatattgagcaacactccaaagggcgactgtagcgaagaagagagatgtgagatgcaaagaagagagcgactgtagctgcatgagtcttctactcggtctactatgtacaccaaagggtaaaaggagtgccgggcctgtcggctccctacaacttatacctctgagcacttgtgcttccatgggttctcctgttaagtaagtgttcgtggttcttatggtattgtgtattttgattagctaagctatgtttttgtttgtttgcaggttcatcgttcgttcttgtaacagatgttctagcgtaggactacgatcttctcggactccacgatcaacgttagaatagtaatcgatagcatagatatggtgtctaggctagaggttaccttcgttttcttcgtttccccacggtagaggggtaggcggcaagtggtgacagccctatccgtccctagcactcccccacgtacgggttggaagtagagctataagccagacatctacctagtggactaggtgctggccggtgcatgaagtaaagatctgttcttagacctctaaaaccgtaggaatccatctttgccctaacctttcctacccttgtgttatccttgcatggattagctagaagaataccttcgttccctgtggaaaatacgatactttgaatacagcttggtgaagtgctacgttggtaattccgttacgctttcagattatttctgtttgcgttaaaaaataccaacaagcaaaggttcaaccccattactgactaagtcaagcctgatgattatttagcgtcgaactcggcactaaagtggaaacacttcaccaagaatggagaatttaaaaaaaattacttggagctccttacatccttatggcaagccattgattatgcaattgaagatctatcaagcagtttaactatttggattcccagctaactggttcgataaccagttgaactggtcggatcaccagtcaggctggtctgctacaagtcagcttgctctgaaatgctcaagacggtgttgctcaatggatacaaggcgcttggggactagctgtggagggtataacccccggtacccacaacaaggcgcatgggccggcccaccaggaatggcctgacctagtacctgaagacctgtggcgcacggcagcgctcggaggcgctcggcgtgcactgcaagtctaccataaggcaattagcagatagatagggatctgatctgataagctagatatcagatcccttgattgatgcttatcattgtaaaccaactagattagatcttaaccgacttgtaaaccctatctcccggctatataaggagggcatggtaacccctcaaaacccgataactacacctcatcttgtatcaatatacaatccaccagaacacatgacgtagggtattacgtcgccttgatggcccgaacctgtctaaagctttgtcacagccagattttcgttttaggatttataaattatctaataaattattaatagaatttatattaaatgttcattaatttacaagtgaagttaaatgtgggaaataaaatttcctaaatttaaagcatggatggatttaatttttattaaattctccatgattaattatactctctgaaattttctcggattttttttcagagctcaattcctaaatgatacaaagaacagttcagtaattatttaatcattaatgatctaattataattatgttaagtgttttttttgtttaaaaatccttaatttataaattgttgtctaaaagggaattattagaaatgatcttaaaagcctagaagagaagatctaattttaatttgttaaatctcaatataaaattgggctagataaaattttgttaaatacttctcttgattctttagttcctagatttttctaggacttatttgagccaaggaagtatttttaataaatggaattgcatttcatgaataatttaaatagaaaaatgtttttaaatcctccttttggctttgggccgaaagtcggcccaaaaccgctctctctctccctcggcccaagtcggcccaagccgagccgcccgtgcgcgcgcgtgcgaccgccgctgacaggtgggtcctacccgtcagtcgtcatcttcctctcgccgaaaccctagccaagctgcgctgccgccaccctcgccttagtctctcgtcgccagtagagctctagcgccgtgccgcctcgcgccgccgtcgccgccgccgctcctaccgtgcgctgccgtcgctccagtcgtcgtcgtcgctcggggatgtcatagccgtggtcgccgtcgcgtcgccgtcctcatccgccctttcgccgtccctgtcagccgccggagcaccgtcgccgctgttgatccgaccgttgccgccgctcttcctcgtcgccgtcgtcgtccgttgatcttccgccgtcgttttggtcaccaatgagttcgccgtgctgtccgctacgtgtaggtgtcctccgtttgggccgccgcgccgttgttcgctggcgagcacgcgaggccgagccgtcaccggtgatgacgtcatcgccaacgtcatcgttgccgtctgccgtggtccggtcgtggaccgatggatcttggccgtccgttttggatggatgaatctcggccgttcgttttcgtgaaccgtcgccatgcacccggtcctccgcgaaccctagccgatgacgcaataattcccttttccttttcaaaaataattcattattgcgtcataattcaattaaaatccatataaatgctttaatccggtttaatctttaaaaattcataactaattcattgtaactcagtttaatgtggttcaagttgcaaaagttgtataaaataaagatctacatattaaaattatccataaattgaattaaatttatttaatcctttttaaatgggctttaattagatttaatcttgtaaaattcgtaataaattcatatgaagtcagaatgaggccgttcaagtctcaaaattcatctaaaattatgatctacatgtttgtttactttttatgtattgtttatttggagtttcttagtctttttcctcgttttgtgtgttagcttgtcgtttccgtcgtttcgaaagttcgcgagtgcgccggaagtgttcaagaagattaattgaagaccctttattgcaaggcaagtcacacagatcccaaacacaattcctttgagcatgttgatcctatatttaaattctctatttatttcaactgtgcatttatttttgaatgtcaccgggtggtgtgaacctattcctttgttatggctagtttgcattgattaccctatttcttgattacctcgggttataatttgactggttggatttatatattggttcaactagatgttagacataattgcttagccatgcttagaaacattagcacacaattgggataactaatgtttcactattacttaatgatggatatttaatgatagctcacgatggtcaatcgtgattggttaattaattaatgtgccaactaaaacttgataatggtgggttgtgagcacatggttttgatggtcgtgctcatgacaattaaggaccggttcacgattttcggttgtgaaacattaaccgtgccaaccacaagccagaatgggcaacggctggacacttcgtataacaaggctcattgcggagcaccagactgagaagtggcggagataagcccacgggggtcgctggggagtccatgccttgtttataagggggtgactatgatccgggaacggtgcactgctttgagttgagttatgcgaggggtcttgtcacaatcactcaacatggtgacgtgtctgcgcggacacggtaacatgctggtgggttgtgtcttgtgggtacagtggtacacctctggccagagtaaaactattcgaatagccgtgcccgcggttatgggcgggtctaacaatgtctttcgtgattagtctcacacttctcaccataataaatgatgctataactggtaataatttgattagctcctggtttggaatggtatattcctggtttggagatagatctgtgcagccgggtatggttgttcagaatggttgggcctgtgtagcatgggtgtgctgttcagtgttgattaatattgatgattaattactctattgttttacaaattctcaaatgtttgctaaatgctgtttttgcaaatgagccctatattatgccatcctttggtatccttgtgcacttgcatatttgttgtgtggcttgctgagtatgtcatatgctcaccttgcaataatcaatcaaaccttagttgaagacaagttgcgaaggagaagacgtttggcttataccccagttgagctgcctgtgggagtggagccggagcttcgctagattttattttccgctgcagttttcttcatggtgaggactaagtgcctcttaagtaagtatttatcgttttagttaatttgatgaatctgtatattaaattgtcagtttgtgtacctcggctgattcctggacgaggattttatgcacaaataagttcagaaattactagtgaatttctgggcgtgacaagcttcatgtccctgctcttcgtgttcatcatctggttctgatcatgcacgtccctccacgtagttaatctaccatcgtggttatccccctcagtggactgccgaccatatttagtcaaagtgaactataggagcctttgagcaagtttaattgcatagccaactactaaatgcaaatcatctatagccaatctaatagctcattcatacaatagttatccataaaccattaatacatggtcccacctctcatacacacataacgtattggagtttgtgctacagctggctacgaatctgtagcccgctttccttctctctcttctctcctccacatatgcttacaattgacttgtagcctgctattgtactcactcttatagattactgtaacctgcccttaacaactaattaaggtggaattaaaattccacggtctcataacacagtaacacatgagccaaattcaaataggctgactgtcacctaatttaaggtgactaaataaaagggctaccatgccaaaaacaaaattatagttcttggacatgcaaagctgccgagcttgtcaacatcgattctttggcctgatctgttgtagtatgttgttgctctctggggtagatatgtgtagatttctcaatatcgtcatcagtgacatcatcagtctcattaccctctttgctcttaccccacagcatggtgtaaagacttgcgaccagcaaaattccacccaagatgctgccaataaaggaagagaagaaaaggaaagtttgtttatttcagcgtgtttttagaatattgcacctttgatcagctgacagtgagtatatatatatatatatatatatatatatatatatatatatatatatatatatatatatactatatgatttaatttacttgccgaggtgaacaatctctccggggtgcagga

SEQ ID NO: 82551 - DNA, 15017 bp, Oryza sativa
gactcagcttttcatctaaagatgttgggcaagttcttgcagtggcaggtaagtcaaattcaatcaatttctttcctgcaaattttaaacacattcaattccttaatcacaggatcagggtgtttgcatttaatgttgagctctaacatcttggttcggaagataaacatctcctttgttacattgtaggtgccagccttcttgtatatcagctttttatctacggttgggttgataaaattcttggacctatccactcaacccgcatttcagcggtgagttactaaatttcagtatttcttatataatttttacagtttacttgttattggtaactgtgagttttaaaagaaaagagttcaaaatattgctggttactactttgcttttatcagctgacctttagcattgcaggcactatctgtaccaattattgctgcttatccctttatgacacacttatcaggaataagacttggtgttgccctctatagtgcagcaatgatcaaaagtgttcttgctgtaagtactttatgaacttaggattttttttaataaaaaattatagaagtacaaattcttaggtactttttaacaaacattttggttgtgccactcatggaggcatggaaaactaatactgcaacaccacgaaaatttcatagcaaaggtaatattgcacaattgttcagagagactatgtgaaaataaataccaattttttagttcaaaagagaggttgagaaaaaaatatccatgagcttacagttctgaaatttaacccatataaaattagttagcacttcactgcaaattgctagataatttagtttatttatttttcacatggcatatttgaagatatcaagatactgatattttgtaatgttgatcagataactataattacgggcacctctcttctgcaaaacaaagcagtggtacttgtcgaacttatctcaatcgactgttgtctgataggctcaaaaagaaaagaaatttctctgatacactaatatcaaataaatttaatttttgaaaattgcatcgttttgacagccacaagggcaacggggtgctgcaaatggaatagccacaacagccatgtccttgttcaaggctattgctccggctggggcaggagttatgtaagtacaaatgttgctgtctacaactcctagttataaacaaacaactcaacaaagctactagactcagtatcactttccaagattgaacagtagatttctggctgacataattgtcagtttgcaatttgcagaaagactagagggatttttttttgaacaaacctacatttagattttaccaatttcaatgaatagagcagaaaaaaaaactgtaatcatgaaaatgttggtgattagttcgcccttcccaatttagtgaatagttgttgcctgaagcctaaagatgaacatgtccttacgaaactgtaaacccgtttgaagaaagaaaaggactgactgttcaaaacctgtggttgcagattttcttgggcacaaaagagacaacatgtggcattttttccaggtaaataactaaatactccaatgaatttttaggaaccatcaactgtgtgtgacaaccatttactacaatactttaaattagagcaagtttaatagtatagccaactagtaaatccaaattatctacaatcaatttgatagccaattcataaaatagttacctacaagtatatactgcactattaatatttggtcccacctgtcatacacacaggagtccgtgttgcagcccgcttctcttctctctttcctcttttatctcctccacatgtgtttatagctggtttatagtctgctattgtacctgctcttaggtatgtataaatcggtgctttgtaatgtttatttgatcatataaattgtaaattcaacgttgtgcaggtgaccagatggtatttcttctactgaatctgaccgaggtcattgggctcatgttaaccttcaaacctttcttggctgttcctcaacaatataaatagaacattcagatactgctagctggtgtgacaaagatcataaagatgtagttacagtgagtaataagtatggcttggtattaaaagatggtttagatgtggttatagcataatggtaggatcatgcagcattccagtgcagagtctctgttggattttgttctgctttgggcttatgagcaagataaccttgtatattgcagtgttgaatttgaataactgctcttctagctgtggagtactagtgaggtgaggtttggccattggaactgattaatcaaaactaccaaccatccaatcaaatcaagcacaagaaaacatgtaggactaaaaatcagttgagtgctattcgcgacacagaaaatgggatgaatagctcgtaccaggcagagggcaggatgaattcgggtgcagaggcgatggggagtagctgctaatcggatctctcagcagagatcaatctctatctccgtaacgccgccgcctccgccatcgccaagggcaccacgaatcggggcgcggagcactgaggagccactggcctccgccctcctcgagcggctgccctcgttcgctcgatgagccgtatgtatccgtacaccacctccgtcgtctcccggcgcggcacggcagccacggccccgtttcatttggggaagacgagcggccaaccgccgtcatatttactagtaggtcgagaaaacggacgatatgccggatgaaatgccacttaataccatgcacaggataaaatactactcaatatattatctaccggatgaaaattgaaatgccactttgaagatttttatgcccaaaatatccatggagagagagggagaggggagtgccggccgggcgacgccggaggccttcccgggtggcagcgatggaggcggccagcattgacgacggggagaggaggacggggcggcgacgacgggggaggaggataggccttgccgagcggtggccggcgtggacgacaggggagggaggagaggcgatgacgtgtggaaggaggacgggcagcgagcacgcctacccgcacgttcgtcgggaggtggcagcagcggggagcagggggaggaggaggcgacgcggagggaggaggatggcgaggcgagcagcatcgcccgagcgacaacggggacgacggtctgaggctccagggccggccctggccctatgcagccgaggcgaccaccgggggcccatgatggtggggggccaactctgaaaatttaaaatccttcgatgaagtagatctttggtcgcactgcaagatttttgcgaaaacatttagggcccctttgaatcaaaggattcatgtaggaatttcatagaattcaaatcctatagaaaaatatcctatttggccctttgattcaaatgattgaagctctccaaatcctatgaaattcctatggaatggcacattacatgtgaattttggaggaaatttagcaagagctccaacctcttggaaaatttcctttgagtctatctctctcatccgattcctatgtttttcctgcgctccaatcaaacgaccattcctgttttttttcatgtgttttgcaatcctctgttttacacttcaattcctgccagaatcctgtgtttttcctattcctctgttttttctaccttgcaattcaaaggggcccttactcatgagaactcatccaatgtttagatcaatgatttttattcagaatcttcgatgtccgcgcctgagattctgaagtctgttatggatacagattgctatctaaatgtttcagttgcctatcgaattctcttaactgtacctatgacggtagcttcagctgaaaaaagtttatcaaaattgaggttgttgaagaactatttgagatcaactatgtcgcaagaaaggttaaatggcttggttatgtgctctattgagaatgatatcttggacactattgatcttaataccgttcttgataattttgcatcaagaaatatccaaagaagtatcttttcataagaagcaatgaatatgatggggttctatttttcactaaggtaatgatattagttctaaggtattattttggtcgactttatttctcaataattaccagtcatgttaaatttaatatatggatgtatttattttcgttttgcaagtaaaattagcgtttatatatatcacaaaattttttatatagtttagagggcccatcacgataagttcgcctagggcactcaaaatcataggaccggccctgtgaggctccactgcagtcgcctcttcttccgccctgtcctcctcccccgtcgtccccgccagccgtcgccgttgcctggcgaggcctccggcaccctccggccagccctcccctctccctctctctccaaggacattttgggcataaaaatctccaatgtggcatttccctctccctctctctccagggatattttgggcataaaaatctccaatgtggtatttcatccggtaaatgtattgagtggcagtcaggggcggatccactatataggcagtggggtcctaggaccccagtcaaattttaactcgcaaatataccctttagatgtatgacatatgggtctccactatacccgggaaaaaggacccccgctctcataatttcagttcattttctcacttgtgcatcggtgacaaccttttctgtggacatgatgaatcaaaatagtctaaaacaatatatacatggagtatactatgaagtaaaatggtgtgtatgttctaaaccttggataactctcatatagatgcccccagtccatttttgtcttgcgtccgcccctggtggcagtttatccggtgcattatattgagtgtcatttcatccgaacccaagctagagagtgacatattatccattttctctatttaggtccgtttgttttagtaatctagattattgagtcattactacttccgctttacattatggagtagtagtataagctactctctccattttatattataaattattttgattttttttagtcaatcttggttaagtttgattaagtttataaaaaaagtaacattttaaacattaaattagtttcattgaatatatttccataatatatttgttttgtattaaaattactactatatttgtctataaacttagtcaaacgtaaaaaagtttgactagaaaaaaagtcaaaacgatttagggtagtcccaacccatagtgtccataagcagtatttatggtgccatgtcaataagacatcataatagaaactacactccacaacccatgatttcttaaagtgagccattaataaatacatcatctctcttctctaccaatcatatttattcttcatctattatgaagatattattctctcccgatgtaaaacttgataatgtctagtgcataggttctcgtgttgaagttggatcttgcatgagacccagtttcttcctctctcctctctctcttaattaatatagtgccacataaggtaaaagtcctacataacaatgtagttaatgccatagaaaccatcctaggtggagggttgggactgccctaatataatacgaaacataagaagtatttgtttctctctagattattggagacacaaaatactaggtttgaaagattaaagtctataaagcccttagctgttttgttcgcctaaacagcgacgcccgtctgagtgctgccatgattcgctaggtctctctaactctcgatctgttctggagtaggggcgataagagctaagaggtacaaatgatagaagtgagtactttctttgaagtatgtaggggccgtgggtttttagccacccaagaataaaaaaagaacatatttttggaggagattactagattatactaatttgaataatatgattataataatctacttcctccgtattttaatgtatgacgccgttgactttttaaccaacgtttgaccattcgtttttttttaattttttttatgcaaatataaaaatacttatgtcatgcttaaagaatatttgatgataaatgaagtcataataaaataaatgataattacataaatttttttgaataagacgaaatgtcaaacatttatcaaaaagtcaacggcgtcatacattaaaatacggattaaaatacggagggagtattaattttgtttcaaattacttctaataatcttaatctgattgcaattgcgtggccgttgctgacatggattgtaggcttgtagcgggtcaacacacagttggcccagaacacatttacccctctgtctaggcccatatctttgcctgtttaatgtcacggcctctaccctagtcgtcgtcgtcgtcgtcttctttttacatggatatccctgttctttttatagcactaaaagttagcgtacagttcaactaaataattgaccatttacaaaaaaaaaactaaacaattgacccaaaacaaggttcaaatcaagaatcacatgtacagtttttttaatgaagatatcatgtctgtcgtcctaaggccttcggtgggttaggaattcctaaccttaggttggcagggttcgccttgcgcgttcgctggctttggcttcagcgttccgggcatccctattgggatggcttgaaggccccggtcgagcagtctgtctctgacatgttcgaggcgtccaccttcttcgtgccgggggatggtgaatctatgctcttctggactgactattggattgatggaggccgctcagtggcctccttggctcctgacctcctcttcgttgtgccacagcacctccgttcgcgcacggttgcttctggcctggcgaacaactcctgggtttcggacatccgcggggccctcactgtccctgtcatctcccagtttcttcttatatgggatgctgcacttcgaattcagctctcgccgggtgtcagagaccgtcttgtttggcgttggacgagcgaccagcgctactctgcgcgttcagcgtaccaggccttcttttttggctagcactcctttgcctgtgccgatcttctctggcacgcgaagggccctgctaaatgcaagttctttctctggtttgcatttcagcagcgctgctggacggccgacctcctcctaaagcgcggcttggatagtcattcggcctgccctttctacggtcaagagcttgagactgcgaaccacatcctcctcgattgcgtgttcacgcggcaagtttggctccgtgtgcagtcgcctcttggttggactgccctctctcctccccggggtagctgtctccaagattggtggccttcttctagggtttgcttgccggggcatctccgggccagtttcgattctatggtcctcctagtctcttggcaactgtggaaagagcggaactccagagttttcgactctgcattgtcatcggtctcggaggtccttgagtccatcatctctgagggccacctttggtctttagctgatatcattaattttgggcttctcctgggagggtaatggctttgccccctcccagctatttggagttgtgtgtggccatcacagtagtctttcgtctcttctttattttatctttttttctcccctttcttggcataagtcggtctgactgattgcgttgtgtaacaaacattctattcttctaatatattgacgtgcaatccttttgcgcgtttgagaaaaatgaagatatcataggtagaagtaatggaacatatcatagtactccctccgtttcgaaatatttgacaccgttgactttttagcacatgtttaaccgttcgtcttattcaaaaacttttgtgaaatatgtaaaattatatgcctacataaaaatatatttaacaatgaattaaatgataggaaaataattaataattacttaaattttttgaataagactaacggtcaaatatatgcttaaaaagtcaacgacgtcaaacatttcgaaacggagggagtactatatagctagctaactgccaccgccggccaggttattttggcttgtggcgtgttcatcgatgcaaagaatgcatactttgtttcagaattaactgatctggaagaaccatgcgttacacctatcgaccaatcaagatatgaaattatgcaccattgtttcacgggattaattaattaaagctagcttacatgcatggctactggctaggagaggccgaactgggtggcacacttcatgcatgctgccgaactcaagcacattgcaagctgatgatgatccatcgatggtgctgtatccatcatcagtgtaaaatgaatgggagaagcgataccctttgtctcgggttcgcatgtatttatataggtagaaagagcctctaccgtggctgttacaagagattgaatcacagaagtttatcccgtgagtttacaacaaaccaaccttatctatctatcttaacaaactacagatgaatatacatgagataacaactcttatcttaacactccccctcaatcacaacttaccaagattgagattgtgtcgaaaacctatcaactgctgaagagaaattggtttcgtgaaaccatcagcaacctgatcttgtgagctcacaaaatgtatatccaacaatttctgagctacttgttcacgcacaaaatgataatcaacttcaatgtgtttcgtccgagcatgaaacacggggtttgcagtcatataagttgcacccaaattatcacaccaaagtcttgcagcattaggatgtaaaatacctaattcagttaataactttcttacccaaataatttcagctgctgcattagctagtgctttatactctgcttcagtactagaccgtgagacagtggcttgcttccttgcactccatgaaatcaagttatcaccaaaaaacacagcaaaaccccctgtagatctcctgtcagcaaaaccccctgtagatctcctgtcatcaacagaccctgcccagtctgcatcagagaaagcactaacaagatttgatgaagacttaacaatcttgagtcctagatccaaagttcccttcaaatacctcaaaatccttttgactgctgaccaatgagctgttgtaggagtttgcaaaaactgacatactttattcactgagtaagatatatcaggcctagttaaagtaagatattgtaaagcaccaacaatactcctatactgtgtcacatcactaggccccaattcatctccaatctcaacagacaatttttcagcagttgacaaaggtgtactcacaggtttacacgatgtcatattaactctttcaagaagttcagtagtatacctttcctgtgagagtaatagagtttgcggtgtcctcttaacttctattcccaagaagtaatgcagatcacctagatcctttagagcaaagtccttttccagatctttcaacaacgcatttacagctggggaagatgagctagcaacaatgatatcatcaacataaacaagtacaaacattttatgatgccccttattatagaaaaatagggaggtatctgcctttgaagagctgaaaccaagttcctgcagtttcttactcaacctagaataccatgccctaggagcctgtttcaatccatataaagctttatcaagtttgcacagaaaatgtggttgtctagcatcttcaaaaccaggaggttgtctcatatatacttcctcatctaaataaccatgtaaaaaggcattttgcacatccaactgtcttaaactccaaccttgagacattgcaatggacaagactaatcttatagtagcagccttaacaacaggactaaaagtatcctcatagtctatcccataccgttgtttaaaaccctttgctactaacctggctttgtatctgtctatagtgccatctgctttctttttaatcttgtaaacccatttagaatctataatatttttacccttgaccggtggtactaaatgccaggttttattatgcaaaagagcagaaaattctttgtccattgcctgtttccagtttgcactgctaagagcttcctgtaaactagatggctcacctgtctcagtcaaacaaccatacctgacagtaccatccgtatacttctttgggcgatgaacaccatgctgtgatcttgtcactggacgctgctggatctgttgtgctgcatcaaacgtgtgtgggctggagacgttgcctccactggacgtagcggatccatgcgtcgcatgcatcccatctgcagccgcagacgagaccacatcggctggcgaaatcgacgacgtgtctccccctggttcgtcatgcggatgcgtgatggaagccggcaccgagtcctgcgtctgcgacggacaggtagcagacggcgcgctgcgcggaggtgactggagcgcagaaccaccctcggggtgagcaccatgcacgtcggagccatgctgcataaaatgacgactgtttgcagccgtttctgcaccatcagcaccagcgttttcaccaggatttgcaccattttctcctgcagaaattcctgcatgcagctcagcagtctcgtcagtatggttagggatattaatcagaggttggttgcacagttcagtacccccgaacgaatggacaagatgtgaaggcaacaacaagacttcagcccgcaggcgagccccggcattaggacgaagctgagcgaaagggaatatattttcatcaaacacgacatcccgtgagatatacacccggccagaattcacttcgagacacttaaaacctttatgcaaaggactgtaaccgagaaagacacattgtttggagcggaaggccaatttatgggtgttgtaagggcgaaggttaggccaacacgcgcaaccaaaagtgcgaagagcattataatccggttgttcctcaaacaaatatgcaggtgtatcataatggatgattttcatgggagtacgattgatgagatatgtggcggtgagaaaagcttcatcccaaaatttaagcggcattgatgcatgagccagcagagagagaccaacctcaacgatgtggcggtgcttgcgttcagcagagccattctgctgatgggcatgagggcaggagacatggtgagagataccaatgcgctgaaaaaaggaatttagacgttggtactcgccaccccaatcggtttgaaccgatttgattttgcgatcaaggagtcgttcagccatgttttgaaaatctttaaatttctcaaaaacttcgaatttatgtttcaacaaataaatccaagtgaacttgctatagtcatcaataaaactaacataataagatttattgccaactgaagagggggcaggaccccatacatctgaaaaaataaggtccaaaggagctaaagacaaactgaaagacttggggtagggtaattggtgacttttgccctgctgacacgcatcacatacagaccctacattggaatccctaacaacagggagattattttggctgacgactcgatcaacaatagaaaacgacgggtgacccaagcggctatgccaccttgtcatggacggcttgatgacggcgacatgagcttgtttattggaagactcaaaggaagcagcagttggcaacgggtacaggccgcgtctacaccgacctcgaaggagaagcttcttcgtttcctaatccttgagcaagaagaagaaaggatgaacttccatgaatgcatggttatctttagtaagatgatgtgcagaaacaagactcttttgggcatcaggaacatgtaaaacatttcgcaaaacaacatcacgaacaggggtacgaataacagtgcgcccaacatgatcaattcccatacctgtgccgcttgccgtgtggacttgatctccaccggtgtatttgtcccgcaccgtcagcttctctagctctcctgtgatgtggtcggtggcgcccgtgtcgatgtaccagttggtgtcgacgccgtaggagtttgttgccgcagccacgctcttctcttcaccggagtacgaggtgtcaaacctcttccagcacttcaccacagtgtgcccgatcttgccgcaaagctggcagatgggcttcagcttgccatcgccacggccgcctccgccgcggccaaaaccgccacggccgcgatttccgctgttgggaccgccatgtcctcctccgcctccgcctccgccgcgccctcctcgtgacgcagagtttgcagaggactgggcagccccttgaagcagctccatgcgcgactcaaaccctgtcaattgagcatgaagctcgctgacagagattggttcagcccggtttgccacagatgagaccaccgagttgtagtcgaagtccagcccggcgaggatgtaggttaccagctcctcgtcatccataggctttcctgcagaagacatttcatctgcaagcgatttcatcttaccgacatagtcagatatgctgagatttcctttcttggttgttgacagcgccagacgagtgttgatcacacgcgcgcgcgactgagaggcatagatcccctcgatggcagaccagacctccgatgctcggggtgagcgtcgccacctgcgtgagtacctcccgtgacagagacatcaggagataactcagcacttgttgctcctgcgccacccattgggtgtacgccgcattgacaaccttttcaccagtgttgccgtccttgtcctgcagcaccaccatcttggaaggaggcttgatggagttgtctaggaagcccgccagttgggctcccctcaacgccgcaaggacttgagctttccagaggacgaagtttgtcttcgtcagcttctcggtgaccacctgccctaggatagcaggtgccgcagcagtggaagatgacgccatctaatctagatcaaattgagatgagtttggtggagggagacggctctgataccatgtaaaatgaatgggagaagcgatacctttgtctcgggttcgcatgtatttatataggtagaaagagcctctaccgtggctgttacaagagattgaatcacagaagtttatcctgtgagtttacaacaaaccaaccttatctatctatcttaacaaactacagatgaatatacatgagataacaactcttatcttaacaatcagcaggtaggcaggcacagcttggtgcagctagcaactgtcatggccatgcgtgtagtcctagtattgatcgatcgatgcagagagaggtcagatgcatgcgtagcttctgatttgacttcaagtaatacagacagccgtcgcatatatgcgtgcatcagcgcttacatattattttcttctccccgaatatatgataatgataggatcctctcgtttcttaatttcattaattaaccccttcatgattgctcatttgctcttgcgcatgcatgctacctgaatccctctgtctctgccgctgtagcgccgatgaacaatgacagattatgatttatgcaacgaaaacctgaatcactgaatgtgctagaagatgagttaattaatttcacggctttaattgatcactatgaatacttggcttgttgtcattatgtatgtacgtacattgccatctagctagaatttaactcatcaataatcatggcttcattattcgccgattgcaaaaagagaaacatatatcagcctcatgtggcatgaggtgcctaaaatatctcacacgcgcacatactgaagcggccggcaagcttgatgcatgctgctatggtgctgactagctagcaaccagcatggatgcacaaagaagcaacttcatggatccatggctatataatatcactggatgtgtgtcttgcctacccatccggtctctgaacatcgatcgagttgaccactgtcgttttagtttcaatcggtatctgaactttattgtgtgctctgagtgtagtgcatagctgtatacttaacctgactatcacaactaatctgcttgacttttcaggtcagctagctactgcaaatagtcaatgagtgaggaggcgccgccatcatcgccggtgatgagggcggtgttctatgatggctgccccggctgcgccatggaacggaagctggagagcagccaaggcatcccctacaaggagttcttctttgttgggatcaccaccattgcctcttgtatgttcttcttaattaactaatgaactaactacggttatgatgtcttgaaatttttactatgagcccatacatgcatggtatacttgttttgatgatacaactagcttgcaatccatatgttgataatcttattttctgatgattggttgtattgttttccttttcagctttaccaatatcctcgttgttcccattcctctacctcatggtactacgttaatctcaatgggatctaatccatgtcatatatcttctctataggagcaaaaacgcatgccatgtttcactaagtcatattttataatcctacaattattttatcttcacactagatagaagacctacatgtggcaaaaaaggaacaagatattggattatacgctggatttcttggtaagaatcatgaaagttatgattttcaatcagcgtagcccactttaaattccaaagttccttctctttcctatttcataaaaattatatgctcatgcagaagtagaatgtgacaatatttatgttttgtaggtgcatcatatatgatcggtagatgtttgcctcactcttttggggtgtagttgcagatcgtatagggaggaaacctatcattgaattttctattttatcagtgtgagtatttattgtctcaaaatgttcacttttacatgaaaaatttgaaaagctcaatatatgatcctctgtttttaagggtcatattcaacactctgttcggattaagtgtaaagtattggatggcaattgccacaagattccttcttggtgctctaaatggcatgctggccccaataaaggtatgctacaaagcata

SEQ ID NO: 82552 - DNA, 713 bp, Oryza sativa
  unsure (1)..(713): unsure at all n locations
ctgcagccctgtcgatataaaatcatgctgaacatcgcacgttgtctgctgaaatgcatattatttctagtgattaactgagtgtaaaccacatgagctaacaatttatatgcaaagcagtagcaaaccatccatagataatagcaagaacaatatacctctgtataagccatatcatgaaaggagaagacacaatagagaattatggaggacatcaagggccaatttctcaataagctcttcttgcagtccaaactaccattttggtcagccttttcttttggatcaatcaaatggctctccaaagcttcaacagtttgggatctacttgcatcagctttatgcttgtgtaatgtctcctaaaatacatttcaagttactttacaactatacaaaaagaattaatacaaggtaccgaagaattatcctttctcactatgagtcatgctaaatattgatacttctgctaatgcacaagtttttaagagaggaaatataaatttgacttcaaaaagtaacaaaagagactattaattcctgatgaagtggaacaaccacattaggataaaatgcagattatctccgttataattaccagtaactgattttggttgctaagcatgcagcaaaacttttgatttcttttttcagatccatgtcataagatcttccacagtgcanatatatcanatacaactaaatatatgacaaat

SEQ ID NO: 82553 - DNA, 2367 bp, Oryza sativa
tgtggagtgccaatagctggagtagtttttgtcacttagtgtgttgcttatgcttcaaaaattttcatttcttgagcatgcaacgaaccattccatgtaggagccccttgcctgacctggaaaacatggtaattttggaaagtaagcagacaatgccaatattttactggattatcttgacatgttggatatcttggttaatcttgcctttgaccagctggcagccatgcatgcccagtcattgaggcaaaggtaaagacaccaccctagtatttactcatgcttgtgtcagttgtagttttcacatgttgactattgtccgctgagagactccagactgcatgaatgtgttatgcgcaaatgcagtttgaggaatccctcctcatggatggttggtacttaccaccagaggaaacaggaatggtgataagttggatggttacaccgtggtctcttgaaccgtaaacaactttcatgttcttctcacacaattacacttatatacgagttttattggatatagtagaaacttatggatggcattcttttattgaagactgtgtcagtgtactaaactacaaattaatccagcttactaccaatgaaagtggtaactgacaacacattgatcacttgcagagaaggtaaacaatacagctgtataatgctagagaaaactaatacagctgcataagttttatacttttacacttatacctattgaattcagttgtcttttgtagaaacttgtggttgatattctctgttgaatagtgaagtatatcaatttaactaaactgcataagaccctttttgtatcagttacatatttgatcacatggacataaatggttctgacttttaaatctagccatgaatttgttgattctgttgtgatccaatacatgttaacagtagcttgttgctaagttccttgaattgagctcaagcatctcttttattgtgaaaatgaccaggtatttaagaaccatggtgcatctgctggggcctcaatggcacactcacatagccagatgttaggaactccctttgtccctccctctgttaccacccggcttaactgcatgaaggaggttttcgagagattggggaagtgcagcctttgtgagttccagtccaaggatattttggtccgtgaaacacacaatttttctgcaattgtcccttttgcagcatcgtatccttttgagatatggattattcccagacagcatagttcctatttccatgaaatagacaaggatacggtatgtactgttcctaattcgtttttatgtgccattatcatattatgcttagtggttcatactacagtttcgtttacaagtttatgtgattcacaatttgtatattttttccttctttgcttgtatcatattaccttctgtgtatgtgattcacaatttgttactcattgttgaagtaagtccatctgtctatatttcaagcttcaatgtgtatgctagaatggtagttaagtggttaaacgtggacttaaccagccaagtttaaatattcaacgcctgtatgcccagtgattgtaattgccaggtgtaagtgttggctgccatgagaaccaagttcaatgcagtggcaataatgcaatatgctttcagctattggttcgattgacttagggtgcttagatatcttgttgctttttgtgatatgcctatactactgctagaattcagtaattagtgttttacatttactctggtgtgtcacatggaaattagcaaattgtctttctaaatcctgattaaatgttggcctgtaaatgctgtgcattagctattaaataaccacacctttaatactacagctacgttatgtgccatgtcatttcctacagccacaagcagcacatgacacgtttgtgtctctctggaaatttatgagttcctcatctggctttgagcgcaccatactgggtcacatatgctgtgggacatctgtgcactaaatcattttgatttactttactttttttttccctttcagtgcttattgatgctttctgtgttctctttcttttgatgtaaatgagacgtgagttctatttcatccatgttggtgtgctctagtcattgatcctgttgctcatttcttggtttgtccatttcagtttcttgtatgctcatactgcctgactatttctattgcctttttgttgcattaactgattgcaatgatgtctgcaagcactggatcttgaatctttattgaggaccatgctggcaagagttgtctaaacagctcaacgaccctccattcaactttatgatacacagcgcaccatttggagtctcatcatcctgtcttccttacacacattggttcctt

SEQ ID NO: 82554 - DNA, 2596 bp, Oryza sativa
aaaaggattaaaaaacctcgcctgtgctgcgctgtgaagtgcttgggcgagtttgaacatattttgacaaactagccaagaacccatatgttccaataaaaaaacaaattatgtcgtgtgttgttattgtgggtggggaactaatcctccacacacgtaaaatggagaaacggattaacggatgattaatggagtattagtttaaaaaacttaaaaaatatcaatatatatttttaaaattaacttgcctataatttttttaaaaaaaatacacattgttaaaacattgtttaacagtttatgaagtgtgcacgtgaaaaaatgtgaaagtagaatgttgagaaagggggaaaagaatgcaccctaaatctaattcaacaaaatcaacgaaaattcaaccttttttgaaactgccacgcatgttgaccaaaacggtcaacttgaaggagtacaaccgttacacactcttagagcaggtacaatagtgagctataaactagctacaaatatatattttaaagagataaataaggagagaagagcagcgggctacagatttatagccagctgtaacacggactccaagacacagtgtgcgtatgacaggtgggaccaggtattaatagtgtagtatgtagctattgtatgaatgggctattagattggctatagataaattggagctagtaattggctatactattaaacttgctcttactagtttccaactttccatctctacatgctaactactccctccgtcccaaaaaaatagtacaataaatctgaacaaaggtatatccagattcgtagcacatgtgtcacattcaatactagtttgatcttttataggacgaagggagcagaatcttgatgatgggtacacgcacactcgtggagggagacgtggagtaaaagaagcacgtccatctctacatgctacagtacacggtactactcataggaaataattttcttctgtcaggaattaatccgaaaatatttctgtgtcattattagcctttgcagggtcacatacgtacgtagtacaaatctcacaaatccatccgattcgtgcgtgcagtcgatcgatcgatcaagctgtaataatgtgaagtacacaccaactatctataattaaacttgctccatctgatcaagaagcatctggctgtcaccgccgccgtcgtgtccctccgccgccgccgccgagaaatctctgatgatggacaggtacaccgtggcttggatgacgacgatgatcgccatgaccagcagcatgaccggcagcatgagcagcgcctccccccagctggtgctgtccaccaccaccatccgcgcgatcacacccagcaccaccaccgtagacacgacgaacaaaacctgcatcatatccacacacagatcatcagctaatcaagtaatccacactgaattacgaggtaattcctgtgtttcattatgaaacatttttcctcgtcaaatttataaaaaaaaatataataatattttcagcacaaaacagatatattattaaaatataaaaattgaaaatgcttctgccggtactttggtacgccattcgtgtataagtcggttttcaagttcgttcgcttttgaaaatacatatccgtatttgagccggtttttaagttcggttttggaagtacataagggagtcgtaaaaaaacttgcatgctaattttagatgaacggactcctaactacagctcataatttatatatatatatatatatatatatatatatataacaaactcatataacaatagtaagattaaatagtttccacccgttgcaacgcacgggttttttctagtattattaaaatatttacaatgttatatttaataaaattaatttgttgttgtaaatgttgcttaatttttcctataaacttaatcaaacctcatatgtttgtctagaaaaaagtcaaaatgacctataatataaaaaaaagtgaaaataacttataatatgaaaaagagaagtactccatccgtttcacaatgtaagactttctagcattacccacatacatatatatatatatatatatgttaatgaatcatgtatatgtctagattcattaaatgaatgtggacaatgctaaaaagttttatattgtgaaacgaaggaagtagtaattaactagcagttgtcagtggtctaggtacgcactgtgacgaagtttttgcaggcgggggtcatggggcggtgggggaggtggtgcgggggcaccctccgccgctcgacgtagttaccgtcatcggcggcggcgacgtcgacgaccgtgtggggcggcgccggcgggagcttctgtagcgggcagtgtaggggatcttcaaggttgtatgcacccatgaaagggaacatcgacatgtcgtcgcacgcgcgagggacggacgtacacgtacggctgtcttccctttcgatcgtgccgccttatttttatagcggggagtccccaatccgattccgtcttagaaacgcagacaggacatatacacgggataaataccccggtaaatatcggcaagtgagtcatgcatttggtttacactagtatcatttt

SEQ ID NO: 82555 - DNA, 823 bp, Oryza sativa
ctgcaactagaaaattgtaaaaatactactaaaactgtaatttgagttgcattccttgcaaaattggaaaaaaaaagtggtaaatttgcaaatgccccgatgttatcatacacatatctgccattgttgtttcaagagccagctgcctagttttatctttgtgcgtaacatactatttgggataaatttataagcacaatcacaatatatttccttaacatttggttgcttgaatttacaaagtgtatctccatcgactggttacagtaagagggaagactgaaaccgttctgcagaatctcaccaagaatagctaaaactactggtgtgtgaagtgtgaactaatggcagggagaaaaattgaaccgtgtttgccaagtgctatatagcctagcaaagcttcagaagtgttcaactgcagctggagaaaagatgcaatatctcctaccaccatgaccagttcagtgctcatttcttgttgaatccaaacaaggatttgatggcgttgatagcattctcattgatgaacgattcgtcgtacttgttcagcaggacgttgaattcctcagttttcctcaagttttctagatccgggtcggtgcgaattctcttcatgaaatcaagcaaaatgtgtcactagtcatgaagaatgcttatctgtactgcaaaagagttgttgtctggttaccttgaagtcttcataacctgctttcagggcatcttccagtgcagaaataccagcttgtatctgcagaaagaaacatccacatgagttcatggacattcagtggcagatttgcttttcatattgagagaaatatcg

SEQ ID NO: 82556 - DNA, 880 bp, Oryza sativa
gtttctactagcaattagtaactcccattttagctgataaattccttacttgttggcttttgcgagcaggggatgatgtcctcctctcctgactcctaaggggacagagttaataaaggaggacggcctgcactgcttcagcttcgattaggatttaggagcagacaagaagaagcttctgtacttttgctggcaaatggcataaaactcttgcatctcatggtcgcttctgtattgccgttggccagtttgtatctgtacattatctaaaaagtttgtatctgtaatttctgtgtgtagttgctgttggccacttgtatctgtaagttctatttctgtgtccatgttttcgttcaaacataattatgcgagtatagtcatgttgttgcaggctgcatgttcattcgtatcagactcccttgttgtaatagctatacattgtacctctctaattgagctagctcatgcatggcgtcttgtacagcgcatttggggctaagaacttgggaaaatgttggacatgacaacatcagacatggcaaatctgcgttgtataagttttgactgggactgaagctggcgagaacggtgattacgtggctgtgatgagtggtgacagtcgagattaattagaactgaatatgacgatgggattcagcggcaataacacaactggccaaacctcggtgtcgctgtgttacgtagtagtactgaactactgatgatgtgtttactgtttactagtattcagtactgcaggttgacgccccagttttgtgcacaaatattcgagactcgcaagtccaaaaccaagttaaagtaattcgttaaaatcaatgttgtttttctagtcttgccattaattataacttttttccta

SEQ ID NO: 82557 - DNA, 1403 bp, Oryza sativa
tgtacatatgtggcccgcaatttgcgggctaccatcgttatattttctttcatatattagtatgtatgaattatatggtggtttaaggatatatatatagacacacacatgtaaataggtgtcaattaattgctactaattagacttctaatggcttgctagcaacatatttaatttctctctacatgtatataaacatggatgaagctagaacgaatattaacttatatcccatacatatatattacatggttaatattctaatcacatgtggtaagtccattaaaatttcttaaaatacccttaagctgccatgtggtgcactaataaattagagaaaatattagaaattctaaggaaaaaaacaaagtaattgatcttagaacaaactaaatactacgaggtcccacctctccaccttgggtacggacctaagtacgtgggtacctacgcttcccctccaccttctttttctccatgtatacgcttccctcctttccttactatatcatgcgccttcatgagacgatttaatcgcaagaattttgagtatcttgctctcgtgttttttatttgtagccatactacaagtaatagtttattaattactcgagaaaaaaacatgattcaaaagtcgtaagtacttaatctattttctactcaaaagtttgtgaatggttttttaagattccttaagaaaaatagaacccttaaattattaaaaaaatattacaaaataatagtatccgaacacttaatctataaaacaaaatttttaaataaacaataaaaatcttatctttcaataatataagtgcccgtgcatgcgtgtgggccatcttcctagttggattaaaaagaaaatttaaaggaaataccgttccttgtttttcaaattcctgcatgcgtgcatgcactccgtcggtcacgataaaaaattcgtagcatgcaatttggtggcatccagtatatactaaattcctctctagtagcatttaatttcgtggcatccagtatatactaaatccctcgttagagtactggggatttactagaacatgctaataattaacgatgcatatactggttcattactgcttcattcgtctagcttcttggtttgctccatccagaatcacgttcatcgccagcgtgtacagctaccgttggatcaaattaatatacaatcgttcggctggtaattttttaaaggtagtatagtattgttttttaagcaacagtggcggaaccaggatctcgatacgtctggggctcaaattgaaggctttttaggattatggataccagacacctaatagtagttgcctaaatctcggcaggacccaccacataccatgttttatacagaaacagccttcggatataggagttccgcataagga

SEQ ID NO: 82558 - DNA, 687 bp, Oryza sativa
attcctgcagccccacgaggaaatgagaaatactgtactagtataatttccttgtagcattcaggtttctgtcaacatcacctctacctcatcttcttgcaccagtttatcagctagatatttaatggtatttaatagtacatggcaccatttagacatatgccataatgtcagcatcccagtgtttggtttgctatatttttgaagtgctcatctaatcagcatggttggattattccagcacatgacggattctgaacgacttattttctttcgtggcatatgtggggtcaactactagatgcattattttgtgcctttcctgattactaaagtctggagattgtattccgatccgattttttggatctgatacagcatttttctgctccccctgttctggatcgttgccactccatatgttggtagaactctgaactataaattatcatcatgagcgaaattatgaatttgattacagttgcagttgtattagtagtacttttatttgtttgtattattgattattaatggttgccgccatgcgaaaccttgatggtgacaagtgacgagtcaaggcctatcgcatttggacaggatatgattatcaattgccgaggtgtttacgtgctgatgacttggctaagcagtaatcaaacgacaaattatcaattgttctacatgtat

SEQ ID NO: 82559 - DNA, 1153 bp, Oryza sativa
tgggttgaaaatgatctctcttgatggtttaccgcgaaatactggcagtcaacaacgaaaagctgaaggcctcctcaagatgaacaattaccactagttctcaagagatcgctcagaattgaaaagaagcacatatgagttttcttcatgtatgactttgactgtttagcgtgaaaatctcgctagcaactacacagtaagagttaaatgctccctcaatttccccaaggatataagtaattaacatgcaaaaatatatatttaaaaagtcatgaacatcgatttcttccatatttcatgttataattataatttccaccaaaactctttaaaaattttatgtaccacatagccctaacctggtaatcgaaatcaaaaaattttcccttgacctaagggtcaagaaaaatccccaaattataataggcaaaaagtatggcccacttgtcaaagtgtcctctcttattaatcctcattaatcaaaccctactaatcttaatcttggcatccaaaatttcctaaatctatggtgactttatcaattttttcatgatttgtcggtccagtcttcgaacatgctcatagggataggatttgcgtgcacgtattcatatgggtaagtgcacgtgtgttgtgattgtctgcattatactgtataattgaaaaaaaatcccaaatccttttctcctctcataaataagcaaaattaaaacaaaaaaaattaaagcatcactaccatcaccaccaccaccgcgcttgctcttcttcctcccccgttttccccaaggcgcaaaccaccacgaaagcccccgaatccgcagcgcgaatttcaaagcagcctcccccccaacctccgatctcccgctccctcgctctctctctctctctctcgcgcgcgcgcgcgccatctagggttagggtttcgagaggatcccgctgcttgcgagtcccgaccatgagggtgcacccggcgccgcggaagcgcaccatcgccgtgcagcggcggtgcggggtggccgcggcggcggcggggatggccggcgggaagaagctgaggcggctcccgcacatcttcgccaaggtgctcgagctcccgttcgccgcggacgccgacgtctccgtggaggaggacgccgcggcgctccggttcgtg

SEQ ID NO: 82560 - DNA, 2192 bp, Oryza sativa
tccatctacaatttttaacccatgcataaacattaattacttgaaaataatatgtaattaccattgcaataccaatacttcaaaagctaacaacatgtctaatttttccaataaataagtacattactcaaatactacacattattgataaaaaaaaactctactcctacaaattacctacccttcaccacacatcaacccctttcaaaccctctcaatcaccacaaatccatcccacatcctaggccatcaccacacatccatctcccatcaaaccctagtgcatcaccaaacatccatcccaaatatattttgtcaaatgtatcaataacaaccaaatggataaagatatgccacctccacacttcatccccacccatattatccatctaataatccatccttagccaactattatcaaaccacgtctacaaccaaaacaatgcaaaatatccaataaaactttggggaacttagggtttatagaggggtttaccttctcttccgatcccaaactcaatgccgcacaaatcaccttcgattagagaggtttttgggggagattgggcgaggagaacgcggtgtcgaccgaaccctaggcgggcggctggggaaaaaacggaggaagaactggctggggcggcctcagccgggctccaaggtcaacgccaacttacttggcgctgaggttgggcacctcagcgccgaagcggttggcgctgaggtagctgccacgtcagctaggggatcggcctggccgccacggtggcacaatgtcagcgccagtcccattggcgctgacacggccaacctcagcgccaatgcgtttggcgctgagccgacggcctagttttggttgaagtttttggcaggggttagtttcgaaataagtttttgaaaagggtcaatttgtcaaaaaaacggtccttcgggggtatacgtgtatgtttcggatgagggaagaaacggtacgtacgccgtcaggatcgtagttggactatcttcccgtattccaattctgatcgtctctccatgtcggagtctagtagtagtagcaaattaagattactcaattcgtactacacgtatatgatctcctaatccgagaaagctctgattcgcgcgtgcatcgaggcgccgctaggtttcttttttctttccggaatttcttttcgctgttagatttcttttttcttgcatataaattaactaattcgattagttttagataataatgataattaaggtaatgtttattttttctgaagattttttaagtaacagattgaaaagaaatctatacgtgaagtcaaattttgaaaacttttaacctagatttaaaaactttcaacttaaattttgaattttttgaagtcaaattttaaaaactttcaacttttcatctcaaatttaaaaaactttcaatccagatttgaaaactttcaacccggatttgaaaactttcaagtcaaatttgaaaagtttcaactcaaaatttgaaaattttcaactcaaatttaaaaactttcaagttaaaattaaaagctttcaatgctacatttgtaaagaggtgtgcaaaagattgaaaaaaatcggaaagaaattgccaaaaaaagaaaaacgcggcgccaaaatcgaaaaaaaaaaggtctgaacaaaatcgcactgccaaacccacagtgccacgtactccacaccccggaaaacctccatgcacggacgccgcgcgagcatggagtacatggactccatgacctagtcggagcgaggcgaggcgagggcgcgcggcggcgaggcgtggagtagcgtggggaggaagaggaggagcgagagcgcgcgccccgttggcctctcgcttctcggcgcggcgtggggaggaagacgagagaggcaagtagccgtagagaggagattttgttatttctgaactgggcgacgcgacgcgaggaaggagacgacggcacagacgcatgtctctctctgacaggtgggccctccggtcgggtcaactgtcgtcaatgacttgtaggcccaagcagggtgagtcggcctcgctgcgttaacttggtgtcaaatttgctctctgacaggtgggccctctggtctactgtcgtcaatgacaggtggatccgttcacggagctgtcaaattttgcccaattgaggctcagatttaggattgaatttgagttt

SEQ ID NO: 82561 - DNA, 551 bp, Oryza sativa
  unsure (1)..(551): unsure at all n locations
attcaaatcaagaagcctgcaaggtatttatcaccagttcaatgactacaaacatatgtcatgttaattcatactgttgccatcaataaactgtgacagtcgcacatacgtaacagtgatttttcaaccatatctggtaattttttgactnnnnnnnnnnnnnnnnnnnnnntccacagatacatgtcgaatgctaaacaagagcgctacaggttcagaattatatgcaaattatcacattccggacaagcatcacacacctactagtcaagagtttctagtagcacgagtggtaagtagagataacatatggcaatgcaagctaacctcggtgatgaactgatgatggtcctgttcgacgggccctacacggcactgttaatcctccccaataatcacgagaagagactcttccggctctgcatccacaaccacacacttcagaattcacgcatccggaagcttccaagcggaaggagactgaagaggtaggaagaggagacgcgtcttacggtcatcggggtcctcggcgatgcgcttgacctgggcgg

SEQ ID NO: 82562 - DNA, 4833 bp, Oryza sativa
catatgggtccggagatcatcagaccacatgtcagcgtctttatcactaacatataggttcggagatcatcgggctcacatgttagtgataaaggcatggtgtagtgactgcagaggatttggccaatgcatggcaccatgccattaatcatactttaacatataacgtatacactgttggattttaaaccattcatcttattaaaataacaaaaaatagtataattatattgaagtataatttttacttagaatttttttaatgattaaattacagcagaataaaaaggacatttgacgaatgcctacggtcaacaagtgttaaaaagtgaacgacgtcatctatttaaaaatataggagttagtattgattaaggattttaatcttattattaccaataacaccagcgttttcttaatgcttattaactaattcttaattatttgcatattgcagtggttcttcaacaccgttagtctcgtgctgtttgggatcgtcgttgtgaaggtagttccacactgcaagaccatggaggaggtgtttgcatgcattctcgctatactcaccgtccttgggatactaatcatgggttattgcatgataaaaaacactaaagaggatataaaggccatggagggaagcccgtgagattccaatgtatcatcagcttgactctatctactttctcttttgttattttttcaagttggtacttggatccacttagagcatgtatatatcagttaattaattagcccaatgcgacatatagacagtccataataagggatgaaaacggttgaaaatgttcggaaactgtattgtttttctattattttatggaaacggttgaaaatggttgggaaattttaatttttatgaattaaactgaatttcaatgttaactgcaatgccgcacacataaattagaaaaacggtaacatttggtgaagtcaatattattatattagttttacgaatatcactatgatcgaaaaatttccctactccacatcaccaagagtctgtactgatgaaatagtcatctagcttaaccctttaatttttaatcgctaatcgcccctcgagctcccttctaagatgattatgtgatgaggtggaggaaaaaagttaggagaaagaggatgagatatcccttatatatgtaaatataaggggcaatctccacacaatcttcaagaaaagtttaaaaaaaatagtgtgagagtgaactaataaaaaacattattagggtttgtattagagatggtatgttgtacttgttacctcttaattaattagtagatgatatggctcaaattagaggtaacattcaccttcattataaaacttgctctaacgcttcttttgcatcgtattcctcgtagaattttcatctcagagcaagtttaatagtaggctataagcctattataagattacgcggtggagagaaaatttgaaaaaaaagaagaaggctggctcacatgcaactgttagctattcatatactccaaaataaaaacattaaatgcataggtgaaagatagagaaaggagaaaaaaatagagataagggcacgcacaaattaaggtctctattagtaggctctctcaattaccacgtaagcaaatttaatgacttggaagagagagataaagcaagatgaaaatatcgttgtttgctgtgacatcggcgtaacaacgccctggagtgagcaaaacgcggagacgagaaggaggaggaggagtcggcggtcgtcatggcgacgagcgacgggcggcgtagggaatcgagaagctaataccatgtttgacggatagactcaacgtgaattgtattatcacagagcaatacagatataggcatcataggccatatgctctcaaccgattcatggcaataaaatttgggagaacaaggaaggagagccaatcacatgatacatgccatatatagtctaacatgtgcctcgttgcacaacgcggtgtggggcatagagtttccagggtgttttatctagtacactctgattgtttttaaaagaatttaaacttatgtaatcgagatagaagtgtattgtgctgcatctgatagaagtacactctgaaagcacttttaataatttaactatgttatcaatatagaaatgtaatttgctgcatctgatagagtgcctaatggacaacatttacacaaccattgcttgttcacttaaattattctgcatattttcttgtactttgctctcttaccaatgggtctgttgtgtattagggctgcattgccctaagacaatgttagtactacagctgcattaaaaacttataaaactctttccagtgtgaaaatacagagtttccagctctttgagaatcatattgctgtatatgaaacgtcaaaatggtctaccgaaagttaccgcgtatcgcttaccagccactggagagccaattgggcaacttgagggaggtcgggagattgattttgttgatccagcatatgacgtggaacctgagcaatcacaatttggttcatctgttgttcggttccattatagctcaatgaggaccccaccctcggttttcgactatgacatggattcaggagtgtctgtgctgaaggttgtctttggatccaaactaataatttttttcatcacatcaacctgtcatatacacacaactttttagtcacatcgtaccaatttcaacccaaacttccaactttagaaggaactaaacacaaccgaagaagtatgatatcagtcgcactgctttaaatagctttctgttattttgaacaaactaattaatatgttggcattgtttaataacaaggtatatatgttcctgaaaacaggttagtcatgttaggcatgtattgtgcacctgtttcttaaattccactctgtttgtcaccgttgcttaaagcacaatgaacatcgattacttctaacagtatagttgatgatgatctgtagtacactaacagtatatgttttagcaaacctaatgctcgtaaaaattatgaaagaaataactaatttactgatacgatttttcatgttcagaatgaggtgctgatcataagaggttgtcatcagtgtttttttgtttttattaacatgaactataatttgcacagttatcacatgtgcaagcactattttatgtgcagtaacacctgtattagggatggcaatgggactgtccctagcagggggcacagctcccacctctgtcccctgacacctaaaaatgccctgttccccagcaccagccaggatctggttatgttcagaatgaggtgctgatcataagaggttgtcatcagtgtttttttgtttttattaacatgaactataatttgcacagttatcacgtgtgcaagcactattttatgtgcagtaacacctgtattagggatggcaatgggactgtccctggcagggggcacagctcccacctctgtcccctgacacctaaaaatgccctgttccccagcaccagccaggatctggttagttaagggacctccggtatctggttttacggttgggggacgattttgtaactcgatgacaagttgagggacctttggtgtacttttcccatgtataatcgacttttttttatctcgatttgttcaatgtatcgtttgctgcggcaccttggacattccagcgtatttttggcacctaaaagggtctaattctaactgaataaggtcagctacaactagttttcagagattttgactttgccacggacattgttggcagctgaataaacacatcgtgtagatttgattctttgagaaagttaatataagccaaaactatactttctacgggaagctgaatttatgtagtatgtagaactcatataagatgaaacagttccagtttgtacatatgattcttgcgttccatgggtcccttgaatatactcaaatatatgtatggcaattctcgggatcttgatttttagttatcgcaccatgtcgtaatttgctgccatgaaacatttcaatttccatgtactccagttgcgagccaccagccagacagaaacaccaatcgcattgcaagttttaacaccaaatctccagtgctaattaagtgctaacctaccaggaataatcatggtctatctatgcttgctcactgctatctttgactcgccggtgttcttttctttctaccttcctcgctgagccacctgcaattatgaacgaaaatgaactgtaatctcacatacatatcacattgacaagaaaccaagaatagtactggtctgtagatttatataaattaaaggaccaagtatcaactgaaaaatggatgggtatcatcggagggaggatgctaaatctaacttggactgattaggggcaaagctatcgagcgcaggttggggtctgtaacacaaaaacgcatgctagggtgatgctcttcagactcagagtcactcgcaatgctgggaaaatgcgcatcagaatcacttaagagagccagccagtctatcaaaaccgcttggatcaattgaggtttccttaagtcgttctttcaaagtttccagcaaaacaatccctggaaattaaatcagacaatcgacccaacatggatcagctagcaatgcgagatagataaagaggataaacgagaataagaaataccaagagcacgcccaagcacagcgaggctggcattttccgtgcatatataccatggccaaatccttcaagctgatgagcaaatcctgcattgagcagcccctcaatcggagatgagaaaccggaaaaggaatgaaaggcagtggcgaaagaga

SEQ ID NO: 82563 - DNA, 602 bp, Oryza sativa
tcgttgagtagtttgctattgaagaatccatctcttgaacccatctctcaaaatcctgaagcaccaaaatccccctacttggcgcgccactgtcgatgtttgatgtcacgactatggtatttgcatagtatagggatcgttggcaccagggtatatgtgagactgaggtaaaagagatggggacgaggatttttatacaggtttgggcccctgaattgtcaggtaataaccctactcctgttggccaaagccggtcgttgctcttattcatcataatcacaccagtacaatatttggggtagcctatctatctgttatcgacatggcggtctgaagtgctgacacgtaatcgacaacagggtagtcttccgcctcgaatccatatccggcgagatcaaagatagtgctagatccctcctgatggtagtcgtaggtaccgtatggggactactaagcttatctccgatgttggtatccgacggttgtcttgacgtatattggcttgtatgttgatctattgtggcgtgtcccctctcctcctagggggtcttgtatttatacctatgggttattggtgcgtgtcccctctcctcctagggggt

SEQ ID NO: 82564 - DNA, 759 bp, Oryza sativa
ccctaacagataactatgtttcttcctagtatgccttgtggatgttgacagaaaaggcagctctcataagtattatttttcaacagctccaatcagaatagcgtataaaaccaatgtgactggttgaaatcactgagcttcgaaatcattagacatatactacgcttcaaacagccacactaagaatgcaactaaattgcgcactaacagatcaaatttaatcttggacagcatagctctcatattctcattcatcatcaaactatggtcagcatagcgtatattaccaacaaaagtgactacaatcactgagctatgtatgacacaagaaaagaacttcaacaaaacgaaaataaacaaacagcataagaattcaatagagaacaagtgagaccaatgaatcaatttaagggacaaaactagaggggtggtggggttaaaatgacaggtgaatgacggttgtacgacaatgcaaaagtcaaagcttaagtaaaaaaaggagataaatgcccatgggaacatagccagtagaaccacaacaatgtactataaatctatacactgagtaacatagaaaatagacacctgctctcataatgtttatgacatcttaatatgattcagaatagcgtatattgtgatggcataacatggcttataatccttgagcagaaaacacacagaagtaatatggaacaaaagctaatccagaacataagtacataggtaaaacttaaatatagcattcttacaataatg

SEQ ID NO: 82565 - DNA, 4237 bp, Oryza sativa
agggaagaggcacggaaagtgtccatgactccatgtcaatgaggagggtgatgaaggggagtaggctaaagccaaagtcgatgatgatgccgatgtcagtgtccatgcgggttgtgaggccgagccgctcaagctcattgcggacaaggggtgctggtgtggtgttcccagaacgtgacctccagatgggcgtggatgtggtgccgcacgcgcaccatccagtcccgtgcgccacaacagcgcctcctcgtaacttgcggaggcagaggaaacaatgaggaggaggaagaagagaggagccactctttctccaattcggtcaccacggctacgattcagcctccgctgtacctcctttctcctccacgagctccacctggcctcctcttcatcagctgctccctcatcaatgtgtccactagcccctgaggagattgtttgcaccaacagcccaaagcccgtcatgtggaacaacggcaagatgagcaatgtcactatgaccggcaacgacagcttgccacttcgacttcaatggtttggcggctggaggaggagcagcgctgtcaagccgtcctgatttgaagggaaatagacaaggatgagagtggctgcctgggggaaaaagaagggagtagttgggccgggctgagggagaggaaatgggccgtctgggagagggaaatgggggctggcccaaggaaggagagaggggataagaggataggggttgtgttttttttcttgggaattcgaaggagatttgaattggaattggaatttgaatttgaatttttgtaaatggactgtaaaagggactgtgaactttgatattatgggagtttatttgtggacttggaataagaggtttgagatctttaatggcataggcaaaaatccgaataagaaccaaattttgaaaataattttgtatttaaaataggttttaaacgaaacggaaaaatcgggatgttacagaaactaaggtctcctatacgggtaggcatctccgcctctccggtgagcacctatggttgtggtgtgccacgggaagtttgtcaagactttcgatttcacctccgcaaggggaaaaaagatcaagagtgaaatcgatgagtgtattggtacaacctcatgagaaaaagggttgaaagagactcaatttttgtggccacttaacggaggcttggatcgttcaatggattttatgttggaagttttaatttgaattaaaagttctcaccattttaatatgttatgagatgtgataataagaacgccatttaatttaaccccccccctctcctcgcgtaggaggcatcacggttctttcattagggtggtcaaaaaggcttaaggggattcagctactgtcagcactcatcagaattcacaacatcatgcatgtttctacctagtttagcataaacagtaatatattgctagagttaagtgcgttcttgtcatcaatccgtaatatgcatgaatacaaattgtcctcataaccaatattttcgttagaaacccctgtttcaggcttttcaactataaaactagtatattccaacatcagctgaactggaaattctactctatgtgtctaaccaacacactaatcttttgccgagtttcctgagcctgtcataaattcagcacaaaataatttgctaaatcatgggtctccttcctcggtgacaacaatcaacatcatttagataaattctactaccaaagaaacacaaaatacacccaaagtgcataattttttctggtgttgcctaacattaaaattcatcatataagttcaaccgtcgtcaatgatgggcgggcctgtgtacggtgagttggcgtagacgcccgccgcgttaacttgatgacactactacgaaaatcatcgttcgtggcgggcattttaggttttcgctggcggaatttggagccgccacaaagtaaaggccagtgaagatataagattttcgctggcagtttcgtttcgcttgtgaaaatctattttcgcaagcggacacatgattttttgctggcggttgaggtccacttgagaaaactcattttctctggcggtttcctaaagataaccgccagtgaaaattaacccaccccgccaaaaatcacctaccccagattcaaaattccccagccggccaaatttataacagtcttcaaatccgcatcacaaatacataatattggtatcaatccttaaatcctcatttagatgggcagcatgtacagattgaaatccacatccaaaatttcgagcatccattcaaatcctcgttagattccattaacatgcaagtgaacacgacatacaagcattttgaagatgaaaaagaaaagaaaaacaacatcaacaggagagaggaaggagatcgtcatcgccgtcgccgaccgagcagatgtgggagccccatcgccgatcgagcatcaccgccgccgagctcctcccgccgcaccaagccccgcaacaccagatctgagaagcccagccgctagcgagaccgtgggagggggagggggaggaggaggagaagagaagaagcgcccgcctccgtggccgtcgcgcaccgcttcctatcgcagccgtgcgctcgcctaccaccatcgcagtcttgcgcccgccttccaccaccgtcgtggcgcgctcgccgccgttgttgtcgcgcgcccgccatcatcatcgtcgcgcgcccgcctctcctgctgtcgttgcgggcccacctcccgccgccgtcgcgcgcccgcctctcccgccgtcgccgtgcacctgcctcccgccttcgccatgcgcccacctcccatcgttgtcaccacgccggagccaccaccgccgactgtggggtgggaggaggagagagtgctggtgggggtagaggagaggagaggctggttgatgaggatggatggataagtactactggccgttggatggtgatttttataatggctgtgaattttttcactggtgttggtgctctttagtaccgctagggaaaataggattattgttggtggtctattaagatgtctgccagtaaaaatagggttatttttacaagcggatttcttaagcaaccgctagtgaaaatggacataaaccttccacccctctttaaaatttcgcaagcggatttgttatataaccgccagcgaaaagaataggataccaccataaaaaatcattttctagtagtgtcgaatgaccgaaagctgtgaaaatttgctcaaatagccgcaggttcaggattgaatttgagttgactgtacacaaaattgatttaacgtaccgacttgttttgatcgctgctggagtgagtttgcagaatttaggagcgtcatgcccgccatggatgctcgatcgatcggtccagtgaataaagataacttagctagtacgcgtaccattcaaaaattcgattaatagcgggaaaatattatgttatatagtgtacgacatcttaccaaacagttaggagtggcatagccgcacaagaagattactctttgcaggcatgttgctttacgcaaccgtatgcgataatcaatctttgtgtgcagtcgtattaaacggcctgcctgcgaatctgtgtgctgttggattgcccacacatgaagattgtggtcttcgtagaccttttagagtagacgggccgtccaaccacatcactactggaaaagtgatctttgctgagtcggctgatttccacaatagttccggttctaataagaactgggattaaagattgtttttaatcccggttaaaaatttttttaatccttagtcccgattcatcccctatcagaagcctatcaggggaccgatgatctttaatctttactcccggttggtattaccaatagagactaaatatccatatatctttagtcccggttggagttaccaaccagaactaaaaatccatctttgttttaatctttactcccggttggtaataaaatccatcttaactccagaccaactgggagtaaatatttctctcccatctctggtcggttaagtcacaggtgagactttcctcctcaccaagatatttagataagatcggatcgatcatcccctctcctcctacccctcagatccccttcctcctcctaccctcccatccggcggccgacggcagcgggcaggtggccagcggccggcagggccgcgcccggcgccgcggcaggtgccggccgtggcaagcagcatcaagca

SEQ ID NO: 82566 - DNA, 2421 bp, Oryza sativa
ctttttttttctttccgcggccgatagcaatattttggtctcgtagcgctagctatattcagattacattaagaaatacatgttttatttttttagaaaataatgtaaaaatatacatatgctacgttgagttgtaaaacgaaaatcacaactaaaccaattaaacatgtttgctcccgtagtgatgcatctaactgattgtatatatatttgtatgcgggcgcgctaacgtgtttaattcagcggcccaatagttgatcaactggatcatcggaagcaccgtgcttcatttttgtaattaatgggttgtatgtgcttacatccaaaaatattgagggaaaggacatgactctttgattacatgactaagaagattaagtcttccaactaattaatagaagtccataccaaaattacaacggtaaaatgtatatgagtaaaagagaatttaaggctttgacttcaatttcacaccagctcattcttgtctagccatgttgagcatgtggttcaaccatataagatttatagatctcaaaagtgaaaaacaaataaaaaaagatcagagcgagtcgtacatttggcccattttggttaccgaatttcctttttgccacccggcctttatctaattcttttcaactttggattagatacttctactatttctttttttcttaccactaaacgctcttcccgagcacaacaatagcctttaagcacatcggcaccctaattaacgatctcctctactgatgtgcaacatctctgacggaagataaagataaaagcgtagtccaaagtgtaaattatataaaaatacctagtcgaaaacgaaaagattacgtagaaagtagtctaaagtggaattaactttgttaacaaaaactgcacggccaaaatacagtttattcaacaataaaataagcaacaataataaaattcgatctcgaccggtacggttcgtgcatgttgtgtactccctccattcaaaaaaaaaaagacaaaccgtaggtttccgtgtctaaagtttaaccgtctgtcttatatgaattttttttataattagtattttcattgttgttagatgataaaacatgattaatattttatgtgtgacttgtctttttatttttttcatattttttaaataagatggacggttaaacattgaacacggaaactcagggtttgtctttttttgggaacggagggagtgcatgtatagagaaagaggtatgagcgtacttaccaagaatgctttcgcggcagctcgggcaagagcagtagggtgctttcgtctctcgatcgtcggaggatctgcaggccgtgccggggctagctgcccttgttccagcaagctgcacatgagatcggcctcggccttctccatatatcgctcgcgatcgatcgaggatcaatacagctggatcgatcgaacgttcgcatacgcatatcgatctcgcgaaacacgcagtgtgtatgtatatattggaagataattaaccgtgttcctacgtgtatgtttcggaacaggatcgagttgaacaactttcccgtgctccttagtgatcgtctccgtgttgaactccctactccacgctaatgcacttttaccggacttctattggtcacttggcgcactaaattaacaatcaatttggtcgatccgtggtttagggaactctctccaataatccggatgtcacaccgtgaaaaataaaaaggaataaattcactttaggtctctcaaattgtcaaccattctgattttcgtccttagttcggaaagccggatgtgacgcatcccccaacttataaaaccgtgcaaacgaggtccctcggtagtatactctctgattttggctgacgtggcgctactttgactaggtctttatccaacgtggtattgatgtgttacttacgcgtcaatttaatccagaaaaacaataaaacccgtaggacccacatatcaattacacacacaaataataaaaaatagcggggcccactgtggcccatatgtcatcctcactactctcctcttctctctctcgggcaaagcaaagcagcggtcgcccggtgaagctggttgggcgacagccggagcaggggagggccacgggcagagctgagggatggagcagcgatgggccacgggcggctcctctcctcccgccggccggcgcgcgggccatccactccgccccgctgctctgcccacgatccaacgccgctcctcttctcccccgctcttctccccagccgtcgtcgcgtgctcctcttctcccccacctccgcgcgctgctccttccccccgccgtctactggggcgaggcgggtagaggcgaagagatggctgctccgcccgccggctactggcacccctctactctggccgcacatagagagaagagggag

SEQ ID NO: 82567 - DNA, 3157 bp, Oryza sativa
  unsure (1)..(3157): unsure at all n locations
ccggtgcaatatatgtcntaagtcagtatagtgaatggttttgttctacgtggcaatttcaacagcactgagtcagtgtgggccccacatgtcatatctctatgttctctcggtggtgaggaacacggccgctggcagagggttgtgaggaggacggtgaccgatgagagaagctagctcgatagaggacggacgccgatggttgccgtcaacgatgggtgaccctgacaacgctggtgacaaggcggacaaggaaggcgagaccagggagcacaatgtcgtattcctctcagcgcccactccattatccgcagcaacaaggagaagccgagtatgctgttgtccgcagggccgaggtcctcgctccagggatctggcggctggccgcccgccgtcgtcgggagccgagggggtccgttgcctagtgccctcgccgcttgaccgcccagatctggaggctggccatccgccgcctcgggagcctggaggcccgctacttggtgccttggtgtcctccgtctggtggacctcactcccggggaagacattgctccggtgacaccgccatgagccaatggtggggagcgagaaggcaacatcgggaaaggaagatggcgggcgggatggcgagctcgagctcgccagctccccttccctctcccttgcctttatcttctcatcggctcccgcttgctgcaacctctccgtcaacaacctttggcgccctccctatcccggtcctctgctaactctcggcctcttcagatgatgagtagccagcggcggcggatacaaatggggtcgaggtcagtgttggaggcgagctagagcatgtcacagatgtcgtcctcctcaccgcctgccactgggcgttgtcctcctcaaagcccgtcgccggcctcctcgcagtgcgccgtctgttgagattggaaaaggcaggaagagagatataggtggagagagaggtgaagaatcgctgacatgtggagcccactctaactcagcgatgttactcgggtcaaattgcaaattgccatggaaaacaaaatcactcaccctactgccttgcgacttactccctccgtcacaatatataagggattttggtgagatgtgacgcttatattatgggacggagggagtatattctaccggttttgacagttgagcgatctgttgtatcttgttttctgtttcaatgacgaaaatcagatccgttgtcaagttaagagacctcagatgaacttattcctagcacatttgtgttgttgcatattgcctcagctaatcacgcgtgctggaacaagcagaaataaataggacgatcgaaaaaagagggggaaaacatgcaaaagaattaaagaaagatgaaaaaataattttataaaaatctttagatttgttgttcgttataattatcatttatcgaaaacattttttccagatagcatctataatcatctattgaatacaactacaagtagaaaagaagagtaaatttcataaccccatcaagtcacaaaaacccacaggtattttggcatgtggcacataactcaattattatgatcctaaagttaaaaaaaatgcactgttaactattttgacatatactcttgtatcaaaatttgataaagtggatggaacatttatatggtggatgaaatgctcataaatttgacatgtgattatagaactcaaaagtgtggtagatcaaagttaaaataattagtaatgtagttttgaaaaatattaggaccataatatttttgggtatgtgtcacatgctaaaatttatgtggttttgttcaactttgatcataataggtggagttatataaaattataaaaaaatactaacaatcctaaattccaatcctactttgattcgtctcagtcttcaaacaaacacaaaattaaattacactaatagatctatttaaaagtatgatttgtatgtccgttaaaataaatcatgtaaaataatgtaacttttctatgttctaatatgtatctgttcgattttttaggaccaatcatgtatctgtttatcgtatcaatgtgttagaaatttcttcatgccaggtaattaattaacaaggggagaaaacaccgcacataatagtgtgtatagttaatctcataaggaacacgatcccacagcgtatgacgcatgcaccatctgtcacaggtaaaaaagaggaaaacacctgacagcaggatatagagtggtacgatcgacacagccgtcacagagagagcacactaaactgcaggatagtgtattgttgtataccatgcctaaacgggtctgggatgaacaaaatcaagaaagggatcgagaaacacccatctgtcagctattggaaggaatcttcgacatattgcctgtccccaaaaagtaaccaaaaaacagaggataggaattagagatagctagggaatatgtatacagtacccatagttgtaaaaattgagtttatatatacctgataaaatcaattccatttcctaaaggtccgggtcttgatcaacgcccgtacaacagctctgcattaacaattaatgataatgatacagtattattatctacctaccatgacattatatagaaactaggaatagataagagagaatttaattatttgcttacccttgcccacaaatacaaatgcccaaatagcaccacactgccaatgaagccaaaaaccaacctccaaaaccacaactcattgtcgtgaactgcaggggccaaaggtgacgagggtggaggaggggccaatggcgaagttggcgtactcagtgccaaaagatagatgctgtatatgactagaactgaaaaggccgcatacaggacatgtcccatatgccgactgaagatctttggaaacttctccccaaacatcccggcagggagaccaacgctcccgaagccccagatagttgcaaatgctgcaagcatccatataccataaccagcgggcaacagaggccggagaaagaataacacggctaaagatgtgcccaatatgtagacatagccaatttgtcttttattccaaacgtccttgtctccctgtatatagacattaacattatatgcttgtactgaaaacattaacattatatactttatcgttaacattgcttaaagcac

SEQ ID NO: 82568 - DNA, 2648 bp, Oryza sativa
ttagttgagggacgcacggtatctggtttgcggttgggggacgattttgtaactcgatgacaagttgagggaccttcggtgtactttttccttaaccgaacgcacaatttcgtatggccgggattgtttcctcgccaaggtgatccacagagattgggccccgatcgcggccgttcctggcccaaccgaacaagccttaaagaagaagaactacagcgagggcaagggaaagggccgggagttgaaaactactgtatgatttaatgtagttatcaatttcgttcatttgcttgaattggacagataagggcctattcagttggtaaaataaaaatttttagttgttacattggacatttggccggatatcgaaagagattttcggacatgaatgaaaagctaatttcataactcgcctggaaaccacgtgacaatcttttgagcctaattaattcgtgattagcctaatgacggattaattaggtttaaaagattcgtctcgcgatttacctacaaactatataattagttttttattcatatttaatactttatacatgtatcaaatattcgatgtgatgtttttaagaaaagtttttggaaataaacaaggcctaaaattactccacaaagtcacagcactctctgactttacaggatccaaatcctcctcgaggatggaacgaaacgaagtgattaggccgcttaatcaaatcgattaagcaaaccacttcccttccgcgacgcggcggcgactccggcgacgcgacatcggcgatgctcctcgtcgacggcgagcccgtctccgcctccgcctcccccaccttcggctcctcccgcggggtgcgcctacttggttgttggagggatttcttcccaccccgtctctcaccctcccgattcttgcaggggagcggcgggagggagctggtggcggcgctcatggggaaccccgggctccgcgccgcatcggagaggctcagggcggagccggagaggcggatctcgtcggggccagaggaggatgatgcggacgccgcggcggcggcggcgccgaggcacgtgtacgtgttccagcgggagttcgccacggttgatccggcgcgcgtcgaggtgcgtgcgtgatgcccgggatttcacctcgctgtagtaggttcaggcctcgcggtttgattgggtagtgtcgtagagatggggggggggggcactcagcgattaattccggcgttttgatgatgaattgtttgagttagttgttgcttagcagtagcgccatgaaatgcttgctgtcaatatggattttgtttcactagaggggatcatgggttgctttcaatataaatgctgggcatttgacatggagtgaagctctcagtagtttacgcatgatttagcttggaagcaaaggtgaggccttctgggaacgaaggataagggcataaggcccttctggaatgcgggaatttttcccgattctcgtacgaaattaactgattcctgtgaaattcctgcgacaaaccttgaaactactgcattctaaccgaagcttaaagttgcggtccttatgtttggaggtttgtttggggacattgtaggcagtagctgtaggtggtaaacttagtactaggctaccagcagaagtttctttatgcgatttctatgtagctaacgaactaccaagtccgttgtgctgtttaagtgtttattagttgactttgttagtgaccataaaaggactgttgacatctttgagttgaaaatgttctgaataaggatataagttgtcttcgactggaaatgccgatttgtgataactccaatccatattaaagttccatttggcttagagtctgttcatcgactgttgctgttacagtcccttgaacattttgatggaattttttccttatttcacttgggtcttttgcatgtctgttgctaaaagttaaattattattcctggaccattcgatgtcagtatattgcactttatatgttaatccattcttttgcatctgtagttagtgggcacagatgaggtgactacatgcgtgggtgtagtaattcgcaacaacaagactggaatgtaagtgaaaaaggaagtgagcatttaagctgaacctgtaaggcttttggtttcttgtgtaatttagtactcttatttatcttttccatcacttgatgatacctctttctggtattcttaactaatttcaggacctccattagccacatggacttcccaaaaattgtggagggagggctcaaacagatgttagaattacttggtgatgacaatgcaccgtttgatgtttgtatctttaccccctttgccctccaaacatagaatacgcacccttggtgaatggtgatattcttactaccatttgactacaggttcacctgattggtggctttgatgatgtttctacaaaggttgaatttcagagcgtactgtgtggttaaacttcctttaatttttgttagcatgatacctataggatcatgtaatttactatattttgcaccgcaggttgtacattctgctggaaggaagcacatcaaacaggaagggtattcctatccactatgttgcaggatacttgaggtgttgtataagtcccggcagcaattccatcttcgtacat

SEQ ID NO: 82569 - DNA, 4533 bp, Oryza sativa
aatcacttaattgatgatcctatatgctctatcgatatcttgttctgctcgtataggatgccggattgggctgaaatggcatcatcacttaaccagctatcggactctgaggtcttgttgcagtgctccacctctccagctgccgagccaccacattttgtggaaaatgagagaaggtttgtgcccatatttttctacaaattaaacctgtcatcctgacagatgagagactgatgtggtttaagcttttctttataccatcttgatgtaggatatggagatacttgattgaaaatccatattggcaagacacatttccgaaatacaagcctcgggtcttccataggaccagtgatggaaggtggtcacgttactcaatagtatcatccagctaacattggtgctctctctacatgcggaacaaggggatatatacttcatatataatctctcctttgttagaacctgtgatagattgtggtgtggcaacacaggatttcttctgaacagcgggcatcaatcccagtcgattctagatttctttctcctgtgagttgtcccatgtaatcatccttggaaggtgaatgaggaattattcagattttccccgtagacgcacagaagtctcaagttgatgtattagcacagaacctgtgttaggattgttgattgataggcaacatggatgatggcattccgttctcgtctcatatgctccgaccattgttacttggtattttctgaagggaacatttttcattttggcagttgtgcatcctttccttgttctgtacggtgcaaatagtaggtgattcatgcgatacctggcgtgttcgttcccgcaagtatttacgttgcctcttttttaccaggtgtctgtgtgctgtgggccaatgtcgttttcactgcacgctgctcctcggacgtaattgtgcctcctctgcatctacacagcgttttgccatctccaccgtttgatgagtgggtctgttgctacgtgggaaggcatgttgtacacggttggtgcataacagcctgtgaaaatcggccggatgttgcagccaagagagattttccccctccaaatgagagagatttcttccccgcaacaccttggtgcgcatggtctatggtggaccctgtggttaagcgcttcttatccttttggtccggcgtgcaccgagaccaccgttacaagggtttcaaacatatcttcttgggattcatatggttatgtggacatgttccattgtatggttatatggtagatggatgaaaaacaataggttcttggtgcactaggatcgtgtgtgggtatagctagcctactgctcagcaaattagcgcttaacaacaacccctctttttcagcgtatgctatgatttatctccctacttttccctttcttcagtttcttaggtatgatgcctcgcaaaaataattggagaggaaaatataaaagaaagagcaaagcagcaaatagcaacctagtgctgcgttgtagttcgtggcactttagctgccgaacaacagagaaaatcacttgcttataaggatttgaggctagccaagagagtttggactttttgcgcgaagcgagaatggaagtgcagtgcgttgagtgtaggtgtggtccaagtagatgagttaggcccgataatgttttcgggtcctgtgtattacatttggcttatgagacaaccaacgaccatgaagatatctcggtaggtgtggtccaactagatgagttggcccaatatcgtttttgagccttgggcattacatttcgtgtgtgagacaaccaacgaccatggaaatacctgggtagctctgcctctatgcatgctacctgtatctttgtttgccaattctaagttaccccatgcgtcttacaaagatgctgcctctggatgtgcggttgcctccgcctaggaatcaagcttgacacaacaagttttaacaatttttcttggtgcttgtcgccgacgagattcgttcgtcaatttattgttttttgttaaggtagcaggtcgtcttgacttagctggcacccatctatgctccccttggtccgtggtctctgtgatcccctttcgacaaatcgtcttgatgtgctgctctcctccgctatcttccacgtcagctctccctagccccaaatccgctcccgacaagataatactatttagtttttggctttaagttgctttctatgtgcctttttattgctatttttattgtatttggtttgcttggaaattgggagttggtatgtgagcagccatatatggacaaagcccatgtttttcctctgagaaaatcaaacagtgatgccttcttgctggagagatttattaactctgattaaataaaccggaactttgcctaaaattatcacctttgctactaatcacagagttgatctatacaccgctcattttgtatagccattgattcaccttgatttattcttcgctttgtctcctgtttctttagtagaagcagcaactaggggcggagctacggtgagcaaggggcaggcacacggttccaaagattattttatctatagtaattctatgtttatcaattgtgcatcctccctcagttcagttaagtatactgtagaaattgttacctctctagaagttcgaaatcgttttccttttttttttaaagaagttaccctgtcactcagagcaagagaacacccaaaagatgggaaaggctgggtcgagcacgaatgtcgaggcggtcccaacggctcctcgtaccgtcccgacccgatttaacctaacccaccaccactcgccctccggttcgctcgtcgcctcgcgtctcgtctcctgttcggctcgactccacccgccgcgagagagagagagagagggagggagcaaaccctatctagggttttgcccgcccaccgccctcgccgtcgacgccatggaagccggaggaggcaagcgggccgccccggagggcaccaacggcgccgccaagcgcgcgagaggtgagcctcttcgtggtttccttcttcttcttgttttttttcccttttcttggttgctggctcttccattggaaggatggctggttcctagggtttctccagccggctaccttgttggggggctcggattctcggcggcgctccggcttggttttgagctgggtggtgattggtgaagacgggagacgaagatttggggggtgttgggattggggagcttgtggccgccttaagcctttcatgtttttttttcttgttttgttcgtttggagatgatgacggaaggctcgccactatttttttaaaatttatttttggcaatatttcgcaaagagatctagaaacgcgattggtgacctagtggacctgctaaatatgtgaacggatctagctgctcgtcgaattttcttgagtgagttgaaagagatgtccgatttctcaaggcgttaatttgaaagtgaaactcattaagctctggatactggacattattgtattgtaccatttaccttttttttttctttctgagaaggtaatgctcagtggattttgaaatgattaatgtgtacatgttgtttatatacatgccatgttttagtaaaaatcaacgctattaaccggcggaaataataaatttggtgtaacagcatcggagtcgtctcaagtgggtgtaggaagcaaattgaagccatgcaccaaatttttcaggttctaatctaacttaaaatgaactatcacctgtttacacatgctattctgcactttgctgtggttttgccttaaataattataatttgttattttgctaagaaattgttgttgaggggtaacaaatgggttaagtaagatttttctacaggtttccattgtgtataatggataacatagcagctatatgtaaaactccatttctgatgaacaatcaaatctatctgttacactgtggtaccatatcacctgcagcaatcaagataatagtattaaacgttccatatgggattgcaattgacttgccattatggaattatactacttactaaatgataacattcagtgtagcagcttattttcagtacacgcacagtgtgtttaccttgaatttgaacttggagagatgtttttctttttatattctactattgattgatcatgtgttttagttatcacatcgatataagctactccttctgctacactcctgagttgcaaaagatgttcttattatatacaattgtgaatgaatcatgcagtaaagtgataatgtgttgtcatgttcatataagtaaagtagctataagacaatagggaaataacttctttgacaaactaaaattctattattttttttaaaaaaaatggtgacacactgataggcaaattattctgtgttgctgtatgcctttattaatatgtatgctatatttactgtttaccacagtatatgtttgcttctgtattaatatgttcagtttcatgtgatgctacgagtgcttcttaataattagatagtattcaccat

SEQ ID NO: 82570 - DNA, 688 bp, Oryza sativa
atgcactttataacagccctcagcacggattgctcttgcttgtttgcattgctctgcaaggtaactagcattagattctatcaagcgaacaaaaaaagtctattaagtatgaaagtttaggcatgactgcaattcccaggttgcagggagagaatcttgccattattaacagcagaagtttgtgatgatttgctaatttgaattcactagcacaaggggttaaaaaagatagtgtgggattgataatggacgtaccccagattgaccactgctggtgcttgaattatctgaaacggtgcatgaagtcttcttcgagtccgccaggtaggacttcaagagaggaactggggggaacttctcctgaagaccagcctcgtacgcaaaattcacagcatcaagctgctgccccttagcaattagttcctcgataatatctgcaaaaaaatgtaattactagtctacttaactctggacttgatcatgattgattacttgttttcaagaaacattccaacatttcacccaagaaatggaaaatagtactgtacatatagaagcattaggtatgtatgatgtatcagcaaggtacccacaaggccacaaggacaaaaaagaaacccacaaccatagataccatgaatttggaagcaaggacaagaaatattagaactaattagatacagctaag

SEQ ID NO: 82571 - DNA, 718 bp, Oryza sativa
attcctgcagcccttgggtttcagagtttttccagattctcagaagctggctaccaaacagctgcttctcagaatttaaagttccccaaacaggccctaagagagtatgggcggctccttcatgtcagcttcgtctcatagattgatagagtagctttcatgtacaattatgttactagtaatttcgctgttattataagacgagacgagacgacttggaaaagaggagccagcatgacgaatggattttactattatatatcacttctcttcccggtgatcaaggacgagatggtggagtacgtgcaagcgcacgtatccaagagcacacgcgataggcaagtgagaccaattgacatttgttaaaaggtgtacttgttttattcttttatttagttgccaattactataaaatgaatcatgtaacttctttcttttagaaacacagtacaaacacatacgctcgtaacatgcgcatatatctctggaagattgtgccggtatatcttgagattgacgagcgtctcgctgtataccggtacgtcgtttaccactgaaaataatgtgaggacttgaacttggatgggatggttccaccacaataaatcttaccaattatgctatactcacttcgcatgaatcatgtaactaaagcaatgaaaataagaatttcaactcatttaaaaaagagagaaaaaaaataagacttttagcatat

SEQ ID NO: 82572 - DNA, 1280 bp, Oryza sativa
tggcaaaaggagattggggactgttgtgacttgtgagtctagtttccaatatgttccttcttattaacgttatgcgtttacttggttgaggacccaatgattgaggatactagctgatgaccccgctctataacaagtatttttttttctgcaaagctttatatttggtaccacattattgtgtgtattgggttaactgcattttatctcacttctcacaaggaattaaatgcttttgccttttatttcacatcctctctcccattcttttctattggcatcatttttcccattatatacttatgttgcaaaatggtatcatcgaaatggaaggttatgatgattcatataggaaaaatcataaagtgactggtaaatggtttctcatcagtttgcgcttcgcattctatagtagtgtgaactcacttctgctttgccatgtttgaattatattgaacagatacagcttatttctatattccagagttgaaattttgcaatcatcacagcatacaaagttgcatgtagttccattcagtcgctatatttttattcatgtgctatataatgtaaaaaggatatccttatgcatttgatcttcctaataaattttatatttgctcaccctctttcaagattatctcaaagtactcattactatcatggattcatggtatctattgtaggattcattcctagatatcaggtgggctcaagtaaagttgacacaagtgaaagatactttgatgagtggcaaaagaagctgcccaatacagatgaaatccgcaagagcaagcctagatcaagatatttcacaatatctggggtggaactatccccagataatatggcagttgcaactgtgtattttgtgcaaggggttttaggccttgctcgacttgctgtgagtttttacttaaaagatgatcttcatcttgatcctgcagaggtctgtgttcccctctaaatgctatcttttttgttttggtattggtatttatttatgtaatctcattccacccatacagtaagttgattcctatataggtcttgataagtgatcaatatgttttctcccatgtagactgcagttatatctggcttctcatccttgccatggttgatcaagcccctgtatggctttatcaggtcttacaaaagctcctgcctacagttctttctgctatctgtacagtggtgtaactagaattctgctgttctttgcctttcagtgattccatcccactctttggatatcgacgaaggtcataccttattct

SEQ ID NO: 82573 - DNA, 1250 bp, Oryza sativa
ttcctgcagcccccataatcattaaagactgtattttcctatcctcattggatggatttgaaaatctgattgctctcagaaagttagtggtagcagattgtaaaaatttctgtttcttgccagctgatctgaatgcattaatatctctcaaaacattagccatttatgggtgccctaagatgaaatttctcccccagaatggcgtaccagcttctctacagttaattttgctgtcactgttgcatccagagttagacagacagcttcaaaggagggaaggtactgaatgggacaagattgctcatgttcctgaaaagaaactagaggtatgcagtgcttgttatttatttccatcgtattctgatggggttcgttgttcatatcgccttacttactgtatgtagtgttgtgtcatgtaaatatatgtgtggttgttgctcaagctgcattattatcagtgattcagtgttatgaatcatgatctacaaataagtgtcaagtatctcagtttgctatttgatttgcaaattcttctggagatgtttttggcaaaaatatcatgaagtttcataatggcacacctaagtcctaactgtcttagcatatagttccttgacagagttcagtcttgtactaatacttaacctcttgcaggtagagctaattgatttgttgacactgtttccatccagttctttctgacgagtgttgtcatttttggacgtgtggtatgccttcctgaaccactctactacatttacttcaaccgaataactactagtcatgtaagtatgtgactttaattattctatggggaccatggggttgggagcatagcaaaattttcataagcttttgtttcattacaggctcacaaaaactcatatatgggcattactacctttgcagtttatcagtgccaaactgccaattcctgaagtagaggttgtttcaagctgaatgctatttagaccattttgaatggtacgcaacatctcaactagaaaaactctaaatgtcgtgtataatgaacagattataaagtgactatgtcatttgttttcctttgttttcctctcttagaattcaagcagttgaactcctgacaactctctattacagtcattatcataactttggcaagcaactttgaccaacctagtctagtgtttgttttgttgcgatatgtttgtcatgccacacttttcggttgtgttccacttgtcataggctcatctttaccaaaacat

SEQ ID NO: 82574 - DNA, 2452 bp, Oryza sativa
aattgccccctaatccaattctctacaaaatctcccatatttgaatcaagcatcatgactaaaaagctattcatcattctaatttgttaaacccaatctaacctttatatgacatattgccttctaatccaatctccagggtttgatcatattttgtgctcttcagctgtataactccaatctcaaatattgtgaagatgccaaagaactaaagtcaacattattttgggaaactcaacacaattggcactgccactcaatgtttatggccaaatcttggagctgaaagcctgacacccaccttttaacaactccattattgattatatcagtactcaatacctaaatttgttaatttgaacttcttcccttctaacttgatgatcctgatactctagctttactatgcctagtgaaatgttgcacccttcacgatatgacctaaaaaaaggtctgttgttctggtaatgctaggtctagcgtattaccaggaactaccaggatagttagaagctatttcctttgtttcacattacaagaccttttgggttttgaatagatgcttgcatggatctatgtatgtgcttcatatatgtgtccatattcatatggaagtcagtgaatctatacgagggatggagaggctaaaatgtcttataatgtggaatgggaacgaagggaatagcaactagcacggcatcagcacactaaaaaaaattgaacctgccacaccagatcccaatcaaacgaggcttagaccagggaaaatctatgataaaaaggtccatcaaaaggatcaatttgagcatcggattgcagcatttaccttaaacacaaaggaaagctagcttgtagtagaaatcaagtaagtaaattattagtacctaaatgaaggtcatgagtccggcaagagccgggcctggtccttgtgctgcagcgccgcctcgtcctgcagccgctgctgcgcctcctccttccccttggcgaccatgctcatgtgcgcctcgtacttgcgcagcctctcctccatcttcgcctgcacatagcaccaaaaaaagcagtagcgaggtgagcttccccccgggagagaaacgcgcgcggggaggaaagcgacggggggcaggggcaggggcagcgagcgtaccttgtgggaggtctcgaggcggtgcatgacgtagaagccgagcgcgccgccgaggatggtcccggtcatcacccgcacgcacgcccaccgccgcgatcccggtggcgccatctcccaccaaaccttccgccgccgagagaggagagaatacgaagggagatgttgctgccgcagtggcagtggtgcgtggttgggccagatgacccgggccgaaatctgaagttgtcctaatatgtagacaaaaccgaaacgataccgaatcccgatccgtgagttagagcaggtagaatagtagactataagctagctataaacatattttaagaagataaaagaagagagaagagcagtgggctatagatttgtagctagctgcagcacggactccaagatgtaacatgtgtatgacatgtgagaccaggaattataaaagtgtagtgtatgtttataggtacaattggctattaaattgactatagatgatttggagctagtagttgattatactattaaacttgctcttatagtatcttatggtactacgaactcacaaaccgaaatgataccgattcgatttatagtatccaaattttcatagtatgttgattttactatttattttcacagaatcctacgaaatatgatagtatcccgactccacgatccttaggatcttataaaatattgtttacaataagaagaattaaaaaaaataatgtgaataagtatgctcaagtttacataaaaactaattaaatttatcaaaaccaatatgacatgttttaacttttacaacatactagcaaagtgcatgtgcattgcaagggaagaaaatgtgtgatccaaatatctatgcatgacatcatgagaatgaaaacggtcacgataacatttattcggatttttctttcaatttgtagaatttaactatttagtgatgacttcaattcaacactaacaaaaattagaaaatttatttttttatatatagctataaatatggatgtttgaaaacaatatcactttaacagaagaggactcggtactgtctcgttcatccaacttgccctcctcgattgatgggagaaccaggcacctccctaaggccttattcggttccttgggttccaatccccaaggggaacctatccagggagggattgagtgaatccctcccatatcactcaatccctttgggggtttgaatcccttgcatgttcctaatccctctcctaaatccccatgttcattttgactgggaataaacagcttggctacaatcccacaattacgggcccaatctagtga

SEQ ID NO: 82575 - DNA, 780 bp, Oryza sativa
aggggtaaaatcaatttctggatgccgtttaacaaaatataatacctgacgttgcatgtacacagacggtgttagaacggagcaggtgctagaacacaatctgttgttatcataaaattattgattgcgttcctttttacttctttctccgttctaagactttttagcattacccatattcatatatatgttaataaatctagacatatataatatctatataaatatggacaacgctagctagaaagttttataacctgaaacgaaacgaagatacaattaacctagggtcccattccaacttggaccctagacttctctgggcacggccggcccaaagtccgcggcagcgcggtgcacgctgacgccaggaaggacggactagcgtcccgcatgcacgcgtaggcaacggcgacggcagccgcacgcagtgccagaaggacatcgtcggcggcgtcaatatccatggcggcgccgcttactatagagaaagggtttttacagatccaagtcccataccgctggagaaaccgtttgtaatctcggttaaaaacccctctagttccggttttttaaccgggactaaatatttttagtcctgagtgaaataatcggaagaagagtagaatttatagttccgggtgaaataaccgggagtagagttgaatctttagttccgggtgaaataatcgggagtaaagttaacaccaagcgggactaaagagagggtagcggcagtcccggtcggtcccttttttttcatcgtttctttgctagttg

SEQ ID NO: 82576 - DNA, 1934 bp, Oryza sativa
tcaagactgtgaggtatgtctaaaatgaagaattttaatcattcatatttccagaactatcatgcaatactaggaaaaactgaactgaaacacacaaatgaaaaccaattcattttttatgacattaaactagatcagtccttcaaaacaagagatgacttacatgtttttgtttgccccgaagcaattataactttagggattagcgagggtgccgaacaatccagaaacaaatgttcacctacgtatgtaatgacaatataaaagaagattatcaggaagaaataaaaacagcaattaactgtttccagagatgataaaagaaacttaaagggatgcatagagaattgaacaagcatggcgcaaacttatgaaagggacaaaactacaatttcttaacttagtttctaaaaaccccatgcataatgttctactactatccaatgaatagaacataaacagaaatgctagctacaacaaatttgtaggttaattaaactgacagcaaatgcaaaatggcaaatggatataaaatcaacagaggtgaagtacatatgatagatgaaacgtagtagcactggtacagtggcactgaagtcaaagatggttacaatcatgtttgaagtcgattgcaagagcgtacctctcctttgcttagaccctggtaagggctttgaaacagagaaccactggctatccaacttctcaatccctttgatctcgaacgagagcccatccaccaagagcgagggggcatcctcaccggtctccgccgacgccgcgtcatccttcaacccagctggggtgcagatctctatagtcgcggtgaccgaatcaccgggtctgtacacctccctgtccgtctggagcttcaatctcggggagtgccgctgcctggccgccgcggcatcggccttcctctcctcgaaccacccgacgcttctcaggaaggagagcccttgcgggatcgggagcttcagtgacatttcatcaacaggttgcctccgattcaacgtatatccccaccgccgcatcaacctcaaaacgagaacaacaacccaatccaattatccaaatcccccaagctaacaaaccgaacggattcccaatctgtatacaccacgcacgcagggcggctcatcaatcgaagtggcgcgtacgagcgagcgctacaagaagagaatggggattaccttcgattcgattcgaagtgggaggtcgtcgcctctctctccgagcctgctcgccggccggccgtgcgcgcgaggggccggggagaggctcgggcggccgcggcgaggaggaggcggggccgcgggggctcgtcggcggccgcgcgcgagacgcaccgcagatcggatcggaaacagaagaggggagagagaagagtaatggagtcgagagatgcgggaaagagaaggacgacatttggtcaccggccgttttcctaaagttcgtttttgtttgaaaaaaaaaaagagaattctaacattgtttaaaccattgaaatcgatgtgaattactccatccgtttcacaatgaatattttccacattaatattgatgttaataaatctagccatatatatctatctagattcgttaacatcaatatgaatgtgggaaatgttagaatgatttgcatcgtgaaatggaggaagtagaaggcaaaatgattggacattaggttagcaataatataatgcttagtgtggccaattttaaaacaaagattgatgatttgctacattgaagattgttcgtttgattatgataccacttcacgatcatggcatatgggactatctgatcatgaggcaaaatggaaaatagttgaaaactattttgtggagtggcaaaatagcaatctccatgtctttggtaaggtttggctacaaaatggtaagacaattacacaattgcaatcaagagat

SEQ ID NO: 82577 - DNA, 1390 bp, Oryza sativa
aggtattactctgcaaatatacgtgaataataacagtcagatcaaattcagcttaagaaattacaattcctgtttatcttcaggatgccatgagaatcggctattacagaaaatctgagataaatcgggaaaaaaaatgctgaaacagaactttagtaccacatgtccacaatcccttatctaaaacttcaacgcacgggtcttttgtctttctcgagtcttttcctgataactttgacatccaaagtaatgtgaagtgcacagttgcaggtatattttagtctttgttagcacaaactttttggttccacctacactactggtgcgtgttgaaaccataacatttacagctggtaaatactaattacctaatattttacagcatttgtcaaaccatggaagttgtggatagtcagtataatttgttaggtaataatatgatattttttcaatctcaaacaaattatggttagtgttttacatgcctaatgtacagaataaataccgctattagtcatataaattataaagggtagaggtgcatcctctttgatagttaaatctgttaggcaatagaatatgccgtctgtggatatcccagctgctatagatagcagatgtaaatcagggattagctactatagatagcagatgtaaatcaagggaattatccttgccttgtacagcaggccagccggccctatataacagaaggcgccccctcccattgaggcgtggccaattgccccctaatccaattctctacatggtatcagagctccgggtcccgatccccatctaacctcgagatcctctcctccagcgccgcccccttcctccctccctccccatgggaacccaatcggacctcctctctgccactagcggcgcccttggggccaattctgcccccgtgatctgccccttcgccaccatcaacatcaagctccacgtccccatgaccctcgagttgaagccctccaacttcaccaagtggtcaacagcgttccaggccacgtgtgggaagttcgggctgctgcatcatctcgccaccgcctccacctcgcgccccaccgacgaggcctggaaacaggctgacttctgcgtccgcggatggatgtacagcaccgtctccgacgccgtcctcaaccttgccatgaccgatgacacgcagacagcgagcgttctttggacggccatcggcggggtgttccaggcaaacaaagctcctcgcgccatcttcctgaatcacgagtttcactcgatgactcagggggacctgtccattgacgcctactgcgttcgcatgaaggagaaggccgacgaactgcgcgacgtcgggcagcccgtatctgagcccaacctcgtcctcaacctcctgcgcggactc

SEQ ID NO: 82578 - DNA, 3069 bp, Oryza sativa
ttagtacaattttcaaactactaaacggttcgtttcatgtgaaaactttatatataaaaattgcattaaaatgttaaatatatccatttgtcaagtttgtaataattaaaacttaattaatcatatgctaatagctttctcgtttcacgcgcgtcaacttaatctttaccttcaccagtcccgtctcttctttctgtagattctcttggtcctcttcaatcttcctgtcagtgctagtctttttgaccctgagattcttgaattcccaagcatgaagccaaaaaattgctgagaaatttgtatccgtacttttgagattgtgacaacctgtcgatggaactgatgttttaagatcgtagaggtttacaatctcactcaactatcacagtgcgaatgaaactaattagctagaataataacccaaggttaggtgcgaaaacatttcccgtcgctttctttagcagaatcgttttcccattcttcgtgtatataactacttggcggtacaggccgcatatcctggagggggaattcggggtcggatttgctatttcactttcgattttttttgtccgtagagtcttacattaagatttgtgttcctgtagatccaacttatacttatactcagttgcataccacttaaatttagttacagtgcgccaaaattagattttacaactgcttttgtctcgatatttttggcatgtttgtccctttttgtttatttcgttcaaaacaggctgtatccgctggttaaaaatttctttaagattaaaatctcaaaatctgccaatctttttaaaccgaagccagcatttgctagtgttatattaagtaggatagaaattatttacaaactcaccaaaggtgaaagagataaagctgaaaagaaactgaaaaagaagggaacaacaagaaaacccgacagcctcgcatgtgttttattgggacattctcgcaatatctttggtgccgcacataatccacaccttgatctcatatgtgattttggtcactagttgaggcaattcagtctcctgattgcggaacagtcatttgtttcgttcacaccagattttccaagccaccatcatatgaattgatttcattgctttcattttgtgtttttccccttgggatgtccacttgatccatcagtcaagcagtggctcatcgccatcgtatgtgtttagtgtctcatgtcccagctgttgaaagatcttctcccagatttggtgtgcgaaggtgcagtccttgaaaaggtgttgtgccgtttcaaggttttcatagcaaagctgacataaatagttgttcggccattgacggatttgcagccgatccgccatccagattttgttttgaagagtcatgtgaaatatttgcattttgacggtgcccatcctttctatattagctttgccactgctgagtcaatcctccaattgaattgtgccatgtatgccgattgtgtgttgtatatgccactatttgtccatcgccatcttatggtgtcttcaactccatcagttagggtgacatttcttctccatatctgtaggaacacgtcgaagaattctttaacaagtttaactgccgaaaaatcaataggttagtcccctcagggttgagtaatatgcacactttcctgttcctaaaaaaagctagtactcatcaacttgttaaaatacatctgttaatctgtttagacccttctcaaattaagcattaataactcaccctgaaatcaactgctttaaaatagtagtagtcatgttgacttgccgtactttgaggagggtttaaacagacacagacacttcatctcagaggattaattaatggcgacgagtccatgtggcagtcggatgggtgaggcaaaacgcctctgcaccggcagtgctgctctcaagcagctgcaccacagcaccacccggtgcatcgtcggccggccggactgccgggctcggctcgatgctatcgcggttatcgcgcttatcatggggtacggtaggggaaaccagcgatatagtttggatgaattttgatcaaattcaaaattctgaaaaaaatcgaaaaaaaataaaaaaaaatcatggatgtagttcttaatttgtaattaccaatagtgaagaatgtttttgaaatagagtaagctaaattcaaatttgagagcaaaccaaaacatagtttacaaattgaaaaagggaagagaatattgggccttaaatatcctacatattcttccaattatttttaatttctagttttttacacatattcaactgtatttttgattttttccctatttattttacacttattttagctacacaaccccgcgataaccgtgcgaatatcgcggttattgcggtaaaccatgcgattatcatggtgaaaccacgaaaccgccgagttttttttttcgaatttttggatgtgatttttgtgcgattttaggcaattatcacggttatcgcgttaccgcggggtgacgataaccccgacccaaacgataaggtaaaccctgtgcaccatatagtgcaggtgccacgctcgcggaacctctccaccttctctaggtcaaatgccgtcacatcgtcgtcgtcaccgtgcagcatgagctctgtaccctccccgtgcacaccagctgaccggcccacccgaaaagtgtgatcactgtgtcggtgttgctgtcatggtgatgggggtggtgaaaagtttgataatttaacatttttttcgttgtccaattgctttaattgacacttgtgaggatgacatgtggaaccatatgagtgaatgaaagtatgccaggatgtcaaataacaacagctcatatctagcagagaaaattggaattttgccattgtcaaaacggggtttcgctgaaatgccactcccaaaagtggtaacctcaaacaagggcaacatgttgcaatgccatttgatccatttcttctcagtttaatgatttttgtaatgtttattcttgctgagatgaccaaaatacccttggatcctatcttatctctccctctggctcttcctcctcttcggggtggctgg

SEQ ID NO: 82579 - DNA, 6288 bp, Oryza sativa
tttttttggcaacaaagtgaacagtcccaaacacattcttgccattgctaccataccaaatttagaaaatccggaatctaaactctattgatatccgtaagactttaaactaaacgtgtttaatagtactaaaaaattgttatatttttagactaaagtagtagttaattatgaaacgtttagaaaatatatttataagagtggattgtatgtacatggaggcatatagagacaggtatttggtactagtggtactagtggcataaagagaagttatgtttggatgaggtgatgaaggggttgggttgccggcgagcgacgaaagaaagaaagaagcagcagcagcgggtctcgtctggtctggtagtaactaggagtagtagacgggcaccggcggcagcagagtcaccttcctttcatttcctttctcttttctctttctttctctctctttcttggtgttggaaggcgaaggcaacccagggggggaagcaccggaggagccgcagatcccgccatgcgggtgctcccggcgtcgtggtcctccgccgcctcctcctccgcctccgcctccgcggaccgcctcaactcccccaccccggcgccgccgccgccggcccctcctcctcctgctccaaaaagcagcagcagcagcagcgcggagctgtacctcaacatctacgacatctccccaatcaaccactacctctactggttcggcctcggcatcttccactccggcatcgaaggtctatatcactctatctccttcccccttccttgtgcgtagatttaccttctctacgccacgccacgccccgccagggaccctacctctaacctggtagtatagtaggcgtactccagataggtcaggatcgaggtaccaccacacctacatgccttgccgtatgccgtatgctgcttgcttccttcgggacctgctttgctcttctactctggagtactaccttactagtaccattttcccccttttcttttctttctcttgtattattattaatcccaaccaacaattctcatgctctacaattcaccacatcctataagccccccccccccccctacacggcacacgccaccaattcttgtgtgtgcctaccgttacttctaattagaaacaacatgtgcaacttaccctaacaccctgtcaatgccccaagtccgactctctaccaggcaaggttcacattacttgttgaccaccggatttatcacgctttgggacaaaattctgcctgcattttgatcaagtttactgtttaccatttgaatttgtcaaaaccaccaaatattccaaccgaaaattgatttccatccgcatcgaaacattgaaaacccgcgaaaaccaatcggctttcattggctctgcgaaccctgctctctacgcgcagcctgtatgtgagctcagctgttcaatcgcctcatcgagacttcatttggtctccaaatggagtacaaacggcacaaacctaagcagtattgctttgctatatccaacttttaccccccccccctttttttcttttgctacacacgtatctagcacatttgctatatattacttgtgggctggaccaactgttatttgttctaaggtcttcagtctgctgatgccttagctgctcatagaattcccatgtttgctttgcaaccattactttttttttggtttgacatccagggatcagcacctaacaactccaataccatttgcagtgcatggcatggagtatgggtttggagcccatgaatacccaaccagcggagtcttccaagtagagcccaaaagctgtcctggctttatcttcagacgctccgtgtgcgtgggttccactgatatgtctcgttcggaagtccgcagtttcatagaggatcttgcagaggattatcacggggacacttatcatttgattgcaaagaattgtaatcattttacagcagacatctgcaagcgtctgactggaaagccaattcctggatgggtcaatcgacttgccagattaggtttgcttctgcaacacaaactcataacctattgttcctcgattttgatgattctaaactattgctgggatcgcaggttctttctgcaactgtgtactgcctgaaagcatcaaggtttccgctgtcaaagatgtaaccgatccccccgagtttcctggtaaactctctctctctccctcccccagttagtgcgtatggatggattcaattgtttattttcctgcacacatccatttttgggttggactgcttatataaattaattacctaagatgtttctaccagtccaagcacatgatttgatgttgacctttctaggttgtactgcctgggtaaattattggcatatgcttccttcctccttttgttcttctagttggctctatcaacattgcattagctggtcatactcaaatcatttatttataccacatttcctcccaacgtgatgttgaattagtggagatattttcccgaggtttgatgtaatctagctgcatcctaatattcgagcgttaggtttcttatatgcttgagtttaacatctcaaaagttatgcaattaacgttagtgaagtgccatgctatgactgactaacagtatagttactcttgtagtcttttgtttatattccatatataatccaataatcgatcttagttataatgattaaccgaattaatcaaaacattctgctaatacattcaaatcgttaaccgtttcacaagtagtgaactaaatttcttattattagagccaataatttctacaagtttggaaccatttaatatatcctaccggtattttctatgaatggttagacatcatggaagatcttggtaaacctagcatggccgtgagtttaattgccattttcatattctgttttccatatgaacatatgatgtgaattatacacactgtaacttgtcatttgtaattggtaagattctgttgctacagatgatgatatggagtctaatgcatccattgttgacggaagtgatgcggatgatttagaccatcttctaataaccccaagtagcgatgttgtatcttcaaaagataagatattaactcctggcagggatagcttgtaattgcatgtattctccattgatatagttcaagtattacttgtggggttgttttctgaggatcaatctgatgatttcttgctgagtggcgatgtggctggaggaggggtatgctgtgggcagtcaaccttgaatagttgaatgtataatccatgaatggtaattctgtgtgtcttacactagaggtagtgaatgtgattgtctaactgtggcgaagggccatgtttccattataagtatatgctgttttgagagaggggaggggaggggaggagtgcgttgacagtgtggtatgtatatgctgtaactagttggagaatgattgacttcatttgagttacctaggtgggcttcctgttttgttttgttgtgtgtaactgatttgtttgtacaaatgaatgatttgcagttgtggaagttgaatagatgttcggtccgtctctctgttgttgttctgcctgctactctctctctctctctctctctctctattgtttgagagggctgatgctttactggagtaatgtagccgtcttaattgttggcgaaccaaacagatcgcttgctatgctttgattcaacaagaagtgttgggcgcatacattatcctgcctattgtcttttgtctcttcttttatcttcttttttcctttatggcaagtgcgttcttatcccgtctttaactttaggaaaaagtacgaattatcctccgaattattgaggtcgatcgaattatactctcgaactcaaaatccagacattctacaccctcaactattgaaaccggacaaataatccctctaattcaattcggggtggttttggattcacgtggcagtccagtcagtatttttttaaaaaaaaatcagtggaccccacctgtcagttcttcacccctctctatctctctactctatcccaatgtctccctctctacgtcagtggaccccaccaatgtggcggccacgcgagggcgggagccgacggcggagggcgccgggaagcgtcgaggcgggagttgagcgtgcagatgatggcgccggccattgggatgccgaagtggagctcgcacatcactggaatattctacgcgaacaccgcgacctgcacacagagacaaccaaccaggcaacgatttcttctgaaaatacgaatcactcagctgctaattcggaaccaaattagaagattcaacaagtaaattctaagcgatttggttttttttagcatgaaaaattgaagaagggggagatttgggagaaaaatccaattactgtattgattggcggcggcgaacggaggtcaatcttaccacgtggtggcggtggacgtcgagggcggcgagggaggcggcgaggcggaggcagcggtctcgcgtctcccgccaggtgcgcgtgagtccggaggaggaggcgacgatggcggggtggtcggggtagacgagggcggcgcggtcgaggaaggtgatgggggtgagcgacgcgtggttggcggcgcagagcacggcgccctccatcgccgccgtggtggacgtgggcgtgtccggtgaactcgggacgacgagatcaaagtcagagagacgagctgaggtgaggtgaacaagggcaggcgaggccacgcaaaaggtgagggaagagaagcttgttttatgacgacaaggcagcagcacaccacgacgacgctcctcagccgcctcaacctgcacggcaacctacgcgggcgagctctgcctcccgctgctggccgcttgctccgcctccgtctcagccgcccggcgccctccaccgccggcagcgccgcctactcccgccctcgcgcggccgccgccatgctggtgagaagagagagagagagggagagattgggatagactagagagagatagagaggggtggagaactgacaagtggggcccactgatttttttaaaaaaaatacttattggactgccacgtggacccaaaaccaccccggattgagtagggggttatttgtccggtttcaatagttgatggtgtagaatgactagtttttaagttcaggggtgtaatttggtcgacctcgatagttcaggggtgggggtaattcgtactttttccttaactttaattgttattttacctccacattttcaagtaaaacttgtattttgcctctgttctgttaacaagacttaatcatgcttttaagtttaagaattcctgtaattgggttgacgaagccctaattttcttgctgaacgttctagtgaacgatgtaattatgtttgtagattaataaagcgcgccaaatggcttccttaaaaaaataagacttaatagtatttaagtttatgtcaaccttgtgctcgatccttttcttttttacattaaacatgtgaatgtcaaaacagatgtcaaattcatgtgaaaaatataaaatatttggtgtcaaaatcatcaattatttccaaagacgaataaacttaaaaaccaactcaaatatggatgacataccaaaatactggcaaaaacatcttcaatttttataatagtagagataggggttaggagtaaaataaaaaatctcagatttatactcctaaaactattagaaattttatctttttttgttacggctaaaatattttaaaattaaggtcaagattttatacataaatgtaatactattgaaagtttatatacatttttttctagagttttagatgatatttgttagtaggtgtacacgatgttacacataaagttttggtggttatgattggttaagacgattggttaagacgagggataagtgggagattatgaaacaaaaacctaaacattataaataattatatgttaggatggaggggttatatattttaaatattattaagtcttattaataatagagtaggggcagaataaacttggtttacaaaaaatattgaaaaaatgatgaagttggggtatcattttttgtttgaaaggttcctggtgggccaagggggagcgatcggatcaggggaccacctagagaataaggggcttcgtctccccacgcttcccattttctttcatttgggttggagaagttgggggttggggggttgggcgaggaggaggaagaggagtacaagaaagaaagaaagattagtagtagatggccgcttattccctcg

SEQ ID NO: 82580 - DNA, 554 bp, Oryza sativa
aacacttctgcttaaacacctggtcaaattttacaaagggcaggatctgccatgggttcaactgatctggaattcttattatgactccaaagtgccccatttagtttggaataaagtctctttttggtggagagatatagtggctctgtctgatatcttcaggggaatttcaaaacgcttcatcaggacaggatcctcagctcttttctgggatgatttttggaatgacaagattaggtgcactgcattcccagctttgtgtatggttgctttggatagatccctctctgttaatcaaatgtgctctattcctcttgaggattgctttttgctgcctctgaacacccaagcctatggagaattcatcattctagaggaggaattgtcctctctctctttgcagaatgacaagggtgatgattggtctttcatctggaactctgacaagtacacaaccaagaggttttataagctcactttctcaaatgtgcaagtgccaagaccttttgtttggatctggaaaacaagatgtgtaatgaagatacaagtttttg

SEQ ID NO: 82581 - DNA, 21054 bp, Oryza sativa
tcccggacctgcgcgcgcgcgccatcctcggttccagaagagaactcgtccagcgctgcccacggggagaagtcagggtccctggcctggtagcttgccagtacgagctccaccgccccccgggcgaggtccctcgaggatgacttgatcgtctcctcgagctcctcggggagccgctggagggtcccggccatctctgagaggcgctgggcgaggcccccctggttggcggcgtatttcgcggtacgcccgccccagaggcccgcctgccgcccggcacggtctagacgggagacggcgtcccgaagcatgctgggccctacctcgcccgtcaagcggagggcttcgacctccccggcggatgagtccagcgcgccctgcagctcggcgatggtgtgttcggcggctgcgaggcgggcggctaggttgccgtcgcccgcggccgccccgccgctgcgcgctctcgcgtccagctccttcgcccgcgcctcgaattcagcggcccgctgatctagtgcggccctctcggcgcgggcgccttccagattgaggcgcgcctgctcctcccgccgctgcgccgcggcctcggcctcctcgagagctcgctcccgctcagtgagctcgtcctcgcggaggcggagtgcggactcctcttcggcgcaggcggcctcgtgcgccgccagcgttgcctcccggatggcgacggcggcctcgcgacccgccagttccctctccttcgtgtccagggcgcgggcgcgctcctccagcaccgtggcgcgagcctcaagggcctcttcgcgttgccgggacgcgtcgagcttcttctctagctccgccgcccggctcccgtattggaggcagaggtcgtcccgcgccgcgttgaacatggcggtggcaatgagggcagtctcccgctcctcctccacctccctggcgatctccgccaggtccctacgacgggcctcgagctctgaggcgtgccggcggtgtgccttgcggcccgcctccaccatggcttccaccgagcgccgcccctcttcgacgcgtgcccacgccgcatcgacctccgcccgctatgcctgcaggacctccatctgggcgcttaacccgtccaacaccgtggtgttcgcagcggccaaggcctgcaggaggggctctgcgctcaatggggcagcggaaggcagaggggagagccgcctcggtgtgggcgctgcgcggctcggcccgccgatcgacgtgccgaactcgggggcgtcccccgaagcgggctcgtcccgaacgtcgccagaggggtcgggcccgagcggcgcgcccgcggcctcgtcgtgggtggcctcggaagtcgttgtcgcctcgggcggagtcgggtcgggggcttggcaggccgcccggcgtgcgcgcgccgcctccgtctcccggacggactcctcggcccggcggagtctggcctcctcccaaacggcttcctcagcctggcgagcccggacggcctcctgggcagcttctttggcttcccggaggcggtctgcggcttctcgccggtcagcttcccgcctccgggcctccgcggtcgccgtctcctcggcctcagaccggccggacttggaatggcgggaagggcgcgacgggatctcgctgaggcagaagaaaaaccagaagacgaaaaacgggtgagtgaaaacttgccttgggagatgggagaatgaatacggccgcagtgggcgcggggacgaacctgcgaggaggtcggctaaacgaccaccttgggggggagatgaggtttccccggcatggttcggtcccccccatcttgcggagccgcttcttttttcgctccccctcgggctgcgacgtcggcacagcaccctccgggcgcctgctgctggcacgcaccgccccgccccctcagggaggagatggggagggggtatcctcctgtttcctcttcccccgggcgtcggcagggcggctgccccccgggcccccgtcacggggcccagaatctcttcccctcccggggtagattgttcccccctacggctcccgcccgcgccatcgtggcctcgaggagcccgctcccctgacgccccgaccgcctgcatgatggtcaggatgttggcgcgctctggatcgctgcagagggggaggacaccttgggggatgaggaatgcctccacggagctgagattcagcacccgttggatcaccatcttgaagtcttcagggacccagtcccatttgaccccctggtgggtcctcatgtagtcctcggacccggtgtactcccaggcgccctgggcgcgccgctggagcggcgcgatccggcgacgaaggtaatcgccgtacaccatggccccgtgagcccctggaatcgcagaccagccaggcggtcaagaacggcgtcgtagccgtctcccagatctaccggcgcccgccagctggaggcctgcgccgggggctggctcggaagtcggaggcgcgcttcgtcggcgagaggggtgtagaaccagtcgctcttccagtcgtcccacttcttgcgaaggacgcagggaatgtagcggttcagcaccggcccccgcggctggaagtagcagccaccgactaccgacggtggcgacaccggctgtacggtgaagaaccaccggaacagccggagagatgggcacaccccgatgaacatctcgcacaggtgcgcgaagatggccaacgtcattaccgcgttgggggtgaggtgcgccatctggagatcataaagctccagaacatccatgaagaaagaagagaatggcgggaccagccctgccattgcgaaggaaaggaagaatacggaccgccccgggtagtgtggcgccgggcgtccctcacccagcgcgaccacctcccggccggtggcagattccggcatgaatcggcgcggcagcccggcctgcctctcgctcacgatgcgagaaggcggcagcacgctaccgtcgagcggtgcggagccccgtgccatgacgccggcggaggaagggcttgagagcgagtgagtgcggcgaggatagggcacaggaaacgagaagttagagcgcaagcggtgaaggcaaggggaataatggcgagaggaaggaaacgaatctcttcctcggcgtctttataccctcgccaacgctatgcccggctcctcgcttcccgcgccaactatctcgcccctcgtttctcgcgcccactcctccactaatcccgctcgcccgtttgcggcgcacgaggcggatgtgcggccgtggcagtcgagatgggacatatcgtgcgcgcgttaactacgctcgccgaccgatgcaccatcatcacatctccaggcgagacgaaccggctcgtcccgattcgcgcgctactcaagtaatgtagcggtcttgaagaaagccgctcattattgtcggtcgtttttcccttgccgatgcgcgcgatttgcgaccactggattcctgcctgcctgtagacaccggccccacctgtcaccaggcctaaggagtggcgtcacgcccgagcgctttcctcgaggagggcgatcgccctggcataacgccgggggctactgtcggtgacatgggaccgagggtatcttgactagaggtttgcggcagccgcggtcacccacgtggcctgaccccctcgggggggggggtcgggcccgagggtgatgtggccgcccctccctctgtctccccgaggggtcgggccgctcccgtttcggccccgagggctggggcgccccgaccccctgtgggtttggcgccacgtgtgtgggttaggtgagcacagcagcgctcacctaacctcgtttattgcgggttggacgagcgccccacgccgcatttaatgcagcgcagcacactcgttcggtccgtgacaggtcacagtgtgtggccggtcacagaccggtcatatcgcgggttaggtggcaacaggcggcctttcgcatgcctcgccccgtcccgtcggaatgatgagaagcctctaggcactcgtccctagccggagccggcgtgctaactcctggagttagcacgtcagtcccggctagattcataccaggcttcatcgcaaccattacaaggaagtcattttatgaagaagggctgacgtgtggcatgctaaactgacgcgtggtagacaagaatgaccggtttgtgactggtctgacgccggtcacgtcatcggcagacaaccgtgctcccacgttgcgcctgcttccggcggagtggaggtaggtatggcccatcccatcggagggtcattcggatagcagccatggcaaatctccgcccattaatgagggagtaacagggagatccccggtgtcaggcgagtgatgacgctgggcctcactcaaagacaagctgtgatttagcttcgaggcgaaggcgcaagccagttttttttttggaagatagggtgagtccccacccaaaagaagagtaggtagaagtggtgcatgtggtatccccttgagatataaaaggaggaccttgcccacttaagagaaaaaagaaaggggagaacacctgagctggtagaggagagaaagaggaagagggtctctagagtttgaactctcttgctctccagctctttgtaactccttcatacacagatccaccagaacacaggagtagggtattacgcttctcagcggcccgaacctgtctacatcgcccgtgtcttgtgcatttgctctctcgcgaaacattccacagatcgagggcttagaacctcacctagctcccccggccgaaccggcaaaggggggcccgcgcggtctcccggtgaggagccccacgctccgtcaccttgtcattcccctttaaatgaatggagactttttgcggtccatctcacgtggggggggctccagacgatgcattgatgggacggggcatacctgcccctactccgccgagcacagggcggaacgtgggggcaccaccgcccgtccgatcggacgtgaccggcgacaggccggtcacaatccggtcacgcccgattgatgtgggtcaatcgggcaacgccgcacgtccaacctcaccgcattaaatgcggtgagggacggttggggcgctgcgcattgatggtggttcagcctgggtctccgccccactgtaggatcaaggaggccgactagagggggggtgaataggcggttttaaaacttaatggcacttaaacaaaactaacctaagttactaggcaaggtgaggtgcaaggttaactaagcaactaagttaagttttgcaaacctaagtgatatgggctcaaatatgtctctatgaatgtaaatagcacaaatgtaaatgcaacaaataaatgagacaagagacaaggaatttttcaccgaggttcggaaactcgctggtttcctaatccccgttgaggcgagcccaactccaccgctcaaccacgaagccaccgcacgcccccttcgtcaaggggtgggcaaggcgggagccggcccatggagaggactacccaagcctcgatcactcggggtagttcttccttcactccgaaggtggtgaactccaaaccactcacaaacggtgccgggcctcctccacaatctcctcggagaggtcaccgggcaacacctccacaagccgtctaggaggcggcaacctccaagagtaacaagtctaggatgcttgccgagtatgatcaagtgccacactagctataacaatgaagcaacgcactttgacggagcgtggggctcctcaccgggagaccgcgcgggcccccctttgccggttcggccggggacgctaggtgagattctaagccctcgatctgtggaatgtttcgcgagagagcaaatgcacaagacacgggcgatgtagacaggttcgggccgctgagaagcgtaataccctactcctatgttctggtggatctgtgtatgaaggagttacaaagagctggagagcaagagagttcaaactctagagaccctctccctctctctctcctctatgagctccgctcttcctttcacgagctccccttttcttctcccttttctcttcctcccgttccccccgtcctggtaggcatggtcctccttttatatctcaaggggataccacatacaccatttctacctacccttcttttgggtggggacccatcctattttgaccaaaacttggctcgtaccttcgcctgacaccgggatatccctgtccttccttcattaatgggcggagatttgcaatggctgctgtccgaatgaccctccgatgggataggtcataccaacctccactccaccggaagcaggtgcaacgtgggagcacggttgtttgctgatgacgtgaccggcgtcagaccagtcacaaaccggtcattcttgtctaccacgcgtcagtttagcatgccacacgtcagtttagcatgtcacacgtcagcccttcttcataaaatgacttccttgtaatggttgcgatgaagcctggtatgaatctagccgggactgacgtgttaactccaggagttagcacgccggctccggttagggacgagtgcctagaggctctcatcattccgacgggatggggcgaggcgtgtgacaggccgcctgttgccacctaacccacgatctgaccggtctgtgaccggtcacacactgtgaccggttacggaccggataagcgagcgctgcgccgcattgaatgcggcgtggtgcgcttgtccaacccgctataaatgcggttaggtgagccccgctgtgctcacctaaccaatacacgtggcaccaaaaccacagggggtcggggcgtcccagccctcggggccgaaacgggagcggcccgacccctcggggagacagagggaggggcggccacatcaccctcgggcccgacccccccgagggggtcaggccacgtgggagaccgcggctgccccaaacctctagtcaagatacccccggcgttatgccagggcgatcgccctccttgaggaaaacgctcgggcgtgacgccactccttaggcctggtgacaagtggggccggtctctacaggcgggcaggaatccaatggtcgcaaatcgcgcgcatcggcaagggaaaaacgaccgacaataatgagcggctttcttcaagacggctacattacttgagtagcgcgcgaatcgggacgagtcggttcgtctcgcctggagatgtgatgatggtgcatcggtcggcgagcgtagttaacgcgcgcacgatatgtcccatctcgactgccacggccgcacatccgcctcgtgcgccgcaaacgggcgagcgggattagtggaggagtgggcgcgagaaacgagggggcgagatagtggaagcgggaagcgaggagccgggcatagcgttggcgagggtataaagacgccgaggaagagattcgtttccttcctctcgccattattccccttgccttcgccgcttgtgctctaacttctcgtttcctgtgccctaccctcgccgcactcactcgctctcaaatccctcctccgccggcgtcatggcacggggctccgcaccgctcgatggtagcgtgctgccgccttctcgcatcgtgagcgagaggcaggccgggctgccgcgccgattcatgccggaatctgccaccggccgggaggtggtcgcgctgggcgagggacgcccggcgccacactacccggggcggtccgtcttcttcctctctttcgcaatggcagggctggtcccgccattctcttctttcttcatggatgttctggagctttatgatctccagatggcggacctcacccccaacgtggtaatgacattggccatcttcgcgcacctgtgcgagatgttcatcggggtgcgcccatctctccggcagttccggtggttcttcaccgtacagccggtgtcgccaccgtcggtagtcggtggctgctacttccagccgcgggggccggtgctgaaccgctacattccctgcgtccttcgcaagaagtgggacgactggaagagcgactggttctacacccctctcgccgacgaagcgcgcctccgacttccgagccagcccccggcgcaggcctccagctggcgggcgccggtagatctgggagacggctacgacgccgttcttgaccgcctggctggtctgcgattccaggggctcacggggccatggtgtacggcgattaccttcgtcgccggatcgcgccgctccagcggcgcgcccagggcgcctgggagtacaccgggtccgaggactacatgaggacccaccagggggtcaaatgggactgggtccctgaagacttcaagatggtgatccaacgggtgctgaatctcagctccgtggaggcattcctcatcccccaaggtgtcctccccctctgcagcgatccagagcgcgccaacatcctgaccatcatgcaggcggtcggggcgtcaggggagcgggctcctcgaggccacgatggcgcgggcgggagccgcaggggggaacaatctaccccgggagggggtcgtgcttctgggccccgtgacgggggcccggggggcagccgccctgtcgacgcccgggggaagaggaaacaggaggataccccctccccatctcctccccgagggggcggggcggtgcgtgccagcagcaggcgcccggagggtgctgtgccgacgtcgcagcccgagggggagcgaaaaaagaagcggctccgcaagataggggggatcgaaccatgccggggaaagctcatctccccccaaggtggtcgtttagccgacctcctcgcaggttcgtccccgcgcccactgcggccgtattcattctcccatctcccaaggcaagttttcactcacccatttttcgtcttctggtttttcttctgcctcagcgagatcccatcgcgcccttcctgccattccaagtccggccggtctgaggccgaggagacggcgaccgcggaggcccggaggcgggaagctgaccggcgagaagccacaaaccacctccaggaagccgaagaagctgcccaggaggccgtccgggctcgccaggctgacgaagccgtttgggaggagaccagactccgccgggccgaggagtccgtccgggagacggaggcggcgcgcgcacgccaggcggcctgccaagcccccgacccgactccgcccgaggcgacgatgacttccgaggccacccacgatgaggccgctggcgcaccgctcgggcccgacccctcgggcgacgctcaggacgagccagcttcgggggacgtccccgagtccggcacgtcgatcggcgggccgagccgtgcggcatccttaccgaggcggctctcccccatgccttccgctgccccattgagcgcggagctccttctgcaggccttggccgccgcgaacaccacggtgttggacgggttaagtgcccagatggaggtcctacaggcagagcgggcggagctcgacgcggcgtgggcgcgtgtcgaagaggggagacgctgtcgcgaccgagaaaattgccttttcccgaacgctagtgtattgatccccgtcccaggaaaagccggggtacaccacacaaacatgatacaaaaggcacatctttattatatcgataatatttacattattacaaaggcacttaaggcctgacaatcaaaaataaacagcagcggactagcgggcctacggctccatcttcacaggcgctcaactagggtataagccaggactccacctaagacatcttctccaaagcttctcttactgaaggggggggaaaagattgagcaagaatgagtacaatcacagtactcagcaagccacaccggagatgcataattaatgcaagggggtacaaggggataataatataggggttaagttttgcagtaaacagcatttaaaagtcacttagttgcccaaagctattttgtaaacacgatcctagagctatacaatattattaatcaaggccgtggacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcatgtgtaaccacgtgccacataccaccacggtataaggacggaagacgtgacatagttcccaacccatcctagccataaacaagagtaccgacccaaccctacctacggccggaacccccgggacaagtaggcaggactgagcccccagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgagcttaatccttatagtacccgaggtacgactaacaaaacccaaccacgcacctcgagcccagcctaaaaccattttgggggttttgaatagagggggaggtgtgtgtccaattccaacataagccaaccattccatagtgtccaaatgatatgagaattcccaaagtctaaagttataaaaccacctaatgttgcctaattaatcagcgaagcatctacctaaattcatactagtggaaccatgaatagagtacccactagttggggttttgtttatcctagggtgaacaaggtaataataacaataataataataaggtcataacaaaggtaaataggcatggctagataaaacagtgataacgcgggaatttaaataaagcgataatgcaataattttaaagcaacataattttataaactgggattcaatatgttcaaggatgatgtgacttgccttgctcgctttcccaaacgccggcttcaacttccacgaagagcggatcttccgaagctgcagcgtctacacgaccaacggaaaagaaaaggcttttactctaataaactccatataacaagcagaaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaatagatttattgcgtcagccgaggggaggggcgcgcggaccgggtccacggggggtggggcccacgcggcagccccacggtccacggtggaccgggcgcacccgggctcgcaccggccggcgccgtgggtcccacgcgtcagccgcacctaagggcgcgggcggctgacagccgggccccacacggcagccgcggggcgcgcccgaaggcggccacgccggcacagccgacgggaggcggcgcgcccgcgtccctatggtcgccggcggcggccataggtacggcggagcggcggccgagagaggggagggaagggggaaacgaatcagcggtccacggctcaccccgggtcgacggcgacgacgggaacggcgaccggagcggaggaaggcggcggcgcggctcgggtggacggggtcgacggtgctccggcggtcggcgtgcgaaacggaggggtggacgaggtcgccggggatgcggtgaagccgaaggtggcgacgccgaggcgggaggtggtccggggcgacgacggcggcggaccggagctcggcggtgacggcggagagagagagcgacggcgcgagctcgattccgacggggagagagggcggcgagtggcggaaacggtggagggaggcacggggaaggtttatatagggttgggagggggagagagcggccggacgagggggaaacgggcgcggaagatccggtcgccattgatggcgccggcgaggttaggagagaggtttccaaatgaatccgagggagagagggagggaaaaatggggggaaagagggagggaatcacggggaatatttccccccctcttgattgcacgcggggcggacgggggcggcgggattcacggcggcggcggcggcgctagggcgcgggcggggcggcgggagcggcgggaggaaggggatgacgggtgggccctacccgtcagcgagggaggcgggcgggcccgcccgtcagcggcacgcgcgcggggaggaggccgaatgggccgcggggagaggagagggagggggagggagctgggccggaccggcccaagagggagagggggagggaaagggaacttttttagggtttttctttttataaaacctttttaactttgtttatttcttcttaattattatttgtgctctgaaaattcaagtaaaatttgagggctccttttagaccaaggagaatttaacaaaaattctccgggccacattcgaatttttctggtacgtattttagtgtttgccaatttcttttcgaattttaatttaattctattattccttttagggaatgatttttatttcgggatgaatttatcaggacgtgacagacgctcggtggaggccatggtagaggcgggccgcaaggcacaccgccggcacacttcagagctcgaggcccatcggagggagctggcggagatcgccagggaggtggaggaggagcgggagactgccctcatcgccaccgccgtgctgaacgaggcgcgggacgacctccgcctccaatacgggaaccgggcggcggagctagagaagaagctcgacgccgcccggggggtccttgacgccgccgctgcccgggaacggcgggcggcggagaacgaggcggcgtcccggcggcgcgaagaggcccttgaggctcgcgccgcggcgctggaagagcgcgcccgcgcgaaggagagagacctggcggaccgcgaggccgccgtcgctatccgggaggcaacactggcggcgcacgaggccgcctgtgccgaagaggagtccgcactccgcctccgcgaggatgcgctcaccgagcgggagcgagctctcgaggaggccgaggccgcggcgcaaaggctggtggacagcctgtccctccgcgaggcagcgcgggaggagcaggcgcgccacaatctggaaggtgcccgcgccgagagggccgcactggatcagcgggccgctaagctcgaggcgcgggcaagggagctggacgcgagggcgcgcagcggcggggcggccgcaggcgacggcgacctagccgcccgtctcgcagccgctgaacacaccatcgccgagctgcagggcgcgcttgactcgtccgccggggaggtcgaagccctccgcttggcgggcgaggtagggcccggcatgcttcgggacgccgtctcccgtctagaccgtgccgggcgacaggcgggcctctggggagggcggaccgcgaaatacgccgccaaccaggggggcctcgcccagcgcctctcagagatggccgggaccctccagcggctccccgaggagctcgaggagacgatcaagtcatcctcgagggacctcgcccgggggacggtggagctcgtactggcaagctaccaggccaaggaccctgacttctccccgtgggcagcgctggacgagttccctcctggaaccgaggatggtgcgcgcgcgcaggtccgggacgccgccgaccacatcgtccacagcttcgagggtacggctcctcggctcgtgttcgccctcgactccgacgaggagggcggtgacggtggtgcggacgacagcgacgatgaggccggcgacccgggcgcgtcggcgtgagcccccaggcccccgccaatcttaaatagctttttctttcttcttctgaggccttcgggcccccttcttgtataaactaattcaatctgcaatcaaataaagaagaaatttttgtgtcaactctgtttgttgagtgtatgagacgaggatggtctgtgccgcggtccttctttgtcttggattgaacgagggctcgtgcccaggtcccaacctcaagcggcgcgggtcggggctagtgcctagggagatccgcgtgtcgagactggccaggccgagaacgtggtgaccgagggttatggatgacccgattgtgggcctttgccgattcccccccggagttcaccacgccccggggcacggctcggttctgggccccgtttggcgattttagccggcccgggccaccgagggcagggtcgggcacgagcatgctacttcaagccaagattcttcaaaaggaaacgatggcacagacacagtcctcaggaaatcgaaaatgcttttattgaaatacggaagagaaaaaaagataaggatatgcatgtggtagcccccggccaaccctgcacgcccgggggggtgcggggttggcccgagcccgagacctgacacccgactcccactaggggtagaagcgacgaaggtgctcgatgttccacgggttaggcagctctgtgccgtcgcccgtggccagccgaacggagcccggccgggggacgccgatcactcgatacggaccctcccacattggtgagagtttgctcagtccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttgcaagtagtcgaggtcatctctgcgaagctgatcttgatcagcctcgcagtacatggtggcccgaggggacctcagggtgagctcggatgggagaaccgcctccgcgccgtagacgaggaagaaaggcgtttccccggttgctcgacttggcgtggttcggttcgcccagagcaccgctggcaactcctcgatccacgagtcgccgtgcttcttgaggatgttgaaggtcttggttttgaggcccttgaggatttccgcgttggcgcgctccagttggccattgcttctggggtgggcgggggaggcgaagcagagcttgatgcccatatcttcgcagtagtcgccgaagagctcactagtgaactgggtgccgttatccgtaatgatacggttaggcaccctaaaccgagcagtgatgcccctgatgaatttaagcgtagagtgcttatcgatcttgatgaccggataagcctcgggccacttagtgaacttgtcgacagcgacatacagatactcgaacctgcccggggcccgcctgaacggacccaggatatcgagcccccagacagcaaacggccacgaaagaggtatggtctgcagggcctgggccagctgatgggtttgcctggcgtggaactggcacgccctgcaccgccggaccaggtcgactgcatcgttgagagccgtcggccaatagaaaccctggcgaaaggccttgccaaccaaggtgcgtgaggtggagtgtgctccgcactcgccttcatggacatcggcgagaagctcgacgccttgttcccgaggaatgcacttcaggaggactccgttagccgcgcgccaatagacggtccctttcaccagcacgtagcgcttggagatgcgtcggacgcgttcactcccttcgcggtcctcgggtagagtcttatctgcgaggtacgcctggatctcagtgatccaagcaatcaatctaggggagccgggaacgctcccctcgggtcccgaggcctggactccgacgggcctcgggggccgttcaggcgcgtccgtctcccctagggggtcgggtcgcgccgacggctgggcaagcctttcttcaaaggcgcccggtggggtctgggctcgcgaggaagcgagccttgagagttcgtcggcgaccgcgttatcccgcctgggcacgtgccgaagctctatcccgtcaaaatggcgctccatacgccgaacctggcgcacgtaagcgtccatctgcgggtcagagcactggtactccttggagacctggttgacgaccaactgggagtcgcctaacaccaggaggcggcggatccccagtccagctgccactctgagtcccgcaaggagtccctcgtactccgccatattgttggtcgcccgaaaatcgaggcggaccatgtatctgaggacgtctctgctcggcgaggtcaacgtgacccccgcaccggcgccttgaagagacaaggagccgtcgaactgcatcacccagtaggcggtgtgaggcagctgcgaggggcccgagctggtctcggggacggagatgggctcaggggccggggtccactctgccacaaagtcggcgagggcctggctcttgatcgcgtggcgtggttcaaagtgcaaatcgaactcagagagttcgattgcccatttcaccacccgtccagtaccatctcggttatgcaagatttggccaagggggtaagacgtaaccaccgtgacccgatgcgcctgaaaataatggcgcaacttccttgaagccatcagaatagcataaagcatcttctgggcctgagggtatcgggtcttagcgtcccggagggcctcgctaacgaagtagacgggccgctgcacctttcggcggggccgatccccttcgctaggggccgcatctccagggcgctcttcgtccgagaggccgcgcggggcgcactcggcttctgtgccgacgacctcggggtcggaggtcgtcgggcgacaggcgcggccttcccgcagtggccccggggccatcctgggggtcgggggagcctggcaccgtcggacaagcaggcggagggccagctccggccgtcgggggcctcgggccgccgttcggctcgggggcctctcctgcctgctctctcccgggtcgagtcgacacaaggtggggatgcgcggggtgagggttgtcctcgtcgcgctccacaaccaacgccgcgctgaccacctgcggggttgccgccaggtaaagtagcagcggctcatctggctccggggcgaccaggactgggggagaactgaggtacgccttcaactgagtgaaggcccgctcagcctcctccgtccagataaacggcccggagcgtttgaggagcttaaataggggtagcgccttctctcccagcctcgatatgaaccgacttagggcggccatgcagccggtgacgcattgcacatccctaagcttgctggggggggcgcatccgctctatagctcgtatcttctcggggttagcctcgatgcctcgggcagagaccaagaacccgagaagcttgcccgcaggcacaccgaacacgcacttgtcggggttcagttttatgcgggcggagcggagactttcgaaagtttccgctagatccgagagtaaggtctcttggttgcgcgtcttcacaaccaagtcatcaacataggcctcaacattgcgtcctatctggctacccaaagaaattcgagtagtgcgttgaaaagtaggacctgcattctttaacccgaaaggcattgtcgtataacaataagttcctatgggggtaatgaatgcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaacgacgaccgggttcgccagccactccggatggaggacctcacggatgaatccggcctccagaagtcgcgccacctcctcgcggatgaaggcttgacgttccggggcctgccgccgcactttctgccggaccagccttgcgcccggccgcacggcgagacggtgctcaatcacctctctggggaccccgggcatgtcagccggtctccaggcgaagacgtcggcgtttgcccgcaggaaggagacgagcgcgtcttcctatttgccgtccagaagaccaccgattcgtgtggtcttggacggtccgtcgcccagggcaacctccttgaccgggacctcgtcacacgtgatcatccgctgccttggggtggctgggacggaggtgctgagcctctcgttgccaccctcgggcttggacgcggcggcgaggtggtccgcgcgctgctctatacaagcaagcgcgactttgaggtcgccatggacagagatggggccaccggggcccggcatcttcatctggagataggcatagtggaccgccgccatgaacttcaccaacgcgggcctccccaggaccgcgttgtagggcagactgaggtccgccacatcgaagttcacccgctccgtgcggaagttggcggatccaccgaaggtgaccgggaggtcgatatgacctagcggccaagtgtgccccggcgtcacaccgataatcagctgggacggccgaagcaccatccccggggccttgatggcgtcaaaggctgcgggggaaaggatgttgagggctgcacccccgtctatgaggacacgccccaacttcacgttgcaaacggtgggggaaaccaccatcgcgatctgtcctccccgggcaacgcacggcgggtggtcggtctggtcgaaggtgagggcaacctccgaccaccgcgcccgccgcgtcgcctcatgggtaggggccgcggccagaagctctcgcttcatggccttgaggctccgacgagaagcgtgagcgcacgctcccccatcgacggtggcgatggtggccccaggctcctggaaccctaggtcatcgtcgccatcgtcgatgtcctcggcgggggccttctgcttggcctcacttcgccggttgccggagggagccgccggggccttgccctcacggcgctcctgcctcctctcctcctcccacttcctcgtccgctcagccaaacttttgaccgcgcggcagtccgcgaggtcgtggagggaggtgttgtgcacggtgcaccacttgccggtcgggcgctccctgctgggagcgccggcctccttctttttgtcgctcgcaggcctccccttttgggtggcccgcgaagctccctcgacggcgaggacgtgtccctcgtcgttggaatgggccgacctcttcttcctcctcctgtcccgccgccctgaccgagcggcggatccgggggcggccgaagctgccacaccggaaccggtggaattccaggtccaggcctcctccttgcgagccacacggtccgcgagctgaaaaagctccgcggtggtctggggctccttggaggcgatattttcgagcatgcggttgtgccgcacgccccccctgaacgcgtagattaccgcgtgtgcggggatgcatggttgtgtgttgcggacttgacaaaaccgctgaatgtacgagcgaagagactcatcgtcccttcgctgtaccgcatgcaagtcggcttcttcaactgggcgcggatatgtgccttggaagttcatggtgaactgctggcacaaatcctcccaagagtggaccgacgcgggtggcaagttcattagccaaccccgcgcctgtcccttcagggccatggggaagaaattcgccatgaccctgtcgtcacccccggcggcctcgatcccggtcgtgtagacctgaagaaactcggcggggttgacgcttccgtcatatttttcggtgatggtgggccggaaccttgggggccaatggacgttccgaaggctcgacagccgacaccaccaaccgggggcacggggggctggtccccgcacccgaaccgaaatggcgctccggacgaggaagcgccttccgttgcgtgggcagcacgacgaccattgcgccggcgctcgatactgaggcgggcatccggccccctacgcacatcttcttgggtcggaggcgttgacgagggaatggctgacgaacggcgggtaacggccgccgctcgccgcgccctccgcctcgacgacacggagccgacggtagcagcgccagaggccttggtggcggaggaccgcccaccggcgcctaggcgctgctgtgccgtcatgaccaagtcggccacgtcatccagccaacgtcgggctggagtctctggatcggggacgacaggcgggtgacgcaagagcgcgcccgcagcttggagcgcgccctggggcgtgctaccatcgccgtagacgaggaggcgacgctccccgtctcgccgtccttcttcatcgctcgtgggcggcgaagtcgtggatcttttgaccccctcgagcgcctcctcccacctaagacttcggcgagaggggggcggtggagtacgagctcgacggcgcgggttctgctccccgtcgtcaccgctagcgcttggagagaggttgtgcgccacttcccgttcggccattgggctgagcgggagaagcttggcgcacacgaaagaggacgagagcttagaaaaacacacgcgccccctacctggcgcgccagatgacggagcgtggggctcctcaccgggagaccgcgcgggcccccctttgccggttcggccggggacgctaggtgagattctaagccctcgatctgtggaatgtttcgtgagagagcaaatgcacaagacacgggcgatgtagacaggttcgggccgctgagaagcgtaataccctactcctgtgttctggtggatctgtgtatgaaggagttacaaagagctggagagcaagagagttcaaactctagagaccctctccctctctctctcctctatgagctccgctcttcctttcacgagctccccttttcttctcccttttctcttcctcccgttccccccgtcctggtaggcatggtcctccttttatatctcaaggggataccacatacaccatttctacctaccttctttttgggtggggacccatctattttgaccaaaacttgg

SEQ ID NO: 82582 - DNA, 7477 bp, Oryza sativa
ggcccgacccctcggggagacagagggaggggcgcccacatcaccctcgggcccgaccccccccccccgagggggtcaggccacgtgggtgaccacggctaccccaaacctctagtcaagatacccccggtcccatgtcaccgacacaagggtgtccccagtgtcaggcggggggcggcgctgggcccctactcgaggacggacgactgcttagcttccgggtgaaggcacgaatggtggtccgatccaagcggagtgggttcctctcccgtgaaggagtaggtagaggtggtgcatgtggtatccccttgaactataaaaggaggaccttgcccacctaaaaaagggacgattctcagtaagcctaagccccggggaagaagagtgagagtgctccctggagtttaggaaccttggtaacactcaaccttaaatcccacgcgcaggagtagggtattacgctccatagcggcccgaacctgtataatcccagctctcacgggcggtctcaggagactctaggcggatatacgttcttgatcagcgcgccctttcccccggccgaactcacaaaaagggggggtctctcgatcacccgctagagaggatcactcctcgacagtcgtcgttgtcgcctaggacttctcgcaacgagaagaggtggccgaatctcggctaaagaggagaggtgattgggtctggtatgccgtcgtcgcttctccatcacgcatcggcatccctcttctcatctctgccttgctagccgtgcagagggattaaggaagggaagagagatgctgtcagcggcgacgaccaagggccccgtggcgacatcgtcgtcatgtgtggagctccgaacagtaggaggacggcggtggcgcgagacacagacctcccgggcgaaggagcgccaaaaagggaggatgcggtgactatagtggccatgtccatcgttggtcatgcttgctgctgttggcgccgagccaaatcaccgatttctcacattgtagaagagaaaagaggggagaaagcagaaagtggaagaaggaataagggggaaaagggcaatgtgaatccaagggaaaaatagtggcatatttcaaatatatgtaaaattataatggcaatgttactaaatcgttaatactagtagcatatttcaaaaccgacatatttctaatggcatgaattcaattaaccctaaaagttagagaccaacgagaatccctacccttactagtgtatagtggcggaaacaggggtagggtagctagggctgctgccctactcctaagcctaaatatccattaaaatttacatgtcaaaacctcaaaacatggaagataaagataaattatgtacattatactggttaagccctaggcttgagaaaattctggctatgccactgctagtatatacaacaactaagcatattatcgcctctcatgcctcatgggtcgacgcccgaaactttggatcaccacgctacctggtccccttcctcctccatttctttgcattaatgtcagcaacgaggggaagggctgaaggggatcggggatccgtatgatccctagggccccaaaaacgatatttggcgaacttattcagttggaccacacctatattgtaatacccttgcgcttttgtcctcacttaatgcaaaaaggttcgaatcgatattactaatgatcaagcaactcaccttatcaattaatgtgcatcaagcttgatagcggagatatgcactaaattggacataatacttcattattgacttctattttcttaacaaatccattccttctatgttcttagctcatgccactcctatctagtagccaattgtccaaaaaatctagattttaactcaataaacataaggatatgacatttgtaattgtcgagtaaatgctcgttcaaaaaaaaatgttgagtgaatacccatcctttaaagctacggccgccactattgggcatggtcaccggtatctggcagttatggctattgtgtctgggtctgacaaagaaatattgcatatcagatcgatgttatttttgctctatatgtgtccaaaccgacccattgtaatcctacccacccatagatctaaggtgcgaaatagtccaacaaactaatatatttacatttgttttgacgccatatgaaatttgcagtcaaaacttaaacttgtaaattatttatagatgagaaaaatcaagatgtaaaatgtgaaatagtaccttcttcataaaaactctttcataaggagtagtatttcatatggcgaatatacattccttattatatgttgggtagacaaggggtaggggcaagtcaactcgtgacggcacgcctcgccacgacacgacacgacacgacacgagagagatctcggcgccggcgggcggcgccggcgaggcgtacggcaatgcctccttccgccgtgcccttctcccgtcgcccatccgacggtccacgcggcgcccgccccatcctggttgtgatcctcatcgccgccgccgccaccctactcgccctcgcctactcgtccttcccctccgcttcgcgggctaccaccgcatcatcttccatggctgtggcgccgacggatgacggctgctgcaggggcctcgaggggctcgagctgtggggtccggcggtcaagtggggctccgaccaccgcctgctctccgccgccgcgtgctgcgaatcctgcaaggccatgtgcaaggccaacgactgccgctgcgattcctgggtcttctgcggggacaagaaaagatgcggccaaaggttcggggaggtccgttcgcccacccacccactgactattcattctccatttctactggagtagctataataggaggagtatttctgtatgaccaaaccccaaattcagttttagtcactcactactcctgcatatactaatatgatattatataatcccctttcgcctgcttgcaatgcagtgctggctgaagaaacaaaaggatgtgatggcaccctctgttgttgcaaagggagatgatgttatgtggacttctggtctagtcttcgcaaaaggagaggttagtgtctgtctcgcctgattcccttcaaatcccagctgtttcatgtgctccctgcctctgcttaatttgaaatattttggttccaatccaactagagaatgtgtgtgtatcaccttgcctacaagtttggaacgcttgtttccttatgctttcaaacaaacaaaaatgtaccaccaattcataccatgattaattcagagatttataatttaataatgcagggcattgtgggcctggaaacaaacttgggaccattcgtattcaagtaagtgctctttgcctctacaacaaggcaacaatattttgaatcttctttagtgttcaatcaccgaatcaagaatgttacatgtaaaatgctgtgcaccggggcccggggccatatacagctatagttgcatccactgatctaagatttctcttagcaattattttatttgcatatttttctacatgtatctcattttcagtattgtgcacttacctttgggcaatgtaaaacccctttttaatagaatggccacaaggtagatatcttttgtcaacaagaacattagatgcaggtagagatagggaagctggcggagtggtgtagtgtcatttacttttctttccatgaatctgacacattttttgtttactcattaagcattcattcaagccaacaaagatatggtgtgctaatcgtgttgcttctcctctgcccatcaggggtttttatagaatattgtttgttccaatctgttctactgagaacatggtatatgcttgttgagaattggcaacaacaaataatgcactggggttacatttgctacatggattgtttggctatatagagagccatggcaaacacatgagattatggatttaatatgtgtctaagagtaaaaccatacatgcatttaatgtaagaccgctaagctgccaagtgaatatcgatcattagagattatgctgttagcccaggttgctctgtcaagaagtttggatggtaatttcttgacattttgtgcaggtagttctaattctgtcttctggataatccacttgagttgaatggaattatactgtatctgcgatttttcaccatgtcttccctttctaatatactttctttgcatctagttgctgcctggctgtgcaccccattctgtggactatttcattgaggttctgggcttgcggaactgcgctggatgcagattttatcgagctgaaggccgtgggaatttgtgggatgcaaaaggcgaccacataaaaaatgtatgtcttctatgatcgattgcatgaaagggttccaatgtcacatttgggtttggacttgttggtgacaacaattataccctaatgccccttgtttttgtgtgactaggctgcatatggtccaccgtatgccttgcttcaagggacactggaagtcgatggtttaccctttaaggagagagcgaaagaagcctgcccagcactgagaagaggatcggttgcatgggttggatcagggccggagttcttgatcagcttagcaaaccatggggagtggaaaggagcctacactgtgtttgggtctgttgtgcccgaggacatggcgattgctgaggaaatggcactgctgtcgaccagcacagacgtgtggagcaatgtaaccgtgaaggtgctgcgagaccctgtgtatttcaaggtgaagagaagcaccagcagtggtgttccttaggtatcactcattcgctcactcactttcagtcggttggtcggttcttgtgctcattgccgattcctttctggactatctttgtttcttatagaggacataaaagaaagggaaactagattagaatcaggcatgttatagcccctgacatgtagtagtattaccctaaagaaaaggggattactgtgtaaagaaagaaactaaagttgccatgttcaactgtttacctgctcatctttatgtggtctgataagtgatgatgatgtttcagaggtttattcacttatactgttatagtacatactagaagagtttcttcttcttcttctgtcaatagtatatatacttctatttctatataggtagatagaggagttcaatcttggctatatatactgttatactattccaaatcttaaatggcctccctagtccctaatatacatatgctctgctaatgcttgtaatgggctactgaggaaaaaaaagcagtaatgggtctgggccggccgaggagaaggcccacgagcgtcatctcatgacggtttcgcctctctctcctctcgttctccctcctcctcactcggaaaggaaaagagcgccgccgccgccggcgtgatgcttcccttcgaggagcaggtggtggcggacctcctggaggaccccaacggcggcctggtggtggtttcgtgtggcctcccggtggcctccctggcgtccgccgtcctcctccagctcttccaccaatcccccgacgatggctgcttcctgatcctctccgcccccgagccggtcaaagctcaaatccggcggcgcctcctcctcaactcccagagccagcctcctctcttgcagctgcaggtccacgacgtggccccagacctccccgcccaccaccggtcgccctctacgcctcccgcgccgcgctcttcctctccccccgcgccctcgtcgccgacttcctcacctcccgcctcctcccctcccgcgtccgcgccctcctcctcctctccgcccaccgctcctccgacacctcctccgacgccttcgtggctcgcctcctccgccaccaccacctcctccctgtttatgccttctccgatcgcccccatgccatggtctccggcttcgccaaggcggagcgcgctatgaagagcctctacattcgacgcctccacctttggccccgcttccaccttcttgctgccgctgacctcgagcgctccccgcccgaggtcatcgacgtccgcgtccccatgactcagcctatgaggggcatccaggccgctatcctcgatgccatggacgcctgcctcaaggagctcaggcggaccaacaaggtcgacgtcgaagacctcaccgtcgacaagggcctcttcaagtcttttgatgagatcgtcaggaggcagctcgaccccatctggcacacgctcggcaagaagaccaagcagctcgtcgccgacctcaggacgctacgcaagctgcttgattatcttgtcaggtctgctcatccactccataccttcacctatcattctgctccattaagctgttgatgattattccttcctggatggcatgaatcgcacacaaaaattctcttattcaaataataaaacttcttaggcattctctaggtacgatgctgtgacataccttaagtacctggacacactcagagtatctgaaggcgtccgatctgtttggatatttgctgactcaagccacaagatattcgacctttcaaaaaggcgtgtctaccaggttgtgagagcagacggtacaaaggttgcagcagacaacaagggcacaccaacaaagaagaggaaggtggcacgcgctagcagcaggaaaggaaaagaaactggtagcggctaccggccatttcctttcaatcgcaactaatgccttttcttaaagaatttagatataggcctcttaatttcatgaaaaaaataaatattttccactcaataggagtggctttaacgactttccactgcatagatactaattaattatttgccactccatagacagtcttaatataagatcttcccagtcattttctttgcgatcaccccaaaacaaaacgcagtggccacctatcttgttgctttacgcctcctctaaccagacttggtctggtcaaataagctcaagcagagctgatcaggggacatgccacttatcttcttccctgacttctctatccaagcgacaatacaggcgacatggcacgccggcgccggcaccgccaaggaaggtgcactagcaggggagccattagcaagttggatcctggagccatccccaatccccctttttggagtaaatttgcacaaaatcaaagaagtagcttcttctttcatctactcagcatcatccttgggtcgcatgaccactgttttgcagtttgcacaatcatctgcactctccactagttcacatgtcccctgcatcttctagccaggagcaatgtgttggagtcagcgacgctggccactgctggtcactggaccatgaggcggcggcactgctgcagttgaagcatcccggcactgtctaatcagaggcaaggaagggaggggtaattttggaagaagaatatgtgtgcctggcatttagaggggaagttgcagagaaagtggcatttcataaagctcatgtgtctatcgggtggca

SEQ ID NO: 82583 - DNA, 641 bp, Oryza sativa
catccaaagttcatcattcatccaaagttcatcattcatccaaagttcatcattcattcatccattccattgcatcatttattcatccatccactgcaccattccattcatgggcatgagagagagaggggtacctggagaggagacgacgagcagaggaggcggcacacggcgacgacgagtcccggcaggcgcacggcgcacggcttctcagcacggcggcgcggcggcggcttcttggcacggcggcgctgaggaggagaagagggggttaatcggcgaccaatagtaaacgaggggaggcggggggagtgggctcaccgtggaggtccggtcgagaggaggaggcggcggagaggagatcccagtggcggcgacgacggtcctggcgtggcgactgagaggaggtcccggcggccgtcgagagagtgagtgaggcggcagcggtggagaggtcgaggtggcggtggggaggacggcgtagagggcggagatggcggtagagagggcggcggagatggcggcggagaggtcgatggagatggacggcggcggtcgagagagtgagtgaggcggcggtggtggaaagggcggcaaaaaggtcgaggcggcggtggggagggcggcgtaaaaggcggcgg

SEQ ID NO: 82584 - DNA, 602 bp, Oryza sativa
aaaatggttttttttaactgtcaacgtttttttatggctaggaaattgctttcactgaaaatgaactttttgacatctgggagcaatgcttcacgaaaactgctcttttcgtggaaggaatgatattccagaagtgaatatttatccctcaagggaacatccctgttccctccttttatgtatgtcacctaaaaattataaaaaaaattgtatgacagatatgatagaataatatgaaatatgtttttccacaaacataaaattcaaattcaatataacaagtgaaaaaaataacaaatattactgcgaatagtacacagtattcacagtcagtgttacaggccatggaaacatatgcatttttgcatgtgtatttttaggagatgaaactacagaaactttcaaatgggtttttgaaacgttcctaacagccatgggaggaaaacatccagaaacaattataacagatcaagacttggcaatgagggcagctatacgtcaagtatttccaaacagcaaacatagaaattgtttgttccacattttgaagaaatgtagagaaaggtcaggaaatacattttcagcaagagaaggaaagatct

SEQ ID NO: 82585 - DNA, 3421 bp, Oryza sativa
ggtactactaggacagcattagtccaataatttaaggcccacttagtccaataatgtagtattatcgtttgtttttttcgtccgactaggaaagcattagtgcactaatgcacataaaaggttttatctaatgatattagacaaaatatttgattggaatgatagctttattagcattggcaccaacattcttttataaccctgaaagaaacctttttactaaccttttttacaaattaaaacaaaatggacctgccaacaacaggacacacattggaagttcagttcgaagagtcacaatctatctgaagaaagagaaagggaagaacaagtttcagcagtgaatcttcactcctgtttcctacttctaacttgaacttcacttcccactatgccggatctgcacaatactacaccatctgcccaccattcatccttgcaaactacattcaccatctccatgatgaatccatccaaagaaaaatgcagaaaaagggcatatgttcttgatcctaccaactgacaaagattcagaagcttaatctgttaaaaaacacacacacagattgcacataccatcattcagcgggtgccccagggactccttgatgtaggtcgccgagcccatcctccactcctcatacccgccattgccaagccttatgcagccactcaagctcactccagaaagcagcagcagaagcaagaacagcagcactgagctcatcacacacacacacgccctggctctactctctgatgatcaatgcctctcttggagggaagaaaaatgtctgtgatggattggaggagagttcttggtgctgttctttttggtattcttgtgttcttggtctgaactcactgtgaactgtgaagtctgaaatgttgcagtgttttggcctgtggtgggagactggaatcgtgggtagtcaaagatgagaggagcacaggcacaacacagggggagagtggtggaaggggtccttcctttctgctctcgctttattgggatttgcagcagctgcagacgcggcggcttcccttttaaggacgagtagcgaagcaattagcaaaggttgccttcttttgctattgcaccctcggcaacttgtgattttgcaaaagcagtagcacctctcgctgatccgtgtttctgcaagctccaagatccccagcttgcagtcagagcgattgtgagacttgagagttctgcttatcttgtcacctcaccaaaacgaaggttggtttttaccctgtcttttgacattatcgatattttgatagtaatatttacttgttgctgtaggaaaccaaacatagccaaaatactattcaaaatgccggcattttggtaacggaagttttagcttcaaacctagacggcaaaaatcactactcagaacttgagagtgatttttggttggaagaaaaaagaactgtggtgagtgagagtgactcgagtgtgtgaccggatgaccggagagagcaactgttttttaccatcgagatgacacggtatagagaatatactctataatattgagtttatcatagtttaatgatttataattggcattaatactccctccgtactcgtaaatgaagtcattttagacagcagcacggtctccaaaacacaactttgagttcttgtttccataaaaatatttattgaaaagttatatatatatatatatatatatatatatatatatatatatatatatatatatatatatatatatatatatatattcttttatgaaagtatttttcaagacaaatctattcatataattttacattttcaaactcaacaacttgagagttattcatcacttatattctcaagatttaacttaaacattgtactcaacgactttctttactaatatgaagggagtatatcattaggttggccttacatgtaagattaactattgatttatcctattaaaagtttttaaaaaaaattatgaatttttttagcctctatacacaatgtgaaagtttgtgtataagtttaaagatttttgtatttcattttttataaaatattataatttatccatttatgctatataaaatattttgtctttgtttttaatataaatcatatttcatatcctacccaacataattttatgctattatattttacgtaagcaatttctctatcagttatcacataaaattatttcttttaaaaaaataaaaatgccccaataacttgaaaatctatatgcaaactttcatattgtgtaaggatgctatatagacaattttatatcttatttaaatattgatgaaaaacacgaggcctgagagatctgcttaattccagtgcaggtccaaaaatcgtcttcgggtatgctagcgtaccagttgatttgatcctgtaatcaacaagaaataaagacaactataaattaaacctataaattaatgctaacttcgatgtctttaagggtattctgcgtatttttcataaaaatgatctagccgaatggcatattggagaagaattaataaactcatcggcatattgcagaaataaacaacatcaatagtatattgtcgaactggaacaaactctgtgacatataatacattctattggatgtaaaataaatttatctaaaatactttctttgtccaaacaacgaattttttttgagcttaaagagggaaactttattaatcacggagaaaaggattacattcctggtctattaggtctatgattcctgcaggagcacacaacaacgaatttggataggtttttattcatatttgttatatttggatatattacattcaattctaaatttaatttttatgggatagaggaaggagtatagcacatcaacagtttcgattgatctacattcgtgctaggccttttcaggcctacgggctacggactcggggttgggggcagcatgagcatgagcatgagccagtaacagtgattgtgaactgagcagcgcagttacacttacaccaggattagctgcgatcttgatccgagctttagggaatgtttagttcccaaacgaaatttttctcgctgtcacgtagctgcaatttttcacgcggtttggacacatgtatggagtattaaatatagaaaaaaaccaattacacagttcgccaggaaattacgagacgaattttttaagtctaatcgtgtcatgatttgacaatgtggtgctacagtaaatatttgctaataacggattaattaggcttaataaattcgtctcgcacctagcggaatctgtaatttgctttgttattagactacgtttaatactttaaatgtgtgtgagtgtgttcatatatctgatatatgcgggggcaattttttttttggactattaaacaggcccttagctcgtagtactagtagctctag

SEQ ID NO: 82586 - DNA, 4355 bp, Oryza sativa
atgccaaatcagccctaaaaattatctcaagaaaaaacagcacccaatctctggctacacaaccttgaagaaatgggcataccttgatgcatctgcatctctagagttgtcaatgagctctgctattgctccaaagacccagccagcatgtgtctgactgagtgttcgcagataactaggatccgtgctgacaaaattttttgcaagagtggtggttctctttttcactattggatctaaaattctagggccatcttcaacagactcacatggtgatgattctggaactgatttgtgcagctctgtgacacgcgaggcattcatctccttaggatttgggccactatcacaaatctcctctctcaaatatgactttggattcatcgagccagattggaaatcacttctgtatgacctttttaaagcatctgtcatagcaatattcatgtgtcattctggtggcataatagacaagtgaataaagttaaataccacaaagaaacgaatcagcaaatagctcatagctgactacacgcatattatggtgtatatctttgatgttaactatagagagagcttcctccaacaccatggacaagtgagaatacaaatgaagtaataaaaaaaaagaagggactccaattgcaactcttggggattaatagaccaatattgatgaaacaaagattactggaatgtattgccaattgttaaatttcaagtttttttttatataaaattagcatagggtcagccaaaataaaaggagaagtaaaccatccaagcatagcattcctgttcaacaatcagcataggaaaactctcaccagatactccagccatcggtttgcagtctccaggatctttttgctcatacatgaccaccgcatgtgagaagttagggcgttcatgagattcatgagattgaggagggaaaatatgtaaggcaaaggagctgaatctaactacagcaaccttcaaaaaagcaccgaaaaagaacaaggaccccacattacaggcaagaaaagaacagagaacattgctaatgatgttaataataaaatacaaaatggcaagtagagaacagaacaatgctaatagtgctaataataaaatacaacatgcctactgacttgcaggggaacaaaaccctgacaaaagttgattaattggaagataaaaggtactacagtgcatggcctcccccctatcagcctatatgtccctgttatttgtcccatgtccgacacctaccccacctagtgcgggttctcagtaagaagtacgatagtatccaaatggtcaatcctttgccccattttacttgaacaaataagtaacaaaaaaagataaaatatcttgtatatatttttttagagcacctatcttgtatatttttattagcaattatgacatgcaatagaaacaataattaccctctgattgtcccagaggaaaacatgaactttccccattcaatattctgacgatcatcttcaggttcaggaagcagtgaaaatttcaggaaatcacactgctggtacaccttagttggcacaaacctaacaattgaccaaaccgagggcctgtaaatgtgaaaagcacagacataagatacctccatgaaattaagaaacaaatcaccccaccccccacaacaacacacccaaaaaaaagtcatggtttttttaccgacatgttgattaaatgtttgtagatttgagtaaattaacagtatagctgcagcaattcactttagtagtatatatttttacaaaagctctaccactattttgatgatagcatatgagattgggtagttgtagcatggcatttaacagggggtatgtatggttgaaatcattgctggtgactatttattttgactgagagcaatggagggctcagggtctctgacaagtactgtgaaacagcgggagcagtcagatgatgctagtatgaaaacatgaacacaccagcattgaactttataacagaagaggaaaacccactaatacacactgtagattgtagatttaaccaatcgatgacagtatgcgatagagaacatcaacaatatttatctgacaatagttttggccaatggatgatgatgtaaaacttgtaaagtattcacagatcaggaaaagaaaaagagatcaacttacactttaactggaatatcacagactttggtgcggcatatgttcttagaatctttttgtaataatacatagttcaagccaccacctaccacaaaaaaatatatccttcaggcaaaaattcacacagtatgtattctaccaaaaaggataattctaacaacaatataaaagaagcaagcatcattcataattgatgtgaataaatgttaacatattggcattactaccatttttaagttataaaaaaaggctggacaggtttgccacttcatcacatgttaaagtgaggtactaggaccctatccacatctatcaacactgttgatcagttaaaagtacaaaactagagctgttaatataaacttaggagtataggtgatagagtttccacagattttgcaatatgtgaagtttcaggggtacaagtggacttggtgcagtttcctcttaattttgcagtggaacctggtctacagaaaggatatggccaattggccatcctttatggcaacgcatctcatataatcataccttgattttcatgtggcggctcattcaaatcaagtgtttcatccgccatctccttctcttcaccccctatgaacagcaacaaccatcaaatgataactatattttctaaaagcaaaagatcatcatgcatgtaaactgaaactgaaaccaagcatgagtattaactaagcaggtcaattgtcattctggagtaacatatgaccattaaacaagccagtagatccagaaatgtggtatagtagactcacagtatcgtacatcattaattgttcaaactagaggaagcaaacttatcaaatcccaagttacatgactattcatctataagttattaaataatgccaaaagaaaaaaaaatcagctgggcaaacaggccaatccgaccaaaactcatcacaaaggtcaaacacgacaagaatttgctggtgaataatatatcccagaatgctaaatacatgccagataacatgcttaaaactatccagatgaatcgaactaagcaatgctacaaattataaaaacatcagattcagccctacataactacataagtcaggtacaagcaagcagcaacgaggctcaactctccagtatattaaaatgttaaatgcagctccaaggcttcaatgaaggccatgactcatcaaatgccctccttacagcctcgcataactcaacatattaatgtgattccactatagaagaaagaaagcaacaaaaagtacttgagatcacggtccaaagtggtgatttatgtcacttaacacctccaatcataaatatttggcatttaggacaagatttgattaaacttttaaaacattcaccattagaataagcttatgatgctatgatagaacttttcaaggcaaatctacacaaaactaagcatttgagaagttactcatggtcaaagtttcaaaagtttaaccaaatcttgtccgaaacattaagcatttattgcaggagtgaatactttggttacacaccgagctcggtaaaagacaccaccttcaacccccacaaaaatcccaaaagactccgtcttctataaagaccatgagcacccaaaaaaaaaatctcagaaaacaagttcttaatgcgcatcaaaggcatcaataggattgcaaagtaaattaccaaaaaaaacagagagagaaataaaactgaaagcggagagagaatggaccacctccacacatttctaaccaagagaaaattttgggcacccgaatctcccgatcacgcaccaaccactacgcgagcaaccgcaaagcacgtcacgaacaccaccactacccacttcacctcaaaacccaaacgtcaaaggccacgcacagtaacttttacccccaaaaaaaagaacaggagaaaaaaatcagagcggtgaggggtttgaactagacacatttttctcaagggagaaaatgaaaaaaaaaatcgagcctccgatcgcgtaccaaaccactgcacgcaagcgagtagtgaaaccaccaccaaaaaccccacttcgcctcaaaaccccaaacccccccaagccccggttctcgcaaaaaacaaccaccacgagcactccggcgccggccgcggagcgcatgcacacacgcacacacgaaccaccggaatccacggcggtggtagcgaaccaacccccccacc

SEQ ID NO: 82587 - DNA, 6233 bp, Oryza sativa
taattaccaaaaatctcaacttacatgctgcgtactccatttgtttctccaaattcccaaatttgtggcaaagttggagtaagtgttaaattataaattgtgtttctgattacaggcttagagcttcagttgaacgcttccttgatgttttcaatcctgatacttccgggactccttctggaatatttagttctcgccctgaggttcataacattccctttctcttctagtacaagtttaggataattgattcctgcttcttgaaaacaatttgtttgcttttttagacaaattctaggggtgttatggtttctttatgagaactgaatgtttgattcttttaagagaagtctgaataagatgatgttttcttaggtctcttttgactttgaatgtgttcctgtgtcagtgatggagcgagtaattaacttcctcaatgtaagaacttcaacctgatcttgcttttccttcattggactctaagctaatcatacttagctatgttaggatgtgagggaggatctgagacaatctatagcgaaggactcaataacaatcaagaatgaggatctcacagcagaaatgcatcacaaagaggacagaactgatgagaacatagttgagttgttagagcctagtcaagatgtgcttaattttcaaaagaaaatcacaccctataggaactttgatcaaccattaaacgttgggtgggatttcagttgttggcgatgacttttttcaagattactcttaggtatgtaaagcatccttgcaattttactattactcctttcttcacattccctcccaaaatagcttgcaagatggatttgcacaggcttgttactttcattgcgcttggtgtgctaagtttttatgtaatactaagtcattttgaagagctaagctgcggatgctcttattatctacaaactgagcttttgtttttgctccctacgctatttcacttgtccatgtgctgtcttgtttgctgggtgcagatctagagggagatgaccagcagttggatttagcgctagaatcaagaaatcacgctgtggaaactatcaagcaaagccagcagcaattaatagtagtagcatcattggtagatcgcatccctaatcttgctggactgacaagaacatgcgaggtatatatcggtataattcctgttattatccctgaaacgtgcatgatataatggtattaggtttttggtgacagatattcaaagcagttggattggccgttgctgacaaaagtattatcgaggacaagcagtttcggttgatcaggtatgtatatggctggcagatgtatataggtgatgatgatttatttgtgtttctctgacttggcatgcaaatatgcaatgcatgcagtgtgacggcggagaagtggttgcccatgatggaggttccagtgaatagcgtcaaagtgttcttggagaagaagaggctggaaggctattccgtgatagggttggagcagacggccaacagcaagccactggaccacttctcttttccgagcaaaacggtatataattagaagatccaaatccccccctctctctctctctctctctctctctgtgtgtatgtgttatgtttgcattactgcacataggaggagggaaaaaatcatacaaaaaaagaactaacaaggaaaatatatttattgacaaggtgcttgtgctgggacgggagaaggaaggcatcccggtggatatcatccatgtgttggacgcatgcgtggagatcccgcagctgggcatcgtcaggtcactcaatgttcatgtcagcggtgccattgccgtgtgggaatacacccgccagcaacgcatcgcaacttaatttctgtttgagcagaaatcaacttaattttctcaaagctgttccttgttactagtactcctactccatagtggagtctgtattatatgtattcatcaatcggttagaactagaaacaaatgagagatgatagtactccacttgtcttgcccgtacatacagcacaactctactgtcctgacctgcaccccagctattgttattaccaaaaaacccatatttgttcttgctagtaatgccacgcactacggcactagatagaggtgagtttataatacgaataaaacgtttgtgttggagtatcacttaaactttcctcgtcatttggaacagagctcgaaacgggggaaaaaaattcgaggattggttccgtgtatttgcatttgaaccttttattatttattactagtcgaggcatagaatattttgtaagctataggtaacactccacccgttacattcaagcacaataacaggatctctaattctatttgtgaggtagcaaagcatacacaatactatgttaattctacactaacaccagtgtattagtcctaataattttaatttaagagtaaaatacgttggtggtatcttaacttgtaacttaggtgtaatttatttactcatcttgtaaaatgctcaaataagtcaattatcttgttttcttttttcaaatcacataaaaaatgtgttatgtaggagctcggtattaagttggatgccatgttgaattcttttgcaaatatccacaaataagccaactgccatatgagatagtagaatataaattaagatgaattttgttattgcttgctatgttaaaacacgcaatagcagctagcataggtgaaaatataaatatgggtgctaatttgctattttattgattggcaaaaaatatgtaagcttgtcttgtccacatgtctcacaaaatgtatgcttggcccttatggcttccaagttagaaacaaacggtattttctaagatttgcaccatcgaaacaagattagcgactcatttgtgcaaattgtaagatgaatgactaaattgcatctaacttgcaaattgatactgctagtgtattttactttttaatttatttgcatgtccaatatattcttcctctttctatccatttctcttacagcatgtttggatgatgagttgtgaggggtgtgattgggaatgaaaatgaatgaaggtctaagatgaaaatgaaatgagatatgaagaatgaatggttatgatttaaagatatcctttggtggataggaaatcattttcctaacccattagccaaacatgtccttggagccgtgtatagcttaacctcttgtaggagggtagctcctctttctcacctcttttctaatccaacttatcatcggagcctacgatgtaacttgggctagtgttttgtatcttattgtacctactcaagttaattttaattttgtggatgtgtgctcttagagaggtacaattaatgcataagtgagagaaatagagataattttaaaggcaaaatttatgcgcactatttattcttatcggatgcaggtgactggttcgcttgaacgatagccacgcgtgagaggagtgctactaattaaatacaagcacagcaaattcaaagatttttttgtgtcatgcatgtctttttttctctcctttttatagttttttttttctcaaattacttatctgattacaccattgtatttattacaataaaatatttataacaagatatcacattattatgatgggagctgctatataccggtatcccaccggtatcccgttgggatactgtcccaacgggatcgctcctcttcacctccctgagacaggggagcacgggccactgtgggagcagcgagcgtagacgagctgacgccggcggcaccgacaacgagctccagcggcgccgacgacaagcttcggcgtggaggatgcggccgccggcgacgagctccggcatggaggacacggccaccggcgagctccagcgtggggcatggtcacatggacggcagaggatcctgcgtggtgatagagacggcgccggcgccgagcaccagtgtggggcatggacggcagaggatcctgcgtggtgatggcggcagcgccggcgtggagaacgcggccgcgggttgaggcgtggacgacggacgcggccgccggtgacgtgctcccaacggaggatgcggtcgccagcgacgagctccgatgtggaccgtggacggggaaggatgcggctgccagcgacgaggatcgggttcggtgtggaccgtggacgagggaggacgtggccgccgacgacgacacctcgacgcccagctcctgatatctagtaagtatcatctgatacctcgcaagtatcatcccgatacatcgtagaaatcgcgcgatacctgataggtatcacataatacctcgcgagtatcgcctaatacgtgataggaatcgtctgatacctgatgcgtggtagaatcgcatgatacctggtaggtatcacccgataccggctaggtatcaggcaagtatcaccatctatgtggtaagaatcgcatgatacctcgcaagtatcacatgatacgtggtaagaatcgcatgataccttgcaagtatcacctaatacgtggtaggaatcgcctgatacttgatggttatacctgatacatgttaggtatcaggtcctgataccttaccagtatcaggcgatacttgcgaggtatcaggtgatacttgatacctataaggtattaggcgattcctatcacgtatcatgtgatgcttgtgaagtatcaggtgatacttgtaaggtatcatatgattcttaccacgtagaaggtgatacttgcaaagtatcaagtgtacctatgaggtatcagacgatacttactagatatcaggtgatttctactgcgtatcagaaaccgaacacctacccggcaccaacgccgacaaccactaccgcccccaatctcccctggctctagccaccgccgccgccttgcccctccctcccctggctccggccaccgccgccgctccatcccccggatccggctaccgccaccgccgcccctcccttccctagctccggccaggcggccaccaccgtcacttcgttccctggctctggccaccgatgcccctcctctcttcgttgatgtatcccccgccggcggcttggccacgatgtgctgctgcctcgacgcgacgcaaacgaggtcctcgatgtagcaggagcttactgcgcagggctcgtcgccggcggccgcgtcctcctctcgccgagcgggtcttcttccccaaccgcgccgaaggtcctcacggacaggcggcagcgatctcctccacacgcttaggcgctcagctctcgcttctctttggataggcaagcaggacgaaggatcccatcccgacgggatcccggtatatagcatttccgtattatgattatattttgatgaaataaacatatatgttgcaaaatactttcactacttttattgtatatgtaaaaacattataatatatagatttattgcaatattatttaaaatgtactttaggactttaatattgaatccattcgtttatacaatattagttataaaaaaatcaatcattaccgtaccttgtaagcgggctcaaaagatgggagagacgagggggaaaagggctagagtagacgaggactgcgcagtggaggaggcagaggcagaggcgagagagatggagatggaggcggaagaagagacattgtaggcggcgagagagagagagagagagagagagagacggactagactaggcgcgattgccttgttgttgggtcgtcaagcccgatgaccatcgcaggaggaggagaggggatccctctcgatcgccgccgcctccattctctttatatccgccgcgctccccgctgcctccacctctctcctcctccgccgcccctccccgccccgtttatagatgaatgctaatggaggttgccaatgccatggatgccatcaccaaggagaccgtcgacctggttgctcatctacctcctccttcttctttcccctttataatataataaaataggatattattctcctatttaatttaattatctagtgatcgattccatctctgtggagtggagttgagttgagtggattaacatgcgggcattagttttgggttataatgaactccctccgtttcgaaatgtttgacaccgttgactttttagcacatgtttgaccgttcgtcttatttaaaagcttttgtgaaatatgtaaaattatatgcctacatcaaaatatatttaacaatgaaacaaatgataaaaaaagaattaataatta

SEQ ID NO: 82588 - DNA, 795 bp, Oryza sativa
ggtggcggccgctctccactagtggatcccctggctccatgatctttttatatcatgaatggaaaattaatctactcgaataattttacttatgctgacaaagttagtttacttcacttagcattcatgccatgtgcagtgacaggcttaaaagataggctacaatgctaaatttgacagcataatatgtttttctactaccttaaaagcgcaaccattctccttctgtcctcttcccactgtgcgcagtcgcctgctccttcatgtgtgcgtaaccaccgtagcatccagtattttatccttaatccatccacccagccaatcgcccaatcctcaattgtatgagcttggtacgttgcaaagcactggcatattactagtaaaaagaagaaataaaacagtaaaatccatatggccactacccaaaatgggttgatacatcaagtttgttgatactggcatctatcccgaaacgaactttaaacatgtgtaggtacattgatatttgaattttgaggtttatagttcagcattctttctgtaaaccaaactcccaatttgttgtttcacaacattgcaagtttcttatgcagtgccaaaatcttggctgcagattttttccccccatctttgaagttaggaacatttgaaatgaaaattttcctagttactatgtatatttgaatattcacaacccatgtaggactagcaatccagcattccagttacacttgtggcatcatggcagatacctatagcctaggtatcacaccattgaccactatgcacgagtga

SEQ ID NO: 82589 - DNA, 2246 bp, Oryza sativa
agagaggagagcagtgggctactacagcacgaacttcaaaacataatgtatatataacaagtgagatcatatattaatattaatagtatagtaaacaactattatatgaattgactattatattggttataaatgaattgaaactagtagtgggttatactactcctccatcccatattagttgttgttccaggtaatttagcatcgattaaggtttgagaaaaaaagactatagtatctctaattaaatattgtatggttggatataggagggtggttaggggtagaaaagagataaatttgaattagaagtgattgatgggacaaatactatttcattgtgataactattttaggataaagtttaaatgctgaagagacaagtaatttgggacagaggggtattaaacttgctcttatactccagtaaggctgccacagttttttgttggtcacaattaagataaagttagctaagcgtttaataagtctaacatgtgagctaagatgctaagaaaatactatggcaatagtaactgagacaataaatccaatatataactaatgaggaataagtaaggtatagcgtaatgtacgtgataagttgggattttcaacgaacctgctctcgctatgcacgatccgtgctaacccagacagagatggaatagccgagtagtagccagacaattcaacatcctctcacgcgttcctggaacgctagttgtttatatatatcgagcatagaatatgtataatcactttctagtgatactaatactactagtatcataccctatattttattgtgaatcacacgaataaatgtatgttaactatataaaaattatataaagaatatgaagatgatgatttgatatacttgtataggttgaactctataatgaaatgttaatgatgtgtgttatgtttgcacgatatttaagggcatgttcggctgcccgttaacgcggctgggctgtagcagcttaaacaatgctactattgatgattcagttgttgcagacgtgagatgcaacgctgcggctgcacagcaatggctgccaaacacagtcttgggtgataatcaatctttgtgataatcaattaagatgttttaaaatagtaatactattgggtgatgatgtacatctttgtgataatcaatctggaaatataggaagaaccgaaggattggtgcagattccgagaaggcacattagatacagaaaatatcaaaagaatccacaatgcatacgtgatgacctttggctattgtctgcatatttgtagctaagagctcgtttgcgtcaagccaatgtgaaacttaaagtagggccaaagcgaaaaaggatattactataaaaattagagaaggttatatatattgaccctgttttgaaaaagagaatagaaatatcatagtaagtctcaaataaatttcacactaaaaaaagaggagttctttgattccccccctccccccaacaccttgatggcacgagagggcgaggagatcatcgcccagaaacatagtacgtggtcctcccgccaagggagctacaaactaggcttcgcgtgcaaactcacaataatttcattagaaactatgttttttaaattgacgtgagaaactatgctaggaaaatgtctaattttcctatctcaaccgtaaatctaggcataatacctccctcaaatatcaaatcatatcagtttaccttggttttgaaggtggcttcatctgacatggtgtctacatgactacgtggcatcacaattggaaaaaaaagaatttaaccagtaagaaccgaactctaattctttctcccctacctcctctctctagcatcgctcaatgactgtcccaaagctcgctgacctccccactactccctccctcggcaccagccttcactgttgtcggtgatatgggcccgggggtatcaggtttagagggaggaggctgccccccgatgccacgtggccctcccccgaggggagtcaggcccgaggtggggtggcggccactccttccccaaagactagtcggaggaggctgccccccgatgccacgtggccctcccccgaagggagtcaggcccgaggtagggccgcggccactccttcccagagactggatggagaagactaccctccaatgccacgtgtcgggcccgagtagggcagcggccactccctggccgatactaaagggagaaggccgccccaggcgccacgtggct

SEQ ID NO: 82590 - DNA, 3552 bp, Oryza sativa
taggtcaccacatatggtgggttaggtgtccgcctccaggtgcccacttacccacatttatggcgtcctgagcggtcgcgccacgccgcatttaatgcggtgtgcagtgcactcaaccggtctgtgaccggtcgaatgactgatgggacccaagatgtcaggcgcaccatcgcgtgtgtcaggcgatgtgcagcccgacatatcccatcaaataatgatggtgagaggttctcatcctcttatcccagccggagtcggtcctcccgctctggtcaaagcaaggctcccgtttcccggtgtaataagagcccagaagtcttcacccattaaatggtgactgacaggggcaccccccgtgtcaggcgacaagatttgacaggccccatcatcaagacgacgtgtgcttggcttcccaagtcaagagacaagacatgcatttaatgcaaagattataatacttctccaccggagctaggttaggttgttgggcccatgtggtaacccctttaggtataaaaggaggttcaggcctagtggtggaggggggacttccgagcgaactggcgcttgggtctcgcaagcccaagcaccggtgttctacattcaatcaatcatgcacaggagtaaggtattacgcttcatagtggcccgaacctgtataaacctcttttgtctcatcgtcttggaggggcctaaccccctcaagatcacacagctccgctcactaagccctcgaatctcacccgctgcccccagccgaactcacaaaggggggcctcatggttccctggtggaggagttcattctccgacaactgtcatcatccctcaacctaaagcatactaccttcctcaccggcgtagctcgacctctcccttcctctccttttccgacctagacatcgagcttggttaagggagagctatgtgacaaaggaggtgtcatcggctcgagctcacccaaggccaagatctccactgaaagccatgactgcaactcccattcgccacaatgccatgcttgactacgggtggtggagtcctctatgtcccttcattccccattaattcctgtgatccctcctcctatacagcacaaccactgccgagttcaagcccctcgcgcgagtggctacggcaagctcccccttcctcaatgctcagggaggcgatgcattgaggttgtcttgatggagaggtattagtcagggatgagatcgatgcgtgccgtttctcaccatggagatggtatctcttccctctctcgccactgccatcaccgaatagcagctcaagcttttgaactcaccacttgccacttcctcgcttttgtatataccgagttgacgaggtctcaatgaggaatagatgaagaggttaggttaatggttggtgaaactccgacaaggatgcagtggtggtgaagtgttgacggaaaaatcaaacacactggcctgggagatctgcttagctccagttcaggtccaaagattgatgagatgtgggcgtgccagttagtttgatcctgcaactgacaagatatgcaaatagcagataaaatagccgatcggctaaacaaccgatgtagtgattccagccgaaaaccgataatagccgatgccgataccagccaatagcgatagggtttaagcaatcggctatatgtccaatgtagataatgctataaaggcaattggctgatgatgatgtaataaaataataatataatccaatataaaccaatcggcaaataatgatatgataaataagcatcgatccgaatattaaagcacacatcggctggaggtccgatgtcatgaaatccacaagattagattaaacagtgaaacctttgttgtcatcggctaaatccaacttatatgtatatgcaatccttacgagccgatgcaacgtccagataactcaccagctgaaaccccgatgaaacccttattggcaatcaataagcaggctagagattatggttctaagcacgacttagtagatcaaacttaactgatgcaacactaagtatgaaaagaaacacaatatctagacaataaagccgttgactgattttcagggtgatagatgcctaggctaatctaatctagcaatgcgatttagccgatactggcagaaaccctaaagcgagagacagccgatagagctaaattgatatgctaagactagattaacagagacatgataaataggtaggcaaatatatcatccaaaccagagcaatccaagaggtcgaatgtactgatgtagccttgaacgacgccgacgtaaacgatacaattgcctgggccgacggaacattggacttaccccttcgccggagatcgaacaccgatgcagccccgcgtcaggtgccaagtcccgccggacgataaaataaagtaaaaaggtaaaaggtggcgatgcaccgaattgtattgatcgtgaggatagattacatagaccccgggtgtacatatttatacccatgggttgatacaagtccttgtcagacaagaaagaaactttcctaaagataaaagaaaaacatagagtccttatcggacactaaacacactttcctaaagataaaaggaaactaacaaactattcctaattaataggtaacttgccatgccgcattctctttgagctcggtctcttctcgatagcttcctttagtagatcaatttccttaaccgaatatagcaagaatctaacaactgacgacttgataactctcatcggctaatcttagtacttcgaagccgacactgactttaagccgatgatgactttgggcttaccaaatttcactgttaatatgaagataactcaattgtgggttgaaggtgaggacgagagagtggaggatagcctagagatggaggaggatggtcggacagtgttgtgagttacaccaaggcagatgatgccacgagcaccttcccctcggcaccgtgagcctcccgcctcccgcctccctctctaggcgcctattcccagccatcatcgcctaccttctccaccttctagtcccggtctccttgctctccttcgctaacaatggaggtgctaggcttgagtggaagagagaagagaggtggctagtgacatatatataggttccacctttgttttattattttctccttgactgtactgcacgtatacaccacctcgaatgaaaccaccgttaaatatctcggagaggcaaaattaacctttttttgatattttagggagaattcatatattgttttgttgagagagagagagagatatcggacttgggacaaaatatatttcttccaatgttggtgtgattgggaataagttggggcctattaaataagtaagcgcttaatgtcctgatgggctattctcaaccggcccaatcccatcatggctgatctttttaggaaaaagtccactatgactcccttaaaagtaagccgaatctaattcgtacccctcaaccacagaaccggatagaacgactccctaaactattgaaaccagtgcaatttgactccctcagcggttttgg

SEQ ID NO: 82591 - DNA, 878 bp, Oryza sativa
ttaattatgtgccaaagataaccatgctagggctcttttaccatgtgactatttgtgaccgtttttagactcattgacaatttgacacatggcagagtaaatcaaccacctatttttatatttaatttaacaaattaggttcacatttattttagaacaactaggttcatattacctttatggaattaagatgcctgcactacatcagcacgataatatttggttttactattgcgtttcacagaattaaaatgacttccaagtttatacacacccccagctggtttatgagccactgtttagtattgtaacagagcaatatttctgcagtcgtaaattgaaatctttgattaaattagctaacaagtgtgcggacatcaacagctgaacagatttcagattgttcaaaggtgacctgcagtctattttacaaacaacactgacctgacaagtgacaatcaccctcatgtacaaaaaaaggaaaagaaaaagaaaacgacggcgcaatgtgcaatctattacgattagaaagagctgcggaaaagttacttcatgctgtggaaaatttgactcaggtagaagataaaactcccatttcaatcttgttattactcttcaagtttttggtgcttttgaaggaacacctttgatcttatatcagcctagcgaaggatgaaacgaaacgtcaaattagtacccaagatacaacgtgctgacaagatgaaacttgaggtatactatttacaaaattctacctggcgaatgggctcgggaatgcgataattactacagaacttcactatcccaatggctgagtcaagtgaaatgcgatgcccaactgagatgggggatccactagtggggattcggccgccccc

SEQ ID NO: 82592 - DNA, 775 bp, Oryza sativa
aagatgacgactcgatgaggcataggtggggaggagcacgtggacataatgagaataatcctacaatgatacaggttttagtgtagatgctacttaacaattcttattcacgggaaccgaaagattcaattcgtactttgtagggctggtgttgctgctgtctgcgtaggctactagtcttttatgtaccagtatctcaccgacgaaaaatgagagataacatactttttttctaacttttttttttctaaaacaagactatagtttaaattcaattgatttttaattagcaagtgcatatattgttatgtccatgcagcgtgagagctacacatgaaagaaggtccacgggaagaactagaattcggcattataaagggggtagcgcacgagacctaaaagtggatggatgcggagacaagaatttaaaaaggttcaggccctctcaatgagaggtaataccctactcctatttagggatttgaattcgtcgggttgtagtattgatctgacgatcggattgtgaatctctgcccatgccccttggagggggctccttgcccgccttatataggttggggggcagggttacaaaggaaaaacctagccggacacgttatcagtatcctaatctattactccctccatcccaaaatataagcatttttggaccctgacacggtcttcgagatgctactttgactaacaatatctatagaagtaagatgttttaaataaaaagagttgggggatccactagtggagttcggccgcc

SEQ ID NO: 82593 - DNA, 814 bp, Oryza sativa
taacggaaatctagaaggttgtagtttggatcttaaggctaatgccctgtttagatgagattaactaattttagtctagtccctcccatccaatgatccaaacagcccctaaacttgaaccaaattcaaatctcacacagcctgccccacatcacacatcacagtggcgcaattcaaaacaaccaaccccgggtcccacatgtcacagacgcaccagacaaatcccccgtgtccgcgtagccgcggttcccccgcgccgctctaatcgccagcaccaccgcaccagccagtcagcccaccatttcaaacgccacactcactcacaccaacgcgcacaggcgcaagcccaaactccgatccgttcgtccgaatccccaatccaaaaaaatcaaaaatcccaacacaacaccaaaaaaaaaaaaatccccctcgaatctaacccaacccctcccctctcctcctcctcgattcaaacggtgcccaccctcgccgccggccgccgcgcgccgccgcagtagcccgacacgcatcgccgccgccgccgccgctggagcgttggcggcgatggaaaccctaatggtggaccgcgtccacggcagcctccgcctcttcatgcaccgcaacgccgtcttcctctgcgagcgcctctgcgcccagttccccgccgaggtatgcatgtgtttccctggagtaagcgcggttcagtcgggtgcttggtcggggggtgggggcggcgatttggggtgcgggcgctcgcctgcgccgggggggtcgatttattggcattgtttaggttttagtgtttaggcgtgcg

SEQ ID NO: 82594 - DNA, 3287 bp, Oryza sativa
ttggccatccattccacacgaaaacaaacaatccactccaacctctttttatttttcctgtgcatgggaacgaggcaatcaacaaactaatcttcacaagcttcactcctctgacacatgatgattttagttagtgggtaggttctttaaaaattcctatgtttttcctacgctctatccgaacgcatgtttatatagtattcctatgtttttcaattctctgttttacacgtgcattcctatcatattcctatgattttcctattcctgtgttttttcaatcctccattccgaataagccctaagcctatatagcctcgccacgtgggattgttctttttgtttctttttcttttttttttaccgttgcagtaattgtgaccgtccgccaacctcacacatcaaaacaagtcttttctttttcaccgttacagtaatttttgaccgtccgccaacgtcacacatcaaaacaagtcttttctttttcaccgttgcagtaattttgaccgtccgccaacgtcacacgtcaaaacaagtcacaaggttatctcttctaccataacggcagtagtattagagcaagtttaatagtacagccaacaacggacttcaaattatttatagctaatctaatagcttattcatataatagttaactataaaaatatactccctccgtcttataatataagggactttgagtttttgtttgcactgtttgaccacttgtcttattcaaaaaaaatttagaattattattttttttgacttactttgttatccaaagtactttaagcgtagcttttcgttttttatatttgcacaattttttttaataagacaagtggtcaaacaatgcaaataaaaactcaaaatctcttatattatagaacggagagagtactacactattaatatttggtcacacctctcatacacatataatgtcttggagtccatgttgacatataatgtcttggagtccatgttgcagctggctacaaatctgtagcccgcttttttctctctcttctggatatgtggttatagctcaatatgtggttatagcttgtttatattctgctattgtacctgctcttaaagattgacacgagggaacccacattggaagatatacggtccccacatattaatggctataatggtagtgtcgttatgatagagaataattaatcatccagtcatgaaacaatttatattagagtaaatttcataaaactacagatactttgcacgatctatcacaaaactatatatttaaaaaattgtttcacaaaactacagatttagtgtcttcatttagcacaaaactacaggtactttgcacagtatatcacaaaactatatatttaagaatttgtttcacaaatctatagatttaatatcttcatttatcacgaaactacaggtttagtgtctccattatcacaaagctatatgttttacactaaatctatagttttgtaaaacaagttcttaaatatatagttttgtaataaattatacaaagtatatgtagttttgtaatagattgtacactaaatctatagttttatgaaacaagttcttaaatatataatttgtgataaattatgcaaaatacctgtagttttgtgaaatttactctttatattaaaataataaatacatttttaatttatttaaaatttaattgggttattgggtttgccatctacacttttattatctcaccgcgtgaaatcaccgtgcataccttgtgtattgtctaactaaccgccatgagtgcctcacaaccaccaaaattaagtgtgttgtgtgcatgggcatgatcaggtgaaatttaggtgcttgtttccgtagtttggttttaattgaaattacgttgttttgcaggagaagatgggtaaacttcggtatcattatcttcctctaataatcacattagttgacaattatgactaaccaagcacacttaatgctctaatgttttgtggcaaggtttagaaataatacaacattataaataatacacttttaatggaaaattgtcaaaaaaaaagatgttgattgttcaaatcacaaatttagcaccctatataataaccgtagtttgataaggtacctgtgttcgacaggtacgcctgtcgaataacaacagttcgataaattagttggcttgattaaaaaaggaaaagagcaaccatggatcccaaggtatgatacatcccactgctagggatgaaaacgagccaagccaagtcaggcttgcggtgactcgtaacaaattaggcttggcttggctcaactcgattaggaaaccaagctaaaacttgatctcggctcggctcgtttcctgactcgagccaactcaagctggcttgcaagatttcctattgaaacacctcttcatatatattttgtaatcattaaaaaaatcaagaacaaatcatcaacatataaaatttaaataagtttatatattcaattcttaatatcttaatgaaaaatttcaaattgacaaataataactctataaaaaataaaataatccatataagcacatgatggcctagactcacgagccaaacaaagcagctcacgagtcagctcgggctcggctcattttagcaacgagctgaaaaagaggcttaggtttggctcatttgacttacgagctgagctaagccaaccaagcccgagctgatgagttcatgcgcccgagctttttttccacctctacccacagcccactcacattcactcatcactgtccagattcatagtattataatgcgtcacatccggtattagattcgttttttttaaacggtggagtatagaccaaacggcatatcttagccttagtaaaatactataaatttaaagttatgtatccatgacttcactactatatcaccagatattatttgtggcttcttctactatatttgttgggcatttatttatgagaagttcaacatattattatagtcccaaaaataatggttaaaaattgtagtgcgagaattaaggccgtgttcttttcaactgtaacatcgaattgttaaaatggattatttactccacacttcgatatgtacattttaaaaaaatctacctcatttcttaaattacttgttataaactatctataaagtttatttcttacaatatttcatttatacctataatatattaataattcatagtataataatctaaatcacgacctaataagatcatactagtagtatgtagagctatcattctaactaccctagcag

SEQ ID NO: 82595 - DNA, 3420 bp, Oryza sativa
ttgcgatgaagcctggtatgaatctagccgggactgacgtgttaacttcaggagttagcacgccggctccggctagggacgagtgcctagaggctctcatcattccgacgggacggggcgaggcgtgtgacaggccgcctgttgccacctaacccgcgatctgaccggtctgtgaccggtcacacactgtgaccggttacggaccggataagcgagcgctgcgccgcattgaatgcggcgtggtgcgcttgtccaacccgctataaatgcggttaggtgagccccgctgtgctcacctaaccaatacacgtggcatcaaaaccacagggggtcggggcgtcccagcccttggggccgaaacgggagcggcccgacccctcggggagacagagggaggggcggccacatcaccctcgggcccgacccccccgagggggtcaggccacgtgggtgaccgcggctgccccaaacctctagtcaagatacccccggtcccatgtcaccgacacacttggattggcttaactcactctctaacacctcactagataaactaagtgcacaagggtgtgagagctcttggaagggttcaagataatgcaatggagtgccaaaaccttacccttgctgctggggagtgggtatatatacccccaaccaccaaaactagtcgttggaaccgaaatccccaactttgtgctctgtcggtcagaccgccgttgtgaggccggtcagaccggactactttgtaacggctagaaaactagccattacagggcaatcattgagcctactcaacctggccggtctgaccgcagtgtagtggccggtcagaccgtccacggctcggtcagaccgccgtcgactcggtctgaccggttacggctctggcagctctgtatcgccaccaaaaaccagaccagtgcaacagaccagtggggccggtcagaccggccttaccacgccggtcagaccggctaacagacccgatcagaccggcctaaggcccacggtcagaccgcaggtcacttttcagctcaaccgaccgttagtaaaacggcgatatctcttgactcgggtctcgaaatttggcgttcttggactctatggaaagcttattcaaagggccatccaacccatgaaaaatccatccaataaacacaacttaagtcaaggataaagggctcacactccaaaggatatccaccggacatacccacaagatatcactcactcctattagacatgcccacttatctcttggtttaggacttgagaaaactcatcacacttggttagacaagcccacaaaatgcacctacatgcatatgaactaatatggcacaagatcatccacaagctcgcttcatagacccctcttgatagtacggcgcctatctagcaaatccggtctacaccaaacaccaagaccgggaaaagactaagaaaacattcttagctacattatacctttgccttgcgccatccatcttggggtcaagcttgagccgagatcaacacttgtgaccatccagttgaaccatgtttatgctgaggtcttgtccatcctttgtcaagactttattctcatcacaagcttgacttcattcttgccaacatgacgatgtccttggcttggtgaccactaacccatggtgtcattcattagcctcatcgtagtaggacctattccttttcacacctcaaaggagaacattagtctcaacaaatcagttgtcatccttcacttgatgaccaaccagttgcatatgaaagatatggatatgtttgttgagtattcattaacatcacaagtgtcatatactcgtatgcaagctcaagtgcaaagatcagatataaataataggtgaacaacatggatctagaacatgcacaataaatgtataggatttgctccccctaaatatatgcatacaaataaatatacaagagatgcaagtgtatgcataattagagaatggccaatggggtttatcctatacatatagagaaggcatatgtagtaatgatgtagaccaacataaaacatataccttcatgatctccatgttctcaatgtaaatgagactaaataagataacattcgagtaaacattagtctcacacttatatatcaataacatggaaatcatatatatgaacctatcaaaaagtaggagataagaagtggtacatatcgttttatctctatgcatttcatccttgtcatgattaaggtccatcacaaaagaatgcatgtcttccacatctcattatcgggaaataacctagtagacaacttatgcaaaagagaggttaatcccataaacatcggtttatcatctatcaccaaaataacaattacacaaattgtttaatccaagatctttcaatcttttctctctttggtgatggataataacccgatataaacaatatagagagatgagatgaaaaatgatttcaaatcaagatagaaatcttataataaacaaaatatagaataagctccctctcaagatgtgcatacatatggatatgaaggaacgcatatgcacataatcaataaagatcaaatatgaagctcacactatattttggatccacaagagagacctagttagagtatgtgaagtttaatacatacctctcatcatttttacttccatatccaaatgagactagtcaaagaaaggctcataaaaacgttagtctcatataattagatttgtcattaatcaccgaaaccaaattaaggcacttgaacttacacccactcatccccaccccccccccccccccgccacgtggcggtcgggcgagggcctcggggcgaggtagcacgagggcccgaggggtctgacgtggcaccccgaggccccctggctgcctctgcgtcgtccgagatgtgaggggagagccaggctgtagggtcgcgtggctggacgggaaggagacttccccatacttcgcatacccccgggcccatatcaccgacaacgacgatgtcgaagcaacgaggaccgaggaaagagcggctgcttctcctctctggcgagctcgtgcaccttccttccaacctccctcattgcactaacgttgcctgatgtaccctcatagcctcctccgtctagcagctgcccaacgcgctccaactcgccgtcaacgaccaccttggtgcttgacgcgacaaggccgacctttgtgaagagccccgggtggacctacccggtgctctccggcaccttgagctcccagggcaacatagcgggcgtacattaatgacatgtttcgaaacttgcataattttaatggcatggatctaattaaccatattttttaagagtgcgctaggaatcgtattccagacgtatgagggttgtcatgtatgacttgtatattatctttcgtgaaaaaggg

SEQ ID NO: 82596 - DNA, 600 bp, Oryza sativa
  unsure (1)..(600): unsure at all n locations
actagtggnatcccccatatcagatacttatagttttattatttgtttccaggcagaagtcaactaccttgggcaacttagccatccaaatctagtcgaactgattgggtattgctgtgaaggctctcatagactgcttgtttacgagtacatggcttgcggcagccttgatttttttttttttcgccgtaagctgaccctttccttcttgacagttatcactcccacctactgaatggccgttgtccatggcagcagaacctgcaacatgtttattgtttttgcattttcaaaagtaaaaaggaaaatggtcagtttggtgcacgctgcatgaacaaaaacactaatttattttcaacaagatgagcagatctatcagtagaattaatataaatgcattcacacttatatttctttcagtgctcgatttactggtgcaatttaatctaatgagtagtgaccactatatacaatttagttgtatctgtgtacccgttccctccatgtaattttcaaaaataaaggattttcttttgaaacgataatggttagcatatgttttgaagttctcccaagtcccaactagctactccctccgtt

SEQ ID NO: 82597 - DNA, 10887 bp, Oryza sativa
ttattgttgacgttgacgaggcaggtgatagccttagctatgatggcgatctggatggtgtcggcggtgagctgggccagcggctgctgcagcgggacgccgatcttggcgaaggcggcgttgcacttctgcgtcagggacagggcctcgtccagcttcttctccccgacgtcgtaggcgcgattgttgatcacgtcgtgcgcgctggcaaaggcgaagcccacgccccggtactgcttcgcgcactccgccagcgctggcttgatgcccgccgtgcttgccccggcctctagctcctttatgtcatcggcggcgaggtccgccttgtccacgcccaccagggttgccgccttcgcaagcccccacgcgtccgcgtcgcggtggtgccccagctgcgacaggcacatcgccaagtggacgcgcttgtcgctggcggccgcgtcactgcaggtgctctccaccgtcgcgtccacgcccatagcggccgcgctcaggctcacggagatggccaccacggcggcgagggccttgctcattctcattcttgctctcctcctttttctttctatctgtgagcatctatttttttgtttttttttgggttttaaacaagacatgtgtggacgaacacccatgtatagatggagagatccacgcgggcgccaacaagtgtgtggtcgcatgcggcagcccgcccaagggcactcccgccaatttaggcactactaattttgttttcttctcaaacgaattcaacaagcacaaaaaccatacatcatttaaattattactttgcgacataaaaagtatcaactctctaaatgccacttttaaatttgtaaaaaggtccaaataccctccgaataaaaactttcgataaaaatccgtttaccaccttaaaatttaaaattggacgccaatccttgctataccattcgtattacccgtaggatgattttgcatattaatatattttacgtatctcatccatttatatcatagcgatgtcacacttttattatattggtactcttctataagtcagtgagcaaggaagtgaaaagaaatatttaaataaagattttaccatatatgcacaatgtgtatgtcacgtcatcaaacttatccaacgtacatataaatttgataaaaaaaacactttgcaaacccgtcttaggagtttatatgaatggtagtgcaaagtttggaagttaaatatccggtttaaagtttaggtgctaaatggacttcgaattaatgtttttttgtgaggggggagggggttgggtatttggacttattcctttacgtttttatcgttggacaaataagagttcttaatatattttttgccactcttgtctatgtggcatgacacatctacgtgtcagcatggattggtgatacgaaatgactgttttacccttggtaggttctttctccctcatttcccttcttttcttgtcgcgcgtacgttagttggtaatttccttcaggggcgattgcaatacaactgaatgggctcatcttcttcttcctccttaaccttgttactcttcctcttctaccctctccattctctccttgtaagactatagttgaattaatagaattatctttttttttaccttcctgtgtttataattcatatactactttagtagttatatgctttataaatataatatactttatttacatgtttcacttgattagactagtcatctatggtacgataacgatccaatgaccttgatgggctgttctagctttaacttgtccatccatatagtgggagttctaggggaattaatgtcattatttactagcataagtatggtgcttagataaatgccattggatgcagatatgtcccatgaaaagtgaggccaatccgtcctttgtactcctccaattcgggtatgacgtaagagtgcgtaaattctataaacacgctggcagatcagcagggagtattctctcggtagtacatgggtgcctataactaagtcctagccttgtaagcttgtatgtgttaagtgtatacttagacattaggaatatagaagtacaattatatcatagttctcttatgtcctttttcactatactaattatttagaaatgaatcttttgtgtgccacatatttctatttttaaccggaatgaaaaagttcaaaaaacaccaaaacatgatttttggatatattagaatgtattgggtgcattcgtggcaaaaactcacttcgtgactcgcgaggtgaacttttgtcaattaatgtcgatattggcacacgcgggtgcgatgttatataccggaatcaaaaagttcaaaaagtataaaaacatgatttttggacatattggagtgtattgggtgcgttcgtggcaaaaactcacttcgtgactcgcgcgacgaacttttatcaattaatgccgatattggcacacgtgggtgtgttgtttttatctggaatgaaaaagttcaaaaagcaccaaaacatgatttttggacatattggagtgtactgggtgcgttcgtggcaaaaactcatttcgtgacttggcaatagaagcatccggataatagaggtggattttgatattttagaagttgtctctatagtctagggaagttaagtaaaattttgatcatatatgtgaatggatcaatatgtctcgggactaaaatatatctaaacgaaatcttagttaaattataagattccgacatttacactatggtgggttaattatagattgatttatgatgtataaactatatctttacaacgccaccttctctgcagaaacatacatatgataggaagagatcgacaggagaccccacaggattgcgcagtggtgaaaacgggagcacagtagggatcgatggcgattggactccacaaggagatcttgatgacgtgcgcggagagtgcgacgatgctgccatcactgatctggctctggccaacacgtcacgacacgagcgaaaactggagggggcaggcgcggtacggagtaaatacgtattatccgcatccgttagatttgtccaatgatgaatgagtaaatagactttgtgaattatagagcagatgatgctgtctctctccatatcttcattttttttctttcttctttcttgttagtggacgtcacagcctctcgtggccttggagcccagcgcagacatgagaagagcctggccttcaacgatttggtaaagtctgatacaactccctcaaatccctcattcgctaaaatgggtatatgaaccactcgaaccgtataaaaatgactcactcggtggtggtggtattgatggtttttactaacgtggcgtccacatgacagccgttattaaagaaaaggatgccacgttagagaaaataactatcgaaatagtaagggaggagtgttatgtcggttttggggttgaggatacaaatatttagggagtccaattggaccttttcctcaacaaaactttgtaatcaaatccaagaccaacccagtccaggctccagcccagcatcccgtcgactcgatgatataccagcaaaaggggcaagtgtgagcaggcggcggcggagccatgccgatgccgtcgcgggcgcggcgcaggtccaaatcccggtggcctctcggcgagccccctcccggcctcttccccgctagggacgacctcctccgcctgctcgccgtcgtctccatcgccgccgcagcagccgctgcctgcagccttctcaaccgccgccccaaacccttgtgcgacagcggcggcgccgcctatacccaccatggtgactcactcactcactgctttctcgatctctcgcgcgtattccgtttcttttcctttggctagctgtagctgattatactaataatacgcagattcatgccaaccatgccctccccatggacgatgcgtagacggaaacctggagtgcgtccagggattcaacaaatatggcaacctgtgcatagaggatgggctggtcagccaaactgctaccaagattgtactgcccctttgcttgctctcttgttcctttccctctcattttgctatgcataccttccttttactgcttctccacatatctctatatagtcacagttgctagagcggaggatctgcgatcaatatgcccgtgctttatgtggccaacctgccaaaatcttggtctgttttcgttttactgctccccatcctcatcttcttcattacgactatgtcccccccccctgctttccatgccctcatcctcgtgtacttctgttgcctcgctttcagttccaagagctcgatatcttaaacatggctgatgagctgttatccaagggttttgttggcctaagtcaggatggagctaaggttgcaaaaattaaggttctggacagtgcgcgggccttctttgagaaaacattcagctccgacgggtatgcttcaccactacttctccccctatctctgactatatgtacgctctctttacgtatgtgctgtttcccctttcttgtttagagtcgaagagtttaaatgtccagacctggttgccgagctttataggcccctgacctgtcaaattcggcaatggatctcaagaaatatcatgtctgtgacagcctttggtgtcctggtacgtctatagcattaccatcttagtcatgcagtttgcttaaaggcagttcaattgattattgtacccaagttttcagcactgctctggattctttggactatttacaagagacaagcattatcaaagagggccgaacaaatatatgctcaggtatgaaattcctctctctctctctctctctcactcacacacacacacacacacaattcttccagttctttatcccatgacgaagggttatttgctgctaatttgcataaaacgacgaagtctgattaaccgtatagtaaacgttgttcttgctgtaagctatagctgttattgttttttgttggcaaaatttgattggagttactgcagtactagcattcacttttctggcgcaattcactagtacgtcagcagttccaccatctctttcaccttttccaagcatgagggaggtggtggctgtggggaaaggtggatactttcctttgtccaaaaaacagtagtaaatcatttgtttgtgcattttaatttttccataacttctttggaccttcttgtatttgtcttttgcctgttctcatacaataggtgtgtgaggtccttgaagataatgccatagatgcaaagattggcaactctgaatgtgagccttgggtggtcacgtcttggctgcgagatcatctgctagtcccacaagagagaaggaatgctttcctttggaagaaggtaattactttgcagtatattccactcaatacatagattttgacctgtattgattagcattacccaaattcgaattcttaaaggaaagttccatggagctacaatttttctgtacatgttttatattagtagatgaaagtacgtcatattttcgagcatctgaagcaataattcaaacatttaaaatgtttagaagcaacgtttaaacaatggggcacaataaaattcaataaatttggtttctttggataaccgattaggttactgtgtagtatttgagaagacacttgtacgcgttacattttattttttgatggcgacaagttaaatttcacatttttagtcctaggtgttcatcattacctacacagctttttcttcggttgctcccatggtattttgttctttgaccaccgtcgctgttggttcagtacacgtaattttcagttaaaaatgctgttgagggaatggctcaagcagcgcaacgttgcagctttatttctgagtagaaagttgacatgagtctcatctttaacttatcaaaacttgactactaaaaggaagcgttgagtgggcattaatcttctcatgatcatgtttgcattgaaagattagtgtctagtactagtttcttgatgatgtggagtttatgaaaactatccctagtgtcttgggttggaactggccttatatggcactagaagtatcttgggaaaaggagaaacacactgcccctaatttattgacaagtgcattgtcctaggctcaatatatgtactagtatatgggcataatagagaagtaaaaaaattgcctcagcaagtcgtagcctcattggtctaaccttgtaatttatatagctctgctgctgaaaatttgtcatttcactctccattgttggtaaactaatttccctttctctgttgtattgtggcataggtggaagaactaatactggaagattctcgcatagatcaatacccgaaagtggtcaagggagagtcgaaagttgtttatgagtggcaaggtacaaacatggctcctgctttattagttccaccaactaataaagcagagaagtattgacctgtttgacagataatgtggtgctatttttatttcgtcgagtatgctatcttattagatgttgttttgtggttatatacttatattggtgtgtttgcttgcagcgagcggctcgctcagtggaaagaaaaaggttaagaagatgcaaggtgtagcagcaggcaagtcaagagccgatggtgcagctggcggcgccataaaacttgctgaagaactggatgcaggctagctagagctgccatgcgttatgtatgtacaaatgtttctcaagctactaggagagtatatatcatgatgtatgcttggaatgtactaaattaattgagttaatggagtacgtggtgtatatgtatatgaatggtcactggaagatgctactgacagagcagtcgtcgtgaacgcgccagatggtctcgccgaggagattggcgacggagaggacggtgagctgggggaaggtccggtggtgaagcacggggacggtgttggtgacgatcacctcctggaagaggccgctggagagcctgtcgacggcgggcgggctgagcacggcgtgggtgctgcaggcgtagacggccctggcgccctccctgtgcagcagctccgctccctgggacaccgtccccgcagtgtcgatcatgtcgtccaccatcaccgccaccttccccctgacgtcgccgatgaggtgcaccacctccgactggttgtgcccctgccgccgcttgtccacgatggccagcggcgcgtccgacagcttcttggcgaaggtgcgggcccgggcgacgccacccacgtccggggacaccaccaccacctcgtcggggcagatggtcttgctggccaggtagtccaggatcaccggctgcccgtacacatggtccacggggatgtcgaagtagccgatggactgccccgagtggaggtcgcaggccagcacgcggtgggcgccggcctccgtgatgaggttggccaccagcttggcggcgatcgactcccggccgccgcgcatcttgcggtcggcgcgggcgtacccgaagtagggcacgacggcggtgatggtcttggcggaggcgcggcggcatgcgtcgatcatgatgaggagctccatcaggttctcgtttgccggcgggcaggtgggctgcaccaggaacacgtcgcacccacgcacgctctcctgcagctgcacgtacagctccccgtccgcgaaccgcttgatcttcaccctccccagctccatccccaggtagcacgccacctcctgcgccagcctcgggttcgccgtgccggagaagatgcgcagccgaccaccgctagagctcgcctgcgcctgcgatagcgctggcaccgggaccacgtccgagtactgcctgccgccgtaggccccagccccagccccagccccaactggaagcaacaatcccctctttgacctgctgctgccactgctactgctggtggtgccatggccggcaagcgagcacggcgccgaaatcttgacgaagaaggccatggccaaccaccgacgtatcctctccacacagcagcatctcggtcggataagaatctattatattattaaagaaatagaaaaatgagcttccacgttcgttcgcatggcctagaaattctcacattaatcggagaaaaagaaaaagcagaatccatatagaaatacaattaggaaataactgaaattcggaattaaaaaataaaaaatattagaagaggagactagagtcaatatagaaatacaattaggaaatagttgaaattcggaattaaaaaataaagaatattagaagaggagactagagtccatatagaaatacaattaggaaataactgaaattctgaattaaaaaaaaggaatattaaaagatgagactagagttcatatagaaatacaattaggaaatacctgaaattcagaattaaaaataagaaatattagaagtagagtatagagtccatatagaaatgcaattaggaaataatataaatttgtaattaaaaataagaaatattagaagtagagtatagagttcatatagaaatacaattaggaaataatataaatttgtaattaaaaataagaaatattagaagtagagtatagagttcatataggaatttaaaactaactaaaatttggaataaacataataaaattaaaagtagagtttagagtccgtataaaaatataatttacaagtaactaaaatttgaaattaagaaaaacatgggaagaagagtttaaagtcaatataggaatacaaatataggaatacaatttagaagtaactaaaattcaaaattaaaaattaaagaatattgaaagatgagtttagattccacatagaaatacaattagaaataataaaaattcagaaataaaataaataatattgaaagaagagtatagagtttatatagaaatacaatttacagaaaattcggaattaaaaaaaaagaaatattaaaagacgagtctagagtctatataggaatatatataatttacaactaactaaaatttgatattaaaaataattaataactaacacatatataaaatataatatgaatattacacattagtagtttttgtaaagttattgcaaaatttaaaattatgttgtcatttcaatatatttgaataatataatgagaaaacatatatactattatatgagagaaaatataatgatgctagccgcgcaatctgcgcgggccaccatgctagttaacataaagacgatgagaacatccactgcgcttgaggccggcccaccaagcttctgcctcgcatatattgatcttttgtcatttttcttttagaaaaaagagaaactcataactattttgttatcacgcatgaaacgagacacgcaccttttgtcactatcatttttttgcttatgcttatacttatcagccttgaatttcaactttaaatttagagttgattttgaaggttttttattgaagtttatttttcagcatttgcttttagatcactaaaaacacgcatataaaaattctattcacatattatttttcgtttgcaaatatgctgtttgatggcacccatatgtaaaatgactttcctccaaatctactacattctttcccaaaataattgcaattctagattgtttagcatatattaaggtttaagaagaaagactaaggtgtccctaattaaatgtgtataggtaataaaatggttgaaggtagaatttttttttaataatggattaaaccggcttctatatctgttgaaggtagaataggaagaaattcaaatcaaaagtgattaatgggatagttaattagtactctattgttgggaaaaatttgaatcctaaaaatataattattatgggacggaggtagtacgatatatgcattagcatttcctttcctagccacatatacagggattatcccatgaaaaccatcgaatagatgaagactagactaaaattttcctaaattcattaaaaaaagtacaagagacaagtatatataggaatgaactacatttctaacaaatcacaagtccaaactcatttgcatttgggaggaaaaaaattaagatggccaaacatcgtcgcttcttgttgtaatggttaggagatggggccggtggcgtgtcacgccactggagacgaagaagggcagggcaggatatccgcgccggatttgaggaagagtgatagtatggcgccaaggtgtgacggagtatcggatagggaggcatgcgacagtcgcatgggacgagattcgggagctgcacgaatcttggaacaatctcgaccgttcaaaagtgaatgatattttcttagaaaataaatcagcgggctgatgaatatagacagccgctatatatatacatgaaccgcataaggaaatgcacaaacaacacttgctttccagctgcgcttctaacaaaagaaaacaagaacatattactgatgcaacgaaaagaactcagccatctctcttccgcgtataccaggattcagtgaacccagaaaggactcagcactccaaaagggaaagtactagtcactattcgtgcaactgcgcggagaaatgctcacccattttagttgcataagtgtagaaatattgctactgtgtatacacacttatactgaggatatacaacaaatatactgtctatgtacatgttgacttaatctttctatcttctacgtacaagtacatacctacctaaggatcatcaaaaattgtcagctgtgtcttgtacatggttctgtgatctgatctgatcatcccattttgccattcaagaaaagcggtgctagctagctaccatctcatgatctgttacaacgtgtctgaatttgttgttccttcctgtctgatttcctgaattctttgccgtagccttctcctgtgg

SEQ ID NO: 82598 - DNA, 660 bp, Oryza sativa
tttggacaaaattggcgtttcctgaagctggaaagggaaaactaagtttcttttaaataagaatacagaagtaatttttattgtttcaatgaaggcaaaagtaatctcactataagctgttataggatggagtagtataaatttgataggctgaatttctttcctcttggcacctatctataattcaatcaaactatttattttgcttattcatctatttttgtaccaatattcaaccaactgctatggtagttttatttctttagttgatgaacattggggatctgaatatcttaccctgttgccttcaagctcagatgtgcatacaaggttctgctgttcttttcaaaacccctaccagttttgcttccgatgagcttcgacgagtattctctgtagttcactttgcacagctggccagttccatacctctaaaatacatgggagatccggaacacataaagcgagaacaaacttgtgttagatcaagtgtgcaaatcacagagttcgtcacctgagaacaggcagctgtgccttgatgtaacatcggcactgcttgattaccttgatgtactataggcattcctttgatagagggacaaaacttttggggtgcttgattagctgttataccccttttcattcggtatgtgtatacgt

SEQ ID NO: 82599 - DNA, 664 bp, Oryza sativa
gcggccgaaaaccactagtggatcccccaaattttagtacatatatattgtccaaatcaatgtagcccatttctcccttttagcttgtcataaatattgtttacagttgtttttttaaaaattttgtggaacaaattgttgaatcgatcacaccgtgacatgaaactataagtataaagaatcatttctttttttagcttattcagatgctaaaacaaaatgtaagtcacattaactaatcatatcttctggacccccgtttttataacaggaatcattcgtgtaaacagtaccatttccctggatcaagtagtctggtacacacgagttcatagctgaaataccaaaagcacatacacgagagtctagtgctaattattacatcataagcccgcaggcattgtcttaaatcatcggaccgagcagttcggaatacatccaaaatgcagaaatagataaggcagcggaattcaggcgcagcggcatgccattgccacaggcaacgaccgtactaagacctactgagcgccatcgtcttcatctccctcctggtagtaggcatagggatcctccaaagctttatctcctgcttctgattaattttatatttgcaagggtgagtaccaaccgtactcagcaagccaccacaacaacaatgcatatg

SEQ ID NO: 82600 - DNA, 3315 bp, Oryza sativa
actttccttttcgtaatttcttgttgctacttgttctctactctatacttttcatattagaagtcgttcaagttttttcttagtcaaagttatctaggcatgatcaaatttataaaaaaaattagcaatatttataacatcaaattagtttcattagatttaacattgagtatattttgataatatgtttgttttgtattgaaaacgttactaaatatttctacaaacttgtcaaactaaaagaagtttgattaaaaaaagtcaaacgacttatgtagtatgaaacggagggattactattcacaagtcacacctctcgttgctaagaaacaaacgatagtatacaataattgataatgtagtgcttattttatttctagtgcactgtgcgtatcgttgtgttcatgtccactggatgtcaagggtattgtcctttgctgatgtcgactgcatgacgtcacagtttgagagcacgagggtttgaataattgttgttatttttctaaaacttcgcattgatgggcatggacccaaccaatgtaagagaagcattagcaataaaaaaacaaagttagcatatctttcgatagcaattagcacagcagatcaggacaggatgcagtggttggccgttggtacagcctcaaaggacaccaacttggggtgctccaatcaagactagttttcaaccaattactaattaggtaatttaaaataccgttggtttaatttatttatcatatagttttctttgttaatcttccatcttccctaaatgagtagttttaatcaatacttggtagtttcgacaatcattttctgtcccatatatagctcacatgatctcatatccagaaagcaagcaaaacaaaatatcatcaaaacaagaagaagaatggataagaacatgatagtccatttgatgtgcaattgctgaatggtaaggcaacaaggtcatcaattgtaaggaagtaattgctcctttttcgcaaaagaaaagaagaagtagttgctctaaaaatgttcagaaaatcctactttacgattgggagcaacttactttaggatcctatgtatctgactttattatataaaagaagtatctgacttagaaacttgccaaagaaaatatccacttgcaaatttttaaggccaacctttttgtttgttagttgtgaggtgacaactgtactaagaaaacgaagaaacacctcccacccaaaagttcttttttggctacaatagttgcaatgtacatttggactttctgagaggcaggatggagatggatatccaacatcttggagggacatggataatggagtggatgcagaagtatacctcaccaattataattaaaaaaaatctgaagaaatacatgtgctgttcttagcctcttgcaggggatgcatgaatctagcaccacaactgattgaagaattaaagccatgaaaaaggctggtagatgagagatagagagataccatactatgcagacagtggtgcatgatgatgagttcaattctttcagagaagtgtaatgtgggcaccaatttagtaaatgcagagagcaatttcttccaagcaattaaaggaagaaaatgataccaaaggtaggtcactgttattgacaacaacctaggattttttttcttctggtgataattaacagaaagtcaatcatgtggaaaaggaagaattttgttagcttgtagctattgtttgagataaagccaatttctccatccaaaacctttgattactgagtttatatatagcctttagcactgccatttgtctttttcatctgaaaaaagtatatataaatcttgtatcaatactatatagatcttccaaattgagtgatgaatatcaaaagaacaactagatcttgtttaagattacaggacatagaatgcttattatataaccaagcaagattaataacctatgtaagtgtcgttttctgccagcttacttacacacctctgcaaatgtgaaggccaacactcatccataaaaaagaaaaaaacttcacatacaagagtactataaaaaatctagtgttagtctcatgaaggtaattaatttccagctgttcatggtcatagacacctgttgttcacatccctttgcaattagtaaacttaaacaaacacttaatcataccatcctttttccgtgttcagtgaaactctgaaagcgagacaaaaataattggtggcttcaaacaaaccacatttctctgcacatttcttgtgcaagatcgaacaaatggaagatcatggagatccatgttgtgcaacggagacaatattttcaactgccagccatggaagggatgagtacaatttccattctgaaaacaagcttaaaaatggtgatcaagagggagagctccatatgcgaaagaacaattacatatttacatttgagagacctgcagacagatttaagcacccaaatttgatcattccttctataaatatcccaccaataacccttgcatacacatcaccaattattgcaaccatgggtgcaatacttacttaaccatcatcaccattgtgtttatccccttctctctctctctctctctctctctttttcttttttgaagaccatccaaacctctcaaccaaaatgcaaaaattctcacaaagtaaaccaaaaggaaattgaacctctaatcccaaatactaattaagatgcgtacatttcaccaacgaaatccatcctcgatgaaccaagaggcgattggaacaggtcggcagccatgccttggaacacgtcctcctcctccaagaagctcaagaaccctcccggattcagatccatccacaggtcggtgtgatcgggatgatcgtagccaaatccatggccttcctccaccttcacctcgcacttgatcttcttcttcttcttcttcctcatcatgctctcgtcctccgccggcgccggcctcttcttggtggtgaccttctccttcttttcgtcgagcaccgccaccggcgatggcggcggcaacgtcgtttctgccgattcttgctgctgctgctgctgcttgccggtgaggcgctgcacgaggtcccggaagttggcgacgtcggtcttgatgatctctggcgcaatgatgtggatgatccttatcttgggcctctccttgtgcgccgccgccgcctccggcgagcccttcttcgccgccgccgccgatggcggcggcggcagcggcgtcgatgggctcatgctgttgtagctgcactcacccatatctcgccgaagacgaagaagacgatggtagctagctaagctaag

SEQ ID NO: 82601 - DNA, 2872 bp, Oryza sativa
aagttgagagtagtttagcaagagagatgtttggtgttgctttgcactactatcatgtacttagctgatagctaggtagctagcaccttgattgccatgtgggtatggatcatatagttgcctcttcaggtgattaattaattaacatataatcaagttgtgacacatgctaacataactagcatgctcatattttatccctagagcatacatatatcacacacatgccctttggactttgttgttgattattattactacaagtaaatacatacatcgataggctcacagcgtatatacgtgcacatatgaactatgacgcaacaagttgatcgtggagagaaaaaaatattttcaagttgaagattgaaccactgctttggagccgtgtaactaaggccatatttaagagaacttttagccagttgtaccttctctaaacatgataaattctcacataaactttaaaaaaattgtaagtgtagaatccagatgacagaagccaaaaaataaaactagaagtactaaactgaggaattggctttttcagatttccaaagctagctacgcaacctaattttcactagaaaattttaagctccgctaaaccggatagggcatcaccgagagatatcctaaaatcaatctccacaattttgttttcagaaatcataagcaaaatttgaagtgtgaaaatatttatctttccaacatatgtctaaaactgatttcttataaggggaaaacatatattgcaaaccacatatatagtgaaaatatgaaaactattgttggatccataaatgaatgtatgcgatttgtctacgttatcaggagtaaaaattttactcaataaaatttgtactcatagttgaatctgggagtaaaatttttactctaggtaacgtggacaaatcccatatgtctatttttagatcaaacaatactttttaggttttcacaatacatatgatttgcgctacatatttctcctcttaaaagtgaaatgcatgtgggctcgaaatatgatttttcaatccttccaaacgccgttactgctgatgaccccccgagctcaccctcaaatccgtggaattctcgacttgtggagagtggatatccgcggattgggaacgagtcgggaatggagccatttttttttccagaaatccaaaattatagggttggggatagtatagcaaaatagcatagcccctgcatattttgcgatagtccgtaaattattttcgatcgttggatctagctgggtagaatccttttcaatcatttgatctaacaatgctcatccaataattgaaaatgatttgtttgtgtgaggtcccggtacctgaagatattttttattggaacgaagcaaatcttaaattttatcctaaaaactaaaattgaatttttctgttaaactaccaacagaatttcccttctcctccgttaatggcgcgctatctccttgcgcttctccctgaagccacgccatgcctagcaacagagcgaatatcctgcatagcaacaaagcggataatccatgcaaggcagtaattaagggatctgtgtttagttcacgttaaaattgaaagtttggttgaaattaaaacgatgtgatggaaaagttgaaagtttatgtgtataggaaagtttggatgtgatggaaaagttgaaagtttgaaagaaaaaattgaaattaaactcggccttaaatccttcaaaattggttttggggtgaaataggaggatcattggtgatgctcggcgcttgattactgctgatccagcgttgcgcgccagcgagagccgcggacgaggcatcgtacggcgctagcggcgggcggttgggatggatttctcaccgtctgtctccggacagcctggttgttgcacgtttctgtttcggctttagccgttggcatgcaaattttctaagttttacttgcactaataattttggtagaggattcttcgccctcgtgcgttgctcgcgtatacttgcttcattttaccaatagataactctgttgatttttgattttgatataacgtatacattgttgattggatgtacccgactacattattagtatagcatgagaaatgcgggtacgaaagtatacatgagattgtggtaaagtaagtgaaaataagggatttctttaccaatttagaccaacaagataaataatatccttaatttagtttatatatatagctttaaaatgtctcacatattacagtggtggagcaagctagctaattaatctagccttccaactaatactcgtcgagaactatccaacaactagctattgactttcttctatggatctacgatccggaaggagttttgtttattatctgctacattcctatatttgaacactccttcgtatataggtatacggtattttaggagattacgaacccaagtataaaaaatatacctaatttgaaacattgatagtagtccctgatctcaatgcaaatgatggaaacaacgttcccggctatataattcgagaaagttaactttgctgggatatttgatcactcgagaattagagaaggcttgtaatccttgaacaagttctcctcgaccataggtcgcaacattggcaagttttgaatttggattgaggtaaaaaaaaaacagccctcatagataggaaaccgctaaatttatgtagaaaatttctccggctttctcgaaatatgaaccatcacttcgtggtttataagacctatttacgagatttattggagttccttttgcaagcaatgtcgttcttctccctttccgccctcaatccaccgtagaccctagccaaagttttcctttcatcaccaagatcccgatgga

SEQ ID NO: 82602 - DNA, 1164 bp, Oryza sativa
aaaagaaagagagattgaatgaaaagaacacacctgccatggtgacatgccatagaagaagctgcgaagctcctcatcctcgacatccctgatggcgcgagcatgaggtgaatatttgacaacttcatcctgcaggcagagattaatcaaatcgaagagaagagagcaagtaattagtaaatatttatatataaatacgtacgtcgaggataaagagcaaagccataatcggcggagctgcatatccgagtccctcaacaagcgcagagagagatggatggaagccccctgtgcagtctattccggccatctggcatatgaatctcccagtaagtgccatggcggcataaatccctgcacccatcagattattattctattattacttaattgttgcatagtagcatcgattattactaaaatggaattaatttaaatactaaaagtagatgaaataacaggagtcgttagtaccaatgccatagctgagcctgacaaccgctcccagcctctcccacatggccagctccgcgtcccgggctgcgaagcccccgcctcctccgcctccgccggtgacgacgggggcggcaggtggggcagcgacctccacgactctggggccatctgcagccaagcggccgctcctccgttggtcgccgcctcggccctcagctgccgctcggatccatctgcgaactcggggggcgaagccgatggaacagtgggtgtagctgagcctgagcctgagcttgcacgtgtttgtgactgtggaagaggaggaggaggaggaggccgccgcaaaaggggccagctccattaattcacaagatccctggctgccttttcaatctctctctctctctcgatctcgattctacagcagcaggaggagagagtgccaagcggatcaaagaggggcaagaggagagacaaattaaagcagagccaagaggagagacaactaaactaggaggacggaagatcgatttttgttttaatactcctactcctactcctattagaagtatactctgtctatcttgttgtcctacgctagtagaaatgtactcctagcataggaggaggaggagactcatgcgccatttgattttgattaatgggtttccgccattagttttctagtggccgccggtttgctctgca

SEQ ID NO: 82603 - DNA, 567 bp, Oryza sativa
  unsure (1)..(567): unsure at all n locations
gtgagccatccgccngcggaccgtcacaggtatcccctcacctgtgacgggccgaaaggaaaacccgtcagaggtataccagtgacgagttttgcttccaacccgtcactggtatcccctcacctgtgacgggccgatacattagaagccgtcagaggtgatgggccgccacctgtgacggctttcatttctggcccgtcacaggtgagcggataccagtgacgggccgttgaatagaagcccgtcaaaggtatgagcaatacctttgacgggctttttttatctaactcgtttgaggtgtgttgggtctataaatacccccaaactgccaactgctttccatcccgaccattgtactgttcacaaatcggttgggagggcaagggggcgatttttttgctaaaattcaaggtaaaaaatacattattctccattcattctcaacatatcgatcatcatttatttttcttcgtatgttgttgatttcagatggatcgtagatggatgtactatgcgcatcgttcgtctaccgagtatagagagggggtcactgaatttgtcacattt

SEQ ID NO: 82604 - DNA, 1201 bp, Oryza sativa
gcttctttctgatcataataatggaaagcttctttgtgacagtaatctacctgggagactgacttaaaaatgcaactgtagcagaatacaaaaccagaagcagaaagaacagaagggttattgcgcttctggcagcataaggggcacaatgtcctgtcagggggcaagggaagtccatctttagcaacctgatgaaagaagtagacgctcaaatcaaacagtagtcatataaagaactattaaaccacaaaatatatccaactgcacagtggcaaaacaaagagttctgttcaccatgttactgcaaattgagatttcagacaagggtaactgctttctgcatatattgactagcatataacatgtacctttggcagaggtggaggagggggtgggggatatacagtcggagctgacattctttcctcagcagattgataccaccattccatcatctagataagatcacgagatagagaacattaagcgaagcacgatgggggatcatgttttttcatcatattacatccattgtagggagaactgagaagattaaagataaagagagtgtgcaaggaaaaacaaatttgaccaccgagacaaacgaagaacttgggttcctagagcagaaattggagagctgaccttgaaaaagaaaactgcagcaatcaaaccagtttgtgcataatctaggctagtgtacatacagttaagtaacaccctttgcatggtctgcagggataatattaaaatattagtgttatgcgccattattaaatgactcaaacttgagcaaatccactatatgagtagtgatacaatcctttactaccttcagccatggaggaccacgaagtctctcaagttctcgatttctgattcttgataccctagaagatgattccatctaatttttcaagaaaaaacaatagaaaataaattagcaaaataaaggctaaccatctctaaatatgaaaacttaacccaatttgatatctgatatgttttcttggattttaaaaaaggacaatggtctgcatggagaaatcataatcataagaaagaaaaagggcatttgtatcaaggtaataggattagaaataggcttctgcatatttgagctaaccaatagtcaaggacacaaattagtaagtaactaagtatcaaataccagctcttgtcctgtagcacgacaaacatg

SEQ ID NO: 82605 - DNA, 3908 bp, Oryza sativa
  unsure (1)..(3908): unsure at all n locations
atgcagggattagggatttgggtagccaagtaagaggaggggaatcggcggacgccccgctatggccctcgccagttagcagccgccgccactccagtacacgtcgctgccatagccaaggggataagaaaagagagataaggaaggagagggaggaggaagaagggttggagagaaagagaggatgatatggctgtgggtcccacaagtatttttcctatgtgaacgacaaatgggtcccacatatatatttttaattctaatgtcacgtaagcgccatgtaggacgaagaccaggtcaacatcaccacatcagcgccacgtcagcaaaaccattctccaaaaccgctgagggagtcaaattgcactggtttcaataggtgggggagtcgttttatccggttttctggttgaggggtatgaatcagattcggtctatttttaagggagtcaaagtggactttttccatctttttaagttgctttttccaagcgaaggctagggccgtgtttagttcccctattcccaacttttcatcacatcatatcacatctaaaatttttctacacacataaacttccgactttttttcaaactcccaactttcttcaaactttcaacttttttttcaggaattaaacacaccctaggaggggaacccctatggtctagaattttttttggtttatttcttcaagctccagtaccactatcttcttcacaattgtttcaagtgtgaagaattaattaaagcctgtttcctgtaagtgcaggtacaatagctggctataagccagctgcaaacaaattttaaggagataaatgaggagagagaatagcagcgggctataaattgatgcagtgtacggactccaagacacagtgtgtgtatggcatgtgggaccagttattgatagtgtagtatgtaactattgtatgaatgagctattagattggttatagatgaattggagctggtaattagataagtttaatagnaacgccaaccggccagctccgattcatctatagccaatctaatagtcaattcatataatagttgtttaatatactattaatatatggtcccatctatcatacacaccgcgtcttatagtccgtgctgtagttggctacatatttgtagcccgctgctcttctctcttatcttttatctcactaaaatatgtttatagctggctaatagtctactattatacctgctctaagcgaagttacacgtaagcacatttcagttggtcctctgcatgcattcacaaataggagtatataatatatcgaatcttcagtcgagcttatgaattccggtcctttggtgcattctcggcagagcattgcaaacgagattgtgattaagaaactatgcattccggtcctttggtgcattctcggcagagcattgcaaacgagtaagaaaatatgctgacataaaatatgctgacataaaaatcttatagagagcctataaatctctacaagagatccatgtcaacatattttctacttggaagatattaaatgaagagagagagcaaaactatctactaacctggagatagtctatagagaaaaacgaggcaatgcattagagagctatagataccgatgtagacatactattgaggtgatttactattaatctagtctattgctgagatgtacatgttttatagagagcaacttactttaccattgcgggtgctcttaggcagtaccagtttttattaacggatgcagatggaacggtccagatcagccaggcgcactgttcatcgtactgtagcagaaaacactgtagcacagaatactgttggtgtggtcactgtatcgctagatgactagatctgagccgttgatcacagaaatggatggctgaaattgcatgcagttcttaagttgcagtcatagctataactgcacctgatctgaatcggagttagcattggtcgctggactggacgaccaagggggttcggaatttgtttctctatccgaaccccgcgggtcagaaatttctttccctatttctcctagttattgcagcctgtattgtcaccttcttcgacgacgtttctatgtcccaggtcttttattgagggtttccttttctatttactattataaaaattaaagatgttttttccggtattttagtatgtcatatgtgtttgagtcagtttttaagtttgttcaccttggaaatacatattcgtgtttgagttggattttcagctcgtttacttttagaaatataaaaggagtcgtataataaatctcttttaaaaaactcatactaacttgagatgaaacacataatcctaattgcagctcatcattttctaaaagaaatattcaagcaaattcccacagttaattttaccaaacctaaaccatataacaataataaaattaaaatagaatttacccgttgcaatgcacgggcttttttttctagttcagaaaaaaggtaaaattgcataaaccactccaattaaataaaaaacatgaatattatgaaatggtctgatattaaataattagaaggggtgaggacctagacgggctagcccacctctgttttttcctgtcttctgcggtgctacattatcgccattgttgcaagcatcaacaattccaaactgtttacatttcatttgagactctgggattcagtgattttgcaaacctggacgagtgagggggtcggacttttattctccgaccgattttctttttcttttttttgttgtttttcctatcgagggtatggtttagagatttatcgctttcactcaatcaagctactgatcgaattggatggctcctacaatttttttctctcttttttgcgagagaccagcaagtcgcggcaaaagtgctgagatggagcatggccatcttgagatgaaggttgacactaacagtgatcggtgcctgtcgatctcctccattgccaactatataatactccctccatccctaaatattcgacaccgttgacttttttaaacatatttgatcgttcgtcttattcaaaaacttttatgaaatatgtaaaactatatgtatacataaaaagtatatttaacaataaatcaaatgataggaaaagaattaataattacttaaattaagatgaacgatcaaacatgtttaaaaaagttaatggcgccaaatatttaggaacggagggagtatcttcttcgccattattggaggaaccatcgagaattcgaattatagcctgttttgtaatcaaaagccatacataagaacaattcacatctgtgttcagaaatacgtcgaatcttcagtcgacgagcctttgcattccatcccttagggcctgtttggcacagctccagctccagctccacccctcctggagctggagctcagccaaacagtttcatctccactaaaactgggagtggagctgtctcacaaaatgaactagagttgtgaagttgggtttaggcagctccacaactctactccagacccaactcctgaagttaaatttaggagttggagctgtaccaaacaggcccttaatttgagtcgtggagtctgtatctatcattttggcaatgcaaaactaagatgatctcccagcaaggctgtgccaactactctttttctgtttgggattaaactttagtgatccaaaataacaatctgcagaaccaacaaagcaaaaccagccagtcacacaggcttgcagaaccaacaaaccgtgcttaaaaaagagataaaatatgtatcttaatcagaaaaatgctctaaatggcatataaaaataggctagaagaacaacggcaacttctccctgaaaattgacgaccctatgtgttcgtaatggcccatgtttagcaggccgccctgta

SEQ ID NO: 82606 - DNA, 1278 bp, Oryza sativa
tttagaaggagatggcggcgcggctcggctagggtttcgggcggcggcggcgcgacgaagacgacgactccgacaagcgggacccacctgtcagcgacagcgagggcgcgcgcggctgtggcggacttgggccggcttgggccgaggagagagagaagggttttgggccgactttcggcccaaagccaaaagagacttttaaaaacctttttcaatttaaattattcatgaaatgcaattccatttattaaaaatacttccttagctcaaataaatcccagaaaaatctaggaattatagaattaagcaaagtatttaataaaattttatctgccccattttatattagaatttattaattaaaattagatcttctcttctaggcttttaaaatcatttctaaaaattccaattaaacaacaatttatagattttgattttttagggtgtgacacacaacataccggaaagaggccgtgacaggacccttcgcataaccccctctaaccaaacacaccacacctcaggtttcacccccactcctcgcaaggcagcgggcagtcccctctcgtgcctaggtgaatccggaagccgcataggccgtcgcagggcccatccaaactccgtcacgcccacccttgcctggatgcgtcagctagaggaaagctacactacaagtccagccgttgcccacgctagcttgtggtaagtacgataagttcttccagggcatcccgcgaaccggtccttaactgccatgggtgcgaccagcaaaaccatgcacccacagcccaccatgtgatttattttaattaaccaacaccaaagcggtggcactaatccaacaataccattagaaccagcagtctaaacattaatagaattttccccattgtgcactagttgaactaagcatggctaagcaatccctagtccaatctttagtcatgttataaccccaagctgacaaagggacatggtacaacaatagcatggctatgacaataggtaaacatcccatagtaacattataaaacaatgcaatatttgaagaaaaacaatagagcatttgcaatataggatcaacatgttcaagtgacaagcatgacttgccttgctctgctgctggaggaacctcggtgactattttgaagtacaccggagcgtcgtatgaaccggaatctagcgacatacaaggcaaacattgcaaacaggctataagactactgaaacgaggaacaaaaccatttttaatggattctacacatttttcttgat

SEQ ID NO: 82607 - DNA, 5160 bp, Oryza sativa
atatttttggacaacgttttttaatgtgatattataaaagtctttgtcgagcgctataatagggaagctaattttctagcaaatatacttaaacatacgtctattttaaagtgttcttgattaggttgatgagcctcataattttttttgctaaacattctagctaacgatgtaactgtattttcatacaataaaacgcgccaagtggctttcctaaggaatatgaaaaagtactaccaaaaataggagtacaacagcaaagcttccaacaccgtccgattctcatagcgaagatcagaagcagcataaagccactatctcccaagcgagatttttctttaccagaagcggttaaaaaaatgcagaaacagtaaaaaaaaagaagggaaaaaaaacaataaaccggagcgggtgaaacaaacccgcttcagttcaaagcgttccccctgttcatttcgacctctctcttcctctcccgtcgtcgtctcccccgtctccggctagggtttcggccgctcgccgccctcgcctccgcctccgcctccgccgccgccgctcgccagggggagcccttctcacctcaccgctcccgtctctctctccccgtcgaccccgacgggctacggctctacaccctccccgcctcggctcgtgtctgttcgcccgcggggacgctgtttccggcgggcggaggcgcggccgcggcgtcgcggctcctcctcggaggcacggtgcgggcgacggccctcctcctctccttccccgaccctctctctctatctcactctctctgccctagccttctacgctgtgtggaggcgtcgtcgcgcgcgcgcgcccggacggcgagcatctggatttgagcctaattgaaggtattttgttcatcctcctatgcgatatgggcttggatttatttgtttctctctaattaacacttccaattcgttcgatttgcttaattttgttgcatgcgtggtgtggtgctaatggcagtttgtttgtttccaaaaataattttggggtacagctgaacccccatggcccagtttaggtctgcgcctgtggaaagcgaggcggagccaggcgccgatggccctgtggatgaagccaatgctgtggaagaggagaaatctggtaagggtgaggatggcattgaggaggctgccgataccgttgattccgtgaaggattcagcaaagcctgaaggcatggatgcaaaggaggaggcggtggagcaggagggtggggccgcagcggataaggcaaaggatattcctgtgactagtaacggtaagacggatgctggcggaaatgaggtggctgaaatgaaggttgaaaaattggagaatggtgatgggcatttgaaggcggacggcgatagcaatggtgataacaagggtgctgatggtgagaaacagcttatgttagcgtcagctggggaggacgtggaggacccggtgctgtccaagcttgcaagcaactccttcatgtttgattacagctgtggtggtgatgactcggggactgaggaggagcaggctgctttcatgaaggaacttgagcggttttacagggagaagcttatggaattcaagcccccgaagttctatggtgaagggttgaattgcctcaagttagtacaaggacctctttgtctgtatgttagaatttgttatgtgctatggacatgaactaattttatcttgattttaattttttttataggttgtggagacaagtgactgggttgggtggctatgatcaggtactcattttgatgccttattgaataatatctgaccatctgggttatagtgtcttttggattacttgcttgctattatgcattgcaatggacagcaaataaatagactacaaaactcaaaacaaaaaatacgaaaaaaatatttccaactcaaaacttgtatgaccacatgagatcatttggcctatatatgatcatgtgaaaatgatgcatttttccttattaaaaaaacttgcaaacaatacatccatgtctaccacgtatatatagccacagaagatcctctgaactgagggtggctgtagaacacacctgtcactcccaaaaggttccaagtccttttgtaagattaaatatttactttctgcacatattatgtatttatgagctgggaacattaagattataggactacaatatactgttttacttattttttccctttataaactagttcaagaaaacaaatccaatatatgtatcatacagggttggttatgtgagttttttttttggcacttcggcaatatgcttatccagttgttacttccttttgttatgttagaatggaaggcccatttggaattttgaaaatgattccaacagcaagctataagccaagcaaaacaacaacaaaaaaaaaaggatttaggcttttagcatgtaatgagtttttggtatgccagtttgttatcataacgtgcatatctgattccacacctgtatataaagtggaagatgtggattttaatttgcctacctatttttctttccatataccatcagatcctattaatttgatgcattgtgtgcaaagtgtctgccactattatttctgaatctaatctgttttcggaccttttctcctgaaatattcaactgacctgattaagtgagtcaagaaaatagagatcaaaatcgacacttctatttcctacagtacatacaccaatcatgatgacagttccatttgcacagtagtgagactgaccatatataagttcagttcttgttcaccaaattgatatctctaagctattattaatttctttgtgttactaaaatatttatatgccgcattgtgatttcgtgacattgttgtataatctttaggtaatgtgcactgcatgcttgcttactagttgcatcaacaggtgacatcgtgcaaactgtggcggcaagtgggagagtctttcaaacctccgaagtatgtatctgatttcttctgcattctgttcaggccatttggtgaatctcaattgaattgtgcaatgatggaagctcgaacttggttggcataagctcagatttgaatactctttatgttttatgcaggacatgcacaactgtttcatggaccttccgtaacttctatgagaaggtatgtagatttcagagcctggacaaccttgtctgcagttttagttctctagttgcagcactgttgtggttgaatcctgtattcccctctcacgtcatgagccaatgacaaccacagtagttaattgaagaaaaaaaatcaattcatttaacatattctaagattttgcatgattcttgtaaaaggagtcttgaaacaaaagtacacgcaatactttggaagttttgccaaactgtcaacataagattatgcccttaaatgcgatcccatctcgatgaccgtcacatagatgtggatcatatttgaggctattttctcttggtttatattacttggtagataagcacaggtgctggtttgcatgatttgtttttctctttgaattgcacaagcagaatgcagcaggaacactggttcttatctggggaaactgcgtgtataataaaatttaaacaccaatgcattttgtcaagagtagtgttgtattttaaatcagcattggttttatttttgcccccttctgtctcgccgaccctctttattgtttttgttccatgcaggcactccttgaatatgagaaacacaaaatcgaaacgggcgagtttcaagttgctgcatctaatttaacagagaggattacttctgaaagtcaggtacagtagtatgacggctagcataagttttccatgatccctgtggaaatcagacataaatgggtcctgtttctaactattatttatgtcccaaaatataagaaattttgggcttagacacgggtagtaagaaagtaggtgaaattaaatggggaaagattgtgattggttgagaagagaatgtaggtagagaagttatattttggaataaattttgaaatgctagaagttatattttgggagtaatttaaaaggaactgatttcagatggaatgaagattcattctgcatttaaatttttgacttcctttattgcagatgtttgtttagttgtgttaaatacttcagcaggaaatatgttatttttttgagatgtgtaagtaaggatcttaaaaaggatgagcttataatcttgatacaggttggcatccatgcttctggttctggaagagctagaagagaatctgcaacccgagctatgcaaggctggcactctcagcgcttgcttggcaatggtgaaattgctgatccaataattaaagtacgtgttcgttcaagtcaaattgtcattagtgacttgcaatttgttgtatcagtaaccttttgtttttaccaggataaagggacggtgtctgtcttaaaaaaggataaaactcctaaaagcagcggtaccatttcttgatttttattttttaaacatcatcatgctattatttacttatgttgctttttttaggttctgccaagaggaaaaggacaccgaccttggaagatgacaggattgtaccatataaacctgacaagctacagtaagtcttgcagatgattctctttcctttgtcatcgagcatccacaggaatcatgtaatattactgtaggcaccagtctgttcttttgaatgtcacgatgatattataaggctcatccagttaactatttgggttttggcatgccaattgattttttcactcttccaccctcaatttgtatggatgtgaaactgtgaactgatttcaattatttctatttggcagaaatgactcaatggttcttgaccttggccctccagctgattgggtaaagataaacgttcggagaaccgtaagtatctcatttggatcatcatattttacctttttcatgcttttttggcctcttttagccacttgcccatattttccagttctagtagttctccacagaagttctgaaaaacaatgctagcgaaacgcatattatgtttgaaatctgtagaactatcgtggaagttagaaacagcatgtgttaaccagaaatcaggggaaacatatttttcatggtcattttgtaaaggaaaatatcttttttcttgcagaaa

SEQ ID NO: 82608 - DNA, 12354 bp, Oryza sativa
gtcggcacccatactcccccatcatctccccctcaggttacaggaaccgaagccccgtggcactctccgctgtgtcaggccagcgccgctccaaccccgcccacaacggacgccgcacccgcccccaccggcaccgacatccaagacgtcgtcgtcgccgccgccaccacctccacccttattctcctctctactcaacgtcgccggtcccatcaacgctcaccgggctgcaacgacaggaacgacgatggtggtggtgttgccgtggctgagcacagaagaaaggaggaatgaggcgtcgtcatggttggcgggtcctcacgacgagcagaaggacagagggcactgatctggggcgagctcgagagcctggtgacatacggttctcctcttctcgctgctgccaccgccttcattgatgccggctccgtcaccaacgtcgtatcttcgatggcagcggcaacggaggacggagcagcggccgtcggcgatggcggcgaaggacccagcaggggcgctcggcgatggcaacggcagcggaggacgggtgctgcggcggcggcgctcgacagcgccagagcgaggtggaggcgaaaatggcgatgctcggcgacggcggaggaggagacgctgcccagcgcatggacggcggtcagatccgcgtccccgacaacatggagtccggatccggacgccggcggccggaggaggcgcctcgcagcggcggcgctcggcgacggtggggaccgaggcggagatggctgctcgcctcgccgacggcgacggcgctcggagacgccgacgcgacggccacggaggtggacgcggccgcggcggcggaggcagaggcggcggcgcgaggggaacgcggagacggaggcggcgacggcggcgggagagcgggagggagagggcgagcgagagacgagagggagaagggggcggcggcggatagggttttgggagttagagcatctccaacagtctctctgaattggcctctccaaatagccatatagccaactctccatgtaatttagccagtcaaactagatgggacggacccacgtgtcagcctctactcctcttccccccccccccctctccccttctttcttcttatccttcagatccaaagctaaagctagctagctagctacccagctcacgcgaatggcctcctacgacggcggcggcgacggcgggcggtctggcgggggcgggagcggcgacctggcgtcgagcgccaagctggtggcggaggcggcaagtcggtgttccaggaccgcgtcgcgtcgcgacctggagaaggtcgacaaggcttgcatcgcgggtggcgcctcccggcgagaggcggcgcaaagcagtggcgcggaggagcggcaccggtggaggggcgacgcggaggagcggcgccggggaagaggcagcgaggaggagcagcgccggtggaggggcggcgcggaggagcggcgccggcgaggggcggcgcggagcggtggcgcggaggagcagcaccggtggaggggcgacgcggaggagcggcgccggcgaagaggcggcgaggaggggcggcgcgaaggagcggagccggcggaggggcgacgatgatgtcgacacttggcgacgggatgacgacgccgccgggatgctgctgcgcgccttagagtgtgcggagagagagagggggaagcacgcgtgggtcccacggatggcaagctggttttgactggccaaatttggctaggcagggagccggtttggccagctgatagcttggccatccaaatagcaagtctgttggagtctgtctaattttgaaccaaacttgctaaatttttgctcggagagtgagatagcaagactgctggagatgcttttacgtagtgtgggcgtttttttgcgaaaaagcccctattcttttcactttttacattcatgtccacgatttttcctatacaaacactgtttgtgaggggcctatacgtaattaaagaaaaccggagggctttttttcaaaaacacacccgagcactatagcaaaatccgacgtggcgtcgctcctcgcacgccccttctgcgcggcataattgttgcttggaagggattggattcatgctaattgttgtattccttcaaccatgcatcaatgcttgattcagtggcaaggcgacaagattgaaatcgtgccagctgacaggtcagtcaatgttgccagtgccgatttagctctttgggagatggatggtcttgattatttatctggaatagtttgagatggagattttctaaaagtgtccgattctgatatatagccaattgaagatagagaacccaagctattattttgagggcgtcttggagggttcagatgtctacaacaaggacacaatagatgatctcaatgacaagcaaggacagggttttacgtcggccgatgatttggaagaaattgatataggtctaggtgatcgaccaaggccgacatttattagtaagaatttatctgcagaatttagaaccaagttgatagagctgttgaaagaattcagatattgcttcgcttaggagtattatgagatgcctggactcagccgatcgattgttgaacatcggctacctatcaaaccaggggttaggccacaccagcaacctccgaggagatgtaaagccgatatgcttgaacctgtcaagactgaaattaaacgattatatgatgctggttttatttgttcttgccgatatgctgagtgggtttctagtatagttcctattatcaagaagaacggcaaggtcagggtgtgcattgatttccgaaacttaaataaagctaccccgaaagacgaatacctaatgccggtagccgatcagctggttgatgctgcctcggggcataaaattttgagttttatggatggtaatgcaggatacaatcaaatctttatggccgaagaagatatccataagacagcttttaggtgtcctggtgcaatcggcttgttcgagtgggttgtaatgactttcggtttaaagagtgctagagctacatatcaaagagccatgaattacatctatcattagggatgatggcaatgggtcgggtcgggcgcgggtagagtaaaaccatgcccgacccgatacccgacattgcctgcccaaaccctacccactagagttagcgggcaaaactctgtacccatacccatgcccggcaggcgccggtacccaatggatctcacatgaataataacttgaaagatatgtaatttaacaaagagaaataaaatcaataatttaccaaattattggttatcaataataatttgaattacatcacaacttaaaccttggaaattcagcttctgtcacagatggccgattgacaactttcaagaccatcaggtttaaccaggtctgcagcaaccaccatggtctacctactccaactaccgatccgacagctatcttggccgatgcattgttcaacatttggtataaatagtcgaggaggattttgcccaaaggaaattgtttctttgattctagggcttcggctataaattgccagttggttgtaggaccacaactggatccacagaagaggaacttttctaaccacattagcaagaaagctacatgctctcgaggagtgacaggccctttacccatgtatgcagctacatagccagaccagccacctatgcttttggttctaaaatcaaattgattcttggtattcatgctcatagggttggccgatgaggttacatctagtccagtgatcatggtgatgtcaatcagagtaggagtcatcggccctcggttgaacagaaaggcattgatggtattggaccagaaataagtggcagcggccatcagaggttcatccttagctgaattggctatggtaagggcaagtgcttggccaatcccgatttcatcccagtgaactttcttactagccgatacacgcttgtaccatgtggtccaactcctctcaggggtggttttctcgagagatggccaagacttaaaagttttcttccagtgacctaggttagggttggctaatctaaaggggattctgttgctttcgccgatgatgaaatcagtggggtcaaggttgccgattggaccaagaaagtaatggttttcatgcgacaggctgggaatcgcaactagattggagaggtgctgcaaatccaaaagaatcgagaagaagaaaacaagatgaggaaaggggaaatcgatttcatgcgaggaaaagggatctagccgatgagaccttacctcagcgtactcggctgatggcgcggtagacgggctggcggaggacgacatcaacgcaggcggaggtccggtcggagatggaatcgctttggaatcgctttttgcgtcggtggagtcgccgcaaagagagggcaaagtttgtttcagcggcgaaaatagaagaggacggtgtgagatttctcgagggtgacgattagtatttaaagcacgggagtaatggtcggaaaatagcgaagtgcgaaacttgctcggagtcgatatacggcaaatctgaaacattaccaaatattccggacttggggggcatgtgttaacaaccaaatttggcaacatcggcatcggaaaggaagattagatcgaagtggaatcagagataaggattatcgcgagaacagagtaagaatcggctggagtcctgatcggctacgattggatcggctgaattcgagtcagacttttggtttggtgatacagccgattccgacaatacgacttggtgtacgacatcgggttgagttgatatgcttcaagatgatggccacgcgtggatagagtcctgggaaggcaattgtatctattaattatgatattttatgtaatttccttagatatatgtttgggcaaaagtctgccgttaagacttatggtatcttagagtttgttagagataagagtcgtgtccgatatggacatagtttgtaattttcgagtataaataggccccgaaccacatgtaatcaaagaacacacacgttcaatacaatctcggcgcatcgccacccttttgctttagttttatttcgacgagttcttactttcgggttgagctgcatcggtttcgatcctcaacaagaggtaaaacttgttatgacggcttgcgttctcgggattagtgcttccatctttatgatactctaatcttgtctatgtaattcgtcaagttatcatatatcttacataatctctggcattatcgctatttaacctattatcggctaacatctgtcggtagagggcagttatagttaaacatcgatgttgacttagattatataggatatctaccactctatgaaacttccagcggcttgattgtctagatattgttctttttttcatacttaatgcggcatcagttgagtttgatctattaagtcgtgcttagaatatcaatctctagcctgccttctggttgccaattagaatagtatcggggtttcagccgatcttacctgatttaactatattcaccctatatgcttcattgatatgttaaatctgccctttatattaagatcttgttgcatttaagtatattaggcctttgtttgatatattctacttgctttaacatcttagtatagagcggtatcggagtattagccgatacatgctagatctatctgattggctatgctatgaacatatatagtcctattattaatatatatttcgatctaagtgatttatactgtctcggcatggcgaccgatctatcccaatcacttgatttaaatatatatcgatatgaggagtatatatcgttaatatctacagctgatcgagtagatttagttctttcttatttatttatgactgtcgatcgatatatatatatatgacatcggctcaaagataaatgatatgtcatcggtacttagccgatcggctatcgtttataggtttaaccgcggtttccttgtcgttatttcttgttgattgcaggatcaaatcaactggcacgctagcatacccgaaggcgagttttggacctgcactggagttaagcagatctcccaggcctcgtgttttccgtcaacactttggaatactctcgggtgaaatactacaatggtatatccgtgcgcttgcggatgaaatctgtaaccatagtataccataagtatttcggcgccattgcaaggaattcatatttctagtaatgacgttaagaaataccaacatatacgtgtgcggcaaatgaggtaaaagatttaagccgctaagcttaattgaagacatggcttctattatggctagaaagtgcaataatgtcacgcccagaaattcactagtaatttccgaacttatttgtgcataaaatcctcgtccaggaatcagccgaggtacacaaactgacaatttaatatacaaatccatcataataataacgttacacacttacaaaagaaaagaaaacagcagcggaattaacggtctagcgatggcttcagctccactcccacaggcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcataatataggctcatttgcaaaatcagcatttagcaaaacatttaggagaagtaaaacagtggagtaattaatcagaaattttaatcaacattgaacaacacacccatgctgcacaggcccaaccatcctgaacaaccatacccggctgtacagatctaactccaaaccaggagctaagcaaattattaccaggtataacatccataattattgtgagaggtgtgagactaatcacgaaaaacattgctcaacccgcccataaccgcgggcacggctattcgaatagttttactctggccagaggtgtaccactgtacccataagacacagcctcaacatcatgtctaccatgcgtcgcgatactggaaagtacccgaatagaggctgtgacaataccctctgcacaacacaactcaccacagtgcaccattcctggatcataatcacccccttataaaacaaggcatggactccccagcgacccccgtgggcttatctccgccacttctcagtctggtgcttcgcaatgaatcatgttatacaaaaggtaaagccgttgcctacgctggcttgtggttggcacggttaatgtttcacaacagtagctcgcgaaccggtccttaattgccatgagcacgactctcaaaaccatgtgctcacaacccaccattatcaagttttagttggcaagtaattaattaaccaatcacgattgaccatcgtgaactatcattaagccatcattaaataataatgagtcataagttatcccaatagtgtgctaatgtttctaagcatggctaagcaatcatacctaatatctagctgaaccaatatataaagcttaactagtcaaattataataacccaagatatcaaagaataaagtaatcaatgcaaattggccataacaaaggaatagattcacaccacccaatgacattcgaaaataaatacacggttgaaataaatagagaatttaaatataggatcaacatgctcaaaggattgtgtttaggatctgtgtgacttgccttgcaataatcggtcttcaattaatcctcttgaatacttccggcgcactggcgaaccttcgcaacgacggaaacgacaagctaacacgcaaaacgaagaaaaagactaataaaaaccaaataaacaatacatataaagtaaacaaacatgtagatcataattttagatgaattatgagacttgaacggcctcattctgacttcatatgaatttattatgaattttacaagattaaatctaattaaagcccatttaaaaagaattaaataaatttaattctatttatggataattttattatgtagatctttattttacacaacttttgcaacttgaaccacattaaactgagttacaaagaattagttatgaattttcaaagattaaatcggattaaagcacttatatagattttaattgaattatgacgcaataatgaattatttttgaaaaggaaaagaggattattgcgtcagcgggctcgagttcacggtggaccgggtgcacagcagcggttcacgggaacggacggccgagatcgatcctatccaaaacgaacggccgagatcaaccgatccacgaccgggccacggcggacggtcccgatgacgtcagcggtgacgtcaccaccggcgacggctcgggcggcgcatgctcgccggcgaacgacggtgcgaggacgcgaacggagggcaccaaaacgatgcgggcgacgaggcgaactcaccggtgaccaaaacggcggcggaagagcaacggacggcgccggcgatgaggaagaagcggcggcggtcttcgggtcaacggtgacggcggtgctccggcggtcttcggcggcggcgaagcggtggacggggatggcgacgcaacggcgaccacgacggtgacctccccgagcgacggcgacgactggagcgacggcggcgcacggctggagcggcggcgacaacggcggcgcgaggtctcacggcgctaggacgctacaggcgacgagaggcgaaggcgagggtggcggcgggtagaggagagctcgggggtccttttataggggcaaggaggcggcggcgaaggcccacggcaaccggcggcgagaaggaaaggttagggttcgagagagagaaacgaatccgattcgacctcgaatccacgagtttccaaaccgaattaggcgatgattccaaaagagaaaaggaagaggagatcgagaagattatttcccctctaaagatttcaccggatcgagaaaggatcgaccggattggaaagcggcggcggcgaagcggctcggctagggtttcgagcggcggccggcgcgaggagaacgacgaccccgacaagtgggtcccgcctgtcagcggctgagagagaggagggaggggcgcggcggactgggtcgacttgggccggggaggagagagaaagagagaggtttttgggccgactttcggcccaaagccaaaagagacttttaaaaacctttttcaatttaaattattcatgaaatgcaattccatttattaaaaatactttcttggctcaaataaatcccagaaaaatctaggaactatagaatcaagagaagtatttaatgaaattttatctggccccattttatattggaatttattaattaaaattagatcttctcttttaggcttttaagatcatttctaataattcttttaaacaacaatttataatttaaggatttttaaacaagaaaagctcttaacaattataattagatcattattgatcaaataattactgaactgttctttgtatcatttagaaattgagctctgaaaaatccgagaaaatttcagagagtgtaattaaccatggagaatttaataaaaattaaatccatccatgctttaaatttaggaaattttatttcccacatttaacttcacttgtaaattaaagaacatttaatataaattctaataataatttattaaataatttataaatcctgaaaaaatcaggatgtgacaaataagaaactatatttttcaaatccatcatctaaaaaaagcaagtgatcaacgcatacaacgaacgacagccattttatttaaaatttttaaacgcatgcatccatggcaagataacctcatcactctctggtcataaggaaggaatgagtctccgctctagcaaccgaagatgatataaatgcctatatttagtctcattggtggtccatgaagctctctcggccccatatatatatagctcttgtactatcacgtacgtagtatataacatgagcattagggtaaggaaagtcatcttagctccacaccaattctgctcagcataaacggtgctaatggcccaaaacaagaccatttcggtggctctgctcctttccacccttgtggtggtggttgcggcagtagcagccaccggaccgccggatttattacaaggttggtgcgccgatgcgtgtagagaggagcaacaaaaagaccccatctacaacaagcattgcccagacttctgcgtcatctcgaccaagcagatttttagggcctataagggagccacggatccccccgtggaaagattcaacgccttgtgcgatgagggttgtagtaaggaatttaaggaggatcctgccatcagcaagaagtgtgtagacacctgcatcgtcatgtctaaggaagccaaggaatactttgcgaaaggtggcactattggtgctcccgcgggtgcatgatcgcgtagcagctgcacatctgatccttcttccatgatcgagtgacaatccccataaatggttctcacctggggaccgtccttgtatcacatttgtcctgttgttcccttttcatcttcggttgcttcattatttggtgtttataactctatgtggttgatgtgatatgttgttcttaccaatgttaccagaaacaattgttatctttatttgattaaatatatccggctgtgctttggcttttaccactcattaatctatgattccgtatccaagtaagtagagtgcgtgtaatgttaacatatagatgtagttattgcctccgcccacacgcatccgacgcacgtcgtgtgatcatgcgccagcggaaaacgcaaccaccacggcaccatgatacacatacatctatttctattcctaccgctccgagagagacaaagagaatacgtgcggccacgctgagcgattgcaaatgagtctatttctccaatcccaaggcatgttgcttctgaattgctgcaaccagtagcctcaatgacgatattatacatgtttttctagcgtgcgacatatgtttcaataacttccttgacatgttgcacgagtgtgttgtttcgatcaaatcctagtaatgttgtttcacgaacataatatcgatgtttcaggtttgaaaaatatagtttccaagtgcaagattgaaacaatgcttttcttcctcaaagaataacaccatactaagtcaattcaacacaaatgtttcaccacaacaattttttaccttttgatagtgggcccaacgaaaataatgtatcatgttttaacaaattaagctaaacttttttgtgtcgcaagtatattccgatttttcgcataggcgtgttttataacttaatatatcattgtcgtgcgatgacgagttaggccatgagattttttttttgggatttaaaattatttagttaatcatttctataacttaaattaatgtgcaaatcatttctaggttgctgtcgacctggtggcctagcccaactgcgagactaagtttatgacaaggtttgtagagcttgtaaaaggacacatatgtgttgacagtccttaaatcttaatatctaaccgtcaatacctgcatataataaaattaaatatggtatccaacttagtggtaggtattattactaatcattttcactagtatttgtgaaatatgtgtatgcaggtattttgagaagaaaacacatccgtcaagcgacaaactgcacccccgcgctttcaggacacatttacacgaattggaggtcccataagtcaattaaacaactccaaatgggcccaagtatcatgccaatgggccgagggcctcaaaaatagtgtccatgacgaaaaaagggccgaacggagccgtcccgggttcggtcgaacctccagttcggacgaaccgttttgctggccgttgatcgtcaaattttgcatggacggccctgatcacatcctaatggcggttccagggtagtttggtcatttcgcataggctgtaaccgtcatacctgcctataaaaggaggagctcactctcatttccaacacacaactttgagctgaattacaagaggctctattgtatcttttgtacattagaataaggtagagagtgaggggaagctctggaggagtgcccggaagtttggcgctcatccgactttgtcggtgacatgggaccgggagtatcatgacttagagacttgaggcagacacgatcacccacgtggcctaaccccctcgggggggggggggtcgggcccgagggtgatacggccgcccttctctttgtctccccgaggggtcggaccgctcccgtctcgggcctaaaggccaaggcgccctgaccccttgagggttttg

SEQ ID NO: 82609 - DNA, 5492 bp, Oryza sativa
cacctcctcctcgcccgaagctcgctggagtggcctcctcgccggcgtccagtggcgtcgccaccacttctccgtctccggccggctgctgttcgtcgccggtacgccgaccgacgtcgccgtctcctccgttgacatcgcagcgtcgtcctcccctccggctgctcctcggtttcgccggaacgccgtcgccgcgccggcctctccatcctcttcgtcgccggcgtcctttcggccgccccttcctcctccccggctcgtcggcttgctgcaccactaccacctccggcatcgcagcggcaaggtcgtcctcggcatcgtttcccctccatccaaacccctccgcggtccatcatcgtcgtctccgatcgttctcgtcgtcgacgtcccgtcggttgcccggctcgtcgtctcgcggcgccgcctccgtcgtcggcatcgcagcggcgtgttccacgtcgtcctcgtctccgtgcagccaccgccggctgccctcgtcgcctcctcgccggctccggtcgtcgtcgtcgtcgtcctctcgtcgttcccggttccgatcgtcgtggcgttcgtccctccgtcaagccgttctcgttcgtcgtcctcgcttcgtcaagtgcagcagccccatcatcgtcttcgtcctcgcctccgcgtcgtcaagcctcgtgccggccgcgtctcgccttcgtcctaggatcgccgccgaagtcgtcccctcgccgttcgtctccgtggttcccggccgcctccgccgcgcccgttcgtcgttgtcgttcccacgcctcgtcgcgtggtggtaaggatccctctcccgctgccccgtcctcgtcctttcggtgtcgcccgtgctcgttgtgcggttgtcggccccggtacccgtgtaccggtgttggtagtcgttcgcttgtgcgtgtggtgaccgtgttagcgtgcccgctcggtagccgcgtggtttccacgtgtgcaggccgtgtggtgtctagtggagtccgtttgtcggccactcgcctcggttgacacacggggtccgcttccgtcgacccgtggaccgtctctgtgtacctggtctaccgcggtcctttaggttgacatgtggggtccgcatgtcaacggcgcagccttcctgtcttttccaggctagcgcttacacacgttttatagttgcaaagcttaattataataatccgcaaatctccatataacagcattaaacctcggatgatcatatcttggtcatacgaaccctgaatcgacccgttcaagtctcctaatgttggttataacctaaagaaccctgtgctttctttttatgtattgttattgcttctttataggcttgtagctttgcttgtgtgcttcgcgtagctttcgtcgttccggaggttcccgaagcgtggttcgcggtcgtcgccgaaggttcggaaggccgttctctctgagcaaggcaagtcacatcatctttgaacatattgaatcccagtttgtaaaattatgttgatttaaattattgcattatcgctttatttaaattcccgcgttatcactgttttatttagccatgcctatttacctttgttatgaccatattattattgttattgttattattactaccttgttcaccctagattaaacaaaacctcaactagtggacactctactcgtggtatccctagtttaaatttaggtagatgattcgctgattaattaggcaacattaggtggttttataactttagactttgggaattctcatatcatttggacactatggaattgttgggttatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctagtcataaacaaaagtacacggattggagatggatgaagtcgggggtcgatggacattctccaggacaaatgaaggctacacgagctgcggcccggtagtcgagatgtcgtggcagagggttggtgccctgctgcttggggctcagtcctgcctgcctgtcccgggggttccggccgtaggtgggattgggtcggtactcttgtttatggctaggatgggttgggaactatgtcacgtcttccgtctgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagtcagtgttataattcttaaaatttgctcaacaactaaaatgtggaatggttggcctgggttggcttgggacgagctggggcccaagggtcgggttgccagttcggtctgaatcatcgtaggccttgggttaaggcaggttcgtgtgggttcacgaccttgattaataatattgtatagctctaggatcgtgtttacaaaatagctttgggcaactaagtgactgttaaatgctgtttactgcaaaacttaacccctatattattatccccttgtactcctttgcattaattgtgcatctccggtgtggcttgctgagtactgtggttgtactcattcttgctctatctttctccccccccccttcagtaagagaagctttggagaagatgtcttaggtggagtcctggcttataccccagttgagcgcctgtgaagatggagccgtaggcctgctagtccgctgctgtttatttttgattgccaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacactcttcctcggcccgaggccggagagatcactcccgcgccgtcggcctctcgtcactgcgcccgtcccgcacggtagtgcctccctccgttctccctcctcgctccatctcctccccctagctttcggtagtagcttgagtagactccccgtagttagccggcgccgccccgaccgttgccatcgctcgctgtatgctcgccgccgtcgccgcccgagctccgtagcacccgctcgtcgccggcctcgctcggcgtagttccgtccaatccgacgcaagcgtcgagttcccgaagccgcgtagatgctctcgccgccgggaattagcccctcgggacctcatcgccgtttccccctttcctctccgccggttgccgccgccgcaatccgccgccgacggactccctccggcgaatccgagccgttggctcgtctcccctcgtcctgtgctgccacccggtgtgctcgctttcgccggtatcgccgtggctcgctccgccgctcgccgctgtcgcccgccgtccattcgcggccgggtcgtcgtctacctcccgccggcccgcgtggctgccacgtaggcgccacgtcggcgccacctcggccgcgaccggataagccgacccggccagccgctccctccgtttttcccccgtgcgcatggtccgcggtgagccgtgaggctgcgcgtgggcccgccgcatccgttcctccgcgaaccgcgcgcgtgcaccgcgtcccagccccgcccgcgtgcgtacgccgcaaactccctccgcacggtgagccgagccgctgacaagcgggtcccacccgggaccgcgcgtagtgagcccggtccaccggactctctctcctctctccaacgcgcgcgcgcgcttgggccgtcttgggccggccggcccgttaagatcggccggtccgctccatttcccttgggccgcgccctagccgcccgagagaagtctacttctcctccctcttccttttcttttccaaaaaggatttaattaaatccttttcctttagatcaaaaattcaataatcttagaaattcaatatcttcccaaccgtaaatccgtttgactccattcaacttccaaatttccccaaatctcgagatctatctaatggcacgcttagaggtcattaatagggctttatttttttgccgtttgttgagttgtcccgtttcgcgtgtagtttcggagccagaagacccgcagtgcgaggatttcgaggatcaagctccagatctcgagcaaggcaagccacctttgaacatcttgagcctatatttgaaatttaattatattgcttgcaaaatattatgcattgataggatcgcactaaatcttttgtcccatctgcaagacagattggcggacttacctaacttgttgcatttgatccttccattgttaattgccatactatgtccccttgtaaccacccagttgcacctcgatattcgtgcactctgtgcaagtatcgacggtcgccttcaaacttaaaatctgagtaacaacttgggtaaaactggagttttacaaaagacttggaaaacccgacacctgggtcggtgcttgcgaactaaatgaatttccaaaaccgcggaccggggaacgtaccgggtgtacggtttcccgctctcgcacttaaggaccgattccttggaatttcatccaaacataagacaagtacgaccacatgggtggaatgggacacccctggctgagtaactagcttatcaggggagccttgatgctgagagacatgtggattcgccggggtggtgtcggggaggacccctgggctttctggcacagtatggtctgggacctaacctgttgttggtctgggacccctctcgtcggcatatggtaaacctgtatcggctttcgaaatgccttgtcatgaaagcttggaggtctcccgacgtggctgatccccacggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgttgtgaaaatgggttcgatgtttggaaaatcagcagctgacgggatcagctaggcccgggtggccgtttgaaaagttgttggcccgggtggccgtttgaaaagctgttggccgggtgccaaccttgtttcaagatctgaagactgatacattgcacatactccgaccggacgagacgcactgtctcattcgtgtcgtttgagaagcactcacctagttattttagaaaaagagttcaaataaaatcaattgcaaaaacaacagcctttccttgaagcctgcattaaacacttatttcccctggcttgctgagtactcccgtactcacccttgctctatataaataacccccccagttgctgaagaagatgaaccggatcctgc

SEQ ID NO: 82610 - DNA, 79142 bp, Oryza sativa
cggacggaaaacgatcgagaattgactgaagtgttaaaaagagaacggggtgaactttgggtgctattaaagttaaccggcatctttcggtactataaaactaaaaacgtgaactttcgatgctatataaccaattttgcctaattttaactacaaaatttgaccactcttattattttaaaaatatgtaaatattatttatttatttattgtaatttgttctattacacaagatactttaagcttgatttatactttttttaatttacactaaatttgtaaataagataagtggtcaaacttgataatcaaagttaactctgtcagatatttattaccagagggagtacttccgtttggagaaagagcgccgaagattttgtttcgagcgaaaaatatcgaaagattagcaaatacaatacaagaaccatacttactagccaacctagtctggccaacctggccaaggacagaagctttgaagtttgaactccctagctgaggaggatgtggttggcagtttcaggcttcatcttgtccatcttacgtacactaatgcactctgtttctccattttgcacattggtcaaacttctagttctagcagaaatcaattggtgatattcaaactctgcttccggaagaggtagggaggcaatgttgtgcttaatatctattatcaccaaccattagattcccgcatacataacgcatttcaccaacccatttgggttctcacgtatagccatctcgcattagtcattcttcagtacttagtagtattaggtatggtggaggaaacaaaaggtgtatcaagtgggatgacgtaaggttcgattacatttcatacatctttgatctttgaaactaattaatttaataatgagggtaatgcgtcaaactaataacataatgctttaatggcctattttggcctgtgtctctctctgtattgctttatgtaaaatagaacgagaaacatgtgacaacattcgaattgtgaaagttatttttttaattagacactttggtttgatcgctgacgatggtcaatggatataataattatcttttcgaggcaatatgcttccgtacgtcagggtgcccgattcatggagatcacaggagtagcttttggttcatcatttatgggattattgcccacatttggtgagataaattcatttctcataaagtctggtaaacatcaaaagtccagtaaacatcctcatgggcactcctatgctgtcacatgtcatgcctcgaattagaaagaaattctttaaaaaaaaggtcataagtttcatattataagacactttaattttttaattaaagttaaacttgtttaagtttaattaagtttatgaaaaaaatgtagcaatgtctataacactaaactatttttattgaataatctagcattgaaaatattttgatggtaatattttgtgttgaaaatagttttcttttaaatttgatgaaacttattaaagaagtctaatataaaaaaacaattcaaaacgttttacaatatgaaacaaagagagtggaccaataggctaattattttaaatcattagatttatctagactagaaaagatccaaaattcgatctctcacctcacccacccttccaaagcacgcacccctcccctctgttcccccatatcattccttttctttagctatacagtagaagtagttagtaagatgcagtaagccaataatcatcacataacaaaaacaaaagttaaaacaatcacaatttttaaattgttattgaattttctgtccttctatatcattgtattcatatcacggttaaaattaacagttcaaaaccagtattaattatattttgacttgtaaagacatatgttatattcggtcagatcttaacccttttaacatatgacatccaaaaagctatagtaaattacaaagaaaattgaaattagacgttaattatcatcatatatcactttgtaaaacatgcatagttaaattagatttacaatatctcgaaataaaatcacaaattgtgagcaacattcaaaagatatatattctctatgttatttttgaggcagagcgacctcccgagcaggttaggtggccacccgagctccactgctggcaggggcggatccaggaacaaaaaaaaaattgaggggctcaattacacagtttttttaaactccagtcatatagggacctttagtttattattcatggtgaaaaaattgaaaggggtgctccaggggtatccatgggtctggtgtgtagaggggactcgaatcccccctgcacccacgttggatccgcccctgactgctggcgtctcctttatcaatagccgtcgacacctataaaaagttaaaaactagtcaatcaccgaaaaacactattagtcatccggatttaacgatatcgctggctctgccactagatgaccctttgcatcattgcatgccatcccaccaatcataaaaaattatcaccatatcagttctcaaactaaacaagcccttaattaattagttgctaacgggatcacatccataacacaaatgcaagctgcaaatttttactatatctttggtatgtaatagtagactgcatatacagtgaatctctgcgctgtcgttagtgtgttcaaaaaattgaaaaaaaaatacagcattgcttatctttcctttataaaaatgaaaaggagaaaaaaaaggaagatggtgcacacaggatgagttcataaaacactccagtttgcaatcaaataagtatgtatatctatgggctaattagggtccctgtttttgaccaaccgctaattaagaatcattgtaactgcaagaagtgtcagcaaatgaaaaggacgcatcactaatcccaccaacgcggcgttgactgaaggagcctataaaacctgctgctttatagtagttgattcactagttctcttttcactcccacccttgtctgcttggcggatgtcgctcgtctctgataacatggcgtctgggtctattaggccgtggtttttctgtccactggttaaatgaaggaataagtccagtttgagtccctcaaatatatgttagatcttattcttatccctcaattgtaaaaacaggtataacgactccctcaatgttaaaatcatgcaaaataactccctcaatggtttttagagcggtttttgttgacatagagtccatgactgacatcaccaccgcaacagcatggacaattaggtagctcatgagcttaatttacttgcactcgccgtcgccaggggctgccacatctcgcaccacggtggatgagtcgtgcggattgttgtgatcgtgttgttgcttctctttctgagcttggtttcagctttcaatgggcaggcaaccttctcttcacaattctccatctaactctcctgtggcgccggttggaatgttgtcgtgaaatccgattcaccatagcgcacattcatcccaaacgatggcaatctattaggaaagttctcccacaacgttaccaggttcagtaaccccgacgcgagccatttgtacactctttagccacaatgcgtgtaggcacgagcaacttctcatactggcttggctacctgccaccgtggtgcccgacgacaacacaactctagtcctccgccttcacttcttaccttacgcatcacaatcgggcgacctttccacggcactgttcaacgtctccatcatggggaggtacgtcctgcattcttccttcttgtcgtcgcgcactggcgcggtgagggagttcatcctcgcgtccgatggctctggtgtgggtgggcaggaacgaaaatcgttgggcacctagtttggtgcgtcccaccgcttgttcttcacgcttggcatgattgtctgccgccaccgatcgcttactgtggacaccccttgtcaccgacctcccaccgtcgatgtcgcctctcatggatgagctcgtcggtcatcgttcctctccccgccaacgaactcctagggaagagaggggagaggtagaggggtggggaggagaggggatacgcgagtagaggttgaagtccaattacatgtgagccccacatgttgtatatttctttttaaacgactaggataccacgtcaaccaaaagaaccatccatactgttatgggacctaactcgagtggctttgtcaagatgattggtggaaatttctagtattgcggtttagttatatcaattaaaatcgacgtaaagatgagggatggcaagtggacttactcccaattttctaatccaaattgtgggttgcaggcttgcgacccacctaaatttccattcgctaccggcctaatggaccagaaacattcgtagcccattcaaaacaaagagcggataatatggtgccgtgggccaatttagtcagattttaggatagatcgcaccctcccaagaaagcccagcgctagtatagaccaaaggttgcaatccaaactatagtgggtttttccgctcaaaaaacgaggtccacctttgtcgttgttgctgcatgctttgacagtatggttagcacggtacttccttcgaaccaaaataaaatatactccctccatccaaaaaaaatcaaattcaacttctaaagtttaaattttatcaaaaaaaaaaacttctatcattctacccacccttagcacgtaaaacgagaatttttttcccttcaataccctttatctacatcactcttactatttttttcaattattaagggtattttagtcattctctatatccactaattccacctcgggatactaggaatgtattttttgtgggacggagggagtacttccttagtcctaaaatataagcgattttggacgaacagacagggaggaaatgtctcatccttctaaaatctcttatattttaggacggagggagtttgacgcaactgccactaagctaaagattaaaaaaatattattatatcaccatgatatacaccacatacactaatggaattagatatgttaagggtggagtattttagaaaaataaacttataggaaaaaaagtattagttaattgcatgtatatatatacgtgtcttgtattataaaacatcggaaaaatggttgcttcttatatttttttatatgggagtactattttctccattttaaaatatactgtactaacctaggatctaaatagaacggaggtagtaattactttgatgcggttcattatgaaatttgtcgcatactcactgactcacacgtgctatttattgatgtgtattccctctgtccaaatatataaaggatattgttctaatattttatctaaatatataaggaattttgggatccctagacaatattttatcttccatccatcaactcatgtgctagtttaaataccactccaacctttacttttacttgtttatttcctcaatgatcaccatcttttgtcaatgatttgacccccttccactttcttaattctttctaaaatagcataatcccttatatatacgtacagagggagtattcattttatccattacggtttctgattctttgctcgccgtaaacggctaaacataaccgggcatataaacaatactgtactaacttcgtcctttaaaaaaaatctagacataatttggccaatcctaatcatcagccaataacacccctatctcgtgttttgtttaatatcaacttattgccctaccaaaattttagtaactttaataatagcaagtgcatatttggtttgttaccaaattttgtccacaatagtttaaattcaacactacccaatttggtagtgctaaaacttaccaatattttggcgctaccaagattttggtagggcaaaaattgacttcaaaccaaacaagcccttacatatcgaagtttattgttccctgctccctgtgcgcacgcatgccatcggcggtcctcggtgtgccggtcacccagacgggtaggccttgtgcaattgtgcaggtaggttacatgccggttggtgcagttgattgtataaaagattgtacacatttgtagtactaaatatcatatattatatttaattttttataaggacagagtaaatactttttttatataaaaaaacttaatagaaaatataaccccttctatatagcaaatctcgataaaaaagattgtctattttaccaggtggggtcatcttttagttcgatttttttttaaaagaagggagtagagttaatccgtcgtagtacagcgcaaattccaagttatcacgtctcattgacctccacgcttgccgaccacactgctccagtgctcagtcaaagcactgcctcactctcacccctctggctattctcaacaggccaatcagaccaaaaaaaaaaaaaaacactgacgtcgatctgatccaaacaacgcgcggaattaattgagcacacacggagaaggagatcggccggctgtttcccggcgcatatccatccacccgaccgcgaccagcggcgtcgtcatcacgtacgcggcgggcgagtggatgtggatttggctgcgctgcggtggtctcgccgaccaatccgtcgagcagcagccgccgttccaaaaaaccggataataagcaagctagcaaagcaagcgctggcggcttggaagggatacttcaccgatggtgtccctatcgcattcttcccacttgtcgcggtttatggtggctcgcgcgcggttttgccgcgctgctcaggtgtcgggtgcagtggattggatccgactctttcaccgggttaattgcagatttgagtcaaaaatgttcacctccactagacaggaaaccacacacccgggtttctgcgtactttttctactgtatatttagagtctcatagtaaataggtaatggtatctcatggcatcttcttaagaatcgtaaaattgcttttatttagctagatttcaactatggttgtgtttagttcacactgaagtttggaaatttggttgaaattagtacgatgtgatagaaaatttgtgtgtatgaaaaggtttgatgtgataaaaagttagaagtttgaaaaaaaaaatttagaactaaacatggcctatgcacaacgggatttttcctgtgtttcaggagtagggagtactgtacttgtgggcatgaattcagtgcgaatttggccctggaaaaaaaatgaatgggaaagaaaggagcagcagtaaatgcggcgagaagacgacacaggatgtgttcggatacgacaaaggggattcattacttcctcgtcgtattgtcagattcgctgtgcttgagccattccagaagcttccaaacactgcgatctcgaagcagagcgtctccgctcgaggtaagcagcttgccttttgcaacgaaacggtttctagaagccacgaacattccaactgtactgaaacaaacaaacacaagctgcgaaaaggcgtgtgtttgttacaaacacacactgtcatttgatcaaaaatttcaaaattgatacactcgtttaaccattttttttcctcgcaaaagttgctgtacaaactcgaactctgctactcacacatatgtgatatgtacatagatggatacacaattatacacggaatttagtttctgtaatacgcttcagatttctagaaggcaggcggcctggacgtgcccggagaactcgggcggcgccggcgcgcgcgcccacgacgcgggcttgccggcctcctcccgcagcgtgtacaccgtctggtcgccgccgtggcagtcggacccgatgaccacgacgcggccgtcggggatgacggaaacggccgccgcggtgcgcgcgtcctccggcaccggcgccacgggccgccacgccgcgggggcggaggagatggcgccgtggcgcgccacgaggtgcccgtcgcggagcatgtacatgcggtctccggcctcgggggcggcgctgcaggttctcgggcacgcgccgtcgtcgacgaagccttcttggacggcggaccaggtggacgtcgccgggtcgaaccactcggcggagccgacgaatcgcccctgcgccggcgtcgggtacccgccgacgaccaggaacttgccgtcgacgcagagcccgcgcggctcgtcgcgctcctccgccatgtcggggagcgcggcccacgcgtcggcgtccgggtcgtacgccagcgccgatcgaagggcgttcttctcctcgtcgtggccaccggcgacgaacaccttcccgccgacggcggcgcacgcgaagaacgaccggcgcgggcccggcatggccgcgccacggcgccacgcgcccgtgaggaagtcatacacgagcaccgagtccgtcggcgcccacgtctccgggtcccagccgccgacgaccaccagccgcttcctcccctccacaccgccatccaccgccgccacctggcagaacagcggcaagctcccactcgctccacccacctccggcagcggcgtccacctcccctccgccgggtccaacagcaccatccggtacgagttccccggcacaccgccggccgacgactgcttgtccgccgccgggcccgcctcggcgagctcacgccgcgcctgcaccagcgcgagcgccgggcgcgccaggccctccgccttcctcaggcggttgtacgccggcgactccacctccgccttccactggcgcgagatgcggcgcaccgccggcagctggtcgaaccccacccggatgaggcactccctcgccacctcctccggcaaccccggaatcagctcgttgtaacccatgatgctcaatcgagctggaattcgagcaagaaatgcgtgagatgatgatgatttcttggcttctcttctcttctcttgtctgagcttggtgtgtttgatgtgttttgtgtaaggcagagtggcgggagtggcatccgctacttatacaaggggaaagaagggaacggactgcggatggagggatggatggattgcgtgatttttttggggggtttatgtgggccccgttgcttgcacggctatggtttatgtttctttcagtttggctttttctagttttttttttgactctgtgacgtgtaaaattgagtagattagctcttttgagactaatctaccagtagatgatatggtttgttttattttgggagactctgtttcgggtaagaatgccacatcggatgcagtatcctttttatgttggccgaggtaaagggatgaggctgtttgtgggaattgcctgtttgtgtggaggtttatctcaaccgtcgtcatgcttagttcaacttcgtttggctaacgaactgcttagtactccactatacgacatggaaactgttgcttcgttctgcaatctgcaccaggaaaacagcaaaaatccttcgtcgggtgttgccaacttcacaggaagtaaaacaagaacgacatgacacgaccattacaattttactagtagtactgtacacgcaaatgcaacaaaagaccgagctgttatagttctacggacacctgtgccaacaaattgggcccacatgacctccaaaaatccgtgcgcttggatttggggattccggattccccttgtcaccctcctcacactttccgccggtcttctacaaacacacgtactagtagcaataagagtagtaaacacgctctgtgcaatcatgtttccatatttcaatttcactactgctactactagtagcacggtttttatttcggttagcactgtctcctctccacgcagtcgcacacgtgtagggctcagcgcaggtatcgcgcgcgtgccgcccgtggagtcgcgccactgaacaggttgatgtgccgcgtcccgtgaagctgtatacgctttgcggcgagccgggtgccgtctctgaacgctacggttttctctcctcctggccacacgtcggagactcggaggctcattattgccgaagagtgtgcacgcgtcacggcgtcaggagcagaagccgccgcggccaagctaaggtcagaccgggttcggcctgcctccatgaacgaacggatcgatcccgcgatcgagcagccgcgcggccgccggccggcgccacacgtcaagtccagcgagccggacggcgcgtgaacgtgcttgctgccgaactagcggcgtcgtgtcaagttcattgctaaacgccgggaccgggaaggattactatagtagtactaggcatcatgaccacaccgagaattgtttgctgtgcctgtgctgtgcacgcagttccgctacaccacgcgcaacgtcgcgccgcccccgggatttttagcgacagcgacgtacgcgagattagactattagagagcgaaagaaaataaacgggaggagaaaaacaacgggtgggtttctccggtgatccggacagccgcctgcctgcatgcctgcctagttgccctcgcagggcccggtagtaacgcaagtggaacggaatcaccgcgcgcgcgttcgcgggtggtgtcgggaagtggtaagccctatccgctaatcccacctcgctcgcgctgccttatctcgtctcgtctcgccacgccagggcccaggggccccccgcgtctcgcgcagccggcctcaccctcgcgattgattctggctggctctcgcgcgcgcgagcggtggggaagggtaaaaaagaaaaatctggaggcgcgcgacgaggcgtcgccgtcgtgggcgggggaggctgtgacgattgacgaacggtggcggagcggtcgctagctagcttgccacgcaatcgcgcgtggtgatgcggcgcgcgcgtcggatcgatcgaatcgaacggcggcggcacagcgcttatgtatccggaattccggatccaccatacggcctgacggtttcgatacggctctcccgctgttttttctcttcgtttttttttatgacgggagtgtgctgggagcctgcgatttctgtctcttgccacgccattaagccacagcaatcttttctaataactcgcgtctttttccgaagtctagcttaagtaagaagcgtattcttagccaacatatggaattatggataacgcttggaagaacagaagccttgctgccgtcaaaccgaaatgggagacgagcttgggttgccaagttgtttctagaatcattgaaccagctagttcgaaataaagaacgagttcactgagtgatattatctggagtccgttggtctcaagtaagacaagctgactgcagagtatgttaaacagagcaagcaatacgaactggcaaacagagtatggctaacccggtggtgttgattagtgcattaaccaatatcaaacattatgggacgtgggtatgctaaaaaatttaaaagacccaaaacagcgatggaatcaaaaaacgaagatgtcgtaaaagacgggctcgcttggtcgattcaatggtcgtcatctccatgaccatccaaccgtgtgattggtttaaggggaactggtgaagagggaatgaaagtttgaggttatgtaggaaccagaggcggctgaacctcagaatgtagtggacggccccgctcgttcgcgggtggtattgagaagtggtaatcctatccgctaatccccccgacctcgcgctgccttatctcgtctcgcctcacgctctcaccaccacgcgcccgtgttggcgcgcgggggaagagaggcgagaaaaagaaaaatctggaggcgcgacgaggcgtcgccgtcgggcggtcgggtggcggagcgcgtggtgatgcggcgcgtcggggtcgatccgctcggcagtgcgcctgccggtttcgttacgactcccgctgtttttctccccttcgttttcccgtttttcgatccgttcctagcagcgtgccgcccctttccgttgaaagccaccgcaaacctgcgtcgttttcggaggattagcttatgttggaagcgtattctttagccaacatatggataggcttggaagaacagaagctagctgctgtcaaagctaaaacaagagagcgtcctaaggtttgccacgttgttcataaaatcgctacagctcaaaataaagaatgagttcggtgagtgacaactgcgaatccgttggtctcaagccaaacaagcggactgcagaagtgcagagtatgtcaaagtcaaacagagcctgtttagttttaaacttttcctttaagctttcaattttttcaccacatcaaaactttcctacacatacaaactttcaacttttccgtcacatcgtttcaattttacctaaacctccaattttagcgtgaactaaacacacggggagtaagaaaaaaaaccgtgaagcagagtatgttaatggcttctacatcggacggcaccaaattcagatttcccaaaaaccgtatagtttcaaaaactaataagaatatcgtacccggtaaacatgattgccataagcgaggtagaacttcatcgtttggcctaataaatcaaaacaaaagccaaaatttaaatttttaaaattaaatttaatacattttcaacttaattcttttaaacattggtttttaagtcgttacgaacaaatatataaaagtttaacctagaaattaacttttattttctaataaactattttgccttattagaaaatatgggtaagtaatgaggctcgtattcgcgtgatattgcaaactctgaccctatgccaatccaaagtaaagaggtgcatcaaactcagaggatttcctttcctcactcttgttttatgaagctctttctactaccacctggaacatttggaaggagaaaaataaacttaaatttaagatattttcaacttaatttttttaagtattggcttttaagtcgctacgaaggtgtaaattgatggaatcgagaaaagaaggtgtctcgattaatggtcgttgtctccttcatccaagcgctctacacacggggcgacgctaatgggcgatcgatccccatcccctatacgctcctctcccccttcctcctccccttcttctcttcctactacaccataatttttttaaaaaaataaaaaatataaagttggaaaaaattatgtatagaaatactataaataaaaaatatttgaatttaaattcaaatttgaaacgggtatgtaaacttttgacttataaactttgggtctataaactaatatttgaattcagattcaaattcaaatttgaatcgggtatgtaaactttgggtctataaattttaggtgtatagaaaaactatatataaaaaaatgtgaattcaaattcaaattaatatttgaattcaaattcaaatttgaatcgggtatataaacttttgacttataaaatttgggtctataaacttgaggtgtataaactttagatgtatagaaatactatatataaaaagtatttgaattcaaattcaaatttgaattgggtatataaacttttgacttataaactttgaatctctaatcattaggtgtataaactttagatgtgtaaacttaaggtgtacaaactttaggtgtataaatttactaaaataggaaagtaatgcggtgtcaaaaaagaaagccagccatatggggaggggtgatcgcccaggtaagggtgggcagaaaaagaccaaaccgaaaaaacggagaccgagaaattcggtcagtacttcggtcttatgtgctagatgaccgaattttattcggttaattcggtcatcaccctcgattaaccgaattgaccgaatttcacagaaagcccaatatcagcccaagaaagcaagtccaacattaataaaaccctagctccctctctgtttccttctcctcatccacccagccgccacacccgagcgctcctcttctttttaacgctctccccacctgagcgctcctcgttttctctcgcacatcggcgtcctgttccgtcgccggtgcctctgcacgactgcagcgtcccagcatctcctcctcctcctcctcctcctcacaagtgacaccacgacgacctcctcttcttgcgtggcttcagtggacacccaggccccaacagccaagcccgagccgcgtggaggctccaccccgggggcacatccgatggtgcctcctccactccgacggcgacgagcggtgccaaagccgatctagatgagtatatgatagtgaagaaagctgatctaggatttttatgaattttcttgatgtgtatgatttttttggatctgaaatttattgaggatttgtgcgattcttctgaatatttctaaaatttcggtctaaccgagactgagaccgaattgatcggtcttcaatatttttcaagaccgaacggtcttgcactatagatgaccaaactttcaaaaaagaccaaagacctaaaccgaatttttggtctgaccgaatgcccacccctacgcccagggcgatcgatagcccaacaggaattttgctacacacgaccattcgatcacggcccgcagccgaagtggtagaaccagcgtcccgcggcgccgctggtgggttgagccgttgagcgccattcggccgcatgatgggcaaatggtccggttaagctttggagtccatcgtaaacagccaagattggatcgctaccaatgggcttacgcgtcgtaggaggctcatgggctgaacaaacccgcgccgagaaaatgagtcggatataaagcccaaacattccgtgagatggtaagtttcggcatgtttaggcatcccaggtactacaagtttgctgtgaaaatcatacatttaactcaacctcagcagctaatggctcaagaactgatgccaccttacccatgtccacgccttccagtgttgctggcttccactttggtttctacagatctatctatatctctattgctggctttgtctgccagaatcagaaaatttaatctttttcaactagcccaatttctagtagaaaaagaaatttggctatacattcaagagcattctactgattcttttttcaaattccagacacacatagccactccgtcacaatttcggcgtcgcaatgcttttcacaataacttgtgtcattttctgaagtttagcttaggtaggagccattatcttagccaacttatggataatgcttggagtaacagaagcttagctgcagtacttttgcacaaacgcctcatctactgtgaaacaactttgttggtctcgaaccgggaaggaggctccattgctgctctcaaggcaggcaaaatttgtactgtgcaaaccagctttgtctatcttcctcagaagcagctgaagcctgaagatgaacaaaaaattcttggttacgcagcacaaagggaaggagctggcatcgaacaggcgcttgcttgttggcttgctgtggcatcgggtgcccagacatggaccatctcgaacgaagcgaacagatgccgatgccggcatcccgtgcagtgccaggggggcttgtctttcatcagagtaaaggtgcagagcagaatggaatcaaaacgaaagcttaagcttgtgctttgccactactattctctgcgcattgtcgtctctttcgttcctgcacattcttggagattggtggcagccggggatcgtggacgatcgaagcagtgacattctgcgctctccggccgctcaatcgccggcgccgggggggagatcgagcgatggagtcggtggccgtgaacgcggcgcggcgggtggtcagcaaggcgctgagcccgctgtccggagggttcgtggaggcgtgggtggccagcaaggagctcggccccaacgtcggcgccgtcaagatggagctgctgtacgcgcaggggatgctcgacaacgcccgtggcaccggcggcagggaggcccgcagccccgcgctgaggcagctgctcctggagctgcgtggcctcgcccacgacgcgtcgacgccgaggacgtgctcgacgagctcgactacttccgcatccaggacgagctcgacggcacctgcgaggccgccgacgagcacgccaagggctgcgtcgtccacaacctcttcctcaacactcgccatacagccctcagcgtcgcgagcaacctagtgctcctcccgtgcgctggtgatgatcaccctgacgctgacggtcggcggtcgggagaagacaagaaccgtcagatcggctcctcgtgtgctggtggtggtcaagtgatgaaccgtcagatcggctcgtcgccgtcgcgcactctccacgccgccgccgacgaggaggctgttgccagcaactgctgcatgcacaagctctctcccagtgctcgcggcaacacccatcacatcggtaaacactttccatgcctctcttttgcaccttaacatgacggtacggtggtgataactctagagtacaattcaattctaatttatacttccagtatgacgacctaacggtgtagattgattccttttccctatttaatgagtaaaactttttaaaacatttttttttgaaaaaaaaggcaaatatgtctctctgggtaaacaaccagattatagtgaagaaataagtagtgtggctctatcctttcccgctgatcggagttgcgtttagccgccatagtaaacctagctgcagtttttgttttgtttttttctctcttccccccttggcataagcctatatagctgattgcattgtgtaataagaactcttttccttctaatatattgacgtgcaatctttttgcgcgttcgtgaaaaaaaaatagtgaagaaataaagaacacaccctgctaaacagcccttgctcttgaccatatatacatcagctcgtcgccgtgtctagcaatgagccgtgaggctcggccaaaaggacgagcgcacggcgagcctgccagaccgccgcgaacgccaacctcttggccgggctcagccacctcgctgctcgtcaaatcgctctagcaacgttcttccctagtgcacgatgagatccagtactaaatactcctcccaattggattaaatataaactataaattgctgtaaaatccatctctaattttctaccaaattcctaacatgcccttctatatactgctaggatattgtactgtacaagttttctaactctagcgtcatgtgcacatgcaggaagccagttcctccgctgcacctgttcctgcggcagggtattgcagagggaggatacgatgaaaacaccaaagctgaagttcgatagggtggatctgtcccaaagaatgaagcgcattgtcgaacagctgaagccattgtgtgccaaagtctctaccatactcaatctagagttgttggaatcaaatcgcagcattggccagtacattgccatgagtctcaatgccgagttttccaagaaaccagggcatgcacctgttcttccaagcggttttgctatcagtcggcctatgaccacttcagagtttacagatcctacagtttatgggagaatggatgaaaaaaaatacaactattaaaaacattactcatggtgattactgtgacaaggacctgaccatcattccaattgttggtccaggggggatagggaagacaactctcgcacagtatatatacaaagaagtacataactactttgatgttaccgtctgggtttgtgtaactcccaatttcaatgtgtatagattgaaagaagacattgccaagtcgatccctcaactcaaagatgagaaaaacagtggtccgcatgatttgattgtgcaaagcttgggatcaaagtttttacttgtcttggatgatatgtggaattgtggccacgaggatgaatggaaatatctattagcatctctcaaaaaaggacaaaccaagggaaacataattctagtcaccactcattttctagcagtggtagaaatggttaaaacaattgatagtccaatacaactaaaagggcttgatcctcaagagttttgggaattattcaaagcatctgtgtttggtgatgagaaatcagcaaatgatcatgctaatttacttgagactggaaaaatgatatcaaaaaaatctgaagggttcccctttggcagcgaaaacagttgggaggttactgaaaaatcaccttgatttggaacattggacaagtgtcctggaaagtaaagaatgggaattacaaaccggtgagaatgatattatgccagcattaaagcttagctacgattatctcccttttcatctgcaacaatgttttacatattgtgctatgttccctgaagaccataaatttgctagtgatgagataattcacttatggataggactagacatcctacattcacaggatcaaaacaagaaaattgaagacattggattgagccgattgaatgatttggttagctatggattttttgaaaaacatgtagaagatgggtcttcatactacgttatgcatgacctactacatgagttagcattgaaggtttcatcgtatgaatgtcttaccatatgtagttcaaatgtcaaatctatacaaattctaccatctataagacacttatctattgtggttgatgacatggacgtaaatgatagagtgacttttgaaaacatcaagaaggatttcatcacattaagtaagagactagatgttggaaaactgcactcattgatgctatttggacaataccatggaagctttatcacccctttcagtgatttgttaagaaaagcacgtgcactccgcatagtcttgttgtctatgccatcttatgctatagtcagtatgttgcataacttttcaaaacttgtccatctacgctacttaaggatcaatggaggaaaattttcagaattaagtctacccaacatcatatcaagattttaacacttgaggaaaattttcagaattaagtctacccaacatcatatcaagattttaccacttgagaatccttgatgtacgacaatgcaagggtcattttggtttaccaagagatatgaataaccttgtaaaactgcggcattttgttgtccaagatgataaactctactctgacattgctaatgtgggtaagataaagtgtttacaagaattaaggagatttgaggtcaaaagacaagttaaggcatttgcactaagccaaatagggcagctggatgagctaaaaggatcgttgggaatttatgatcttgaaaatgcaaaggcggcagaggaggcaaaacttttaaacaaaagtcacttacacaagttaatattagattggaatgttaaccattctacaaaggattattcacaagaagaacatattcttgaaaatcttagaccacatagcaatcttcgggagctacatattcaagggcatgggggtaccacttgcccttcatggttgggtcctaacttatctatcaaaggtttgcaatcactttgtataaacggtgtatgttgggacaagtttccacctctaggggggttgtggttagttaacaagcatggtgaaaaattcctggcttgtgcaagtggccgcagcttccagtatttaaaaaggttagagctagttgctataccaagactagcaaaatgggccggaaatgatgcttgttgtgtgctctccctgttggaggagtttattgtaagagagtgcccagaactcatagagttgccattttcacattccacttgtccttggtcaagacaggagatgaacttgtctcaattctccagactacagaaccttgagattgcaaaatgcccaaagctattaccattgtctccccttccttggacaagctctccatgccatgttctgattaaagaagttggatcgcattttcatctcttggattatcagagaaacaaccaatctgaacaagggttacaaattgagggaaaggatggccctctggatagtacattctggaagttattggctttaagtaatcttacagaactaagagagttgaagatgaagaaatgccctcctttgcctctcaaacatcttaagttgctatcagctttgaggaggctctccattactgattcaggtattgccttgttgccgactgattgtgaaagcacagtcacatatcattttctagttgagcaactcgagatctatgagtgcagtgctagtgggatagaaatgacacaactgctatcttatttccccaagctcatgaacttgagaatagaaaaatgtcaaaagataacagggcttggtgtggcagggcaagagatgatggcaacgctagcatctccaccatcactttcttataataagtctgaggatgcacagattgggaatgatcagcaacaaccaagaggagacaatggaatagcatcggtggttacaggactactgctcttgcctcaccaactacagaacttggacatcagacactgctcaaagctgatcctgcagctcgattcatttgtaggcgacacaacacgcaacctaataagaggtgtaggaggaggattacaatacctgcgctccctccaatcattgtgtataaagcattgtcccaattttctctcctcctactcaccctccttgtcttgtttcccatttccatcctcccttcaagatctggctattattgattgtgtgagaggcatggaaactctggtacaaaacctcagctctctcactagattgtccatatgggactttggggatttaagaagcgggagcatgtgttccctcctcacccaaggccaccttagagtgctggctgtccataaaactcccgaattctttgttgggtccaagccatcggggctgcaacagctctacatggatgacatcgtaggggtatttgttgagcctacttgcaggcttctctcttcatcactcaccaagttaagcttaagcatgaaccacaaggtagagcgcttcaccaaggagcaaaacatggcccttcagctgctctcctccctcgaggtccttatatttgtgcaatgctcgaagctgcagtctctccctgctgggttacatagactcaccagtctcaagagattagagatcgcatactgtccaaacattcattcgctgcccaagggctgttttccgagttcactagaagtactacatgtttatgaaagccaaagcgaagagctcaaaaggcagtgccgcaagctaaaaggaacaattgcaatcatcgaagatgaagactacttggaactggtaacaaatactcacttatttgacttagcccagttcacgttttgtttggcacaacactagtatgtcatagacgagcgcttaacatttttttttcaattagcgtgggaacttgtgacttttctagttaatatgggagctcccaagcttctagaaatagagttatgtgagaagtacacaccaaatctatgcatgctgagcttaatgaaagtaatatggtcagaaaacaaatatttacagatcaatgtatggacacaggatgctgaattgatcagaccaacttgatcacctatttgtcatatgttttctgtcgagcaaagactccatcaagtttgaaaggttaaattcaaaatgagaacttctccatgggaataattacatttaactagaatgtgcactacttatatgtaatatgttcctctgttttttcttgatcactacttctggcagtttattagcatgcaaatctggcagaagtatcataccatacattaagaaatcatcaaattatgagatctgtgaagggtgtaggttaagataatagtttccatgttgctatatttgagtctctgcacaggcttcatgtgttgatgccatggaattagaaaagtaataaggaacatacttatacatgattaatggtcctgctaattgatcaactctttgtgggtgctaatgtcgtgctcgtaactatcttctctaaccaaagtatgtatacatttggtaccccaagttttgaagttcttggaataaccggaaacagaggtagccttttgattctttcacagacaccactggtagatgtgattttccaagtatgaaatcgaagactcaatgatgacttacttgttatatgatctttgaacatgattctttcaagtatgttctttatatgttcagctacctgtagttgctgcatctaatttaatagagaaaatctcctgtgtacgtttgaaagttcacctaatcccttctgtatccctgaattttgctcaatcccttacatacccctgaattttagtttggatcccttccatgccctttccgctagttgaccattagttgactattaaattcttatgaaaaagtccattttgccctttggtataaagaagcatataaattaatagagtatattgttgaagcatagaaatttgttatatgagactactatgtttatgagatagttatgcaccatattatttgcgataaatatacttttagatatgatataaaaaattaatatttatttattagttattaaaagattttttagcatatgtgttttgatagtaataaataaatctgttgtattactataaaaacacatatgctacataaaagaacttttaataaataataaataagtattaactttttatatcatatgtaaaagtaaatgtcacaaataatatggtgcatcacatactcataaatataatagtatcatccaataaatttttacattccaacaatatacttcattaatttattatgtttcttcatagcaaagggcaaaatggactttttcaaaagaatttaacggtcaactaacggtcaactagcggaaagggcatggaagggatccaaactaaaattcaggagtatgtaagggattgagcaaaattcaagggtatagaaggaattaggtgaactttcatgcatacataggtgattttctcaatttaatactcagggtggccatgcaccatggacagagatgcagaatcaataatttcaactcaagaaccttttatttttactgacaaaggaatgcataaaaaacaagtatactcttttttttcaacatattataagttctagtgagtgtttaattatgatagacatcatgttgttggtgctgtttatacttatttagttggatgcataggacaaactattatttgtaattacaccgaataaatatataaggctgccactagtcagaacacaatataaatgttacacctgtatggtgataaataggatggtcttaattccgagatgtgatgattgatgatcgcaagtagtaggagatttccccgcacaaagcaaattttgcgcgtgctaattgaatcggatttgttatacaacttttagctcatgcttacgtatatgcaattatatttaatatcttaactaattaaaacaatcgtcacctcgtccgtgcgctttttcatccgtccaccccccccccctcaaaaaaaaacccagaacacaaatacgagtccacatcaaaatctaaattggacccaaatcatagagaaaacactactacaataacacaagaacaagaacaacattaacacaagaacacaagaagaaaaggggagaatgctgccatcgccgccgtcacagggacacatggacatcggtccgccgccagcttccctcccgctggatccggcgaaggggaggacaccgccgccgggtcgccaccgcctcccctcccctcccgccgtatctggcacaccgggccgccgccgcctcctcccccgctggatccggcggaggggagggcgccaccgccgccgagacaccgggccgccaccgcctcccctcccctcccattggatccaggacgtcgggccactgccacctcccctcccactggatcggtggaggcgagggcgccgtccctgcccgccgcctcccctcccgctagatcgaccgccggtggtaggggagggcgctgccgccaccgcctgtgatgagggaggacgccgtcgccgccgtcggtggtgagggaggacgccgtcgccgccgccggtggtgggggagccgctgccgccgctcgcgggggaagggcgacgccgccgccgccgccgtttgggggagatcgggggcgggggggggggggggtttgaatcctagggttagggttaggtttcgggtatatttatttaggttaggattaatctggaccgtccattcgattggacggctcaagctgctcccacgtcgggctgcctattgggccgccgaatggaggacacaaaatggacatcaacgaagaaaggaaacaggccagaaacttaggctgcgttcgagcgcaggagaaagagagaaagatagttttgttttccgcgcgcacgcttcccgaactactaaacggtgtgttttttgtaaaaaatttctataggaaagttgctttaaaaaatcatattaatccatttttgaagtttaaaataattaatgctcaattaatcatgtgctaatggctcacctcgttttacgtatctttccaatctcctcaatcccctctttctcaaacacaccctcagggcacccacaatggttatctatagactctctataaaagatccatgtaagcatatttttctacttggaagagattaaatgaagagagagagcaaagctatctactaacctgaagatagtttatagagaaaaacgaggcaatttattagagagctatagatacccatgtagacatactattgagattgtttattattaatctagtctattgctgagatgtacatgttttatagatagcaccttactttaccattgcgggtgctcttagaatagataaaagggaaggaatataaacttttctatattcggcccaaacctaaaagggaggattttgattcctttttccaattaaataattgttaaatgatgtttgtattatttaaattagcaattaagctctgaaaattccaataaaatttcaaagagtgtaactaatcatggagaatttaataaaattaaatttaaccatgtcattttatttctcacttactttacttgtaaattgatttaattatacacctacctacttaaaaataccaaatatttcagcaaatttgtattttaattaattacataatgtaaatttttcttaacttttcctcaattttttggtctgtacattttccgttgcaacgcacgagcacttttgctagtatacaatagatattaaaagtagggaaaagctggaatacggtgcccccaactgcattcacaatttcatcctgaccgccctgtcacgcacgtgagagggaaaacagaagatttcccctttcctctctactccacgtcgcctccaccgccagttgcacttctcccaccgtcggtgcaagaagatgctcgacatcaaataatactcctgttcgcgtggaggtcagcttccgaaccaccgaagaaatcgatttgtatcggtttttaaagtaaagagatacgttatacctagctttgtggttgagggatacaatttgctggtgagggatacaatttgaccggcaagagatgaggaaggcaaaatagacttactcctaacaaaaatgacaatacattgctagtacttcagtaagtcacaaatactgtaatcatgatattatttattggctcaataatcatcatttttatccttgttatttcttattgcaacataacagggaaattgaagagggtattccggtaccaataatattacatgtttgctgtgaagatcatacatttaactcagcctcagcagctaatggttcaaaaactgattccacctcacccttgtccacgtcttccagagttgctggcttccactttggattctacaaattgaaaaggaaatttagctatacgtttagtaaatatatatctatagagttcatctccaccaagtttagtaaatattatttctctcctctcttattaagacacatcacctcgattatttctagccctttgataattgatatgtggtccaaataatttccctccttttcttctcttataaagtcataccaccttagttttgtctttgatgattaatctatgttactttctttttttttttccttctctcatctagccacatcacgtaagttttgcttttgattgatcaatccatatatgatttaaattgttataaaccacaacattttaattgtttatagctttcttttttaatagtcgatcatagatgaaaattatacaaagtgtagccatcttacatgttatttcgactaatatcatacaaaactccgcagcaatgcgtggggttttatctagttctattaatcctaactctagagacataacaccattagttaaacaaaacacaccacacatgtaactatgtgcctttttatattattactaggtatatggaaaaagaacagctatgtgcctatgtctagcaaggcaaaggagagtgaactttgcaccgtgccacacatgctataatgtctgtatccctctttcccagaagtcgcacagtgcgcaagacatggttgaattctaaggtctacctctactggtttacttcttattaacaactcagagaaatgttcaaactctgtagtacgaagtgttcttcagaatttcattgacagaagtttcgatccattagtggatagctccgcgaaaagtagctcaaggcttaaatattagggagtggcaaataaacaattgattttaaacaattaagcttcttaagtttaattacaagttgaataagctggcggatgatacgccacaaaagcaactatttaatgtgacattcatagtttgtaatttgcaacccatgtgctagacatgtggccctgggacccacagacacaggaggtgtctaattatcactatggagaggcaaatgtcagaagatggatgtcctttgaattatggaaatgtgatcctaaaacatttactatacgctatggtgattataaattgtccgccaaacaatttaagtaatcggagagtaaagagatactaagtcacatggataacttgcctggtccttgtcaactaagacagcacgtacaccttcaacaaaatcatttcgaaccgatgacctcaaggcaattcgatattcaactttcataacaccagccaactgaacaaaccaaatgtcagaattagcaatgtccttgcaaaagaaaaagagaagcctgaaaataaaatagttaaccaaataaaagtattcaattgtacaggatagcagtcataccttcgatagatagtgttcattattcctatatgctgatgcaacttgagaaaaatgtttttgagttaaacatagagaaaatggagccccttttttgagtcctgccaaggcctcgttggcccattctgccactgcagacaacaatgaaaaggatacacgtgcaactagtcagtactaaactgaatttataaaacggtctcaatatagaaacactgttggcacttgtgcataaatataacaacattctcttgacgccttagcttaaaagcagagtacctgcagcatcatcactttgactacacttcttaagctcttccacagattcagcaactgatttgtcaggaccaaaggaagaaatgatatatggtaaaaacttatctagctggggccctgactctggctcgttcttgaactttgtcagcaatgactcaacatctctgtgaggatcatctgtgctgcaaaaataaaaaacacgatatcagatgtcaagacactatcaaacagaattataaccgagttttgaatgtgtcactattattctattaatgaaaaattatggaatttatacttctttaaaagaatggaatggtggaggcagtgaatctgacatcccacctactcccattgtaaattttgcaaattgccccttgaatctaaatggatagccacatataaaatcaaattaagatggatgttccctatagaaaaaggatgggtaacacatatcatggaaaatatgtttttatttattttcagtagcaaagcaggggcattcagctagtagtaattaaaagaacataatgatcttgctagcatttagtaagtttttaccaaataacagttcggaacatacaagttagcactcaagagggattccctgagaggtcccaggttcgctgaaggtacataatgagttccaagaccaaagaaaagggcatcagcaggtgatgatatccttttccctgtcatcccaaggtaagatcctgaaagaagcagaagtgagcagtgaaccgtgttattaaggcggtatggcgaagtatgccaacccagcaccgccttaccgccatagcgataagacgtatggcgtggcgacgccttaagtgcattgaaaaataagaaagtattaagtaatatgggccctaaaaatactaatggggtactccattcatcacagcccagcccaatagtagcacttacctagcctagtccaaatactttgctcttttgacctagcaaacaacattttaaccctacccaacagcttccctcccagcagccgccacctcaccttcatctagatctctctcccccattgtgcagcacggctcctctcctccacctttcttctctccttgtgcacgatgcagcaagcatacaccatcatcctatcctttctctcctctattgcagccagcagcctcctctcctccaccttttctctctcatgtggcacagcagcagcaggtggtgcctctcttgatctccctgtactccccatcagcacaagaagggagagggcgatgctagggaggaccagcagcaagacaacagacttttcccctctgctctcaccctctttccttcagtttatgcctgtaaggcggaggtagcctatggcggaaggatgccttgcccttctgggaacgtcacgatgctatagcgacgccttaataaccatggcagtgaatagaaggaaatgaaaaaggcttttacacatttggagcagcaaataatttaggagagcaaataaagacagagtttagaaccaggttacatatcttgcaaaattgaacaagaactgaataatatgcaatgtccagaactcatagctcagaactacagaacaattcctatgttgtcaagctcaaaatgagttatgatgatagattattaacaaaattagtagcggaagacatggttctacagggttactgaaacaagatagtcaagaatcttaccaacagcaccacctcctggagctttggcaccaatgtaagcaaagccaacgtccgggaacaagccaataccattttctggcatagccaggagcgtcctctgtaacagtagtgcatgcgaacattttgagccttacaattcaaatactgagaatacaaatgatgaacataaaatctaaatcagagttacagaaatttcaaacttgcctcagtaataatgcggtagcggccatgccctgataatccaattccaaatcccattgtcacaccatccatcaggcatatataaggttttgtatactcatgaatcttacaaatcaaagagtactctgctgtgaagacctgaaaacaaataaagtaccttttcagtgatgtaaattttaagaacattttggacagaggacatatcaactacatccattttcccatgcagcagagagaagggggaagggggagggggggggaggagtagaaaatgtgtgctactgcctactaggactaatcatgcctatagccctgtaaacaccatttgttgtgcaataataagatgcaaatggtgtctcagtgctcagcagcctaacctcaagtcatttgcaaaccagctaagcatgctgaatttcagttcccatggtactttaattaaaagaagaagaaactagcatggaataaggttcagaaacccctctacgactgactactaattacctaaagttggcatcaataattaaatatgccaccagagtcatattttagattatttatgtacaaatcagctggttatgaatcatatagaagttgttctgcatagtgtgggggaaacattaagtaatttacaaaaataacaatccatttttttttcaaatgagtcgaaatatgttttgcacaagtgcatgtatacatacatgatagatgtattatgtgaattaggcatggttaatccaaagcaggttattggtcacaagtcataaccagttattttcaaacaagtgcatgcatcaaggagcacaccaaacacagcttgtagtttgcagcagatagaagtgattgtaactgtgttggaaaatgatagtgcttcaaagtgagttggtggcggatcagatggtgttagaaaagaaaaggatacaacagactacgatggattaaacaactgaagtctttcaactgtatgtgcattgcacaacttgagaagaataaataataaatgtcagttactaaacccacagatcagttccttctttctttttatttttatgtgtaatatgaacgcaccaataatatgttttgacaacataatcaaaacccaccaataatatgtgaaaacaatgccagaatttttagatcctcatgtctcagtaggagcaggaggatgtacttgtatttttggatattgcagaatcatcagttaaatttaattatgtgttaaatctcaattattgtttagatgtatcaactacaatattaaactgcaaatcaaaattttcagaaaactatttcaatattgcatgactttcagttcgttatgaacttcatatacaaaaaacctattcagctctcctctcaaattatgattgcaatatcaattccgatatcttatatacactttttcagatacaaagagggcattataatttttagaaaatcagagcaaaatagccgcaatcaacaaaaggttttccatcatgcgatggaaactatctccaggaaagcattaatcatgctattactagacctctattatctctggcattgtgcaatcattagcaagtctcttcacatccccacctgcagtttacactaaacaatatcactatctgagcaaagcaacgattgttaacaacaccgttatactgtcacataaactgttgaacaacaaatagaaaagaaatatgagctttaaaagtaaaatcagatcaaaaacacacatgacaaaggtaaaaaccttttgcacaagtggtgtgctcttgtccttttgaatttctgctgcaacacccttaatatccatccctgcattggtcatgaatcttatttgcaaacatctccaatgctccggaaataaaaaggcgcaaaacagcatgttcaatgtacaaggcccagctttttcaacgaataaaaacagagaggtgatcaccagctgagaaggcacggggtgaactgctttccacaagaacacacttgacacttggatttgtttcccattcatcaagaaatgccttgtatcgaaggtccatttctgcaatcatatgagaccttaaatatgtgagtgaacctcagaaagctaccaatgtactcgatacacagttggtgtgcatcatttcttcagaaggttagtgtcacttatatacaaaatcaagaagggaattgttgagtaaaaaacaagggatgcttgttaaaaataaataaatatgtaatctacttttctgcaagtgaagaggacataactatcaataccataaatttatggtgtatctattagtgtctacatgacagcgctagaattgtacggagtacatgaaacccatgtaagtgcagtaagctttgcaaattcccagctccaaatgtgggtctagggctctatgctactaacggaacgcatgaaatctgtaactgagtgtcaattttcaaaacctcaaactaaaacaatcaactggatgaaatatttaacatgcattttgactagagtgccaactgtaccaaacttcacttagctgcatgccattgagcagcaaattattttgattgctttcccatcaccactttgagctcacaaaccggactaaaaagccgcacagcatccagttaaccactaacactgtacagacatgttcaccgcacgagcaacactgattttaattcattattcgcaaccttccaaactagtgggaacgccacaaatcgtggagacctccgccgcccggcccggtcgccctactcccagtaacccaaataggaggaggaagagagagagagagagagagagagagagagagagagagagagaggagcgaccctcaccgaggttcatggcgttgagggccttggggcggtcgagggtgatgacggcgacgccgttgggggtgacgcggcccttcacgaactcctccgcggcggcggcggccatggcggcgaagcggcggaaggtgagggtcggggctagggttttggaggcggatgcggcggtggaggaggggcactggaggaaggaagtggtggagatcgatccggggccgggcgggtggatgcgggagaggagagctcgcatagtgacgtgagagcaacccatgtggagaggaagaagccgagagcgagagggggggggggggggggattaatgtgatgaaattgactattgagaattggagggggtgtgttgttggagtacatttttttcccccaaaaaatgcgctgaactcgcgactcgcgaggaactgatgctaaaagtcagggaaaagtctaactgtcaattttcaaaaacgaaccttccgtctgacctgtttcactacatcgctaagatttgatttaaaaaaaaagaaatataattaaaattcataatgcccaaaatacccttgaggaaaccatacccatctttaaccctatccacatgtctctccatgtctctctcctgccagtgagttgcggcggcggcgatgtgtgcagcggggagggaggtggaggttggcgcgcgaagcagggagggaggcggaggttggcgcgcgaagaagggagggaggggcggcgcgacggcagctggcgccggagggaacgcggaggaataaaggaggcgacgtcagaagaagaagagagaagagagaactgacgggtgggtcccacatgtaatagggtcaaatgactaagggtaaaatggaccttttgtgcttcagttaacaccgttagaagcctttaacagaatagggtcataccgtatcttcaattttaaaaagaagggtcaaataagcaaagttgaaaaaagaggatcaaattagtagttagctttcaaaagagggtcaaatgcgcaattgcccctaaaagttagtactaatattataaattatttgacttttttaagtcaaactttgttaaatttgattaaatttgtagaaaaatttaacaacatataaaatattaaattggtttaattaaatcttacattaaatatattttgataatatgtttgttttgtgttgaaaatactgctatatttttccataaacttataatatgaaatgaaggggtactggtttaccgctaatgctaaaagggagcaggtcctaagcgtcatccacaatgcaatgataattaggccattcatagtacagatcctctacttacaggtcactaatatgtggatccgctggtagagggtccatatgtcagtgacacaagttagaggatctcaatccttgcagtgaggtggcgtttggtctaaatacgccactttcgagattcccttccacgtaagcagatgttgttcatagtgagtccctcgtcctcctgttaggatttggtggccttgttagagaaaagtagaaagacgtccagcgaagcagaaaacatgagagagatgttgccatcgcggagctcccatctctgccaccctgcttcgccggtttgccgttgatcttgcctagccaaaggtgcctccggcagggagtgccctcaataactagatctcgcccgatccacctttgagaggttgctgccttgatctaaattgggaggacctcgtcaacacggtgccgcttggcatcctcgctaccgccataatgtggagagaggggagaggaggaggcaccaccttgatccgcactggctaccccgatgtgcgaactgtcatgagtttgtcggccgcaccgccacaaggctatccacctcgctctgccgggccgagcgcaaatgctaacattgtcgacctgcgctgccccgtctactcattgctccatctgctccattaggaagaagggggatggttgaggcaagaaggagtggcaaaaagggcatcgacaagagaccgctgtcctaatctgtgagttgttaggagcttattgggagagggaggtgaggaggttgtcggcatcatcgggcagccgggcaggagggatagtggaaggagatgggattccattgttctgtatcacaaacaggtggggcagcagagaacatctttgatatatttttgtttagaaaaaggtcctttatgtaaagatctaactagaaaaaaaattaatatataacaagggttgaaacaaaatatgcatgggcttaaatgacaaaattgcatgggccaatggaaacacggtgcaccgtcgagatgtgtggttctatttactttcttattatgtagaagttgagtatccagttaggtgtagactacaatgtgagtactcttatctagtggtctcatgttgccagctcggagattctaatccagatcagcactgcgtgccccacgagagcgctcgtgccttgcaggggcacggatgccttgacagccgtgcaggtctcctcctctattgtgcacgtttctttcgcgagatagctagagagagaagttgcggccgaaaagggaaaagaaaatggccggagaggacagagacaggtctagaacaacctttaaacttatcaaaatgaccttaccaccgtcaccgtcaccgggtgttgagctcgctagttggagctgtctagttccttttacgcggatctggaagtatacgacgcatatctagtatttaaacggtggcgatactgatgcaacacctacacagtggtgctcaatgattggatgaggcaacgccaacaacaatgatgcgtggaaggtcggagacggtggccctcgcctatgttcaaccttctcattgaccgcgcggtgcactaggcgagacccagcatcaactccaccaatcgccttcaactgccattgccattgtcgctgggttttaggtaggagataagcaccatggggaggggagaggagaacgatggcggtggaaagggaataggataggtgccagtcggagcccaaaggggatggggggacgggggaggggggaaggggcacgggagagctaataacctagagatggggtgctatgtgcaagcgtgctatattcaagcgcatgccccctattgcttgcctagctgcttaccaatagtacaagcgtgctacatgttagcttatgataagtgttgactgtcaaaagcctagagacaaggacaccgaccctttataattgactaaatggtaagatttgtttgaattaaagaccgtgttttttcatcccatcccagggcaccaaaacctaatggttgttctatactcaacttgtccaaacattcagcacatgtctctcctcacattacattagtgcttgagttgtttaactaggcaagaagcttaatagccgagtaggcagacgtatgaagagaagatcggtccaatgtataatactctagacttattttagtcatcgtaggtaaatttagtaattagtagcgaggggaaaagtctaaagtacttctcgttaagaatagaaaattacgtagtaggagtatcagtgtattaccacgtgataggtaagtgatattgaaagtataagacttctcgattttgttgacgtagttaagagggtagaaattaattaacttatttttattaattttgaatgctaaaaattatgttactaatgtacaatttaagattattttaattttgtcactaacttcacgagtgtattcccgcctaactaccgcatatccatttgtggtgttcattgatcttatagccaaaaccaatcattagacgagacttgatagctccattgcatccaatctcacttttggaaaacggtagttggaacctgatagcttcatctgccaatcaaggcccccccgtacgttcgtttggtcaaaaagagatacatgttttccttactagaaaaaaatgtttgtacgttgcaacgggtaaaaatattttttatcctacgcactatgctccctttaatgcccatgcgttttggaccaaacgaacgcacattccttctgtccttttcagctctagtcctagtacagtccgctatctctctctgctcggtctacctctctttggctcagtccataaatggagttgtaggcccaagtcgaacagtattatgtccgtaccattacaaagccgatcctcccatcaaatccggtaatccgctcgagctcccatagtcttataccatgacggagccgatcctcccatcaaatacggtaatccgctcgagctcgcatagttccgtacccatacgatgactaacgaagccgatcctctccatcaaatccggtcgaatctttctccatatccaaaattattgagggatttttatccacttgatcttccttttccttttttttaccaaaattaaagcaatcagcaaaacttgggataaaaaatgacgacgattaaatggttcatcaaaatcgaagcaatctgcaaaacttgagataaaaaataactatgattaaatggagattcaatctgatgaattaaagctgaatcaaaaggggaattcatggggaaaataatgagagagtagtggggaatcaattattgcaacgaataggaggaggaagcatatggggagtaaaatcaacgtggcggcggcgctgggtttggcccgataaaaaaaccgcaaaaaaatatagcgataaaagaaataaacagaaaaattggtgaaagaaaatacgcaaagaggggaaaaagaaaacggacaaagaaaacaggaaaaaaggtgaaagaaaaaaaaagaaacgggaaaagaaaataaaaggaaaaaaacaggaaaaaaaaagaaaacgaacaaaatgtagttttcttttattttcgccactttcttatggggaatcagacttttttattttaggtttttttttctatttttttatttagacggacgaaggaaacatctcttaaaatttttaagtagtaatagatacaagataatgtaattttttttattgaacttgatgattacaccaaggtaatatagaccggtggagaactcatttttattcccggttaaaaacccccactagttccggttataacaccgtgaccaacaaatcgagactaaagatctcgatcttcaagtatcgactgaaataaccggtactaaatttgcatatcaagttaaaaaaaatatgtgggatgtgagagattcgaactcaagatctctcacctcatcctacgttaccgtccctcctactacacacatctaacttggatagatattaactaaccctgtagacatcttaccggtattaaaaatatctttagtacaccaaccgagactaaagagctaccaaccgagactaaagagctagagagctctttagtcttggttagtgttaccaactggtgctaaagatgcatttttagtactagttggtaacaccaactaggactaaaaaagtttccatgaagttaaatttttagaaccgatactaaagcatatttagtaccggttcctaatctaatcaagatatttgtgattttgggtaccacaataaaagattaattctctagtagtaataactaataattactccgagaatgcgctcggcctctgcctaactaggatgtatgtagctataacagaaaccaacaagtttaaaagaaagaaagtacaagcagcattaacgactaggcaaagtttgctacagaacaccgcgacttcgtggttttagctgtaggacaccgcacgaagtcacttttgagggagcgcactatgtaaatgtggtaatttaccaagggacactacatctattaaattaatattttcgtgctgactagacgagagggggcccacttttttacacagcttgaccaaattacccctcttatctcattctgatcctctcttcttccttatctattcccatctctctttcattctctcttttacacgacagcggatgcccacttagcagcggcagcgtgtgtggcctactcggcggcggctgcggcggcctgctcgacggtggtggcaaagcccggagcacatgcagcctactcagcggcggcgacgcacgcggcggtgccaagagcgcggcctactcagtagcggcggccggcggtggccgtggaccacgccagctgcaacgtgcaggtggcctagtgccggacgagcacccgctgctccagcgtgtgcttctccttcctcaacgcgacgacctctgaccgcaaccgtcatagctcgtcgcaccggtggagctcctccacggccgcccgcttcttccccgcatcgtttctcgcgatgatggtgtctttcgtctactcgacagcacacttgaacggcggttcttggccgcggccagctcgtgctcttcgccgagcggcatggaggaggggatagagagagaagagagataggagagctgatatgtgggctgaagggcatttttgacatttcacgcgatttatctctcatcttcgaccggaaattattattttaatgagtaggatgtccaccagtaaatatttaacttttgagagtgtcttccctaaaagtcacttcgtgcggtgtcctacagctaaaaccgcgaagtcacgatgtcctgtagtaaaatttccctaacaactatcaatcgtaatattagatcaccacacatgtccctgttaaaacactcttgaccacatgctccaaacatagatatgccggcaataatcaaatcctgcaaggtgcaagctgggtttctatagtataacccaagtgcgtagccaatggatagttaaatagatagcctgcatgggagaaaaaaaatttctatcaaaaaaacatatcactccaacataacttaagcaaccagcatataacttaggtggtgtttggttggagggactaaagtggggctaaactttagtccctctcacaaaaatataagtccctatacttttgtgagagggactaaatttagtccctagttcccaaacacccccttaagcaaccagcatatagcagtcgcccctaacaagatatatatggttgcagatcttcttgaacaccccaaatccaactagtgaatttgcgtgaaatactaccagatggaataattccttactccacactaaatgggctaagtggcattcaaagaaaaagggtttaattgtcttcttcttcttgtgaataacaataattttaattgccttgtcaattatgtttacataaattatctttggttaacacaactccgcgacgaatgtatcaatggaaaattttaaccttcaaaggcacttttagttttcagagatttgggatgtcactatggacttcacattcaaccgtccattaagggttaagttccatataaactaatattgctcctgaattaaatcaatattagtgatgtgtgataataaattattccatgccagtaattttgatctagttagatctgttctctaaaacatctgcaatagttacctatttatacctaacaacactgtagaggaaagtgtactgttctcgtagggttacatctcccaatcatttgtctttccataatctaatttaatttagtaaccattcttaattatgtaggatccaagacaaaagagatctcatttcatcttcattaggctgtctccggccttctactgaacttgcgtgagcggctgtgaactcaaatacttattttgtattagctgtttccaaacatcatctacagtaagcaactgaaatagccacttactgagtaatactgaatttctaaaccaccttatctttaaggcggcatagtatgtctcacttggcttttttttttaccatcactctaacaacaaaaaccagagcaaaaatagtagattttttttaaaaaaattcctctcgctactgtgaagtacttcattcatgaaaaaaaaactcaatctaaatgggatgtgacatactccatccgtttcacaatgtaagtcattctagtatttcccacattcatatttatgttaatgaatatatatatatatatatatatatatatatatatatatatatatatatatatatatatatatatatatattcatatacatgaatacaaatatgggaaatactagaatgacttacattatgaaacaaaagaaagaatatagtataacaaatctggatacctttatatctaaatccattataccaagttggtcgtgtcacatcccccaattagattgggtcttgttttaagacgtgaataaacactaagttaattagtgtgagccctccttcaatagatagaaattttcctttccaactatggaagagatgcatatgcgtgtccaaacaccaaataatagtacattagcccgggagcaagccattggagcatactccctccgtccaaaaaaaaccaacctagaaagagtttgtttagattcgttgtactagaaagggatcctttaaggttgtcttaaaaatacccaacctaaaaaagatttgtccagattcgttgtgctaaaagagaaccctattagacttgtttttttttatggagggagtacgagactaactacaaaattttcagtctagacaatgaccaagcgggggggacatatgtcgctggactcaaactccacgacggaactggcaaacagacgacaagatctcgaccgaatctgatcgacactgggtaaggtcaggaagaacagtcttactcgtcttttttctaatccaacttaagctcagtgatgacgccaactaatctggaccgtgtttagttgtttaggtgtaaaaattttaaagtacacgggcacacatttaaagtataaaacatagactaataataaaacaaattacatattccgacggtaaactgcgagacgaatttattaagcctaattaattcattattggcaaatgtttaccatagcaccacattatcaaatcatgacgcaattatgcttaaaagattcgtctcacaatttacatgcaaactgtgtaattggtttttttcgtctatatttaatgctctatatatatatatatgcccaaacatttaatgtggtggaatttttaaaagtttaaaggtaactaaaagcaacgctggttgagttcgtggatgcgacactgccatctcgaactcttgtgcactcctctcgctcgccacacgaaacgccacaccactaacagataaaaaatagctggccaattgccacccattttgcctatgcgccatagctgagctgagctagagctctcactacagctagctaaccgagagccacacgtcggtgactcgtgacctgtggagccatgtcgccgacgccgaggccgcacttcctcgtgctcacgttcccgctccagggccacatcgcgccggcgctccgcctcgccaggcgcctgctcgccgccgcccccgacgcgctcgtcaccttctccaccgccgccgccgcgcaccgccgcatgttcgccgagggggagggcggcgacggcgacggcaggctcgagctcctcccgttctccgacggcaccgagaacgggttcgtcaagcgcggcgacgccgcggagctcggcgcgtacatggcgtcgttccacgcctcgggccggcgcagcgtcggggagatggtcgacgcgctcgcggcgcgggggcgccccgtgtcgagcgtcgtctacacgctcctcctgccgtgggcggccgacgtcgcgcgcgaccgcggcgtgccgtccgcgctctactggatccagcccgtcgccgtgctggccatctactgccactacttccacggcctcggcggcgtcgtcgacgagcaccgccgcgaccattcgttcgtcctggagttcccgggccttccgccgatggcggccggggacctcccgtccttcctcaccgaagccaccgacccctccgactacttccacagcatcttcaccacgttccgcgacctgttcgacgccctcgacagggagacacccaaggccaccgtgctcgtcaacgtgttccaagaactcgaggcggacacgctcgccgccgttggggcgtacgacgtgctccccatcggcccggtgctcccgtccggcgacgacgccgcgctgttcaagcagaacgacgccaagtacatggagtggctcgacaccaagccggccggctcggtggtgtacgtcgcgttcgggagcttaaccgtcatggcgaaggggcaggtcgacgagctgctccatggcctcgaggagagcgggaggccgtacctctgcgtggtgcggaaggacaacaaggccgccgtggcggagacgggcgacgcgacggcggcggcggcggcgcgcaggaacggcgtggtggtggagtggtgcgaccaggtgcgcgtgctgtcgcacgcggcggtggggtgcttcgtcacgcactgcggctggaactcggtgctggagagcatcgcgtcgggcgtgcccatggtgggcgtcccgcggatgtcggaccagcagatgaacgcgcggctcgtcgagcgcgactggcgcgtcggcgtgcgcgcggaggtggacggcggcgacggcgtgctgcgcgcggcggagctgaggcggcgggtcgaggaggtgatgggagacggggaggcggcggaggtgcggcgctcggcggcggcgtggaagcgagcggtggcggaggctctagggaaaggagggtcgtcggatcgtaatctgacggccttcgtggagggtgccagaagtgtcatttgaaaacgacataatttgaaaacgttataagatgtattttaatttgaaaacgatttggggatcctagggtcttcccttgttggtttggctgtttgttcacttgtatgtacaacctctactgaactactccctccgtcctatgatataagggattttgagtttttgcttgcacggtttgactactcgtcttattcaaaaaaatttggaattattatttacttttttgtgacttactccctccgtcccaaaaaaaaggtaaaccctggattttcgtatccaactttgactgtccgtcttatatgaaatttttttataattcgtatttttattgttgttagatgataaaacatgattaatattttatacgtgacttgtctttttaatttttttcataattttttcaaataaaacggacggttaaacgttgggcacggaaactagggtttgtctttttttggacggagggagtactttattatctaaagtactttacgcacaacttttcgttttttatatttgcataattttttttaataagacgagtggtcaaacactacaagtaaaaactcaaaatcccttatattattggacggagggagtagctgccaactgggctctcattttttatgggcttttgctatattgttgggccaaattattaccaccgaactgaactacctgttgggtaagggaacatgggctttctctggtgtactttctactttggggtcccgtgggtaatataccatccctgccctcgcacccagaaatgaccagggcccccacccgcttcccctgcgggttagaattcccacccgtccctgtaggggcgggtactcaccgggtccccaaccccaaccccacgggagaaattaccacccatatatccaatcgttcgtaggctcgtagcatgtttgttctgcacaacccagatatctaattgatgacagtttgctatagttttactagctaggctatttggtgagaagccgacaagtgaacggtgcctacacattcgtagcccaataccctacctatgtactcaaccaagttcttctttagtccatggccatgtttggatccggagggctattaaatagccctccggaatcttgctatttaagagtattaaacgtagattactgacaaaacccattccataacccctaggctattttgcgagacgaatctaacgaggtatattaatccatgatttgctacagtgatgctacagtaatcagccgctaattatggattagtatacatcattagattcgtctcgcaaaatagcctaggggttatggaatgggttttgtcagtaatctacgtttaataatcctaaatagcaagattccggagggatatttaatagcccggaggatccaaacaaggcccatgtatacaatcactcctattccttcttcagtccgtatcctatcgctcgtaggcttctaggtggcagcagaggtgcggcgtagggcggcgacatggaagcgagcggtcgaggcggctttagggaattgaggctcgtcggtaggggtgtgtcagggttacgggttaggtataccctttaccctttgatatatgtcacatatcggtatggcatgcccacgcgcatacggatactctctacatacactaaggaaatccttcacagagtttacggacgaaaagagtcctactcggacaagactgggtcgtcaatgtatcgtgtagggtttgatgtctccgagttctacttggaaaccgcctgacctgcgatataaaagggaccccccagggaggacctaaggcatcaaatctcaaagccaacacaacccccacagatctagtcgaaccaactcgactacgatcttgtcggatccatcgaattccattgttccctttgtaacctgtgttttccatcatataatcccacgtcaactggattagggctattacctatcaaggggcctgaaccagtataatcttcgtcttttgtttgcttgatgtcgtattacgtggacccttgtaacaacgtactccaataccctctatatccggtctatgggtatcacccgtcgatagtggcgcgccaggtaggggcacttggtgctcaaggttctactactatgtcatccagcttcgtcgacaacagcgtcaacaccaacctcaaccaagtattccctgcttcaacaatgctggtgtagactcaagtcggcaaaatcgtcttcccggtttacaccacgatgccgatctcagccggtccatcagtgaccggaaacgagaacgcagtggatacaaaccaagacgactccatgtcgaaaaatcctcccgccgaggcagagaacggaacatgaacgacatctgagctcgagaaggattccaaggcgaccaaagcttgtcactccgacaagaaccacgagccgacgaggatgacttccaaagcgacaaggtcctggtgtcctatccacaaaaccaggaaacacactttgcaagcctgctgggtttttctcaacgtccgcgctgaaattcgctcctgcaaagagcgtggaattcagcgtatttctccaactcgtgatgtctattctcctattcacaagacaaagaatcacgacctctcaagctgcaaggtctttctcagcgccatgaaggcgccatctcctaaggtccaacagtcacacatcctcatcagggataaagacaaggaatgaggagcgacgccaacttcggatcgatttgttggggtaatcgacatcgatccccacgaaccatcagtcttgcacctcctcgaagactatggatcatcgacaacgagcgtgccacgggagatattggctattgatgatgtcggcacgtcacagcgcaccaatgcagaagcggagaatcaagtagccactccggcccaacacatcagagccgtcaacgctatactgagggaaaccccctacgatcccgttctgaacgatgatctcgcgcgttggacagaacgactacgggaatcagtgaccaacctcagcaacgcgttcgaagaggccgctgccgcagcgcacccagagcagccaccaactggcgatgccaatggtgaaaaccctgaacggagggaatcgcctcaacgagccacccctccacctcgcggcaccggcgatctccgtgatcacctcaacggcagccgagaggcacgacgcacacaagacaacgagaaccgttcccggcgtcatgtctcttcacggcgtcatgataacaaagatcgaggagaccgttcaaacgaagactgagaccgtgataaccgccacgatcacaacgatcgcgaacagcgggtgccaggcgatactggtcgaggacgtcgccataatgacgacgatgatggagaccggcgccgagacaacagcgggagacggcgacaggattctcgagagccaggccgacaacctcgtaatcgtacactggaaccaagcgacccatcgtcatcgtcattatcctcgtcttcctcatcatcagatagacatccatgaaggacacacgatcgccgataacccaccgcccccagcgctgggtgtagagctttcagtcgttccctgcatgatgtccgatggcctgagagattccgacctggagcaatagagaagtacgatgggagcaccgacccagaagagttccttcaagtctactccacagtactctacgttgccggagcagacgacaatgcattagcaaattatttgccaaccgcgttaaatggctctgcacgttcatggctgatgcatctcccgccctactcgatctcttcgtgggcagacctgtggcagcagttcgtcgccaacttctaaggaacctacaagcgccacgcgatcgaagacgacctacacgcgttaacacagaactcgagtgaatccttgagggaatatgttcggcgcttcaacgagtgcagaaatacaatccccgaaatcaccgacacttctataattcgcgccttcaagtcctgcgtcagagatcgctatactactcaggagttggcaacaagacgcatcacaactactcagagattgttcgaaattgttgagcgatgcgcccacgcagatgatgcgctaagacgcaagaacgataagccgaagaccgggggagagaagaaactagccacggacgcacctgagtcaagcaagaagaaaaatcgcaaaaatgggaaaaggaaagctcaagcggaagtcctcgcagcagaatacgcgaaccctcccaagcgcccagacccacaaggtagcgacgcaaagaaagcatggtgccccatacacaaaacggacagacattctttggaagattgccttgttttcaaaaagtcgctcgagaagcacattgcatttgaaaaaggcaagcgagtacgcgtggtcgaaaaggatgcggaagcggctcccaaggagtcggactcagcatatccagactctgacctccacgtttcacacatcttcggaggttccacaacgtactcctcaaagcgagaatacaagaaagtggaacgtgaagtctgttcgacatggcagggggctgcacccaagatgaagtggtctgaacagaagatagaattctcggaagaagaccaccccaagactgccgtcatcccaggacgatatccgatcgtggtcgaacccactattcggaacatcaaggtcacgcgggttctcatcgatggtggcagctcaatcaaccttcttttcgccggcactttggacgcgatgggaattccgcaaagcgaattgacaccaaccgattaaccctttcatggaattactccccagtcatcgtccaaaccattgggcaagattacgttgcctgtgactttcggccaagctaacaacttccgaatagagcagatcacctttgatgtcgctgaattcgatacagcttataacgccatcattgggagaactgcacttgcgaagtttatggccgcatctcactacgcgtatcaagtgctcaagatgccgggaccgaagggaataatcactatttaagggaatgcaaagctggcggtgcaatgcgacaaacggagcctcgacatggtcgagcaaacgcccagcccacccgccacgaccaagccacccaagaaagtgagcaagacaaacaagacgccgaaaccggacggcgcaatcaagatcgttccactctccagtgccaatcccgacaagaccgtcaagatcggggtgacactaagcgagaaataggaactcgcgctcatcaccttcctccgcgacaatgctgacgtgttcgcttggcagccgtccgacatgctgggggtccccagggaggtgattgagcacaaactcatcgtgcgacccgatgccaagccagtaaagcaaagactgcggagatttgcaccagaccgaaaacaagccatacgagaagagctcgacaaacttctcaagcctggcttcatcagagaagtactacatccagagtggctagccaatccagtcatggtgcgaaaggccaacgggaaatggagaatgtgcgtcgacttcaccgacctcaacaaggcatgtcccaaggatcacttccctcttcctcgaatagatcagctggtggactcaacagccggctgtgagctgttgagctttctcgacgcttactttggctaccaccaaatcagcatggcaaaagaagacaaagagaagacaacattcatcatgccattcggggtattttgctatgttaagatgccattcggactgataaccgcagggaatactttccagcgcacggttcagggcgcacttagcgaccagctcggcaacaatgtcgaggcatacgtcgacgacatcgttgtcaagaccaagacaagcgactcattgattgacgatctgcaggaaacgttcaacaacctccgacgatatcgcctcatgctcaatctagagaagtgcacgttcggagtaccatcgggcaagctgctcggattccttgtctccggcagaggaatagaagcaaatcccgagaagatcaaggcaatcgagaacatgaagtcgcccacaagactcaaggaaatacaaaagctaaccggatgcatggcagcactgaacaggttcgtcgctaggatgggagaacgagggcaacccttcttcgctctgctgaagaaacaagacaaatttgtatggacacaggaagccgaagaggcattcattgcactcaagcgctacctatcaaacccccctgtacttgttgctccccaacctaatgatgaattattcctctatattgccgccacgccatattccgttagcaccgtcattgttgtcgagagagagaaagtacaacgaccagtctattacgtcagcgaagctctccacgacgcaaagacaagatatccacagatccaaaagctgctttacgtggtcatcatgacatcaaggaagctacgccactactttcaagcccacagagtcacagttggctcctccttcccgctcggtgaagttgtgagaaacaaaaacgttgtcggccgcattgcgaaatgggtagtcgagctgagccagtttgatgtccactttataccacgaacagccatcaagtcccaggtactcgccgacttcgtagccgattggactatgcctgatgacaaatcagacaaccaagtcgacaacgaaacgtggacaatggcgttcaatggtgcactcaacagccaaggagcaggggcagggtttatcttgacgtctccttccggagatcaattcaagcacgcaatccacctcaacttcagggcgaccaataacacagccgaatacgagggattactcgccgggataagagctgcagccgcacttggggtcaaacgactaatcgtaaaaggagactccgagctagtcgtgaatcaggtgcacaaagattataaatgctctaaccccgagttatccaagtatctcgcagaagtcaggaaactagagaaaaggttcgatgggatcaaggttcgacacgtttaccgcaaggacaacatcgagccagatgacctagcatgacgtgcgcctagacgagaactgctcgagcccgacacttttctggacatcctgacgaagccatcagtaaaagaggttagcggcgaagttagcccggccgccccagacattggcgcggaggccacaaaggcagaacgcgccgttgccgatatcgagatcacagatgactggcacatcccacttatgaaattcatcaacagcgaggagttgcccgaggacgatacagaggccgagaaaataacccgtaaagcaaaaatctaaagtgtggtcagcaacgatctatacaaaaaagcgccaaacggggtacttctcaaatgcgtctcgtccgacgacggcagacacctcttccttgatatacatgaaggcatctatgggtcacatgccgccggtcggacattggtcgggaaagcttttcgacaagggtttttctggccaatcgccctcaaagatgcatgcgacatggtccagcgatgtgaagcctgtcaattccacagtaaacacacaaagctacccgcgcaagtgctccagactatccctcttacttggccattctcgtgctgggcgctagatatactcgggccattcccacgaggacagggcggttacaggttcctattcgtggcgatcgacaaattcactaagtagatcgaagcagtacccacgggggaaatcaaggccgacaacgccatcaaattcatcaaggggatattttgcagatacggactatcgcaccgcatcataaccgacaacggctcccagttcatcagcaccgatttccaggattactgcatcgggctgggaatcaagatatgcttcgcctcgatctctcaccctcaaagcaacggacaagtcgagagggcaaacggcatagtactacaagggatcaaaacccgcgtctacgacaggctcatgtcacacgacaaaaaatgggtcgaagaactcccatcagtactatgggccgtacgcaccacaccgacaacatctaacaaggaaacacccttcttcctcatgtacggttccgaggccatgctccctagcgagctatgacatcagagtacacgagtacagaagtattccgacgaggatcaggaggagtagtgaaacgtcgatgtgaatctactcgaggaacatcgcgaacgagttgccgtccgagcagccaattaccaacaggccctccgccgttaccacgagaagcgcatccgagcacgcatgcttacgatcggcgactacttcctccgacgggttcaaagccaagcagggcgaaacaagctctcacccaaatgggaaggatcttacacgatcacacaagtcttgcgaccaggcgcatttaaaattgcagacggtgatggtcgcgagttggcaaattcttggaacattgaccaactacgtaaattctatgtatgagtcaatgtcatccatacctgtaagacaccttacagcatcaataaagcctattcttaggaccatattacaatcaaagtgttcctgtccgatgatcccttacccagatgacacctaacgttgaaatctatcctcatgtccctttacgccgtcttgacaaggcctccgaggaacctaagggatcttcggctggggacgcccagagccgataaggccttgtcagatcctgtagagacgaaagaccatgtaagacctggtcgtgtaagagttctcgccgtgcgtattaaccaagtcgtgtaatcggaaattaactttccaacttcacggctgggggctaggatcagtgcttattcaaccaaggcaggtcaaaggtccaagagccttatcctctgagaaaactcctccggtgacaaggctgggggctagggagagtgtacgactcaaacaaccgactaaagtcgtgaactgaggacacactcttacacacgatatccggagtaagaaatattttctaaagatagatttcttttctatttcacaaaatactccttacaattcttacacaagtctaaggctatattacactttcccctaagatatctatcacagggtacaaaggctaccaggaaggccaacgccagtccacagattagaagaccttctccgccaatggcgccatcgacttcaccaggtggtctatctctgccagagtcctccgagaacgagcaaaaccttcatggagaaaatcgatgtccagtcgcgggcgatgatctcataggcaggccaacacgtgccccccggcatatcggctcgatcgacgacactcctacttcaaggcttcgtcaatgcgcttgccgacgccctcgagctaagcataggccccgttcagccacgagatgtatctggccgccgactcctcgggatccccacgaggtactcggagctctctacagaccttggccatggacgtgcagcaactcttcaagtacgagttgaaccacacctcacgacctcggagcgtttccacagcttgctccttctttactgctagcattgttctctcaagttccgctacttcaaatttcgtcttccaatattggatacgacgatcttgcccagcaagagcactctcgagatatgctcaatgtgggaataactaagtcaagcttcacttctctttcaagaacacgactgatctaatcggaggagcaaaaagggataaagggaccactaacctaaggaagtcgtcgccatctctatccccgtgggtaggatctggtctacattgtccggcgacgcatgtggttcaaacgcaagagccggaatgatcgccaatgactcaggctgcccacgctgctggacatcctcgtcatcaacatctctacaagggacaaaaagtactcaagatcaaaatgcaagagaaagctagggtaatgactacacgcacaaaggcgatcgaaacccatcgaagttttacatagcacatctaaggagtacaagagatcctactcttcaaaaagggggagaacagattcccccaggtcgccgacttcttccatcacctccttacgcgtgccgctagccgccccctgatccaagatctcgcgcagatcgagtttaggatgcgccagcctcacacacgcaaggacatggcacgcctcggtgtagatcccgttggacgtctcctctccgatcctggccgcatgcttggagggaatctcctccatcgccgccgcgagctccgctagagaagatgtcagcgagaactcatcgggattcgccgggatggtagacttgatgccgcactacccggcgagctggtgcagaccagtataggtgacccgcaacgagccacggatttccgacaaattgttcccgagctttgacatgcggtgctcgagcccctgccattgtcgctcgttgccagccaccaactccctcatcttcttgaggtcttcacgagcttccgccaactcgtatgccagccggtcggcacgctcgtttgccgacgctgccgccgaccttgcctccgcaatctcgcgaccaatgccgcgagcaccagcttcgaggagacaccacatttcgacctggagctcctcccaggtgaggacgacagccggtggaccacgaccagccgcgggatcgctggctgggccgcttggtgtcacctcgcggctcccgggcgcaagcacgacatccgtcgaggctacagcgggagacgcaccggaagtccctccagactcatcctgcaccgccttcgcccgcgccgccctatgagacagctatggttcagacaacgctcggacaaaatcacgaaaacttaaattcacccacttacttctcgccaagtgtcacaagtcgctgttgacgtggaggtgggggagacgcgtccgaggcctggagaacagttgatgcgaagtaaggcgaaattgttctggctgtttgatcagacaacaagatagcttaccgagggggctgatgccttgcgacgatgtccgcttacagaggagaacttcctcccctttgctggaacattgccaccacttgtggtagcagcagcagcagcatcagacgcctccttggcgaccttctctttcaatgatgccaccacctgatggtccgcgagcggcccgatgatgtcagtcagaggaagagcctacgctttataaagtcacaaagcgatctcagaagaaaaacgcagaatgactactgagtacacttacattgatggcggcatcgcgttcggccgcccccttctcgcaaaggggaacgggaacattactcgccgtcgccgggccactgatcatcacctggccgacacgacgtcccacggcttcgttgctcagacctgtgaatcgagaaccaaatttcgatgagccaggaggagcgcgcacacaagcatatcaggataaatgcgagaaagataccccgaggagaaacccgggtcgcatcctccggtccagaatagtcaaaggctaggtgggcttgagcctggagtggctggattcgtctactaatgaagtcaacagcgacttcataccccgacaaaccacgcactcggagatcgtcgaccacatcgatgaacgactgaagagaaggggtcaaagggggttttgcggtccaagacgaaatcttgtctggttgttcctcaggaacaacgaagacaggatccgaatcttctatctgaagatagaacacctcgtctgccatttgctgcgagaggagggacactggaaggggatataacgcgattttaggccatcccgaagtcggaatccaacgcatccagataccctgttggattccatccaacgcaactcgtagtagaagcggaagagatcgagaaagggctctaccccaatgtaggcttcacaaagatgtgaaaaatactaaggctatagaattggggttcagatggagcaaagaaagaccatagaagtttaaaaccaagagaagaaattcagaaggtggagggagaaaaccgcagagaatgtagtcctcgatcacaaccatgcgacctaagatgggctggggttcagtacctcctgcttccctttccatggttccacgacccggaagggcgccgtcctcctgaagcttcttcagcgacacgctagtggaggatgatttgccgagatccatcgccgatcggagatcgccggagaaagggctgaggtcgacgaactagggtttcttgtgggagcggggaagacgaagaacgcttgcaggcgggaggttttcttcacaataggcgggcttcaaaatggatcccccaaaattcctttaaatagacgcactaccgacggtgcgaattccaaggaaaggagagagatagccgccggaaatttctgggtccgttacgcgcggcagtattttggacttcagtttaaattcactcgtgaccgttgggcttcacatggtgttctcgattacgtcctgtctccacggttctcgcaccgggaacaacaatagcctcgacacgagaagtcgcgaatggttacacgagttcatttaagcagaagtcgggggctactgtcagggttacgggttaggtataccctttaccctttgatatacgtcacatatcggtatggcatgcccacgcgcatacggatactctctacatacactaaggaaatccttcacggagtttacggacgaaaagagtcctactcggacaagactgggtcgtcaatgtatcgtgtagggtctgatgtctccgagttctacttggaaaccgcctgacctgcgatataaaagggacccccctggggaggacataaggcatcgaatcttagagccaacacaacccccacagcctacgaagtcgaagcctgcaggagccaaatcgtcgaggatctagtcgaaccaactcgactacgatctcgccggatccatcgagttccattgttccctttgtaacctgtgttttccatcatataatcccacatcaactggattagggctattacctatcaaggggcctgaaccagtataatcttcgtcttttgtttgcttgatgtcgtattatgtgaacccttataccaacgtaccccaataccctctatattcggtctacgggtatcacccatcaacagggtgggcattcggtctaaccgaaaattttagtctcggtcttcggtctttcggtcttttcggtctttgaaaagtgaagaccgaatttcagcgcaaaaatgttaggaccgacaaattcggtctcggtctcagtctcagtcctgaccgaaattcaacaacattttcatatatgcaaagaaataatggaaagtttcaacacaaaaatcacaaaaaaatttcgtaagcacttatgagtaaagactcttgttaggttgcatgcctagaagaagtagggatgtgaaaattagagtttaatcctattaaacatagtggattgtaggttgcatttagacgtttttttgataattctgtcttttcgatatattcggttaaccgaggatactaaccgaattgaccgaacaaaattcggtctttcactgcctaggaccgaattgatgaccgaatttctcggtctcgatcttttcggtctcggtctcggtcttttcagttcggtcttttggttcggtctttttctgcccatccctactcgtcggatcataatctgatgactttcgtggttgggaagtgccagaagtgacatttgaaaacaatttgtgtcaattataagatgtattttaattttaaatttccacctttgtagattttaatgatgaattagtcagataacaagtatatttatacattttttcattttattgattattagtgtgggtgtgggcacgagggagcgagggggagctttctaagaaattataatgtgcctattgcaaaattatcgcccttgaaaggtaggatagaaaaaacacacaagaattaaagttgtattttttaaaaaagtctatagtaaccaaaaacaccggaaatgagaagagaagaaattaactacaccacaggataattttttttctaaaaaaaatcaaaaggtcttatctcttgctttttttttggaatgtaatcctgtggaattagtccgtagaaatgcaattctatggaatatttacaatttctatatgaactaaaggggtctatagaaaaaaaaattagaaaattgaatcctctaaatattctaaaagtttctatgcagacaacataaaacatatattgtatacttggttcgttcagtccataaggtcgcatgctccatacattattgtaggactcatggaagttaaagagtggctgttttcaagacttgatcgtgttgttgactcaataatctccaacgcatagcttgaacattgttagttgtataaatattataccaatagatttacagtgtgcttttacacagcattagtactgctgtcatgaaaagtatgttttctgataaatccatggtcaaaagtttttctagctctagaaattcatggagttggggctgctgctagagtagagttattaaaatgtgacatttaattcatatcttagatcaaataaaagattgaaccattttaattcaatctacaaactctaatttctgcaagcctgcaagaattaatccaggagtttggccatgccaaacaagaatgaactttgttgtgttgtatagtgttaatttgtaaattgtattatgactacaaaagcattgtacagacggtatatatccaagtcactattacatataaaagcattgcaatatataaatgcttttttttttacaggcgatcgggcccatgcctttatttttacatgtctttagtcacagatgacatgatcggtcacctgttaaaacgtgttttggccgcctacgacaaccctatcgtagtagtaagagtataaaaggaattaagcgtatgcgaataatttctgtgcttttttttttatgacgggaatggtcctgaactcctgatccataagttttgagatgcatacaaacaaccatattactccaccacgcaagctgtcatctatggacaaatggtgaatacgtatgtatcttgatctcgtggaggttgagtcgacgtgacacttaccttgttcaatagttgatccatggtgtcgaattcacggcaccttctctttttcacattgtgacacaattttttcttttacaaaataactttatttattttctacccagaccacacataccaatataagtgaaaaaaatagaataccctctattttatcaaatccaatataattgtatcccattttatctagtccaatataattgcttttgaaagatgagttaatttaggataaataagatggtacaaaataaagttatttcggagagagagggagaagtaacctaatgcagatcctagctggagtaacattttttcttaactcctgaatgaagtagtgaatttgaagtagtgaatttttttctacctggcttactaggcgacggccggagatcgctgtctcctggcagattgaacttaattgcttggaggcaatgccgtcgagataagattttaacatgagccgcaggccggcatatatatagctgtgattatctacctgaccggcctgactctttcctactgtttctatcctgtatccacagatcgatataggtcgttttcagttcagctcatggcctagcttatcactataaacatcggtatcgtgttgccggcctagcaagtgtataattaatagtagtataagagttagtttggagcttatgattttttgaaacacagcataggaaaaacgtaatattcaagtgtatttggtacctcaaattttataaatgaaaaacaaagaaaagtattataaatgatcattaaaaaaataccactcttaactcgttactcatagctacaagctagaatactatacatgatcaaattgctttagcctccttccccatcttctctcccaactccaatgtcatatttccctctataaataccatcggcaagccactgaccgtcccgcctcctcaccttcctcctttaagttgcctcggagttggggacttggggcatgccggtcgctgtgtcggagttggaggagcctgactgccgcgccaaggctcaagaatgtcgcggcgatgtgggagtcgaaagaggccaccgttgtctgctcatccctccatcctgctgttgctcatgctccccaaccacgacggtggtgtgccgccacgtgcctctcctgctgcttgtgggcgcggaagaagtgttagagtttatatcgaatatgtgtacgtagtcggttacagtttaggacttggagttgtaaaaggtattaggactagagtatgagtcggactctatcctaggatccctcatagatagaggagcgtgcctgttataaccgcatggtgacttagcataaagagagggagcggttgtcggcatcgaccggccgtaagtcgttgtaactctgatacgctgtatatgctggatcggggaggagcgcccgtaatcagtgccccgaagatgtaggccacggctgaactccgttaccaaatatcgtgtctcggtgtcgtcatcgttttggatctcctatggcattttcttccgcgtttagctaccgatgtcgatttcggggctggttttataacaagtggtatcagagcctgcgggaggtccatggtagaggcgcgatggaggtgctccacaccgcgtagcctgctgtaatgcccagggaggggcattggcgcaaggtggagcacggcggcgatcaacggagtcttgatcggtggatcgaacacttctggcggcggccggaaccgtcgatggctgccttcaacaaggagatgactagacgtggtgctcgggttgatggcggcagaagcgattggcgatccaatcgatgggtcggacacttcgggcgggtggctcggactttccggtgagctactctcgacagggagacgtgcggccgcacgctcgggttgattgaagctggaggcgatcggcgttctcgatcggtggattcgaacactctgggcggggtggcccgggcctttcgaagagttgcgttcgacagggagatggctagacgtagcgctcgggtcgttcggcggctgggaagacggcatgcgacttgtcggcttcggctcgcgactagattgatggcgttcaatcggatgtcggagcgggtggatcctataggctgttttggaggtgttgacaggtatttccacactggaattgcttcaaaagcggcgtattagcggtggatggcagaactaagcgtagggcgtctagactagcatatgtgctagttccaaccctagagaggtctggttctactgtttctagcacagatcaagaaaatcacgatgacaacagatcagtggcactagtcattggtgtagtcggcaagtggtgtttggcagtggtgctaggttccgctggagatacgaagaagcccaggaggtcagggtcgcggcggtgtgcgcgttttgcgtcgaagccgagctggcggcggagatcagggtgatgccgagaaggagcgggctgagccaggacgtgcaaggttcggtggttgtcggattcgtgatgtagaggaagactcggccatggagttatctatgtgtcggtcacggcatggacacgaccgaagacaagctggatggataccgcgttcgacacaggagggagttggatacggattcgatttagactggaaatcggacacgtttttccccaataaaagcagcaaagggaccacgggattgtaacaacgcagtcgaaacaaatcatctagcagagggcgagattcgtacccgattttcgcagaggcaaaggtggtttgggcggcgaggtcacgggcggctggagacgcatcattgcaggcggcgcacggcggcgtggtactcggcggcgttcgtcgcagctcgggcaggagcttgcggcggcggcggcggcggttcccggcgaggaaccggcgccggacttcggtggcgggcgctcctaggtggtaggccggcggcttcccaaggcaggcgacgcggcggctcctcgcagggtcggcgcaagtgacggcggcgggaggcggcggcgccccaggcggtttctgaggcgggcggcgcagtgcttcttgcagggccgacggcgtgaggagcaggaggcggcggcgcatcgggaaaaagtggcgtgggcacggtttctaggaggagcgaggaagccaaaggaagaaggggaacagggtcgatctgtttttctttgactggtggttgaccaagtaaaagaaaccggtccggttttttggagagagaaaaaaaactggttcggtccagctggtactattcgagttagtcggtgggatcaattaatcagggcagatcaatttaacagggcaacagctgttgagttgattatcgttgatggcggcgacggtggtttccaaatttgaggtggtgaagttcgatggcaccgggaatttcgttctctggcagatgaggctgaaggatctgttggctcaacaggggatatccaaggctcttgaggagacgatgccggaaaagatggatgctggcaagtgggaggagatgaaggcgcaggcagctgcaacaatacgcttgagtctctcggattctgtcatgtatcaggtcatggatgaaaaatcactgaaggaaatttgggacaagttggcaagcctgtatatgtccaagtcgctgatgagtaagttgtatctcaaacaacagctatatggtttacagatgcaagaggagtcagatcttaggaagcacgtggacgtcttcaatcagttggttgtggatctaagtaagttagatgtgaaactggatgatgaagacaaggccataattcttctgtgctcgcttccaccgtcttatgaacatgtggtgactaccctgacgcacggcaaggatactgtcaaaactgatgagataatttcgtcgttgcttgcacgagacttgagaagatcaaagaaaaacgaggcaatggaggcttctcaggctgagagtttgctggtcagggcaaagcatgatcatgaagcgggggtgtcaaagagcaaggagaagagggcacggtgctataagtgtcatgagtttggacatataaggaggaattgcctgttactgaagaagaggaaaggtggcattgcaagtttagcagctcgtggtgatgattcagatagcagcagtcatgagattctcacagtgtctaacgagaagtctggagaagcgtggatgttggacttagctagttcctatcatgtgacatcgaagcgggagtggttctcttcatacaaatctggtgattttggtgttgtttacttaggcgatgacacgagttatcgtgttgttggagtgggcgatgtcaagttcaagatgtatgatggaaacgaggtgctactttcaaatgtgagacacgtgccgggactaaggaagagtttgatttcgcttgggagcctacatgagacgggttggttgtatcaggtggattctaataggaagaccatgaatatcatgaaggacggcaagactgttatgactggtgagaggacaagttcatgtttgtacaagttacaagggagtgctgttgcaggtggagtcatggaagatgggtatgctggtgttgttgtgcacgatcctgaaggcggcaagcctggcgtaggctagtcgagcggctcggtgtgagctgcggcagaaccaactcaagtcctggtacacggaggttcgagcaagtaacagattcaagttggtgtggcatattcgccaaggtagagtttgttagagtttgcgtcgaatatgtgtacgtagtcggttaaagtttaggacttggagttgtaaaagatattaggactagagtatgagtcggactctatcctaggatccctcataaatagaggggcgtgcctattgtaaccgcatggagacttagtatagcgagagggagcggctgccggcatcgaccggccgtgagtcattgtaactatgatacgctgtatatgctggatcggggaggagcgcccgtaatcagtgctccggagatgtaggctacggctgaactccgttaccaaatatcgtgtctcggtgtcgtcatcgttttgaatctcctatagtattttcttccgcgtttagctaccaatgtcgatttcggggctgattttataacaagaagtgagatgtcgccacgggacaggagcgcgatggtgtagacgtggctggactagctgtcggtgaggaggtgggagccgtgttgcgccatgaccgcgtggggacaggcagcgaccgcgtgggcgcccgcaacaggaggatggagcaggcacccgtgatatatatacgtgggatgcgacgacgaaaggcccgcaaccgtcaccgtggcaggccacgaggatgagttcgtcgtcaccatacagttctaaatggagtagtattataacgtctagccacacgttaaaaagtgatattttatcaaaatccatctgcacagtggctttcgagcgatactcacttgtgacaataaaacaatgtcaggcccttcacagtgggaggacgtggccagttccttcagatttccagctcggataatcatctacacgttgacaaaacgcgtgcctctgctcagatgctcgggccttagttgggaagcgagttccttcgcctgcaggcaaggacgcgcggcgcaggagacgtctcacgcgtccgcgttactgagagcgtgcccccgcatatgtttccttcgcctcgcgtgcggcagatattctagccatcaaaaagagatcacgagcgttgtggactgcatggcttatgcgttgctgtacagatgactttggactgatttcactgtacggatgagctaaagccacgttatgcgttgcttgcactggtactgccctcagatttgagacaagggatgaaaggaatattcaaattggcggcttaaaggcctctcacagtgctccatgctggaccggtgctatgggcagccacgtaggaattgggcttgcgtggagctagggcgtgcgcccatggtgagcacctcgcacccaaactgaggcacgcggtaccttctctcgcgaggcccggtagcggctgcttttccgcactgtggagctcgtgccctcgcgcctcccgtgcccttgcgccggcaactaatctacacaaatcgcggcaacaaaagcggcaacaaatcgggcggcgcggtcgacggcgaggcgaggcgcacgacggcggcatccccgacgtgccgccgcagcatgggaggcgaggaggtgcgacggcgtgggaggaaccgctggccgcaagcaccatcgtctcagccttctggatccaccgccgcgtccccaacctccttcgccgcgtccccagcctacttcgctgccgccgccgtgaggagaggggagaggagaggccaccggcggggagaagggagaagccgccggcggggagaggggagaggagaggccaccggcggggagaaaggagaagccgccggcggggagaggggaaatgcagtgtcgtcgaggagaggaggggacagccggtggagttggaagagggtgaggggcgtggtgactgagggaggtgggggattcggtgaagtagtatctgtgggtcccacaccggtgcttgccctgtagagaaagtttccttgtagctttttatcctatgtgtcatcctggtgggtgcttgcactgtgaaggcctcgtaatctggaggttgcacatggccacatggatagatcgaagagggaaattttgctccctttattgaactgtttgtagatgatatggcaacatctaaaatttaatgagatctccaattaaatttgctgttacgtcgactaatcaacatactgattgcgtcaacgccacaccaaatgacaaagctattatctgggaatataaaaaaacaacaataatccagccgttgagttcgccatcgccggcggccgccggcggaatcacctgctcgagcacaccgcctgcgtcacggccccggacgcgaacgcccggagattcctctccgacgacccgccggccgcgaccgcctccgcggcgcgctccctccatcgctccgcccgtgcccggacaccgccgtctccgccgcccgccatggcgagctccacgcaccgctgcagctcgccgcgctcgaccacgccctcgccgtccagccgcgcgcgcacgccggcgcccatgcgcgcctcgaccagccacgccaccgtcggctggtccgtccactgcggcacggccaccatcggcacgccgcgggtgatgctctccagcgccgagttccacccgcagtgcgtcacgaagcagcccacagccgggtgcgagagcaccttcatctggtcgcaccactccaccaccatcccttgcgcgtccccttcgccgccgccgccgccggcatcggcggcgggggtgggtgcgctgtccaaggtcgcgccgccatcgacggcgccctggcgcgccacccacaggtacggccggccggtggcctcaaggccgcgcctcatctcctcctcctgccgcttgctcatcgacaggagggtcccgaacgagacgtacaccacggagcgcgccggcttcgtgtccagccaatccacgcacgcgctcgcgtcgtctcgccggaacatgtccgtgctcgagctcgacagagacgcttcgccgtcgggcaccaccggcccgacggcgacgacctccagatcgggcacggcgcggagcgcgtcgggctccagcgcgtcgaacgtgttcaccagcaccctgggcttgagctcgtcgagatcctcgaacaggtcgcgcagcatggcgagcagcaggtagtgcttgtgctccggcgagacgatggacacggcggaggggagctcgtcggacctgaggaacggcatcccggggaggcgcacgacggcgccgcgggcagggtcgttcgcgcaggaggcgagggcctcgccatggccatggaagtagtggtagtacacggcgaacgccgccgccggctggatccagtagatcgccgaggggatccccagcgcgcgcgccacggcgggggcccaaaccacgaggaacgtgtacacgatgcacgtcaccgggcgccccctcgccgcgagagccgcgacgatggcggagagcgactcggtgcccgcggcgcgggtgcgcgccatgtagtcgtccctcgcgtgcaccccgggcttgtacccgtcgtcgtagccgtcggagtgcgggacgtacgcgacgccggtgtcgtcgacgtcctcgccggccggggacggcagggacgggaacatgaggcggtgcgcggagacggcggtggagaaggtgacgcgcgcggccggcgccgacgccatcaggcgcgcggcgaggcggcgcgccgggttgatgtggccctgtatcccgctcaccacgaagaggaagtgcggcgccggaggagggctcttctccattgccattgggatttctgatcagagcagctttgcaaagcaactgatactagcaagggctacctcaatttatatggtttggaaatggaaatggctgaatattaattgctcttgctgatgataaatccgaagctcctttgaaccctttcttttttgcctggcttttggctaaggatcgcctcccaacaaaacgcaacttgcacaggaaaaccatagtgccgaccccaacctgtgatctttgcaattctgccgatgaaacagctcttcacctctgcttccagtgcccctttgctgtggccttctggggcacgctgaatatgcaggttaatgacgcgacgttagctgagcttgcttctcttcccacaccgattcgagttccctccaagcactttttgggtattctacttgcaatgcttttggaacccgtggaatcaccaccactgggttgtcttcaggcacgaagcccctctttgcgtcgattattagtgctgtgtattgaagatgcgtccctctggagcgaaagactcaaattagaggatcggcatgtaatttcgtcctggaagaccttttttcttgagtaaagtgcacgggtggtccttaaacttgtagcggtgtgtcatataggttctaaactcttaaaatgcatatccaagtcccagaattttttatagtgtgtcatctagatcccaaatcgccacaaccccttcaggatcctacgtggcgttgatgtggcatgccacacggaatgacgtggcatcattttgactgaaaaatgggtcccatttaaaatttttcctttttcttttttcttctattttttccctttcttctcctttctctgtgactcgagcagaagaaaggaaaaaacgaagaatgagaagaaaacgaagaaaaagaaaataagaaaaaaaaagaaaatgacacgtcacgtccatgtggcatgtcatatcagcgccacataggatcctagaggggatgtgttgatttgggacctatatgatacactttgacaggttctgggacttggatatgtgttttgagagtttagggacctatatgacacaacccaacaaatttaagaaccaccaatacactttactcttttttcttcctccctctgctctctgaaagtgtaatgccctgaatttgtagttctctaaactggacctttgcccactcttaatgaattcaggtggggaacttctccccccccccccccccacccccagtgaatttttttttataaaaagagagtaaatttcataaaactccatctattatggtccaaatttcatggaataaagttattttggcacgtgacatataaccctaagtgttatgttcgtaaagtttcaggaaaccatgccattaaccaaattgtggcacactctcaaagaaaattaaaaagttttacttacattgatataacatttatattatggataaacaacttacaaatttgagacgtgattgtagaacttaagagtttgatagatcaaattcaaaaagatcactagtgtggtttcgtgaaattttatagtaataatatctgaggttatatgtcatgtctcgaaacccctgaggttatatgtcatgtctcgaaacccctgtgattttactgcaatttagaccacaatacctgggttaggtgaattgagtttaaaaaaagatcctcattcctggtgtgttttgttaattcagttcttttgagttttgatcagtcacaatatgcttttgagggtttttttaatccgttgcctagtcgccgttaagcactgctgggctgtcagatttttgggccaattcgtcctttatcatcagttctccaaccatgatggccgacatccactgctcagtaagcacaatgtcgtactccttgtggagtactcattacataaaaaacaaatctagtaccggatataatatattctagtacgatgaatctaggtagatgtatatccagatttatagtattagaatgtgttatatccggtactaggttggttttttatgggatggagtgagtactccctcaaatctagaactagatgtgatatgttatagtacaatgaatctaaacagaggtgtctagattcatagtactaagttgtgtatttatattattaggttggtttttttatggtacggagagagtacttcactacgaagaaagcaaccatgcggagtagtggagccttcatgtaatcatgtagcgtatttgaacttcgaactgaatcctctttggattactagtcgacagcaactacaaaactaatactaccacagaagtaaaatcttagagatacaaatatttttttggccggctagctaataagaaatggagcagttttggccggctagctattaagaagtggaggtcatactcttaatacttcatccgtttcacagtgtaagttattctaacattttatacattcataatgatgttaatgaatcatactagaatatggatatgggaaatactagaatgacttacattgtgaaacggagagagtagttactaatacagagcaatcggcaatcacaatgtagtgtagatttgtttccccatcaaaattgtagtcctctctaagttgaactcacattgtaacataaggattattgtgtatatccagtggattttcctacgtaatcttacatagagttgtgtttatttcacgtcaaaatttaaaatttggttgaaattgtaacgatgtgacggaaaagttagaagtttgtgtgtaggaaagttttgatgtgatggaaaagttagaagtttgaagaaaaactttgaaactaaacagagccctagatgtaaaattggatttgatatatcactgttagcttttgttttgcaatagattttaaaatccaaattggattccatatataaccgtcatcctctatctcaatagatagagttgtaatatacaatagattttaaaaataaaattggtttttttacaacatacgtataaactagacctaccacgatataacaatacaaaaatttcatttttcttttattattaatgcagtaattcccaagtttttagaacgggcgtggtcgccgtggtggcacatttttaactatcttaataatttaatagataatacataaataaaaacagacaaacataacctcaaagcatggcgcgcataaagcgacctgctaggaaggcagctatcctccagagcaaaacctgatacttctgcttaaacagccaaatccgtacagtagttttctccacaagttatcgtagtgtgactgtatgaagtatcagactatcagtggcagaaacataattatcgttttgataattagcgattcctttagggagagaacaaaaatacagggcgccatacaattctactactcagtgcaatacaattcattgcatcttcttcctgacttcctgtagaacagaaactaccagcatttttttagctattaccatacatctcagttttttatcgatgtaaaacttctcctgaatcagtaatgggctgcaataattatctcccatataacccaacaacaaacatgtccaatcgaagctacaaattggaatgagctaaaatattaaactcattccttgtggtctctgaccttctttctcttccatttgagaaagatttgtaaagagagaccagaaaagaccatcacaacacttccccattgcttcaaggagagtgggttaccactgatgacggaggagatgacaatgctcatgaacttgcgggtggtggtgatggtagtgttagtaagagagccaaatcggctgatggttaggaagatgaaattctgacccacggcaccacacaggcagaacaggagaatgtcccatgccacctctgggttctcctggcaaaatctcactgcctcaaaaccgttggcgtaaggccaattactgaatagtaatggagcaacaaacataatcacagcattgtatatggtcccccagagattcatgccaagcattatatcccatggattagtctttggatacctgcaataacacgacattactttccatgtagataagaagatgataaaatttccagaatgctttaatatggaatggacagggtgtagttacctagactttatcaaatcttgggtcgaattggtgtaaccatcaaaagctaagttgaggaagcacaatgtgtagcccagaggcgcattagggttagcaagcttcttgatagtcttggagcttgtctgatacataggaaacaaacataatactcagaaatgaaaacacagttaacatcagcacatcacacataaaattttattaggccatctacagcttctaataacattagaggtgcagattcctagttatagtgactttgatgtggctgttttctcttctaatttgtattcatcataatacaaatgactgtaaggaacaaaacatattcttttctactttcatactacggagtgaaacagtgccaaaatgtttctgcttttgctttaggctcgtgggatattggtgaataattgaaatagattaaatctttaccttcaacaacgcaaaggatgatacacccccagcaacaagaaaggtgcaaatgtactccggaaatgtgtacttgacaccatacagtatagttcccatcagcattactgtacatattaaatcattggtcagagatatgcgcacatcactatacagactatgaaacatgaaagggctactgttaaaagttattcttaacactgattgctctattacctacaccactctgaccaccaaatatcagcactaatggaaatgctcttgtcatgaaattgatatggttttgacaaaaaaaatgcaagtattgtcgtactaacagctaaagcagccaatattgtggtgccaaaccaaaatccaattttccagtgtacttttttttttacacagaaactgctcagatgagtatacccacccaagctcaaattaatgatcagaagaactattcagatgtagataatgttctgtaaggtacattacatagcatgcatagatcaatgcaactcacctggaatcatcttagaagattttgccaggacctgttaacatagagcaaataattccttagcggtaatgtgctatttaatcaaatcagcatatattattacggcacaaaaatgagacacaaaaatgatattcagaaaacacaggcttgttgcgactgttccaataagttcaaaagataaatcaaattacattgcgcttgagccaaacacattttgatgtataactgtacattggatggttcaaagttcaatcaaaaagtttgatgaggaaatatggttctgtcttcacccatccatgcgatacagcgataagagtatcatggataatcatattttggcatttgtgcataatactcatggcataaatgttttctacgtataaaaattgctaataaacaaatgatctaaacattgtttatatgttcagatatttctgaatcagcccataagccgtctgacttggtcagaccgaaccaaattcaaaactccaagtatatcagaaccagagagtctgaattcgtaatttcactcaaccaaacttaattttcttctccaataatcactcacacatcataaattctccaaatgaccgtatctatcgcatcaatcaaggcaaaaataaggctatagaacattccaaccactgatttacttagcacagttgaacaatccaaaaatagaacattccacttcgcaggcattatactactgcgttgcctatcacccataacgaaaatggaaacatctaattacagatacaatagctgcacaaaaatgcatagagcaacaaagcaagcgaagcgagacgacaaaagggcagctgcaaccaaacctgagctgggtagctgatgaacttgagcgcctcgatccccatggccgggccgacagtgttggtgatgctgacgccccagtacttccgcagcggcgcgcggccagcggaggagctcccaccactcgaccacagcttgatcactgcgcgagcaaaaccagtgtcacaaactcctcacacgatccgcattctgcgcaatggcatgcgatgcgaccgcactggattccacacgacaggggcaggggatgagagagggaggagaggaggctcacttatgaaggaccagacgaagcagacgacgttctgcgcgaagttgaggaacgcgaggtggtcgaaccgccgcgcctccggcccgaaccgcttcgtcgacctgaacgaacggcggggagagaaaacggcgaacaattttcagaaactcgccgaagcagagcccaattcccctccgctcccgagcaccattagagagagagagagagagagggagggagggagggaggcgggcgcttacagggtttcctggaggacgccctgggtgatgtacgccgaccagatcccggcgacgcagaatgcgagcacggccacgcgcgacaccatgctccctccgccgccgtcgacgacgcgggggcggggagggcctctgcctccgcggcccttgcgcgcggtgaccatggcgcggttcggttcggtcggtgcgccgccggcgaggggggagggagatcggtgccgcggggaggaaggcggaggcgcgtgttatagaagcgggggcgcaactggggagaaggagaaggggtcgcgcgcgtcagaggggtgacgtggcgtgatgcgattggggagatgtgccacgggagacagcttattggttgggttggcgtggccgcgtggcgggggaagggaagggaaagagatccgagcgtgctgtttccgtttggtgtttcatgggccgttctcttttggattaagtccaatttgactcccttaactagtggatgagtctaattcatatccctgaactacaacaccggatatcataaccctctaactattaaaaccggtgcaatttagctctcttgacggttttgcagagcgatttcgctgatgtggcgcctacgtgacggtgttgaactggtctttatacaacgtggtgttgacgtgtcacttatgtagcattagaattaaaaaaatatatgggtcctatttgtcattcacacaaaaaaaattgtgggatccaccgccatgtaggtccacatgacatgtgccaaccactgcgcgggccatggccgtgccaacgacgggctactcctctcgccgacctccatggacctcatcgccaacacctcctcctccactccgtcgtccctgacctatcgttgccatccccgaccacctcctctctgccctcgatccctcctccctactcaacaccttcgcctcttacccggtcctctcccccttcgacttctcctccgctacgctcttcttgggcctcgccgcatcccgcatcgagcaaattcaaagaggttatccgcctcctccacctagggatgacaattttacccatgggtccaggtatccacagatacccgacccgatgggcatgggtgtgagtgtgactttttacccatgggtacgcccacccgatacccgaagacgtcatgggcaacaggcgggtttcattttttacccatgggtaacccatgcccgacccgatacatatgtattagctaattttgactcatttcttaattcttataccctttctattggttcatttgtaatgctaactgatactaagttgtgatgtaattcaaattattgttggtaaccaataatttcgtaaattattgattttatttttctttcttaaattatatatattttaagttattatttatatgagatccattgggtacccgccggacatacccgcgcccaccgggcatgggtacgggcacggagttttgcacgctaactctagtgggtagggtttggacaggcaatattaggcatcaggtcgggcatggttttgctctacccgtgcccgacccgacccattgccatccctacctccaccgacacctccttgccgaggagctccgccgccacccgctcctcccattcgacgccaccgctccgggcctcggcgacggcggcgtgcaggcgaggggagctgggacttgggttgtgctttatcaggccggcctaaggcacgacggcccgacatgctagaaagcacggtctgacacggcccgtaaatgggctaggccgtacttgggctggcacggcacgcgaatggcccgtaggcacgatgatggcccgatggcccatggcacgatattggcccatcaggaatggctgctagcctgctagggcgcatgcgcatcgggccatcagcagaaaatctgagtggcactacagctccggaccccggcagcaagacgctcagacctccgaaaatgcttaggatcatatgttcgacgcaaccaataaaaaccggacggataaactactacctccctattcactccacaaatacatacatgttgtaatggtcttcaaaataatttttctcatgaactacttatccaatctacgatatgatcacaccattatatttgttataattaaatctttataacaaggtatcacatcattacattccgatgaaaaaaaaacatatgtttcaatccgttaaatttaatgtttcagatgcggtagcaatatgtttcaacgtgtgtttttgttatgtttcataaaaaaaatttaaatatttcaacaactgattttttttcactatatataactcaatgtttcaacaattgattttttgtttcaccaatatataactcatgtccctactctctctctctcgccatctattggctttctcccacaccatgcatgaatcatgatgcaagtatttagtgatattaaaatatttttccttctaaactacttatccgatgaacgattcgatcacaccgttgaattcattataattaaatctttacaacaagatatcacatgattatattctgatgaaagaaaaatatatgttttgacaataaaagcttaatgcttcatacgtgatagttatatctttcaccatgtgttcttattgtgtttcacaaaatttcaatatgtttcataggctcatttttctgtttcaccacgtataatttaatgttgcaccaacggtcaactgaaacatttgaccgtccgatttttttttacatcggacgtctgatttatagctctctcctcgtacctcagaggatctcctgcaaggatgcgatggtgtccggcgattcccttccgcattggcgcaatgaatggaggcggccggccgaagagacacagccgtggcgccgcgcagacgcagtcaagtgacgccgcccggccgaatggacgcaatcgagtactggggatggggacggcggacggccaaacggacacatcctgccatctaccactggacaaacgctcgacctagtattagggactaggtagtagatgcgtgtgtgcctgtgattcccttgcagccttgctctgctgctcctgcgccctgcctttgcctgcccgcatgtggcatgccatcgccattcgccgtaagcgtttgctattatggccccaatttcatattttgtatgtggtcacatgcacgctgtagctgataatacatgtttgcatgttgctgttttaacttgtgcagatgtgcacgtgcagccgcggagaaaaggcgcctgccttggattgagatggagatgggacgcctggcaacagagaatatgggcatggctaatggtgattggatgtgcctccgtggagcctgcaggcagcacgtgtattgtgtggtgtgtcatgtgtgtgtaagtgcaacgagaaataactagctcatgagggcaatttgttctataaattcctcctcctcctcttcttcccaacacaaaaaaatgcagcacaaaataaacagagcaacatagttatttccctcccacagcaaaaatgtggggtgatactcgtcggaggtcgacctcgtcgagacccccgcaaagacgccgccaatgctcgcctagtcttgaccataggtcggtcgatgcccaccaactatccccgggtatggacgactacaggatggatgaccgccatatggatggtttggagggagatggggatgatcctacggaacagcccatccctaaggccaacgatgacacagtcttgcccatgccgggaagcgaggccgagccatccgcaccatctacagagagagcggagtgttggcggcacttcgaaaaaatcagggtaatggtggactacaacattgtggaaaaactttgtctgcatcttctagttcaggaacaggacatctcaaacggtattatttgacgcacctcaaggataaagcaccggcaggagcaaggcaaacacagctgagcttcggacccgacggttctgtaagtacatggacttatgagccacaactagctcgagatgaaattgctcgttacatagtttcggaggacctaccgattaggatgggcgaaaggaaaaattttgagaggatgatccgaaatgctttttgtccacagtacacccaggtttcaaggaaaaccaccaagaactttattgtttcattatatcgttctaggttggatgagttgaaacgcttgttcagtattgttagcttttcttttgttgtgacatctgacatttagacatccaagcaccaaagaacctcttctgttagtgttgttgtgcattatcttgacaataatcgcacactaaataagagggttatagggttttaaatgatgtcgtcacatactagacgagccattgctgccacactactagatatactacaagaattcaatttacaatctagggtggtttctattactcttgacaatgcatcagcaaatacaatgggcatgacgattttggagccaaatctgcaaagctacattggaggttatgttatccatcaaagatgcatttgccacatcatcaacttgattgtgcaagcaggtattactagtcgttgagaatttattgaaattcattttttagtgcaaataatttatcaattttaatgcatatgtgacaaggaatttattatctatgtaggatttactgttattaccaatttacacaacaagatccgtcaagctgtttctatcatcgagggtcagtcagtgatgaaggagagattccgggactattgtcgagcaaaggataaacctgtgaggatgtttggcattgatgtgaaacatcggtggaacacaacatacctcatgctgcgtcaattgaaagggtatgaggaaataatttctgttttcattaattcattgcactttagaagtaatgataccgatgaggatggtgattgtgagattttgcttcttactgaggaagaatgggacatagcaacatgtctatgtatattcctaaagcctttttataaagctatagtcctactatctaggatttactatcctacttcttgtttggtgcttgaatgtctttggaaatcgtcccttatatttcaagaaaaccgacatgatagagttttagcttctgctgttcaaccaatgaaggaaaatttctcaaatacttcactactattccacacctttattgttttgctttggtacttgatcctcgtaaaaagttggaggtcgtggaggctgctttcatatcaataggtgatgcagtgggtcttgattattctgaagcttatcaacatgctagagatgagttgttcagggttttccgtatgtaccaaactaagctaagtgttgttcgttgggtgcctgaggaaaccccacaaaaaaagtaaagcaaatcaagtgcaatgaatttgtggaagaagatcaagggcaaggaacaagcttcctcatcaggtagcaggtcaaattggaacccagatgcggagcttaaccattacctcaacaccaatcgcacagaacatgatcgaacactagatggtgaaaatgttgatctgtttgagtggtggaaagagaaagaaaggactcttcctgtgctagctcactttgcacgggacgttctattggttctggcttcctgtgtctcttcagagcatgcattagtgaggttggaagaattatcgaagaatggaggtcatgccttgcacctgacatagttgaggcaatcttttgccttaaagacttgattgaagcatatgcaaggacgcaacaccggctagaggatccagagattgccgatgcagcggcagacgcgttggcggaatttggcatatccactgattgcggcggtgctaatcaaaattagtaatgtaatttatgtaataatgtaagcaagttgttatactatttttcttaccggggaaccctactctagggtgtaaggtttttaacgaagcaacaactttgcatccctattctgaataaatttgttttccctcaatttttacatctcaggttatttgcattcggtgtgagaacaaaaatacaatacatatttttagacgaggtaataaagtattgcagagccatctgggcgaaaaaaaagaagagtgtgaccatattgttttccctactcccaaaaattccctcctcttttcagatttccatcccaaaatttccctcctctatttcatattacaggctgctacagcagtgcagcatgaggtcattagccatcgctaagggtgcaagcggctacccacaaaacccacttataaactaaactaacccgcgaacttgtttatttcgacctataagtgggttcgcgggtgacccacttcacccatcacccatccacggtcaaaacttcccatgcaggcatgcagctagccgctagcaggtagcagcaagtagcagctcttcttcatcgcctcatcggtggcaggtagcagcaaccagcaagccagcaccagcagttggcaagattgttcgctgactgacgcggccacgtcgccgcgacgagccgacgaggaggagcagggtgcgcgtggccgtcactgccgcgtcgccgcgacgggacgacgaagccgcacgccaccactgccgcctacctgcgcccatcgccatcactgccgccgccggagtttcttctcagcgcagccggcctgctccctttcttttgggctgtgcttgtgccggcccggcacgaataggcccatcgggccattgggccgtgcttgggctgcgtccctgaagaggccgtgctagcacggcacgacacgacgagtgggccg

SEQ ID NO: 82611 - DNA, 3058 bp, Oryza sativa
cctgttcgtctcgttattacgagccgagctggagctctcgccggcggcgaggctgaccgcttgtgcggctccggccgcggcggcgggcggcggggtggtgcggctgaggaacgaggagttcttgagcgacgggaggaggctgccggcggtggagatgagctggacgatgaggcatgtcaggtcggcgttgacaagctgctgctccggcgtcgccgccgacgacgacgaggcgcggcggccggccatggatcggatgacgtccttgacctgccggatcttctcctcgatgaaggtgaggttgtccagcatcgtgtccgggctccagtccatgtgctggatgctaaccgacggcagcagctgctgcggcggcggcggcgccatgccgaggagagcgtcatccgccatgaacgggtagaagagaggattcatggaggtcaggttcgcagcctgatcgcgcatcgtgttcgtcatctggtcgcgatccattgcaagcttctgaataatctcgcgtgatctttattaggaaaagagatggcgcctctgaaatctgcagaggaagaggaatcaagatcgttagccagttcaaagattgttcttgttttttttcccccaagaaactatttgatgttatttttgagttggttgaaaagtcaagaaactgggaactaattagtagtagtaatctactagattatcaagtgatgcaagatttgcaatctgctccatccttttcactgacacagtcagcaatgctaaaatgaagtttaaatcgattttttttcccataaattacttgatcaaggttcttctctgaacgaatatgctacgaattaaaagatactaccagctttgatcattttcagaatcactaatttattactaacacaagacaggagaaaccaacatcctttttttttcctaagaacaaagaaaaaattttgcaactactgcaggctgcaggaacaagatatcttaagaaccaaaagtctccttcttagttcagaataacctaacaattcacctaaacttaactagttaaccgtaaaccctgaagaaatttctacaagaacaataaggaaaagccttagatccaagaacaccctctctatcctcccaagatcgcagaaaacaggggaaacttatatccatccaaagttccaaaccataataacctagaacgaaactgtcaactgtacaagaagaagccaaaacaaaatcaccagcaagatggttccaatccagcatcaagccaaaacagaagaagcttacaagttgctgatcagagatcacatacccaatcaaatcaagcagggggaatcactcccagctcgtcgccatggacgcctagccgtgtctccacaccaagaacagcagaacaggagaggagaggcgagcgagaaagctagaggagatcgaaggaagcatccgggaagctgggggagctagctaaggcgtgagctgtaggtcaaattaatttgggggtgggatgggctcccgattccaagatcaggatcgagagaggagggggacggatcggtcgtcgattgcccatcatcctatcttagtttagtcggctgtcagtgactaatagcgagggaaattgtttgattagtcgcctcgagtctcggttcactctgctcgagcagttgagcttgagctagacctctctgattgtgggtgtcgcagcctgatttgcttgccgtctctttggttggcagtaacgcaggtgcttagcacatgggagcacttgtttatatcagcttgattatactatggtttagtggagggtagatcaggcctttgcgtgtgattgtatttgttttcagacggggtcctctccgtagggtttgcaatatcgcacggttacaccacggttattgtgcggtaaccttctttccggttttttaaactttatgattcgtaacctccggttttcgcggtaatcgtgatactattgggtagagataatcctcaccaatatggtagtaaaggaaagtctgcctctccactattatgtggccaccgagaactgatatagaactgaaagaaaaatatgagattatttttaagggcacatttgaaatgcaggattatagaaatatattaacattcatgtacgatagccaatctataggattttgcacagtccatttctttgttttaaatgaccttatacaaatatttcccaagaaatgaaatccttcagattttcttttagggcccctttgaaacgcaggataggaaaaacacaggaataggaaaaacgtaggaattgaagttgtatgtttttccaatcctacagaaattgaaaacacaagaaatggagagaggagccctttgattataccacaggataaactcaacaaaggaaagtttcacaagaggtctaatctcttgcttattttcctatggaattgatcataggaatgcaatcctatggaagttttcttatcctctccctatgaatcaaagggctctataggaataaatccttaggaaaatgaatcctccaaaattcctttgctaatcctccattttaaaggggcccttaaatcctttcaatctcaaggagccctaagatgttggtgtttttgttaccttatttttgttggaaatttagtgaggttcactgatgtatcaatggcctttactaggtttagcacttatatttactttacgccatgctatatattgtacaaagttccagttagcattgttccagttagcatcatgatatacatcatcaaacatatagaaatttcattaaacctcacaaaatcaaaatgaaacttcatgaaacatgatctatatttgttaagtctggtatgtctcgctcatgtttttgtgatatttccctctgattatatgaaataacctagtgcaaaagtaaaacttatttccaaatacactagtataaagtgaaagtatacactagaccccatgcaaagtgaaactagatacactatacccaatgtaaagtgcaatttgatcttaatgtatgttagaagagacacattcgtaggtgtgcgagtaaacagtacatgtgtgtattttgtgc

SEQ ID NO: 82612 - DNA, 1933 bp, Oryza sativa
atttccccaactctcgagatctatctaatggcacgcttaaaggtcattaatagggctttatttttttgccgtttgttgagttgtcccgtttcgcgtgtagtttcggagcccgaagacccgtagtgcgaggatttcgaggatcaagctccagatctcgagcaaggcaagccacctttgaacatcttgagcctatatttggaatttaattatattgcttgcaaaatattatgcattgataggatcgcactaaatcttttgtcccatctgcaagacagattggcggacttacctaacttgttgcatttgatccttccattgttaattgccatactatgtccccttgtaaccacccagttgcacctcgatattcgtgcactctgtgcaagtatcgacggtcgccttcaaacttaaaatctgagtaacaacttgggtaaaactggagttttacaaaagacttggaaaacccgacacctgggtcggtgcttgcgaactaaatgaatttccaaaaccgcggaccggggaacgtaccgggtgtacggtttcccgctctcgcacttaaggaccgattccttggaatttcatccaaacataagacaaagttgcttcctcccgccgtggcccacgctttatccgcactgcgcggaagcgtgttgttggttcttccaccgtgttccgtttccactacccagctcccccaccgccagcagcccgtgctgctgccggccctcgacaggttccgccggtcccttcgcaccagccgatcgacgtttcttcgacagaggagccgactacaggaggcagccaggccgacgaggagtagaggaggcagtcttcagcagccgtccgtgtgtcaggcccttttgttccgccgccaactcttttggagtcgtggcgaggtagtgcgtgtgtgtgtttgatgtgggtgttgtttggtagtctggttctcctaggtggtgtgcgcacagtcaagctcggcgtagctctgtgacttgtccacacccgttgtatcaggtgtttttatgatttgaaaaatccagtttatgcctagtgtgtgctatctgagttgctatttgctttgctccttgccctcctaagtgcttatctgactcttaccccgcccttttctgggagtttagatggctagccgcccccgccgtgcagctcgtgcaccagcccgctttggttttgaagatggtagagttgaagcagaagcaaatcatgaatcagctaatgagcagtctcaccacagcaaccgttcgcaccgtactgtttcccgcaacgcagaggttgagcaaccccgccgcagcagccgctcgcatcgcacagtttcccgtgatgcagagatggagcagtctcaccgctctcaccgcactgccagtcacaattctggagaagaacgcctcccttccccacctcatgtggaaaacaacatgcaacacttaatggcagttcagacacaaatcttgcaaggactaaccacagtcatagccagttttcagcataatgcacatggaaatggccaccctcacatgggcaacaacagatccaagctgacagactttctgaggtctcgtccgccagagttctctcagaccgtcgagcccgtcgaggctgatgattggttgaaagatgttgatagaaaactcaacttagtgcagtgtactcctgttgagaagacgctctacgcctctcaccagctaagaggacctgccgcagattggtgggagaattactgcaatgcacaccctgaacccactaacattgcttgggatgagttcgctacggcttttcgtgcagctcatgtgcctgaaagcactattgacatgaagaaagaagaatttaacagacttaagcaaggcaacagcagtgtcaatgagttcctaagtcagttcaacaagttggctcggtacgcccctcaggaaggggccgcagg

SEQ ID NO: 82613 - DNA, 3655 bp, Oryza sativa
attacaacaacagaacagttttgtttatatgtacttatgtttgacatattctttggctgtcaactccacactgagatttatgcaaccttcatggcacaggcaaagtttgcacatgggctggtaggcctatagatgtggggtaaggaaaaaagggtgaattgtaagagttagataaaaagaatttgctggtggtcagtacatgtagggcacatggaacttaagaaaattttggtacacactcctgattttatagtgtaatgtttaaaatttagcgtaaatatactttagaaaatttacaaactgttttggacttttgacatgagcccgatgtcttttgctgctttgacaacttgcagcagcaactatgactactaatgttcaagcgtacacatattagaaccaatatgtacatatattagaacatagtgaactattaacctatttgattttaaaatttaaaatgattagatattatcccgagagcagtacatcaagtctcagaaaaatacaaccaccaaagccaacctacctgcagcaatctacatgcagttgctacctcaaattgcatattgtgcaaatgtaggacaactaggtcttgctaaaagtgctttttttatggttgtggattgtaatcaaagacgtgcttaaaaaaagagtgagacttgttatacccatggtttttatcacttaaaaagatatgagaatgacggcaatactaaaataacagaagaaaagtacggtgttattgaatgaaccataaacataaactctcagtgtaaaatatcccaaacaaaaatgttatgcatctagaaagtatattttaggtcaagagattcgttacatggctacaaggtcacaaattagttacagccttacaggtctcatgtatcatcgttttgtgtttttttttacaatgaacggacttacctattggatagggtgggtcggtcggtccagctataacctgtgtcatcttacacaccagaacctcttctagcactgagccatccatattaaccaccgtctactaacccataaacaacccatcaaattaatattttactccagactagaaatgaggcaaattgctcgtctcttcgtcccgagccatcgactattcattcgtcttcatcacctgttgcttgatacttgttccttcgcagtatcgatgattgtgctagtatacatgtgttgacgatgtattgtgcacaggcccatccgcccatggcccgaagccctagccagcaacatgttagtgggttatgtatggctaagcgactctataattgcattctatttttcttttttgtctttgatgttcttttgtaccttaatttattgattgcactcttgttctcacacggttgcaaaatatgaaacagtatgtgttatattccattatttttttcaagcatatctgttatatctttattttagatttagagctatgtccgccgaccatttatcatggcgtgcaccgtatcttccgttattttgtgaagcaacccacgcaatcccgctttcaaaccgcgaaggcgtaaatcctcaatttcccgtcttcgaagcgatatttccactccactccacgcaatcaccgtgcacctggcttggcgcgcgccacgcgcgggaaccggacgaacacccaccttccacacgccaccgcccaccggcgcgccggccatggctcccctcctcctcctcctccccccactccgccttctccccgccacccttcttcgcgccacaagccgcccggcgtcgccaaggcgcggcctctcctactcctaccccaggcgcgtcgccgccgtcctgcgacaatgccgcgcccgggcgccgcctccgcctgctcctccggatgccgtgccccggtggcacgcggcgctcgcggctgcggcggggctgtacccggcgtacgtgacggccggcgccgcggtggccgtggcgcggcccgatgcgttccggtggttcgtcgcgctggcgccggggtcgtacacgttcgccctgggactcatcatgctcgccatgggcctcaccctcgagctccgggagttcttggctctcctccgcgagaggcccctctccgtaagcaccccaccccaccctgcaaattttggcactaaatatttctccatttctaggtgtacaattccatggcaatctttcaaatttcaattgtgtccttgaatccaagatcccaaaattgtgactgatccaaaggaaataaattgtgtgttttggccgctgtagatattgtttggttgtgctgcacagtacaccataatgcctgcctttggagcaattgttagccgggtgctggggctctctccaccaatatcagtgggactaattctgctaggatgctgtcctggaggaactgcttccaatgtggtaagattctcaaacttgctcagagaatatgccccatttgagatggatcctcgactggattattgccgcgaactgtctactttattgtggagataaattaaacattttgagaaataaacttaacaaaataatttagaacaagtggtctaagcaatgtagtagaatttgtttttaaagaaaatgtatttttagaggcgtgaagccaggggcggacccagcccagaggcaaggcccggaccggcctatagtatttgttttcataatattagcccatgggatattgggctttcaaccccaggccccgtgccatggcctagggtgcccggggtcggggtccgcccctgcatatagcaaataatacatggctcgactatgagtctatgacccgttttgtactgaaggggaattaaggatcaacacttcaacagacacatagtagtgtaaatcaagaattcaaatgtgcatattatttgaatgttcgagtgttctagcaatttcacagtgccacagtccaatgttgaattttaaatttccaactaggattaagatcaagtgtgctttatgaaggtatatcgactatttaaacgattgattccaacagttaacatatgttttctgagtgccaagaaacacacaattatctagagcaccaagttatttttggtggttcctttaggttatttctacataagacgttctgttattttactttatcttcttggctttatgaaccctgagctctccaagtatatgctgtgtgagtcaaatatgcatgattaaacaaagggtctctcattcaagataaaatcatgatggttggaggcagagtatcccacataggttgtccatgtatgtggatgatgtagttatgttcttcctagcaatattcggggaagcgtcgggtctaaataccaagttcgcaaaattctcggtgtttctgagctgcctagtgtggaattgcccctgtgctgttcatgattcccatgtaccttgggttgcctctgtatgaaaaggcacacaaatattttgcatgctgaaaaaatcatttgtacctggattttctttgttatgtattgacctagttcttccatatagtggttcaggtgactttagttgctaaaggtgatgttccactatcaatcgtcatgactgtgtgcagcactcttggtgcagtgttccttactccactgttaacaaaaattcttgctggtgcttatgttccagtggacgcggtgaagctttccttaagtactctgcaggtgaaatt

SEQ ID NO: 82614 - DNA, 3249 bp, Oryza sativa
gcctcaaggacctccttgcgccgccgggaagccgtttcagtttccgtcgcccgccgcttttgggcaacggcggtgtcaaggaccccttgggcggcgtcgagctttctctttagctccgcctcccagctcgcgtgttgaaggcggagggtgtcctgcgcctcgatcatcgcagtggtggcgatgagggtggccttccgctccttctccaccttttggggcgatttccgccagcgccgctttgcgggcttctagctccgagacgtgacggcggtgcgccttacggcccacctccaccatgacgtccaccgagcgccgtccctcctcgacacgcgcccatgcggcctcgagctccgctcgttccgctcgcagggcctccacttgggcgctgaacccatctagcaccgcagtgtttgcggcggccaaggcctgcagaaggggctcggcgctcagcggggcgacagaagacgaggagaagagccgccttggagagaacgcgacgcggctcggcccgccggaggaggcgctgggctcggggatgtcccccggacccgtttggtcctgggcgtcgcccggagaagtgggcctaggcgatgcgcccgcggcctcgtcgcgagccgccccggaggccgtcgcctgagcgtcgcccgagggagtgggcccaggcgatgcgcccgcggcctcgtcgcgagccgccccagaggccgtcgcctgagcgtcgcccgagggagtgggcccaagcgacgcgccagcagctttgtcgtgagctgcctcggaagacgccatcgcctcagcttggcgagcccgggcggcctcctcccgagcggcactctccgcttgacgaacccgggcggctcccgggcgggctcttcagcttcccggaggcgatctggggcctctcggccgtcagattctcgccttcggtcctctgccggcggccgatcttctggctccgactggccagacttggggtggccggaggaacgcgaccggacattgctgaagcagaagaaaaaaaccagaagacaaacaagatgggtaagagaaaacttgcttttgggataggagaaagacggtcgtaatgagagtgggacgaacctgcgagggggtcggttaaatgaccaccttggaggggaaatcaggtttccccgggatggttccgtctcccccatcttacggagccgcttcttcttgcgctccccctcgggttgcgatgacggcgcggccccctccgggcgccgactgctggcacgcaccgccccgccccctcggggaggagatgggggaggtgttcctcccagcttcctcttcccctgggcgtcggcagggcggctgctccccgagcccccgacgcggggccagaagcacgaccccctcctggggtagattgtcccccccggcggctctcgcccacgccgtcgtggcccttaggggtttcctcctctgaggccccgacccccatcataatggtcaaaatagaggcgcggtcgggatcgctgcagagggggaggattccttgaggaatgagagacgcctccacggagctgagattcagcaccctttggaccacgatcttgaagtcctcgggagcccaatcccatctgactccttggtgggtccgcatgtagtcttcggacccggagtactcccaggcgctccgggcgcgccgctggagcggcgcaatccggcgacggaggtagtcgccgtacaccatggcccctgtaagcccctgggatcgcaggcccgccaggcgatcaaggacggcgtcatagtcatcccccagatctaccggcgcccgccagctggagacctgcgccgggggctggcttggaagtcggaggcgcgcttcgttggcgaggggggtgtagaaccagtcgctcttccagtcgtcccacttcttgcggaggacgcaggggatgtagcggttcagcaccggcccccgcggctagaagtagcagccaccaaccaccgacggcggcgacaccgactgcacggtgaagaaccaccggaacagccgaagagatgggcgcaccccaatgaacatctcgcacaggtgcgcgaagatggccaatgtcatcaccgcattgggggtgaggtgcgccatctggagatcgtagaactccagaacgtccataaagaaggaagaaaatggcggaaccagccccgccattgcgaaggggaggaagaagacggaccgccccgggtagtctggtgccgggcgtccctcgcccagcatcactatctcccggccggtggcagattccggcatgaagcggcgcggcagcccggcctgcctctcgctcacgatgcgagaaggcagtagtacgctaccgtcgagcagagcggagccccgtgccatggcgccggaggaagggatgattgagaacgagcgcgtgtggcgaaggtggggcgcagcagagaaggagttagggcgcaagcggcgaaggcaaggggaataatggcgaaaggaagggagcaaatcttttcctcggtgtctttatacccttgccatcgccgtgcccggctcctcgtttctcgcgcccactatctcgctccctcgtttctcgctatctcgctccctcgtttctcgtgcccacgcttccactaatcccattcgcccgcttgcggcgcatgaagtggatgtgcggttgcggcagtcgagatagatcgtatcgtgcgcgcgttaattacgctcgccgaccgaagcgacgttaccatatctccaggcgaagcaaatcagctcacccagattcgtgcgctgctcaagtgatgtggcagtcttgaagagaccgcccattatggacagccaagttaccattaccgatgtgcatggtttgagaccgttgggtttctgcgcaaccatggaaaccggtcccacctgtcaccaagctttaggagtggcgttacgcccgaccgcttcccttgagaagggcgatcgccctggcataacgccgggggctactgtcggtgatatgggaccgggggtatcgtgaccagaggcttgaggcagacacaatcgcccacgcggcctggcaccttcggggacgtcgggcccgagggtgaggtgtctgccctcctcctgatttctcccgaggggggggtcgggttactcctgccccggccccgagggccgaggcaccccgaccccttgaggaagtttgcgccacatatatgggataggtgacacggcagtgctcacctaaccgcatttattgtagtctggtcaagcgtgtcacgctgcatgcagcgcag

SEQ ID NO: 82615 - DNA, 1821 bp, Oryza sativa
ggactaaagatagagtatctttagtcccggttggtaacaccaaccaggactaaaaatggatttttactcccggttttttcacccaggactaaagatagcgatctttagtcccggattctccaccagtgaaagttagatggacgtggtcactgacgtgtaggcccataaaggtgggccccacctgtctgcgacccacgtctctctgtctttacgtcagaggagctgtgtcctactaactggtttatccaactggcacatgcacgtgaacacaatagtacagcacaagatatgtgttagaacaccacgaaatgtcatagaacgcaccatgaaattgatgtgatcttagactgttgattgattcgatctactactatttgttacatgtttcatgttgtgaacaacttcaggaataagtattaggaacaggaggcaagctgaagccgacaagctggcggcggggtgactcatgatgatgaaagaaacaaagcatcaaactgaactgaagttaatcatcaggggataaggttgtgccctgtaatctttttttttctgttttattttgtcctataatctgatgctagttaagcatggataattagtattgatgatagattggagggcccctgattagtactgatgcaagagtagtactactgaaagtctgcaacgagttcatcctggacggcagccgtaaaagggtcaatttgtcaaattcaccactccaagcttccaagtattgggtactatagtataagctaccaatctagctaggtaggtagcgttgtgtggtgtggctgaataatcagagtgtttccttttgttttgaagttagcatgaatcattttacggcctattcctggaaacaaacaaaattacaaatacaccctacaaggaaacaagcaataataagataatatggccttttactagtctcctttcctaataaactactataaaataaaaataataaaaataataataataataataataataataataataataatattattattattattattattttgtaatggtttgtctatttggtaatttattggctaagtggttgcctctatattgggcagggttttgcgtaaaggttagactggtactactaagaaaacgatttttttcgtgcggtcgaaaagggttgttgcgtgcggatctcacccctgtctgcacctaagtgtctgcaaaaatccaatttttttgtgccacgcgaaaatgattttcgcgtgcggttgggttatgtcgcccacatggaaaaaaaacccaaaaaaaaaatccaaaccctaaccctagctaccgcccaccgccaccctcctcgccgtcgccgtcgttgtcgacgtgcgccaccatcgtcgtcgtcggtggcggcgtcgccgccttctgccgcgaccggccgccgcagctggctcacaagcccgtcacctctcccaagctcaccgccgctcccggccacgtcgccaccgccaaccgctggatccagccggcgggagaggggcgcgtcctccagatccgggcgggcgagggtcgccgccgctcctggctgccacctgtcagccaccaagcccacacgctgcccgtgagagacgatagacgagagagagaagaaagggaataatgaggataaggatcggtaggtggagaggataagatataaatttttgaagtggttgagagagaaaaattgcctgaggagggagggtattttcgcgtgctatgctcttaagatgcccgtacgtgaaaatacacttgtttttgcgtgcggccttttaagagcctagcccgcgaaattgccctccccccgcaggc

SEQ ID NO: 82616 - DNA, 923 bp, Oryza sativa
gtctgaccaagtcagacggcttatgggctgattcagaaatatctgaacatataaacaatgtttagatcatttgtttattagcaatttttatacgtagaaaacatttatgccatgagtattatgcacaaatgccaaaatatgattatccatgatactcttatcgctgtatcgcatggatgggtgaagacagaaccatatttcctcatcaaactttttgattgaactttgaaccatccaatgtacagttatacatcaaaatgtgtttggctcaagcgcaatgtaatttgatttatcttttgaacttattggaacagtcgcaacaagctgtgttttctgaatatcatttttgtgtctcatttttgtgccgtaataatatatgctgatttgattaaatagcacattaccgctaaggaattatttgctctatgttaacaggtcctggcaaaatcttctaagatgattccaggtgagttgcattgatctatgcatgctatgtaatgtaccttacagaacattatctacatctgaatagttcttctgatcattaatttgagcttgggtgggtatactcatctgagcagtttctgtgtaaaaaaaaaagtacactggaaaattggattttggtttggcaccacaatattggctgctttagctgttagtacgacaatacttgcattttttttgtcaaaaccatatcaatttcatgacaagagcatttccattagtgctgatatttggtggtcagagtggtgtaggtaatagagcaatcagtgttaagaataacttttaacagtagccctttcatgtttcatagtctgtatagtgatgtgcgcatatctctgaccaatgatttaatatgtacagtaatgctgatgggaactatactgtatggtgtcaagtacacatttccggagtacatttgc

SEQ ID NO: 82617 - DNA, 513 bp, Oryza sativa
acttggtttggatttaacctttttcacgatttgatgattcctattgtggagattatgggtaccccatatccacacggcatggttatccgactagtaataggggataacatatatgtatgaaatatgtaacagatcatgacttgggtattacgtttccctgtatattatggaacggcctaaagtcctggcttgataagattgtaaagtagatttaggaaaccgataccgtgttggttaaggtttctatcttgtaatcctgccccccatcctatataaggtgggcaggaggccctctagggtgcatatgacacaacctgatcgtcagatctatactacacccggcggattcaaatccccaaacaggagtagggtattacctctcattgagagggcctgaacctgtctaaatcctttgtctctgcatccatccacttttaggtctcgtgtgctacccccttttattattgccgaaatcatgtttcgacagttggcgcgccaggtaggggttgcgtc

SEQ ID NO: 82618 - DNA, 2444 bp, Oryza sativa
  unsure (1)..(2444): unsure at all n locations
gagggggagaaatgacgataacatgtggggcccacgtgtcggtgggtcccacatttttttttgaatgacatgggggtcccacaatttttttaactctaatgccacgtaagcgacacgtcgacgacacgtgggctgaagagcgggtcaacattgccacgtaggcgccacatcagccaaanccgcttccaaccccaccaaaggatatagtttgcatcggttttgatagttggaggagtctatatacctggttttgtggttcgaggatatgaatcatactagttgagggagtcaaagtataatttttcctttttttttcccaccgggccacggcgcccatgggccaggcccaggcgaggcatcctattccgtgacgtggataaatttctttttcgtctcccctgatcgcttctttccccatcgagagttcgccagaaggaagaaacctaaccctaagattgcgattcggcggcagcgacgaggcgcgggcggagatgaggaggcccaccatagaagagaaactggcgacctactccatgttccaggttcgtcagggatccaccgtcccgatcaccgcgcgggagtggctggactctgtgatggctggagttggctcgatctctctggcggtgcggggtgctggctcgatctcggcggcggcaggagcgggagatggggcttgctcgagctcagtggcggtggcggggactggctcgatctcggcggcgggagcggcagatgggccttcctcaagctcagtggcggtggcggggactggcttgatctcggcggcgggagcggcagatggggcttgctcgagctcagtggcggtggcggggactggctcgatctcggcggcgcgagcgggagatgggcctttctcgagctcagtggcgggggcgggggctggctccatctcggcgacggcgggagcgggacatggagctgggtcgagctcagttgcggcggcggggtcaggcgaagccccggcgaggaggaagaggacgcctgggagatggaggaggatccctcgcacgctacctcatccttgcctgagaaagaggcccatgacatgggaggagcttctcgcggacagcttggacatgagcgatgaggttcactgcttcagagaggaggataagcccgctttccgcaagtccaaggcgcagatggccaggttctatcagaggatgatcgacatcgagaataacaagatcaaacaaatcttccgaccccgcgtcccatccgatacacagtatgttaaaccccttcttctttctttcttttttttttctcatgggtatgtcaactacaccactaagaaaacatcatacaaatagaactttcctttcgtagatcctaacacacgtgaaatagcacacccattatattcctcattacaaagttcatgtgaaaaactatcattgtttttatcacttataaaacagtagtgaccgcaaacaagacatcgataattcagcttagaatagatctcctaaggacacaaggaagaggtggagacagaaaagccaaagttacttaatttggagacgaattctgtacaatcctttaaatgggtaaactgacattacaacttgcaaccattttaattaataagaaatgtggattttttaagctgcatttccattcttggtcactgaaacagttaaattataaaacttcagttgattcatttagctagtggtaagagatagaacatattaacaattgaactcttgtatatgcaacggatgtaatagttgaagtacgctatcgtcatagtattttaactcatcagatgcatcatgttcctgtgcaaacataggtggccatcttttatacagtctagcaactctttggtacttggccaaccttcacaaaaggtgcttgcatttataaattgaacaatcaaaggtcagatatgcgacagcaacagtgaatctgaaagaatgtcaggtactaacttctagagttagtttgaccatctcagcatcccaggatcaaataaaaattttaaggatggtttaagaatgtgcagtccaacttaggagttgccattagtcaattctctgagtttgaaaacaacactaaaatctgagctaattttaaaggaatgatccatcctgtgtgctgcactaatattcaataattatgttccaatctggatggcagacacaatctggatgggcttgaccaaggtttcatgcatgttgggtaatgaatattcccggggacaaaattaagcttgggtatgggtattcactattgatgcccgccatgcccaattgtcatccctatctatattcctgacaaaattaagtgaatacctaaaattggttttgtccaacacactgttgaatctattactcttttgaatatattgcagcgagcaacatttgaccgcagaagagatggaggcagagttcgctggcaagaaagtttcttcc

SEQ ID NO: 82619 - DNA, 5064 bp, Oryza sativa
  unsure (1)..(5064): unsure at all n locations
atgatggccaacctgcaccgcgacagcgtcccccaagccggcaagtatacacggtttagacgtttagttatttgttgtaaccttgatgttacaaggtagtcactgccattcgtgtgattggaatgccgttttgtttgggaaatttgagagccatcgggtgagaatacgaaaaacaagctaaattctacttattcttagggcctgtttgggggagtttttagctactgcagcttctcccagaatcagaagctcccctaaacagtctagcttttggtctaaattataagaagctgtagttgtagaatccagaaaataaaaagctagaagctgggaaacccagttttttcagattcttagaagctggcaaccagccagctgtttctcagaatcttaagctccctcaaacagacccctagttcatttttcagattctacaactacagattttcagaatctgggtaaaaaactggactgtttgagggagtttttggcaactggagattctaggagaagttgcagctactagaagctcctccaaacagacccttagaatctagatgaaaagctagattgtttgaagagccgaagatgaaattgcagttacaagaagctcccttaaacatggcctgattggctgattatgttgtcaattatcaaaactgtcagctcctcgccatcaggcttccaaaacctgctagtgactggctgtagcctgtagcaactagcaaccggtttgtggtaagtgcataaaaaatcgttgaatgctcgcatggtttgatggtttgaatgctcgcattaagattcatgtgactgcaagccaaaaatctcaccaattcacggccagatcgatcgcgatcgagtgagcgcagaagtttgacactagctccggtcattcacgcacgtgggttttcgcggttgcttccttgctgttgaacatttttttttctcttttgtaactaatagctgttgaacagttatgttgctagcaaccttagctcgcagagaaaaaatgcgtacggtagcaactaactgacaacatactgtcattcgtgctcctttcctgttactactccctccgtcccggattttgagtttttccatactacgtttcaccactcgtcttattcaattttattttgcaaatataaaaaacgaaaagttgtgcttaaagtactgtagataataaagtaagtcacgaataaaataaataataattttaaatttttttaaataagacaagtggtcaaacgttgcaagtaaaaactcaaaatctctcatattatggtatatatattatggtacagggagtactaaacattaacgacgactagttgatccaaattaaatatatattttttgatggttcagcaatactaaggctgtgtttagatccaaagtttggatccaaacttcagtcattttccatcacatcaacctgtcatacacacacaacttttcagtcacatcatctccaatttcagtccttttccaaactttacaacgatctaaacacagcctaactaacaaaaccgttgactcaccaatcgccacacacattgtcgacaagtacaagcgccgtacgcaattaaaccctacctatgtaaagagctcgccgcgagcgctgcatcttgcaaacacacatgcatacatctctcgatccatcgatcgaatcgatcagcttccttctgatctccttcattcccgccatggagagttcgtctcgatctccctgcatttgcaagctgctggcgatgctgatgcttcacgtngtnctgctcgctcctncgctggtccaagctcggccgctcgcgctctgacatggacatcgtctgctggagtcgtcgccgccggttataatgctgccgaccgacgacggcgaggccgtggccgccgcctcgccgggactggatgtgccgggacagctgggacgatccggcggggcgccgccgccgcctcagtcaaatcggccggggacaccgctggccgggggttacagcggcgtgtctggggggagggcgcccaccaatactccgccgtcgcctcaaccgggtgggtcgacgaagccgctctccgacgacgacgggaagccgccgctggggatcgctccgccgtcgccgcagggaaacaagccgcctatcacgtctccacgtcttcgaacaagcacggatcccccgctccggccgccggcgccggcggatgatgccgccggtttgctccgcctgatccgcgacgccgtcgaatacgtgatcggcgaactcgaagcctgatcgatcgagaccgaggaagaagatgaagttatataaactgtaccattaattaccaactgtatgaatatatgtctagcttaagtagacgagcacatgtgtatatttattttgcatgcatgttaatttcgtcactagctaagtaggctagcatatatatctatcgatcctcatggtagtatttcgaccttaattaacatgtatcttttcgatgtttcaataagtctgaaattctgaatcaataaaaactaagttgtattcagattggtgtcttaattataagtttgccatgatttaataaatttcaaaatttgtaattaataatatccggttgtacttagtttgggtctcacaattataatattttcagttttgataactttatagaatttgggattaatgcttattgtcgacgggctatactcgttgacgagatttgtagagtatactcaaatagttatagaaaaaattaaaaaaaaaatagtaacatcaattgtgatgatataagtctatacacaaacatgcatgactaaatttgatctataactaaagaaacaaaaataataaaatcagacagtgactagtccctgtacagtgcagataaaatttgttattttttttctttgtatgtcgattaaatttagacttgtatgtttgtatagtgttttatattaacatagcctatcttattaaattttataaaacttttatatgactgtttaaattacatgtatacacctaggtaccatgtgtagaaaatactttcccggtgatatacccaaaacgaagcgctgcagcttgcaacacacgtacacatcacatctctcgattggcttccttctccttcccggcttcccgccatggagagttcgtctcgatctccttgcactgttgctgctgctgatgcttcacgtcgtccggctcgcccctccgctgctccaagcacggccgctcggacacggcggactacgtctgcaggagtcgccgccggttataatgctgccgaccgacgacgacggcttgctgaggacgaagaagagccgctctcctccgccgtgccgatcagtctggccgacgacgacggcgtgctggggaggccgcgccgctctcctccgccgccgtcaaccttggtaccccggtgtgccgcgacgcacatgcagctcgccgacgacggtggcggcttgccgaggaggcagtggcatggcccccgacaccccggtgcaaccgccctccgatggcgcgcgtgtcgcggtgggacggccggcagcacgctccgccgacgccagcggccgggaaacccgccgcgtggacacaacgtcgccgtcgtttgcgccggctgccggccgccgcttttctccgggtgatccgcgacgccgtgcaatacatatggtcggcggactcggagcctgatctgtcagaagtataatttccttgttttaatttcaatatgtttatttgtatcgttatatggtataggatcagctgagcaggagccaaatgtacgtgtgttgatttccgtgacatatgcataaatttcttttcgcatcgatatatatatatcaggaccactttctttcacccatcgagttcgcgaggaggaagaatcctaaccctagattgtgattcggcaagcggagatgagaaggcccaccatagaagagaaattggcgacctactcgatgttccaggttcgttagggatccaccgtcctgatcaccgcgcgggagtggctggactccctgcccacggcagggtcaggcgaggccccagcgaggaggaagaggacgcctgggagatggagaaggatccctcgcacgctacctcatccttgcctgagaaagaggctcatgacatgggaggagcttctcgcggacagcttggacatgagcgatgaggctcactgctttagtgaggaggataagcccgctttccgcgagtgcaaggcgcatatggccaggttctatcggaggatgatcgacatcgagaagaacaacatcaaacaaatctcccgaccccgcgtcctgtccgatacaccgtgtgttaattaaaccccttctttttactaccattgtttcatatcataagtagtttgattttttttcttaatgaaaatcttttgcctgcttgctcctttcgtccccacggacggcgccaaatgttgggacaaaatccaacaagcgtatgtgtatcacttctgtattcattatgcccaaatgtgagcaatgtttacatatttatacaaggatgtacaaggggaaattacatcgctaccctaatagctaatttatctagccggttggctggtgggccagctttagggctcttcggtcagctcctcggtgataggagggctgcgcccattaagggagtggcgccgattcccgagggcgccggctattacccgggtatctgggtaatagcgtgcgcggtatgccctcatcaacagcgtcagaggtggttggcagatgtgtagtgcgtatttatggcgtcccactacgatccgatcacccatcttacgtccaaggctcttgaagccctggcttccttcagagcccttgaacagctccggagggtctagaaggctttggagtccttggatggctccggagcccacggacagctccggaggccttgatcggccccagagcccttagatggctccgaaggccttggatgaccccggagcacctaggtggctccgaaggctcgggttggctccagcgcctctagttagctccggagcctaaatcagtagatgcctccggtcattctcctggggtggatggctccggtaggtgct

SEQ ID NO: 82620 - DNA, 14064 bp, Oryza sativa
caaactgattaacttaaaagtctgtgcgattcaaggcatgtgagaaattaagcgtcttgatgcaattgaacttgataagattgtaacatcaaattttcttcatgctttaaggaaattccatattacagtagagatagacaacggcgccgacggggatagttagaggcgcatgaatcaggaggggaagggcggccaaagcgcttccatcactcttcatcgatccaatcgatctttggggtcttggccgagcatctgggtttaggattgatcggatttgttgaattcgtagacaccgcgtgcttgcctgcttagtccttgaattcattgaagtgccggaccatgtcgttgcggtcacacttcacgccataaaacttgcaccacctctcgtgtgtacgtaacagatgaagcttacaattacatgcatttttattagaaggtttacatgaattttataaataaataactcgttttaaaagtataggaccgtagtaaattttttgcctaataattttttttagcatgaccaaatttacttaagaatagagtatatacacatatacagaattcaggcttcgacaagaggctgctgaagtgaatggaggttgccacaatagcaactttcagaaagaaagacgggttacaataagatgttactcacctaaatctttgaaaaccctagcttcggctctgattctggaaacacacgcacgtttctcttcttccaaaccatccaacaaaccggcagtataagagtgtcgaaagcccttatgtagtcggtccgaaaaccctaccgcatcgttagcataataaatttcatacctaaagttaatgcgcgattgctatttggcacgcgcgcgccagctggcagcctccacgcgacgccttttttttcgattttcctttttctttttcgattttctcctatttgtagccttttattttcacattttttttgactttttttaatcttaaacatatgtgttttcaaaattttgagttgaaagtttttaaattttgatttgaaaagtttcaaatcttgacttgaaagtttttcaatccaaattgaaagtttcaaatctcgagttgaaagttttcaaatctgagtcgaaagtttttaaatatgggtcgaaagttttcaaatctgggttgaaagttttcaaatctgggttgaaagttttcaaatatgggttaaaagtttcaaatttgagttgaaagtttttcaaatttgagatgaaaagttgaaagttttcaaaatctgacttgaatttttttttcaaatttcgagttgaaagtttttcaaaattggacttcacgtatagatttcttatcaatctattagtaaaaagaaaaccttccagaaaaggaaaatattgctaattaccatcattaccgctaattacgatgctgcagggcgttgaggggggtacggctgcgtgctacttccgtagccagcgcgcgcgtaaaataggaatccccaagttaatgagaaaagcttataaacccattgacgatgatcaacttccattagaagattataagatgttactagaacatataaaccgttttatgaaactaaggagtggcagggaacaagattgctctattttttaactcgatggagataaatattattataccaatagaagataaaggacttatttgatacatgtaaactaagcataattttattgtcaacaaagaaatttttaactgtttactttctactaccaacactttgaagtcaatataaaaaaaatatgtaacgtgagagaattaacaggggaaaacatacatgtagttctaccactaatataggtgattatgcacattgaagatagtgcctatgtactccacctcatttcttacacttagaacaagtttacttataaagccataattctaaaaattaatacgtcatatgtaaccaatttaacaatctttccataaaatagttacatataaatatatactcatacacatatggttttaacccatgatatattaactctgtagctcacttttttctctcgctccttcacctaagcacaaatataatgtgacaatttttagagcccacttgcatcactaactgtactcgttcttagccaatttcagttccgcaaatttctgtttcatcagacactacgtgcttgtgtagttcccaacttttttattcaaacttctaacttttccatcatatcaaaactttcctacacacataaacttttaacttttttcttcaaactttcaattttgacgtggaactaaacctaaatcgtatctcgttatctagtgttagtttataattttggtagtttgaccgaagacaaacatacatcctccaaacatctagaggagagtaatttatagaggggagaatagtagaagtagctgattaaggtcctccaagcgaaatcggagtcgagtcttgcaagtggcagcatatttttgagatagaaaaacttgaaatgatgtacacagccagattttacacggtggccgccgcgctaaatccttttcccttcccgtagaactaacacagtactccgctccgcgtctagccgcgggtgacgtcagcaccaccaccatctgcttccccctccctccctccctcccgtctcctcccccattccatcgcatccgcatacaaaccccaaccctagccgtctccgtgctagggccgccgccgccgccgcgcgccgcgacccgagcgtcgccgcatcgctcgcttcccacccactcccccgagatcggcggcgttcctggtgtttggcggaggaatctgaggaggcggcgggggcgcggggggcatatggggctccatggctgaggatgcctgtgctgcgtagcgcggcgaggagggcccgagaggcgcaggagaatccggcggcggcggcggcggcggcaccggccccaccgccggcgaggaggcgaagggcggcgaggaggaaggagccagaagtcgccgtcgaggctgctccggaggcggaagaggggagggaggaggagatcgaggtcgcggatttggggagggaaggcggcggagagaagaagatggaaggcccggacagcggggcgcgcagcgccgacaagcaggccgtcgaggacgaggggaataccactccagtacctgatacggtgagatgttctcttatttgatacttgtgcttactaggcctgtgcgtggactggatgcagcaatcatcaaccaggcctgtgcgtggactggatacaacaatcatacaacatttattctatagatgcacccgtcatccgtgaagctaatttgttttcatcttgtaaagccggaggctaagcaagggttatgattgggaatttgggattgatagctgttccgaacacgtagatgcacccgtcagccgtgaagctaatttgtttccatcttgtaaagccggaggttgagcgacggttcacggttatgattgggattggtagccgttttgaacatttattcagtagattcacccgtcatccacgaagctaaattgttttcatcttgtaaagccagaggttaagcgacagttatgattgggatcggtagccatttcgtgtttgtatcccaaaagatcctagcttcagttgtctccatttattcaaaacgatttttttttctaatctgtttgttttggctttgtgcaggtccaggtgggcagttcaccaaagtatagagttgataaaaagcttggtaaaggaggatttggccaagtatatgttggccgccgcatgttagctaacggtccaggtgcttctgaggtatttagtgccagcctatttgtaaaactgtacttgtaaccgtggatggtattaacggttgaaaataaatatcgtgctttcgaatggtaggtggcgctaaagtttgaacatagaaccagtaaaggatgcaaccatgggcctccttacgaatggcaggtttacaagtatgtgcctcatgatctgccattatgcatagcaagttgcatgctatatataggtacctgacttttatcatggccatcgtatatacagcgccatcggtggcattcatggggttcctcgagtccactataaaggacgtcaaggcgaatactatgttatagtaatgacacctcattttgactactacgagagaaactgttttctttttgccctttccaaaattttaattaacttggtttatgaaaaatgtaggttatggatatgctgggacccagtctttgggatgtttggaataataattctcacacgtgagttttccaatttagctaacatttatgtagacttctaatttatcactaacatagtttgttttggttttcagaatgtctgttgagatggttgcgtgcatcgctattgaagctatctccatacttgagaaaatgcattcaaaagggttggttgccatctctctaattattattatcccctccccaccaaaatacattttatttcctctgttgtaatagaaaatgttttgcaatcgcagatatgttcatggggatgtgaaacctgaaaatttcttgctagggcctattggaactcctgaagaaaagagactcttccttgtcgatcttggtttaggtaactaaatcttcacagattaaccaactgctcgatcattgtctattcaattgttttaaggtagcagcagattgaggagtctgaattaattgagtttaatctatctttaaatggcagctaccaagtggagagatgcttcaactggcctccacgttgactatgaccagcgacctgatgttttcaggtgaccagatggaaattttatgataatcaataggcatcatttacattgtcgctagtgcttttatggataatattgaatgctctgtggcatttccttcgtaggttctgtttcctgtttttggttgagtcctaggatgcagccaaatcaggtcaccctttgtactggtttctggccaacaattattttcattcacttaaattttgttttatcttttttttccccgcattctgcttgttcctgtacaaccattattcattacttctcaacagcactaaatgcggctggcactggtgctggtcaatcactcctcactattatgtttggtgactggctgtttctgcatggaaatagagccctaatttctgtcttgaatgccaactcattcttcatgttgtaggcttatagcaaatcagtaactctgccttgcttttgctgctatttcagggggacagttcgctatgctagtgttcatgcacatctagggagaatcggtagccgaagggatgatttagaatctctagcttacacactagtttttcttctacgggggcgtctaccttggcaaggttatcaggtaattcgccggacccaccattccatttattctgattgtagtaatacatttaaataattgatagtgtgtgcctgcagggtgaaaacaagggtttccttgtgtgcaaaaagaaaatggctacgtctccagaatcattgtgctgcttttgcccacaaccctttagggagtttgtagagtatgtggtcaacttgaagtttgatgaagaacctaactatgcaaagtgtatatcccttttcgatactgtagtgggcccaaatccagatatcaggccaattaacaccgatggtgctcagaaggtacaatacaatcatatattgcaatctgttatactgcttaaaaatcatgactttggttgcactaatcttccttgtaatttctctaaagcttatacatctagttggccaaaagagaggtcgcttattgatggaagagacagatgaacaaccaaagaagaagatcaggatgggtatgcctgcaacacagtggattagtgtttataatgccagacggcctatgaaacaaaggtactttttcttatgaggcccgaaagttttagtttatagttagctatatgatccacctttgttaatgcagtacaatgcaacatacatgttctatattttgcaggtatcactacaacgttgcagattcaaggcttgtacaacacattgacaaagggaatgaagatggtctgtttatcagttgcataacatcttgctcaaatctgtgggctctaatcatggatgctggcactgggttcacttcccaggtttatgaactttcaccacattttcttcacaaggtgagtagcttgctccttgtttaactggtggaaaatcttagcaaactaatcacataacttttcaaggcaaagttacatataaggaagctcttgtatacattgtcaaatgtgattccatggttttctggtcatttgaaggaatggattatggaccaatgggaaaggaactactatataactgcacttgctggagcaaataatgggagttccctggtagtgatgtcaaaaggtaaccagttaaagcatgctgtttcagtgctattcctgtcttataatgtataaattattctttgactaacttagcatgcttttttaggaacaatgtatacacaacaatcctacaaagtaagtgatactttccctttcaaatggataaacaagaaatggagggacggtttttatgtgacttccatggcaacagctggaagtagatgggcagttgttatgtcgcgtaatgctggattttctgatcaggtagcattctttctgctgcaatggtgttcatcaatatttacatttgtttgacaatatgcatttgcatttattttacaggttgtcgaactggacttcctataccccagtgagggaattcaccagagatgggacaatggttaccggataactgcaactgctgcaacctgggatcaggctgcattcgttttaagcgtcccaagaaggaagcctacagatgaaactcaagagacgctgagaacatctgctttccctagtcaacatgtcaaggttcgtctgcttcatatactagtaacgtacttggcagtttttgccgttagtactttgctctgacagagtgatgcttgtctcgttccaggagaaatggtccaagaatctctaccttgcatcagtatgctatggacgtactgtatcctagaaatctggccatctagttgaagccatttcgagttctaggcttctagcattggtctctgctcagagtgcagcggcttatgtgatgctggcaagttctgaatgcgacttagcgtaccctgactatcgtgctgtcgtgaagatatttaatggctatcgttcttaattatagaagagcttgtacagtagtaaatgtttttgtagttcgtgtaatcgttcatgtagtgtactgttaattgtagtgcaaggcgttgtcagatgtgtacacctgtccgatatgattgaactcctatctaatcgtgtgaaagcatgaggttcctgctcgccaccttatgagctacttactgttaccatctcctcacctcacctgtgcgcaatgcgctattgctggcttgccgaaaacctcttcagaatacaaggttctctttcaacattgaattgattttctcctcgcaaaattaaagaaatcttttttgaaaatggtgtgttcgaaacgagacaaacgaccatgcataatatgtaactctaggctgttgctggcttgccgaaaacctcttcagattaaaaggtttgttctctttctacatcgaattgattttctcctcgcaaaattaaagaaatctttttcgaaaatggtatgttccaaatgagacaaacgaccgtgcataatactatatactctaggctagtggaacctgggatgccaggttgtttaaaatttctacattagactgaacataactacggagtagtactttccatttaggatctgggtccctctgaacttggggctcgtgaatagtcgtgacaattttatcgattatgcatgttgcatcaaggccttgcaccaccaatcaactagagtattcagttttactaacatcggaaggtcgttaccgtgtattatcaatctaccatctagggaaaggacctgtacagtactttatttgttaaacatcttcggtctaatctgcgtccttcagcagctccagcggtgaaacataagggcctgtttaggtcgtgaaatgaaaaattttatgtcacatcagatgtttgaccggatgtcggaaggggttttcggacacgaatgaaaaaactaattttataactcgcctggaaaccgcgagacgaatcttttgagcctaattaatccgtcattagcatatatgagttactgtagcacttatggctaatcatggcctaattaggctcaaaagtttcgtctcgcgatttccatgcaaactgtgcaattagcttttctttttatctatatttaatgttttatatatgtgtccaaagattcgatgtgatgtttttgggaaaagttttagcacttttttggttgttttactggactggtaactttgatgccttcatctcggcttggactacgaaagccttgagctttcaaatctatgatattttcatgacatgcgtactgaactcatcttactcttgagtttgattcccagagtccagaaaggtagatcgatcattttccaggcaccaagtttatagtgagcagtagtgactgacaaaaactgtacagacaaagccgagttgcatattcagagaacaggtcctgtatttcacaaatcacaacaaccaagtcgaatgcaagcttgacaggagaaagtggtatccaagcacaaggcaagcagccaccatgaactgcaggttcaacgggatgatcttgccggcatccgcgctcaacacctcgctcgccttgccagccgccgtgccggccgaagggaagcagtagaacaactccgcggaggcgacaccggtgtcgccgccgtttcctcggaggtcgtcattgctgtacgctggcttcccggccacgctcttgtagagcccaccgttgcatgcctgcatacacgcagccggaggaggagacaggtaagtaacgagagaacgaatcatggcgacgaaatgattgcagatgcgacgcgacggcgggcaatgtccacatggcagctctgctagttcagtcagtttcttgtttgcagacaatagaggcgtcgtcaactcgtcgcaggtagaaacttaagatttgagaaacggtttggagctgtaagagatcggacgcgtgacctggagctggtcgccgacggtgacgacgacggcgccgtccatgggcctgaatctggaccagcctcgccgggagaagatgtggaacgccgaggcgccggggcagaggtggagggcgagggcccgcgagcaccgcgagctccggaccagcatcctcaggatgtcgtcgtggcggatcgggccagaggcgccgccgctgcggtcgtcttgcctgcggcggtgcttgcggatgcagaggagcgagccgtttgtgtcagctccggcgatggattgcgtggcaacggcgccgcctcgctgcaggacgtccattattttggttgcggtttgctccagctgaatgaacaaagcgtctgctgtgttcctgggcacaaaaaaaatcaaatggttagtgttgtgagtttggactagacaaattatacaacgatcttagctcgttcttttggtccaaattctgacaatcacatcgactgtttgatctaaactatgtgacgaattctgcaaaattatcaaacctcgcatgtagatcgacatgctagattacgagttttttatatacatattatttctgaggaagacatgatcacatgagtacacagtaacagactaacagtgaagtacctgaagtggctggcgccactttggagcgcccaatttcccgccatttcttggcctccgtcaccaggcgaccaccacatctcctcaccgttctcatcgtctccgttgacctccacctcctccggctccggcgtcgctgcccttgcagttgcagctgccacatgacgcaacgctgctgagaccaagctccggtcgaccccatggccgaccacctggaagcagccaaacgcgacggctgccgacctcagcgcctccgccaccggaccgccggcctccggcaaggccagcaggcgcacgtcgatgaccggaggtgcccacgccgctttcttcttccgcgggacggccctctccggcagccgcagcaccgggactctggcggagcggcgcaagaacctgccgatctcgtcgtcttcgttgctatcggggcactcgccgtatgcaagagagccggagctactgctcgtgaggacgccggtgaccggagacggcggcggtgcccggaactccggcaccggaagctctctcggcctctgaagataggtaaccaccgatgcagtagccatagctgatctcatggcctcttagctttggcttgaactcttatgtgattcgcgttggcatggagaaatggtgcttgagttcttgtgttcttgtagggccatggattttaagcttctttttctttgtggaaaaggggaaatgataagaggagccagatgccagctagaaagagggagagggtggaaggcatgatgctgcatcagccatcattgtgtcagaggtgcaagtagatacactgtgtaccttcgaaatatcattctgcgttctttttaaggatattctggaacagcaaagcgctttgctttgtttcaactgctttaaatcaggcaggtttagcgtccttttgtcaggtcagtcctttattcttgcggttgcacaggtttcgttgaatgagaggatcagttcatcagtcacggtagaagtactccattttaccaactttgggctttcactttcatcagttcactcatatacttgtcagaactcaggagtaccgttgtaaaggagttatgagcattgcgtgcgatgtccataggcatgttttttctcagataatacagtacaaataaatgcgcaatctaccatgttagtggggatagctcagttgggagagcgccagactgaagatctgaaggtcgcgtgttcgatccacgctcaccgcaaatttaatcttctcattttttttcacagaggatttcctttttgctgcggatgtgttttgctaatcttctcattttatttttcacaggatttcctttttgcacagaggatttcctttttgcaggatgtgttttgctaatcttctcattttatttttcacaggatttcctttttgcaggatgtgttttgctaatcttctcgtttttttcacagggtttcctttttgcaggatgtgttttgctaatcttctcacttttttttcacagaggatttcctttttgcaggatgtgttttgctaatcttctcgtttttttcacagggtttcctttttgcaggatgtgttttgctaatcttctcacttttttttcacagaggatttcctttttgcaggatgtgttttgctaatcttctcatttttgatatttcctttttgcaggtgtgtttttgcagggtgtgttctgccaatcttctcattttttatatttcctttttgcaggatgtgttttgccaatcttctccattttacaggatttcctttttgcaagatgtgttttgctaataatttttttccacaatatttcctttttgcaggatgtgttttgctaatcttctcattttttatatttcctttttgcaggtgttttttttttggctattcttctcatttttgatatttttccccatgatttcccttttgcatgatgatctcttttttgcttatttttcttcttctcacaggttttgcctttattccccttccttttgctctcagggactaaaatttgtctcacagatgtccaggccactcactgacacacagggtaacttcttttcttctcacaggattacttttttcccctaacccacagcgcgcaaagaaaaacggaattaccgcatgaaagccgtgacaaaaatggtacaaatgttcgctgctcatcatgaatctttaaccaagatacgttgttgagtcgaccagcgaaacttatacagatacacagaaaacaccagtagcacctcctaaactaccccccgtgtgtttcagcgcaaaagttgagttacatcacagttgccaaacttgcatggatgcttcgtcagattctatttctaccgtcttttggaaggcttggctaaggatcctcctgtcgcctgcgcagttccaggtctcatgctacctgtttaatgaatacaagcttatcagtagaatgttgtttgtgggttccatttctaggtgttctcatagcaattattaaattttggcaaataccgagtactggtgacccagcatgccgaatatttttgggatatatacataccttgagttttcggaacaacctcccttggttttggtctagaagttgatggctgcccgttcttcgtgagaaagaatctggttattcttgatggcgctttatgcctgttatcatagagctcacccattaaacagtggacgtcattgttttcttaaaaataaaaacgaagtgtttttggtaatgcatatggagcaaaagaatgttgaagccctacatattttgcttgcattgtatgctgtttaagtcagtaaatgatgagaagaaaaaagttcatcacactgctagagaaacggtttttactcccggttatagcaaccaggacatctttagtcctggttgagagaaccggtactaaagttgcatagcaaatgaaaaatatatgtgggatgtgggatttgaactcaagatctctcgcctcagccctcactaaccatcccacctactacacacatctgacttgaatagagatgcttttttttttaactaaccctagaggcatcttaccaaccaggactaaagattattttttagtcccgattggtaataccaacccagactaaaaatgtttcgagggacttggagcatcttaagtaccggttcttaatctaaccgggacaatcattagttctccactagtgtcacaagcgcacgatggtttagcacaggagataaaggaaaacaggatgagtacatacgctcgttctgctgatgtttctgaagcaccagcaggagaatactcagtttcccccactgagcaaccatcgtcagatgcattatcttcagcttcagcttcaacggatcctgcaagcccagtatcagctagtggagtcagtgtgaccactattattttcatcgacaagcgtataattttgagtatctggtaagagctctatcactagagttcaacgctacttcacctgatagctgttggttctgttggcttgccacgggaagtgatgacaaaccagtagaggaagtagattgtctcagcaagttactgccatttctgtctgtcattgaattgggagatttggatttaaggagctgaagctgttcgatttccatatcttttcgtgctattgtatctttcaaagatgcaacctggacaataacacaattatgaaatcgaggcaggataatattaataaccaaaggtgaacggagaagctactgacaaaagtatattaacaagttaacaagtactccttattagcaatacgtgctatcaaaatacataataatgttatttttactcctattaaagtctaataatgtatgctcaccttttatttcagttcaacagaagaaacgtttcagttcatctttgaaactgaatattaagtgcttgctagggattataattcaagtaagtggcacacgaactttatatgattaatcagaggctgatgtgccaaaaaaaatacctgttccagcagctcttttatgtctttcccctctctgttacttctcgcagcacctaactcaactccagaaaccctttcagcaaattttaaagtacttatggtttctgaatatgattcaatatcagggtttatttgaacaaacattagtgtctttgcttgtccacctacaagaaagcgcataagttaggcaaactagtaagcctatccacgtacacatctatcaacaactatatgttacctaaagaactctgaagaacttgagttagcttgctgtttctatatggcacatgggcattcttctgggccaaagaaaaaatgacatctccaagagcagagagagatttgttaatatgctgtgcctcttttaatctgtctcctgt

SEQ ID NO: 82621 - DNA, 32681 bp, Oryza sativa
  unsure (1)..(32681): unsure at all n locations
atacatcataagactttctgtgtggggtgaaatctattagtagtttatcatgtatacctgtgggagcgactgctcctttcatttagagctgttgatccaactgctctatttgactgtccaatttccatcaagtctagtacgtctgatgttgatttgacagggtgtaaacttgcatcaggaactacaaggccattaggctgagaagtactccaaattccaagtgtttatatatgttaaggataacatgttagaccttgttttcacatgtttatccatgtcaatattaatagctcaatgaggatagatttgtcgactggaaatagaatatataaaaaggatatcttttttgtgcaatgtcatttgacagaagatcgcgaacttgctcattgtatatttcaaccatctgcactcccacctcatatgagaatgcatttttcctacttagagaaatatcaaacagatcatttaaagcacgatagttaacaccccagtcttctcttgatgtccctggtccactctaaagggtaaaagataagagagtcaatttacaatatccccaatgatagttagcagagcaagtttgctgtcttgaattaattaaacagtagtaaataccattgtgtatgtttntcctgaaccagtttgtccatatgcaaaaatgcaaacattgaatccatcaagaactgatctaatcaaaggttggatatcggagaaaacttcagctgtgagttatcaaataaaagcttgtgagcaatgttcaactgtatgccaaatttttttttctttaattaaattcctgctcttactaatatataccttgagaggaatgtgtaccgaacactttgttaaacttaaacattcgatacccttcctttccttgcttggaggggtttgcaataagaatctcgccattttcaccaatatagtcaattgcagttaatttcccatcttggccagggagaaatggtctaacacgacagtatactctgatgttgcctgataagtcatagcaaacattagagtgcagacaagggtgctatatccatagaatttgttccaatgccaataatactataatggtgtaacagaaatagaaattacctttcaattcctgcacttcattaaataacttctggttttcagcaagaaccttatggtaattttcagcagcatctactaaaccttttaggtcatgtcctatacaagattgaaaattaagactgagcacaagataatgtgtttatatggaacaatacaaatacaactatcatgaggatcagtgcaagtaccaatatttgatatttcatccctccatgtcatttgaagggcatacatttcttgtttaatggattgagatgatatctttatatcctacaatagtttgacaataaaaaacgtcaataaaccaaaatacaatgaaacataattaagaacacaaagttaagcagaccttgatagaaagtttctgattattcataaaactctgaaaaatgtttgcttttttgctccagagttgtgactttaattgggaagtagcctcaacttcttcaactttctttttggactgcataagacaaaactcagcctccttagctcttagtgtcaagtgttcctccatctgcctagcttttgtttccatttgctcacggaattgttcatgcatcctattcatgacttgcatctcttgatggaggctagcaattatattctccgcattctccttttcacggatcagccgaatcatgtcttgctctcctagttttcttttctcatcaatttttgacttctctacctataagaaaaacacataacatattaccagtaaataataataatgcatgcagtgtaaaagatttatttgagacaacatgtagtacaaaataacataagtaaacttaggtttatacagtacaaatgtgtgatgccaatacttttattaagtaaggtatttaactatttatgaatacttactgaagaaagaaaagtgcttgaaagaaaaaaaaaacgagctaaaacatatagcaaatgaatgaagacattttggataccttaactacctcaagccgatttattgccatctgaagaaggaaccacatagttatagtcagtattacaacaaaggattaactctgacaagcatttagaactctcagcaactttggtgtttacctcgttttcttcatttgttccatttactaatgtctcaagtgctttaatttttgaacgatacttatcctcccgtgtcttgatgatgctattttgctgcgacacaagtggtttgattcaggaattaaacacgcgtgggaaaaaagagagatagttcaaaactaatattttttagatcaaatgttgatccgatgatcagcccagctttactaacaaagaccaaaggttcaatcaaaactaatattatccttacatttctaatgtgatctgcttgaataccaatgcggtgctcaatctcctgaataacattccttagtaaatgaacaacacgctgagacaagcaagtcaaaccatcagtaacaaaagataaaaagacactagtatttcattaaaaaaacgaaaatcaaaagaagtacacatacatgtggtatttctcctcttttcctctcaatactttcatccagaatgccattaacaactctaagaagggattgggtaggggcattctgagataagaacatatataatcattaggtaaggagccagtgaaaagaaaaagaaaaaggttgcagtgttaggatacactatgctaaagattttacatctaaactatttgaatgcagcatctctgagatcttagcagcaggaagatctgtgtaggttccatgcttaaattggacaacctcattgatcttttgtcctgcaaaggaaggaaaacataactatatattaacatcacaaggctcctaagtcaaaattggagagaaagagaacttgaaagttataaatgttattcgattcacaaaataacacaagttaagaacattatatgtatggaattataagaaggtatggaagtcaagctgaagtcatgggacttgttagataagttttaatcagtatatcaatatgtaaaattcaaggattaatagaatatgctcccattagcaggagaaaaactcatgataatattgtttctttggacttccgaataccaagtcaatacagcattgatgctcaatattatctgacacctgatgcaaaaaaaacaaaggacataatatgtgtacctgaaagaagagggcttctttgctgggacttagggtatcttttccctggtgtggcaactgaaagcaccggtccatcagtttctcgaagttccagtttccttctgattggagtcttagcagtgctgttagaaatatgaccacccaattgtgtagccacattatcctttaaagccaagagacactccactatagaagacattgatccctgtaatcaccaaaaagaccagagttgacaaaaactactggcacaattgacaatcataacatgaatctgattcaatcaaagctttctgtccctgcctcttacgaatatctgagtacatcaataaccataagcactaggagcaagcatctgagaatgaggcacattttagtgaatactcttgcaactttcttcctaggctaaataggactccatagcagagtctaagatccagctatccaaggccactccggttctgcaaatttcttgtactggtgcaacacttttcagcctttctaatagtctcagattcagtgctgatgttcaaatcaacagtcagaaaacttaaaaggacagttcataaaaaaatatgtggaaataatcatcttggtgaagtcatagactcatcatcactattccatgccaacaagattagagtacttattttctttccaataaggcactagtactgacaccaactatgttaattatattgtcctacaccttgacaaggagatgacatcattaagttggaagttggaacatatgctagtatcataattctactgtatactaacaactacttcacattactggagcaacctcacctcctcaagatccttcacgccaaagcctggcagccccatctctgcaacaacagagaggaacttcttcacatttgaccgttggtccgatgcataaccaccccacgtcccctgcaaacgaagccatatcagcaagagcagcttgcagaaacatatgtatcagttcagttagctcacctccagaacaccgggcatgagcttgtccgcaacatagcatagcgcttctccgttaatgaggtaatcccgcagctcctcgtccgaagaatccaacggcaaatcgaactccggcagtaacccgccgagccaatctatcacctccgcacgccgattggctagaatttgaagaaaaaaaaggtgtcaaccaaggaaacaaccgtgagatgcgtagagatctcaaattgagctctcacattacagtttactgtcacaaaacaacattttaggaacaaaagatctcattttgacctcccaggcaaagaaaagaaggcaagcgagatgcagggaaaaaaaaggggggcttcatcacactgcactggcaaaataggcaacccaaaacgatttaaacgccgcgcaaacttgactccataagcgccaaacctggagcataacatgaaccgaatagcaccggcctcccatttcgcgaaatttttcaaaagcattcattaaactctgaaagatccaaactttgtaggtccgcggctcgaattcgagccacttccccgcagcgagaagagaagcgagaaaccccagatcgacggcctcacccgcatcgaagtcctcgtactcgccgttcaccgtccccatgcctcaccgcccggggccggagcgcgcgcggggcggggaatgccggccgatccgggcccagatcgagccctccgaccgggtcagcgtcggcgcgaccccggatcgagcggcgccgaggcaatgcgggaggcgagccggcgcgagctccggggattttggtttgggttttcctcctcctcttcttccccgtgctgctgggtgtactgcgcttttgctcagcttcccctgctgtcgtttttgttctctttctccggtggttagttggggggtttgatttttttggctttcgcttgcgcgttaagcccgggcatgctcgagtactgtactgccatctcacgctttaactcgcgtcaccttaccggtcgtaggagtaacgaggttttttaaccctcgtgattttactgacaagcttttgactagtggaaatggtcaaacttttataacttagactatcaataactttaaaaatatttagttttaaaaaactagaacaacatatatatttgtcttttaaagtactaaacatgtatttatttattatatatattataatagaaaaataaggtcaaagatgtatattgtagaccgtgttattatttaaaacgttaattaaaatgaaaccagagggattatactggatagacgtaatcacatcagagttggtgccgcaggtatgctggagtattgcatgcaagatccaagatccaacatcgcaacgtgtacaaaagagaaaggagggaggcgtatgcagatgacgggcacgctggggaattctgcaagacagcaacagggcacagggcggaggcttttttttggtgctttctcgggacgcggcgctcccaacagacacgagacggacagcatcagtgtactgtctacaccagtacaccgctgccataggattgatgcgatgccgcgatcttaagtttaagatatgacccttttgcccgggtgatggccggcatcgtcagcggctgggtcgtcacgtcgcgcggggcgggggggtggtggggggttgttgtacacgccccactcggtctgcggcgctccccgtgatctcgtcccgctgcgtgcgtgcgtgctcgcacggctctccctgctcggctgctcctcctcgcggtcgcggcccaggtaggccgtgttcctttttaaaaaggatctgttgcgtctggcgtggtcgtgttgatgggcagccactactttttttttcttcaatgaatcagaaagaaagagattgtgctatttcgttatatataggaggaaaatacaatccctataaataaggtgaaaagactgtacagagctataaggatgtcgagaggagctcctgaagcttttttttctcctgtcagtgcctatacgtcattttccaagaaactaagtctacggggatacgtttatatattttttatatattagaaatatagaaaattaaggagtttttgtacgaaaatagcaatataatactagtattagagcagtccgttccatgacaatcttctccaattctctattctatttgacgaagggattataaattgggtgtaatcaagtgtaagactacaaattaatagtacacaaagcacaaattaatagtccaatcatatgtagttgctcctgatgaatgtgcgtcaacattaggagccgcatggggattgctagatgtcctagctgcacagaagcacttggatgtaacaaaaacgagaatatttgtcctaaactaatacaagcattgcagatcaagcaaggtacgttagaacactagagaagtggatttgcctaagataagatggtcaggagaacaaagaaaaatatgctcggtgcttcgatgctggatgttgtgcctgccttgggcggtggtggccctgataacctggccggttggcctccgcctcttaagactagcgatggaggtgctgcgcctgtgtggatgtgcacccatcagcgggaacttaggccggccatctcacggaggaggcctgtgccgccgggcgcggcggtgatgcagctgcacgcctgcacccggcatgtggcggcgacatcgctagggcgcatgatgcaacagtgcccgacggacggcggttctgtgcaacaacggcgaacagtgtagaggacgaggctgcagcgagcaaccgaacatgagttggggaaggtggcactgtgggagcgtagatttggctcggtactgggtggatttgatcgaaggagggttaaaacatatcaaacatgtatctgaattgttttaattatctgaaaatcaggaaattgctcgatacgtatccagacatatccgatatcgtatttggtacgaataaatggcctgtaagccatatccaggtaacgtaggtcagtgcccaagttcttgcttcctcctttatttttgccacaaggctaggtgtcgtaacttccttgtgttcaaacactcattggttcctttctttccagatttcccagaccaccagaagaatcaagctacgcagccctttcttaggaacctctcttttgttagcaagcatctcccaccagccttgtacagataggcaaggctcccattggcttgggtccaactgctggtaagccacccaggaggctaggagcgtccatactcttttggtgtatctacattgggaaagaaggtggagtgccgattcattcgttgttcggcagagggggcaatgggcgctgtgtggccatcctcttgttgcaagtctatatgaggtctagactctattttgaatgactacctaagcagtgggcagccactactcgtacgccgttctctcaatgcctgagaaataggccaatggagaagctcgacgtcacgcgatggacccaagccgtggatccttgtcgtgccgtgatcatctttggcgagcccccaatgcctgacgccacttcgcccctttgctcccttggttttcgatggctcgccatcctccatcctaatatcttcgattttcagtgcatcacctccgggtctctctgtgaatcgagctccctcacgtccgttccactccacggtgattgccatcgttcggcaccgaaagacgtttcggtcttccgggtgacttcgccgggagaattgcacaatttcatagggtcccttttcttagacctgacaaatcaccagttggatcgtaaattaggtggtgtttgaatcacctgaagatgaagatgaagataaagattaaatgtttcacataaaacgaggtggtaataacgtgtgattaattgagttttaattattacaaacttgaaaaatggattaatcttatattttagaacaactttcatatagaaagttgtcacacgaaacacaccgtttagtagtttaaaaaagtgacacttttatccaaaagtttatccagtttttgttggagaaaagaacacggcctgacactagatcctattcagggtcggctatcacggcatagatcgaggtaggaaaatgcacactgcacttttgcaaaagaggccctaattatcgaaggacgtatggcgaaaaaaaactatcaacggccgcgatcctattctctaggttcgcgtgaaccgtcggatctgatctcgatccaaaacggcgcaagggagatgcactttcacaaatactctctccatccataaaagtcacatttgattttttttttataaataagttgtacctatttatagcttttatgcattcaagacttaaatgaagagataaattaaatattttattagaatccaaggagccatctaaatacttattggttgcatatttacattcacttctttattttataacatatgatttaattttaataggtgtaacttggatggagggagtacaatcctcgaacgatagattatcgtatcacgctcatatcatcctcccctcgtctccgtcccgctgtgccaagtgcaaacgccggggcccgggtttcgccgtggcgcaggaacacggcggccgccggcgacgtgacccaagtttcgtcgacgctcaggctcctgcctcctagtacacggataggttgcctcgaaggctctggatcaggccgtgcgccggcgcgtcgcgtgccgttccgggtgttgcgcgcgtggcaggggctcctccgccgcgcgcggcgcatcgcgtcactcatggccgccgccgatcgaaaatccgggatggctcggttcgtagcggagcctttttccatggaatactgacgtgacggcttctttgcgaggcggtcgtcggcaaggatgcctttctgttcttccgcccatgtacacgaacacaactgtgcaaatgaacgatagattgattgaaagatccattttgatcccagaatctgaatgctttgtaaatcgggaaacaatttcagcatgcttcagagaagagaaacagggttggcagaacagaaccagaggcatggccaatatgagccctgaagaaaatgcattatgcacccatcatcactcagaccccgtaattcacagcctagagtgaaaagcttccgcatccgccacatgacgggcataagcaaaagtatcagtccaacacaaaacactggccactcgttatgtgatacgctctctgataaccgaaaaagcaccgaaatacacaggcacacgacgacgacgtttgctcaagactacatagatatcacaattcacacgctcagaacactgaagctatactgtaaaccagtaagtgatatcatgtttcatgctcgtattacttacacgatagtacatccagtctgtcatctcttcttatttcactttaatacttatacaagcgtatttaagtgtggcacatccattggctattgccgtagaggcgtcgggtaccgacaggctacaaacttatatgctggcctagttataatgtcagcaggaccagcatatcgaagatgctggaagagcagcagtgcgccttgcagaatgcgaatagccggttcttacatgacaggcctagtggcagctccagcggggccagcttgtcttagcagctgaaacacatatcaacacattcagagatactacaactatactagaggtaatgataaattttcatggcacagcaacggagcaggtgaagggtgaaggttacctggaaataggattctagtttctgcctcaggacagcatgctcccgcttcactttctggaaagacctcatgcaactgcatcacaaaatatggaaggcgtatagatattaaacagtgactgttttcaccgtgggaacataattgttcaatttcaaaaataacaatagtgtgaagtgacatatataagagagaccctacccttcaacatttccttggccacaactatccctgaacgacatgcactcattcttcatcctagaagcgccgatgctgcaccaagttgtgtaatgtcaatgatagatcaatgatacatcgaattaaaaacagtctcgtgctttctatacatcatgccaaatgagatcagaagcatgagatgcttcaaaaaggtcgatacacttcgagtttttagttggcaacagtatgcatatttagcggtcaattggccgattaaagcagatggatttctctgcagtatgaggtctcctcaaaacattattttaacttcagtggacatgcattaatgcatacagagcttttatgagcaagacacttaactgggtggtttcactttcatataaaccaaaagggagatggaaagctgaccaattaactgtgatatgcaagactttagatagaaagagatggtgcaaaagagagtgccttggcttcccaagatgcttaactaaactctgtatcatgtcagttcccatggttcatgccacaatgaactaaaggttggcgctgctgaatctgacaccctttgtgcatcatatgcactacaacaaagatattacatagaactagaagcaaatcaggaactacctggaacagctgccttttagttgctgcatatatgtatcccacctgttgaaatctcttgggtacttctccctgcagtgttttcaaatctcagttagtcagcccctcttagcaacatttcctgtgtagcctaaaccctacagatcatattttcagaaaaaatgtctcatgctgcatatggaacttcaagtactttttattacttacagagcttgctcaatgtttgacattagcctgcccgagtccttaaaaaacaaagtaacaacttcttccacaaaattaggactagcttcatcctgcaaatcttccacctgacaaaattgctcatctaggtatccctgccatcaaaatataatttgctgaatcagcacatctgtcaaagaattacatgaaagagcagtagaatactgaaaatgggatcagatgtggacacttccagcataagacctaatatggtcgacacaccctgagcacacataagattactgttgaaagggaaaaaaaagaactccagagaataggatactagcctgatcaaagaggctctttttcatggatgcagcttggcgacgcaaattagaataatccatttatatgaatgaatgaggaaatatgtgacaaagtgaagccgttacaggttggaacacacttaatgatgaacatatgacttgtgggagctatggatatacaaagtcgaacatgggatgagtttatatagtagagggaacataagaaaaagtgcagatattctaacttctggatagcaaaggttggcatcttgcatgcacaggtgatttgattgccacggtgtgcataagctatccatatttgttatccatattttggagaatgacttgaatagatacagatacctgtaggctgtagctctttataagatgtatgatgtgtaagtatgcatatgcatgaagaaaccattaacggttctgatatggatcacactcttcataatagtatatgtcactgcatcaactgatcaactgcccaaaggtagttatgttcctaatgtatcacatggaaaaaagtcatggttcagaagtaaattaatcatacacgtgattgttctaccattaaataagatgaaatccctacaattggggaactcataacagaacaatggtttggacataattctgttaccagccaaccacagggcctggaaggctgaatggagtctgtagatggtaggctgaatggagtctgcagatggtagtgttacattaactcctcaaaatgtttttgaagtagggctgttcattcccagttttgaatttaccattcaaaatcggtggtagtctgttttctggcatgctcaactagaagctaaggtaatcactgcctaaactcattgatttccagtttcgagcgggctgagtaaactagtaacacccctatttgatgatttagtacaaccaacgaggtattttgcacaaatgtagaaaaataatgctctcattctgttccaataaatactaaattgtagttcaattaatatctactaggaactgaagttaaaacctacaaataaaactagtaactttacaccaatctcttctttggctattgattaacagctttgtaggtgaagaataccatcagctttaagtgaaaacttatcctaatatttcaaaagaaattatcttatgtaaccagacaaggaggggaaagatagaacaatatatctttttgtgcccctcaaagttcaaacaaaatgtggagataaaatctgagagaacgatggggaattagaataggcccactgatgcttactttgagccccagcaaaagaaaagtagacagagaaacaggcaccaacagttccttccaattgttaaaaaaccaagactctctcaacacattggaccacgtgtcagaaccaacaaactttcacaaaaggagtaaaagagattcattcaatcattgatccgatgattgctcctgacctccaatcaacatcacaacttgataagagaatctgacatggattaaaaaatatcgaaataaccaaaacacctatacagggaatggatcagaaaagacgcattctggatgagtcactgctgaggccacgaatgcgtgaactacatatcttgtctacatacaatctgcacagtcaataccttccctacttgatgtgtacatttataaaaggataaaaaagcatagcggtccatcattcatcactacagaaaaacatgccttctctttctatactgaacattcttatgacaacattgttcctttctgcaagatcattcttgtggcaaacatcacaaaacatcctttttacaaagcacggtgagggattgtattctcacataacataagacatatttcagtatttttttaaaatcttaacagcatgcttacaggtaaccatggtaacactctaaaagttgatacagataagacgtaggtatatagatggtaatgtttccctatgagttcatgcgtgacaagtccaatactccaatagtacttatggctccaaagttcatcaaaatgtaaatcagaaaattcctgtggtcattattttaggtataataccatgttgatataaacattagtttcagttgaaaaaaacaaatatgatactcaaactgctatatcatgcatatagatgagtgaggtgcaaataagtctcaagacaaagctataagggatttggcctttctcataaatgaaattatcatactatagcatttgctatagccttatgcccctctgcaaatggattaggcaaatggaaatgggagagatcaaagacaattttatatccatgcatcacatatctgcttccacgcatcaaggttattgacactccatggcttgtgcgtgaccacgttgtcaacaatccttttatagcatcaacacatgcactttcaacaatctaaaaccagtatcgtgtgcccaacatgacctagattttctcccagtaccctccaaaagtgtatatgtagctttatcatctacggttccccaaaaagagagatgcttctatggttgcgttttgtacgtatagtctaatgctccaatgcttttgtcaccttagaattggtttccatacgtgtgcgtctatttgcctcatatcctgctcactttcgaaacacatttggaaatcgcgaaaaatatgcatttaaaaacaaactatgataatcaattagattaacctccgccgtatacctcatagaagctcaggtagatctagaggtcaggctataactgagattatcaactagaaaatctcccaacttctcatgatgtataacatagcactggagtagagccacatgcagtgagctccaatagagcaaggagacactggagtagcttcatcaccagaaccaaaaaccagtgactcctttccataaaggaatacatgatgtgcgaaagaacccaacactaaagtctcgaagttcgatcaaatatccaagtttgcgcagcctttatcgttccagtactagaaaataaaaataacacggtatttagctataccggccagcttccttgattgattcgaggtcacacgagaaacgattctctcgagcgacatccgcgagggatccagcaaaggaagcaaggtataccgaccaatggggagccgaggggccgacacgattgattcctcgaaagcaaaccctatagttggcatccacccacgacaggatgagcgcgccggcctgatcccctccgctctcgcctcgacgtcgaccggagcgcagccgcaggctccgcatccgggggattagaccaaagggtggagaggccgaaaagacgcgcggggaaaaaagaagcggcggggggggggggggggggggggcgagtgcggcgcctccgctgagattgggagtgagatgaggggatagcccaggaccgcgagagtgattcgatgatgcgatcagctgtggtgtaaggggagttaccgcgagggagggagagacgacgacgactcgccgggcggaggagacggcggcggcgggggcctcgcgggtggcagcgttgggctggccggcgacgccgccgcgcgcggggaggtttggagagagggcgagctcgcggcgaaggctcgccgtgggtggtggcactggtgcggtggtgcccgtgccgcaggcccgcagtggcaagactggcaactttgcggcgaccgtggttaagtcaagtggctcggctaggcgttcgggccgggcctatggtgtgtggtttggagtcctaggacccgatgggtggaagaggattggcccgtgtaatttctatgcgaagctaggctgaattcagtccggccacccaggccattcaaggcctcttacaaatctcaaagcacgaatctgtcgtgcgacgccccgtaaatttttttttcatttaaggccctttaaatcgtagaattgagaaaacattggaatagaaaaaacatagaattttgatagaaatagaagtgtaaattagaggattgcaaaacataagaaaaaacacatgaatgaccatttgattgaaccgcagaaaaaacgtaggaattggatgagaaagatagactcaaaggaaagttaccaagaagttgaagctcttgctaaattttctctaaaatctctatatggttatccattccataggaattttaaaggattgaatatgattcaatcctttatttcaaagggcatcataggaaattttcctataggattgaaatcctcttaaatttctatgtttttcctccaattcaaaagggccctaaagaaacttaaaattgtgagaagcaaactgtttgatagttaacttgtaagaatttggtttctagttcattttctgaattctacaactataatttatcagaatctaaaccaaaagctgaaagagagtttctggttatgggataagctacaacagttagaagcttcccctctcttcctccccgaacaagccatttgattaccagacaaatagtatatcgtaatgaatcaggttcacagagttaaaatagactgcgggcctgtttagttcataccaaacttcttcccaactcccaactttccatcacatcacatccaaaactttcctacacacataaactcctaactttttttcaaactaccaaatttctccaaacttctccccaattttagaaactaaacacagcctacgtcatatatttggatatagactacgtgtccgtatgttaacagattaggtccatataaatagaaaggaactgtgattatttttcacatacgaacatactgcgcatgttgggatgagaggacggaagaagaactactccacttttaaactagtagatatatccatatctaaacgttaagattatagcaactatttaatctaaaaattgcctgttttgtatctttttatttttattttttatccttttttctataataaagatgaaagtgtaaaaactgaaagtatattgaatggggagagaacaataatgtctttacagtgaactgaaatttataatgaaatttcaacccctttaccttttgtttgttttaacatctcctaaattttactgtcctcgtggagtatctgaacttgaaaattcaaatgcctatgcatgtgaaaaaaaaataagaaaaatcaaccacttgctttttcccaactatatacagtttctaacccttgttttttagcttcatcccatcccaccatagtatccctaaaatttctcaaaccaaaaacactgtatttgaatccgggcgaagcgaaagcccgggaggaggtggaggccggaaaactctttcgccgaccttccccacacggcttcaccctaagccagtgagcccaggcggcggcggcggcggggcggaatggcggagccggactggatcctggagagggagcggaggcaggtggagcagatcctggagcttgacatggaggagctccaggtcgaggaggtcgacgacgccggctcatcctcctcctccgaagtcgacacctttctcaggtccaaacgctaaactcgcttctcctttgccatttccgctatccacccatggtttgcttaaaccgtgccttacactgttacacatttcggtgcgggagttggctttcgcgttgatacggcgagaggattgacgccgcgagagctgctcgttgctagcaactattctgaaatgaaatcaaatgttaagttgcgccttcccaaagtagcctgaatccagacagaggccatggaggttagggttggggaattttccacaggttaggatgaaaacagattagacaaccgcttgctaggatgtagaagttagacccggtttgtttaatgcttgtggctttccccaagttaatttgttcatcccatagggcatttccacactatttgaatagattgcacaaaatctactcagtttggcatcgtatggtacttagattttgctgatataactcagcaattcatgattttgctgacatgttttgggttttatggagtgatgaggtagtttacatgttacttacgttttcgcttaactaccattaatggtattcatgatggaatgtgcctttccccaacataccatacagtctaaatttttcacccctcaagttcgttggtaatcaacagatgtaattttttgccacttatttaattcttatttttacagaaacactcatggggatggaggatctagaacttctgaagcacttgcattcaatacgtctgtggtttcgctgcccacctgtgatggtggtaagcattcatgcttatgttagtatatttcctgattctagctgcaacacttacaagtttgtttccgcaccagaggttcatgatgccccaggcagatttgctttcttggatggtggtgtggttctctgtttaccaatgttttatcttcaaggtagcattcctataaccctgtgttccaacataatagtatagagcttatctcaatctaagctttaaacacccaattcaatctcaagtgttgttagctgatccatgtcgtgcctaatattgaatgctgaacttgctaaagttgtgtcctattgcaaaccaacaaagtatacatgacatgtacgcatccttgccattctttcatcttactcttgaacagtcacacatttagttggcatctgtaaacatagctgcctgtattaaaggctaatagtttgcaacttttgcaggtgttgttttgtttcctgaagctatcctgcctattagagtagttcagcctagatctttgacagctgttgacaaggctgtcaatcatgttgacgctccatgcatgataggtgtggtgcgtgtcacttgtccttgttctgctgcctttgttctagctttgtttttaatggcaattctccaatgtcaggttcatgtttatcaacacactaatgatggacaccatgctattgcttcagttgggacaacagcggaggtgtatttttcataaagctcattcaaactagaatgatatctgtgccttgaagtttcatcttgcatatttgctcatttctgaatttctgttgtctgtgttatgtttcccttttgcattttaatcttctgatcctccttttggtttcttttgtgacctattttgctgcaaaaacaccaaactaagatagagtttgcagtggtcaggtagtaaggtcggacaaaaaaaaaactaaaaaagagaaaagttatatgcttgtctgagatagcgtttgcaaatacccatgccattgaaaagatatacatcaattctgcagaaagagacgatgaattatcacaggacctgtccattcatttctagatatcacgtagtatgcacagctatagttgactgcagtcacaaatgtcttactaggacatcatgatcaccatatttgatcttatctgtgcggttatatgttgttccttctagttctatgctgcacaataatacaatatccttgggcacaaatatgcactacacacatgatcttcatattatagatatgaacttctataaattttataaatgagcccaacagatatgaacttgatcatttgaaatatggctgaagttatctttttccttaaatcatttatcttcaactgaactgtgaagcagtgaaattaataatttcttctggatagtcacatcagcttttgattttgttttatgtcatagatacatcacattaaacaacttgatgatggctcatcaaatgttgtcacacgtggtcagaaccgttttcgccttagacgccgttggatcgatgctgatgacgttgtaagttctaacatttggttgagaaataagatgttctgaactgcaaatgattgtcctatgaagtagtggtaagagagcatataattccattttattaaccatgggcagcaatggggtgaagtacaaattatcgaagaagatacacctcagagaactccaagagatgcatttggccagttagctacaaattatattttcaaccagtgtggcacatcgttactcagtttgggtacatcttgtttcagacaagatgatcatgtgaactctgatcaagattgggattctctatcatccactagtacttcaagtgaacattcagtaacagatgcaagaacatactgttcctcaaatgaagatgaagatctcatgcttgaacagtcttggcagaagtatgattctgtgaaaagaaatgctgaattagagaatccagtcaagcatagcaacacaagaggcaagggtgaaccttgctttcaatccccaaaatctttaccaacaaaaaacaaaggtgctgaacaacgcaggcggttctgtgctgcttatagttcaaagctggcattgcaggctccattgtcattttggcctcgctgggcttatgaaatgtacgattcatattcccttgctcgcagagtggcaggtattgaattatttcactacagctatttcaatccgttttgtcttgtattcatgcattctttagccaaataatattctttcccactggctaacatgtcatttgttactatgattaagatgtgatgtatgcatgacattaaattggttttgtggcagatttgtggagacaaatagttgtaaatccaagcatggatgattatgtgagaaaaccagatattttgtcatatcacattggaagcaaacttcccatgtcatgttctgtgagacaagaattgcttgagatcgatggtatctcatatcggctacagaaagagatccagctactcaaggcctttaacatcataagatgcagaaattgcctggtaatgattaattattttttaaaatgtgattccactgaagttctgatcataattcaagcttatttttccaattatccggtgttttaatcttgattgctgcagtttcacacttgcacttggctataacttgtgggcttacctgtctttggttgctgtcgcaaacatatggtagagttgtagttggtttgctacaccataccatggctgcaggataagcaatagtaacgatatttaatcataccgcttcatccagatatctgttggttgttgcctgtgttttaaacaaccatggtaccatactaccaggatttccgagagacagggttttgatcatcaaagcacactagtattctgatttacaggtgatatctaagtcatgattcagttctctgaatcattatgtaaatgacaaagggacatgttcttttaatcgcttcttctctacctctaaagggctggatctcactggttgatttaaactggatttgtaacagaacttcttggaatactttcaagttttgactaatatggcaacaattccatttcttgtcgcaggctcttatctcaagacgtagtgatggccctgtcggtgcttatgtcaagcagttcagctgtgggcaagagatgatgacagtgtacaatgcaactggtcttgcactccgtggcgctccttccaaagctcacagtttgtttccagggtatgattctaatatattctactaaactctattactcaaaaaaggtttgaaatccagcctatcattaacagaagaaatgaacattgttattcgttctgtttgatcccgttgttacttgcaaatcacaggtgttcagttagcagcaatttcctgtgttcttccatacgcaactatcatacctgcactctgttattacctccattctaaaatataaaagttttagggttaggcacatgcattaagaaagtggatgaaattaaatgaggaaagattgtgtttggttaagaaaataaagtaggtggtgatattaaaaggtgaaaagttgtaattggttgataagataatgtagttaaggaattatattttggaataaattttgaatgttagaagttatacttttagatggggagagtatacgctgctaacacaaagacctgtattttttgcagttatacgtggacgattgctctctgtgctgcctgtgagtccaacataggctggctgttcagggcggagaagacaaatctgcttccaaaatccttctggggattacgcagctcccaagtttcagatgacacacaatcaggacataactgaaccttaacagtaagtcagggccccattttgtaattcgtataggtctgcctttaatttccttataagattcttttttttttcaccgggaaggccgaaggaggccaaccgaatatattaacaagaaataaaagttacaagagaaaaaacatcaaaatgcaccaaggtgcattgccacacaccacgcgctaccacccaagcacaaaccgctgagggtgaaacctagcaccaaacgaccctcgctgagcgtggccgaacgccgctaggcctacggcaacaccacagagacgaggcttcgaaaaacgatgccaccatggtggtcacgacatccaggatgccgccatcgcccatctaaaaagatgtggtttttacctagagaagctcgccaagaaagggagagggtaaccctcgacaacgctccaaggagattacgacgcccgaagacgtagccgctgccggcccggtgaaccaccggactaagctttcgcctgggaccctacgaccttgactgcagatcgccgtccaccaactcagaaccaccacacggacaaatggcagcacgtggcatccaccacaccgcaccgacacccctccgtcggtcgacttcaacgaaccaccacccctgaaaactggcccaggactcctccgttccaccacccgccggccgcctcgccatatttggccgaaggagaacccgggactaggtggcattgcttcggcagcctgagcttcccccactgacgagctgccgcctcaatccaacctagaaactccccgcaaagaaggggaggagctccacgaaggctgagggtgccgaccggcaacgaggaagacgacccaccgccgctagctccctttgcactgccacttggccgccagtggtgctgctgcttcggaccggcgccacccgccggcgcccgcgaagtccggccgccgcgcctcacctggccaccgcgacggcatcccggctgcccagccaccacgccgagtcgccaccgaggcctggatgacccaccgcgccatgggctggcgccgggcggccaggccgagcgagtgagcgggggcgccgccgccgctccgggcaggcttagctgcccgccgcctccgagcgcccgccacctccgcgacccggccggccacgacgagccgcggccatccgccgcctgcgcccgccgctgacgaaccgcctctacgccgagccgcagctgtccgccgcctccgcgcccgtgccgggccggcctagccgcagccggccgccgcctcgccgccttgccaccggccgccaccacgaccgcatgccgtcgcgccacctcaggccttctcgcgccgccgccgggcagatccaggcgagggagggccggatccggccatgggggctccggatccgccgcctcctccccaccttgccgccgtagccgccatggaccacaccggtggggagcttcgtcgtcttcgtccttcgcgccgaggagggagacgctacgaagagaagaaagcctcgccgccaccttccctgcccgctgctggcttcgccgctggcgggctccagcggcggcgaggtggggagagggagggagagaaggcgcgggcggctagggtttttcgcccccgagccgcccgacgcgagagcgacgcggggatcaggtttttcccttggctcttttctcccctccttataagattcggtatgctagctttgctaatcgtgcggctttcttgtattagacgcgagagtttgtcaataacatagatgcctgcgtattaccccacttatcgtgccccagctgccatggtccagcatctggcacatgcccagaaaattgtacatatatcacagaatgtgccttgatgctttcgttaaaaaatgcaaaaacaaacatgttcatccgtgtgtggatagtgtatacacctttgttgcaatcgtacgagcaatgccatatacaaagtaaaatcatactgaaccaaattctgcaatagcagacttgggttatttattacatgatgacagggcaaatatgtacaagcacagttcagggataaaatgctactgccgtacgatataggtccaaccgcaaattattactgtaatacaagacagcatgctgtagccaaatgaagctgtacactaaggtgagcatcacttcatctataagaacggtaaatggggctgtacatgcagctctcagcgtacttcaccaagtcttttgggcgagggagatggctagccaatcctgcatacagaagtgcgaaataactgttggtatgcgagcatcttgttttagctagcgtgctaatgaaccacatcaaaaggaacaaatattaccaaggtcataggcttttgcagcaacgcgggctgcgatgttggctgatatcttcctgatgcaggaaaagggtggataaataaggcctttgtcaacatgctctggggtcacctggtcagctaagccttcagctgtccaatgccatgaaggcaaaaacaaaacaagcaagaaaacaacaatagcgtggttagcacattagtaaagtggatgggaaaaaaaactcttgggctcatatagaatgcatttaccagcagcaaggatcatttcatctttcacccttatcgctcctgaaatcactacgcctaggccaaatcctgggaatatatatgcattgtttgcctattcaaagggtaaagagtatgtttaaattgtcaaaaacctgagaactaaaattcaggtggggaatctctcccctccagtgatttatcaaaaaaataataataattgagaactgcacatgtcgtgcgcaaaggtaatatccctaacctgtgcaggcacgaaaagcttgtcattgtatttaactggatcaaatggacttccactcccaaatattgcacggccctgcatgatgtatcatttgataagttataaagcataaatgcttgtgacataatttacagaagtttatagttcatatatgtgttgatctcaatgggatagatcatagatggcgtgaggttgcacatggaatatcaccttactccatgaatatgcctgttcagcagtacattcagattgtgatgttggattggatagtgcgaggatgattggtctctgcattatattggaaccaagctttcagttcttgaatgtgtcattaatgtgacttattatgagtcaattatctgaagaggtcaatgattttattgttacctcattaattgaactcatagcctcaatcacctcttttgtgaaactttgacccacaccagctgaacctatcaatgcagtcggtttgataacctaaaaagatacaaatcagtctagtgtggtggtgcctgaaagaaaaatgtatactgatataatatgcatctcttatggttcaagttttgcaccttaacagcatccagtagatctttgactggttcatgctcatgggcatatcgcttcttaaagggctgaagagaatctttacgtgaactgacaatcaacccctgcaatgcataaatcaactctcaatggtccaattaccaaaggatgcaagttaacactgcgatatcattattatattaacctttgaatcaagtagccagatctttttgcgagcatcttccactggaactttggactgaaaaaaaatcatagctaacgattaattgagccatcatagacaaattaccaaaaatcaaattaggtgaagctagcaatcgagttacctgatttgatatctcgagagccactagttcagcaatgcctgtaccagcctgcaagaacaggtaatctatttggaacaatctataggttttacatgatagaacaaatttttgctcgtcggtgattaagagtcaaatcactaatttactggtggcatgcttagattattcactattcaagcaaaaaaaaaaacttttttgcatctcaactagcaagaaacagaaaaggtttctgaacaactgaagttttgaattgtgataagtcctattcctatggctaaccaactctactgataggataatcagtccaactatttatgttttttttttgttactgactatcttcaattattcattgctacagttatgacaggaatgtaaaagcaatactcaatgtatattcttataatacaatacgcgatgtatagatggatgttcagagttcagacatgttgcagcagtctaaagtaaatgtgagcaatgcagaatgcaccctccatatcactgaaagggaaggtcagcttacctctcctgcgccaaagaataagaatgtgtgatcagctaaagtcccactgacaaatttctgagcagcaatgaggcctgcaagcactacagcagccgttccctgtttacaccacagtttcatggtttactcctattgttgtgaaacccagtataaatgcacattcactagttcgctttcatttaggaactgtaacgagaccaatacgaagagtaaaaaagtgagatctgaacctactacctgaatatcatcattgaagacaagattgtttgcacggtacttctcaagaagggtaaatgcattgtaatttgcgaagtcttcaaactgtaaaataaaacaaattgaacaattgcccataggaacagctcatttacagaccaaagttttcctctttccttttaacatttccatacctggactagcaccttctgtccatagttctgcttaatagcagccatgaattcatccagaagatcactatattcctaattaaagaaataaaaaccaactttcatgactgaaatcacaaccatattgttacatatcattcatgaaaactgaatgagcatatccaagaaataagcatgaaacctggccagtggctcgtttttgtcttaatccaatgtagaactcgtccttcagtaaatcctcattgtttgttcccacatcaatggtgataggtaagcactggaatgcaaaatggtgggaaaatgctacatcaatctgctattctgctcattgctgaagaaaacaattgaaatgaaaataacttacagcagaaggccggacacctccaagggctgtgtatagtgcaagctttcccacagggattcccataccctatatatgttgcaattttcaacgaacatggaaaaaaaagtcatgttaagcagcaaagtaatagcactttaaacaatccaaatgcatgaaggatccttatcaaagcacaaatgtcaggactaatttactgacctggcaaccaagatccccgagacctaaaatgcgctcaccatcagtaacaacaataacctgaatgctcttctctggccagttcctcagtaactccaatattctccccctggtacaaaagcacctcattttagaaaattgaagatgatttacacctcaaacttctgccatcagtttgttcaaaataagtaaaaattaacataaggtgaaggggcaaactaccaacagaaatgagcaacagatacaaatgatggaagaaacatacttctctttaagactgatgtacagaccctgtggtcgtctaaagattgacccgtacttctggcaagcctcgcccaccgtcggcgtgtacacaacggggagcaattcctcaacgttgtcgatcaggagcttgtagaaaagcctctcattcctctcctgcaaaccaaccgtccaccggaacaacatgacatccgtgcctagtaaactgcaaccgatatctagttttcttctacccttctgacgctttctctaaacaagatgaagccagagcacacctgaaggtccatcagagccatgtaacgttgcagaggaacctgaaactgccgcacattttgcagaagcctcttctcctgcaggtgatgcacgcttcagtgagaaacgtctaccgacaatgttatcagatgaatcgagcgctggggaagtggaagggagcaaacctgaagttcttgggagagcacgactggaggcagcaaaccccgcaggtagtgggcgtctcgctctttctccgtgaatgatagccccttgttgtgccgtggatccctcagcagagagtgaccgctaaaaaaccaagtagcaatcacaaaattaacaccagatcacatatgtgtagactggtcgtttactttcttagtttagagctggactgggcttatcatggtctggttagtggttgattgctcatagttcaaacgaattcatgaagtaactaggaatatgttgaaatgactatgcgagatcgtgtgataggaaaatctcaaattgagcccagataagctcaaagctactagtactagtgaaatcactaatcacttaatcaataatcattagttcagtactgaaagtctgatacgttggcaaagcttcttcaaatggcgcatgcacacatgtaaaaccattttgtcccgacgcaagaacagaagatcacaaggcacaagccatgcatacctggcgacgcagacggcccacggcgtgatgggctggtcctcggtggcgcggtcctcgccgtaggcgtcctccacgccaccggtggccacccccgccatcgtcgcagcgccgttcccctctcctcgccccgccatgccgctcaccgtcctcgcgccttgcctgcagcgccgccgccaccaccaccaccgcttcgtcgtctctcggaatgcagcgcgagaagccacgacgcgtagtagctggaggcctggaggagccccgtgccagcagcgtacataggagcgcgcccgcgcgccgcgcggcgggcgccgaggccacgatgacgccgccgcccgcttgtccggggacacgtcgcaggagaggtggcgccacgtaacccccgcggttaggccggtttctggagagttacacggggccgggccggccagtccgggccgcacctgtggctggattggcaaaatcgtgggccttttttcctccaccgagccggcccgagcgatctccggcctcaaaacccgaccaacctcagttcggctcgcggctcgtcgtctccttcgtcctccacttccccctcccacccaaagacgcgcagccaaatccgacgcgtgcggcggtgcgacgccggccggggtgggggacgccatgagccgcacgctcctctcccacatcctccaccgcccgccgccgctcctcgcgtacgccgcgcgctccgccgtgctccgagacctagcggctgcttctgctttgcttccgagtccctaactttcctccctgttgtttggcttcgcaggtcgaggggtggtgggcgaggaggagcgctcccgtcccgcctccgcactctccgactcaactgcagcgtggctgaagcgactgcctccggcgacgaggcgcctgctcctccggctaggaagtaagcccctggccgcctagtgttcggcgtaatgcgtctggtaggaagaggattgcggcaggtttctgtggtattttgttgttatgcgatggcgtagcctatgatgtataagtaagcgtttgctctggttcaaggctagtatgcgtgagaagtcacggatgaaattctgtaaggcttgtagcttgactgtggtaggaccagcttgtgatgtaatgcgcctgtagggtgttgtaatgagtgagtacagaattactgaggtgttgggaggggctaagaatggcaatgcaggaattgaattgctgttgaagcctgcagttcacttgctgctcttagtgtatatacttgtttgttagaatacttaactggtgttggatgaagcaagctacccataccatttgatctgaattcatttatttttctctactagacactagttgttaaattaaccgtcacttaatttttttcgtgcttgaaatgactcgatgataaattccacagaaaaattgtacatatcctagtatccaacaggctaaagtgaacttattttttgcgcaccaaggaagagagcatgccatcacagctcgcttctcttggtgtgcacaaaatgaaggtgtactcagttgactgattgtttttgtatttacaacttccacaattggtgcctcatatacaaattcagtgttcatttcatgtagtatcaagaaacaatgacattttttcagtccgatgaatatcttgatcctaagttagtttacactgtcaaattaattagtttcttcatgatcttatatatacacttgtttgcactgctcaaagtcatgaaaatattattgatggctagtgtgaagccagaatagcaaaaatagctattttggatatgtttctcatagggaatatttttagcaagtatgaacatataatgcataaggtaatcaagaacttttgattacattgcatttttttcatgatgcatcttttttcatgttggctgtttaattgtatttggatcaaatttattactcttattttatagttattattatagtcatccgtttgcagtgtgcttccaaagcaattgtttttatgtattataaggtttcatgagaaagaatgcagtttctttgcccaagttccatagtagcatctattcccacgggtctactagtcgtagttgtgattttcttcttcttttttttttcagataacaaagttctggcctagtcctgattaaatatttatacgcgtttcactaatttgaacatctatatttatctctactgactgcaggaaaagagtagtttctggtgtacagccaacaggattggtacaccttggaaattatcttggtgctattaagaattgggtttcacttcaggtagtggtttgagaactgcatcttattattctttaattttgatggtaataatctcaaaagaaaatttttcagaaaccatgaagctagtgataaataatcaatctgtagctcagtaacaaggcaacctcaaattctgacattgttcatctaattgagatgcatttgagagctaagctaacttattgactgataatacacactttatctgtgatacttgacatcttatgcatagaaattccttgcaggatctatacgagacattatttttcattgtggacttgcatgcggtaagttctatctgacctcttggcatcctaccaaaaaaataatatttatattgtttgtacaaggtgtcacttattttgtacttttatcttttccttggtcaaattagtatgtttcattttcctttaacacaagctgctacatatttgtgtaatatgtggtgtccatctttcaccaatgttatttatggtaaccaaagtgttcatgatgtatatccaaattgccgagttaccttgcaggatcaagcaagtggttcatgctcatgtctgatttgtttgtagttcatattgcaattttttttttgtctttacgattcattttgtggtcctttgtaagcttatcacgttgtttaaaatgtctgcagattacgttaccatatgaagcaccacagttgtcaaaagcaacaagaagcactgctgcaatatatctggcttgtggcattgacagttcaaaggtctgcttcacatatttacattatatgatgatgtttgttgcaggtgcccttgtggagctgaatgttttatgttgttttgtgtctttacaggcttctatatttgtacagtctcatgtccgtgctcatgttgagttgatgtggcttctgagttcttctactcctattggttggctcaacagaatgatccaattcaaagagaagtcacgcaaggcggtgcgtcattcgctgtatgacagcttcaccatcatcttttgtttgagctgaattccttttcatattacataagggtctagaaaatgcaacagctcaattcacaagagcacatgttttcaacatttccgagattgaatatttgatgattccataacactgcctgctcaacagatatgatatcatgtagttaaaaaactgttctgcaccagtaatattcacatggtgtgttccctacttaattttaataccctatcaaaccagaggaagggaaagcattacataaaaatatcttttagtgtatgccttctacttgtacaccactaccatatgattagcgtaacagcatttttgaggcagtagtcatgtgaagatcgtccatagttctagtttgtaactttcacactggacgcattaactcttattaatagatcataggcacagataaataccattctaacattagattctttgcttgggtgtaacatcacttatctatcagttggctttcctatgttctgaacaatgtttggtcctcaagattgcttacctgattcagttaaaaaaaaaaagattgcttacctgactgacaccaaatgatattcatgcatctcccctgatttctaaattactagtagaccacctctgtcattcctgaatgtgatgtgtagtgcttctaaaagtttgaacctctggcattgccattttactggagcatttattccacaatattaggaatcatgtggtgcagtttcttttttctgcgtgcaaaaccctcaactccttatatcatggtgttgtactgtttaatccgtcctattttggcaaatttttattttgttgggtttatttttttcttatttatagggtgatgaaaatgttggagtggcacttttgacttatcctgttttaatggcttctgacattctcctgtaccaggtaaatattactcgtggctattatttttctgggttgtattctcagtgatgtgtagaagctaatattaatagatgtagtttaacaattcaactttgttatggttctgtttctctcctttctatgatgccaataatagctaatgattgcagtccgatctggtgcctgttggtgaagatcagacacaacatttggaattaactcgcgaaatcgctgagcgtgtaaataatctatacggtggaaggaaatggaagaaaatgggagggtgagaaaattatattattttattccacttttttgtgtaaataatctattgtaacgattcttttttgtatttgttcttgcaggagaggtggttcactatttaaggtgtgtgccatattatttatatatggttcagcatccattttataccctcggaagtcagaactgaactttgttttgcttattatactttctttttgtttattaggttcctgaagcccttatacctccagcaggggctcgtgttatgtccttaaccgacggtctctccaaggtagttagccatactcattatcattttaatcctgatcacaaaaaatgaaactactaggacttttttgttattaaattacttattgaagtgtcattacaccactagtattgatgctcattcattaacatataaacaataacttgcagagctgattccaggcatctatattttatactttctgctcagtgtgctgtatatctctgccatactgacctttgttctgtttattcatgttagatgtcgaagtctgctccttcagatcagtctcgtattaaccttcttgatccaaaagatgtaagggcaccaagaattgaattccctgatg

SEQ ID NO: 82622 - DNA, 543 bp, Oryza sativa
cccccaccaagagatgcttcatcaggaaggtttggaaattccgtgaatgaaccgcagaaagtttatagcctgcatcagcatatggtcactgggcacaaatcaggttggttcgctttatagtcaatcagtggcggacgtggaaataaaaacaagatagaagtctagagggatgaaaacagatcagattcggatggatagttgtcatacgatattctatactatattttctaagtggattcgaagccagtgcggatgcggacggattatttctgattcgtatcctaaaccacaataccggatatctcgaccaccaactattaaaaccggtacaatttgactctctttacggttttaaagggcggtttcgatgacgtggcgtctacgtggcggttttgacatggtctttgttccgcgtggcattagaattttaaaatggaaaaactatgaattacaccactgaacaataacggtcgtccgaattaccccccgaaccacaaaaccggacattcttcaccccctaactatacaaaccggacgaattac

SEQ ID NO: 82623 - DNA, 2858 bp, Oryza sativa
ctcgttgctcgtggccgtgggtggggtgaggacgtcatcaccggtgaaggtagagaggcaaggagggaggtttggggtgggggaagaatatgacaagcgggcccgagggcatttttgaccttttacattgtttatctctcctattgaaccagaaattaatattttattggctgcggtgtcccttggcaaataaccatattttgatagtgtctttccccaaaagtgactttgtgcggtgtcctacagctaaaaccacgaagtcgggatgtcctgtagcaaaatttgccaatttattccgaatttactgcctgatcatttcttgtcagcaaagtttcttgtttgttgaattggacgcatatacaagccaagcaaataaatatcaacatattttttgtttgtttacaaatttgttaccttatatatctatgtaagtagaactacatatggcatcaaaagctacagagttgggattcgaaaatgttcaactacttgctagataaccacaaatccaaccaaacagctccagctggattttgccactggctgggctagatttccagctgcaaacattggtgtttcctggccgtgggaggggacatggaggccttggcgtgcgcttaccggcggtctacaactagttcatccccaacggcagcgatggagtccgctattacccgggttaccccaaagcattagccacttgtctatctgcctctcttgctgcatatagtgaggttgcgaaataatcagagtattcttttgtttggaagattaaatggtttgattcgtaattcaacctacatctggaaacaatgaaatataattaatatatacactaaggactcattgtttcgcttattcgcgaaataagccaaatgatatatttgcaaactgaaaataatttgtaaataaaatttttatatacgtgttctcttagcaatctaaaagctggaaaataaacttcgatgaaaaaaatcctcaaaatcaacttcaaatttaaagttaaaaatcaaattttcgatgataagtataagcataataagcgaataatctgcctcttgttctaatctcttttggtaacacaatactgctaataagaggccacccgattaaaattaggactcaaattatattgaaattctcaggatctcgcgctcacacgctatctagctaagtctgaacctttcaaaaaaaaaaaaacatcagagaaaagacaccaaagaacagaaccaaagagacagttggtgttacggattgtttccagctttccagagatttaatttcttccttttattcatctctgtataggaggttgttacatgcacgattttataggaacaaacaactactgactgtgtcctcccacgatccgattccgcttcaatcttccctagtgaaataaatgagagaaaaccgatgacggaaaccacatgttctgctattttgcagccactatgtgcatgatgggagtccaaagctactaccaaactgatgcaacaattagacatgacaatgcttacaagattacaagcatttgcaacattcttaacattggctcctcatcaaaaccttaagagcccaagttaattaattggcttgcccatatataattaactttatccctctttccatcggcctcatgttgtatctaatttaactgattttgcagtcatttaggaaataccatattttctttttctagtgtaaaacttagtatctcttggtacctctagtactataaggtacaaaatttgtactaataattttggtgtcactagttttatttccattgctccaaccagaaaacaaatcgatacaaaatcaccattccaactttgcacactgcgtgggaaaaaacaacatggttgttgacttcactctcaaataaaagctaaaacagggacttagagccaataaaggaaattactgaagctgttagtacggatgggcagggtggatagtcgaaggctcattccccatgcatcctaatcctatatcgtctacaagagatttcaactcgatgatgaaattgtcatggtatatccttgtacttgtatccatgcagacgatgctcacagctttttatgatcgtcctacactcttgagatgcttctaattcccagtgtatgtgtatatattagctgctccatgattgtagttgctagcagtcagtaaatataacgtacaatggtactgctaccgtccgtaaaacaactcaccagatttaaaacaaaactcaaaatttccactagtaaacaaaacattttcctgtacaaggagcttccattttcctagacggactgttttcgcatgcatctgcaaaaattaaacttctatttcgcatgcggacctttaaaagatccacacacaaaaatcgattttcgcaggcaggtctcttaacggtctgcacgcaaaaataagcatatgttcgcgtgcgggcctcttaagtggaccgcacgcgaaaatttatctccctcttttccctctcacccacttcaaatatttcatcttctctcttccttttcctttttattctctctcaatcactcctctttctctctttcctctatgtgcctttcctctgctctcctctagctcctcccctccccaccgagcacacggggcgtgggaggcgtccggctgccgccgccgctgccgacaaggcggcagccgggagcgggcggcacgacaactgttggcagagacggcgcggcggctacaagcaactcggggggtggcacggtgggcaagtggctggatccgcgctgtgccgacgatgaggaggaaaaggtgcccgggaacggcgacggcggcgggcagtaacggtggcggactcgggagcggtggcggcgcgatca

SEQ ID NO: 82624 - DNA, 15872 bp, Oryza sativa
gaaaaatgcattttgaccacacggaaaaatcttttgtgtactagtggtcatgtttcctgggggggggtgcaagtgtacacaacatccgacgtaaattttttataccaaccgtctatattctttgacactttattttagggtacgtacaatatcaataaataagctggcccataagtctaagctgatatggatgatagagataatgaagagagaagagtggactttccatcaaacatcaactcttagtatgagagaggataagaaaaaaaatagaatagatcagttatttgttagcatgaactatatgggaacacaaatttgttagcatgaactatatatgggaacacaaaccaggcttatatataacagttgagcatggccttatatatacacgagcagtccttcgtgaaaatacatatactttttttagataatggattttcattaatccgatctctatatccacgaaggatataaacagccaatggaattatacatatacttatctcacgcctatattaataagcaaaaggggtgacatctaaggctatatcttttgctttcataacttttgttgtctcataatgtattattttggtcagactttcattcagactaaaatggttgtaatatattcagacttcatcacccctctgtgcctgggtctctgcttctatgatacagtttatggccttcccctttgagtcttctgaccctggtcctactcgtaggatgttcacactgcaactggttgcttatgtctcaccacacatttatgaactgtttgacaatgaatatagatggacaattttgaactgaaacacaagcggagggaaacaggtacacgaattttcgaattaaactaaaaggggtccatattaccatctttattttgcactgcgtgggacacagtaacatgggtgttcacctcaccatctgggataaactcaaaccgaaagagatgtctgaagcaaattaacgaagccgtgagtccgaatggaaagtgcagatagtggaatgttcattcctgatgcatcctaatcctttcgtggaccggtcggtctacaggagattacagcatggtcatgaaagtgtcatcgtacccatgtatctctgttgtagacactcacagccttttatgctctttggtcccaacagtctttagccgattctactttcctcggcatatattaactgctctatgatacttgttgctatcagtcaatcaattatactgcattgcatttcaactggtcagaatcgtgtacaatggttaccaaattaaaaggatagctcgaaatttgacgttttacaatgggcgggggaaatgcacaaaagacgatcgacataacatttaacatcaatcattcaaactttttatgctttcttatctgggtatatacaaaagcaataaataaattatccggtaactctactgattgtggacgagggacagggaggaaagaaaagagtcgaatctcaactaaacatcgattcttggcccatgatacaagaggataaaaattttggagactggatgtttgatgataaaaatttttcgccactttttctgtttttcgaatctgacttttttgttttgtttttcaccatttttaggtgaatcggactatgcttttttttcgctattttttctatgattttttttgtttttcctttttaaggggaatcagacttctttttttttagtttttttcgctatttttttatttgtgacggacgaaggaaacaactttttttccctttttattaggggaatcggactacggttttttttgtcttttcgctactttttctctgattttttttttgtttttcctttttataaggggaatcggatttctttttttatttttttcgctattttttatttgtgacggacgaagaaaacatctcttattttttaagtagtagtagaagtagtagatagatatgcacttgttctcctggtgatgcttactgaataggacttggtataattcaaaccaagtcctattcggcccaaacagaaacaaagtcctaatcagcccaaacagaaacggatgggagtttgtttcattttttttggaatcggacagatacatttttttcccgatttttcttttaccgtgtcgatggaatcggattcgatttggtttgcactttttttttccccggttttttatcagacaaacctggtttttttccccaggtttttttttcgcccttttttttctggatcgaacttctttttttcgtctagttttttatcggacaaacctagttttttctgcttggttttttttcacccggttttttttacggacgatggaagcacctcttcttttttaagtagtagagagtacagaagagatagagatagagatagagaaagagaaacggaaaacattttttcgcaacttttttttttgaatcggacagaaataatgttcacgctttttttttggatggacgacgagattttttttaatcggacagaaatattttatttcactattattcaacttttttacggaagacggaaacccttttgtcgcaccctttttggatcggacagaacaaaattttactttcctatgcatatattaactgctctatgatacttgttgctatcagtcaatcaattatactgcattgcatttcaactggtcagaatcgtgtacaatggttgttgaaacaccgtctgtacaagttaccaaattaaaaggatagctcgaaatttgacgttttacaatgggcgggggaaatgcacaaaagacgatcgacataacatttaacatcaatcattcaaactttttatgctttcatatctgggtatatacaaaagcaataaataaattatccgctaactctactgattgtggacgagggacagggaggaaagaaaagagttaaatctcaactaaacatcgattcttagcccatgatacaagaggataaaaattttggggactgcaataaataaattttttgtttgatgatgtgactcatcctggtggcatcttgggatgttcttttcactaatgtagatataaccttctggatcgttcaattaatttcctgtatatctgatttcactgatttcctgctgatctattaatggtagtatgatactcatcttattagagtcattgatgaaaggtttattaattaattgcaagcttcagacagtgttgtgtactatcaatatatttgtatgtattttcaaattaagtacaataatattaagttgtgacgaacagcatttaactggaacattattcactccgaggatagattgattgcatatcatatcattcagaggaaatctgtaggggaaaagagctgtacacttcatgctcttttctttggaaattgaaatgcatcctgctatttatattgaaagtataataagatataatgcaaccactaaatatgttgacggtagtagtagtgtttccatcattcgtattgcagtgactgaattcaacaatgcttgtatctgctgaatcccagccctatcctcgaccctataggcagtagcttcaaccctcaaactttgtattccactggctgcttctgtatgtattgtttgcaaatgggttgtgctagggctaacatcatcttttgacataacatggaaggactagtttgctagacgaacaaatactaggacagaatcttcattcctgatgcatcctaaccctaacgcgcattggtttttgcatatgaacatagatcatcacagtggaaactgaatcactacaagaaaaccaaaatttcgtgagcgtggaaaacggccaaggaaagactaagtgtcagtgagccaccacgcaaaagcactcacgaatagagcaacaaggaaaacgaactatcttggcggttaaccgccaatgacaatttttttggtggcaaccactaccaaggaaataaggctatcgttaggttcgtgcaccgtcacagatttgaatgaaaccatcaggctaatttattatcaggttggtgttaaccccccaggtttaataatttgcatttttttcgtggtagtgcaaaggacccgacaagagaattctcatttttggcagttcctatttgcctcacataaaaattctagattgctgtagtaaattgactcaactttagaagaatgccacaattaacttgctagtaaatggtagcttttattttgattttagacatttaattgtggtattggaagtaggatactcggtataaatgatagctagcagatcaaaacagggcattatgatgcaattcagtgactagtgaaggcaaggcttatttgcaagcttatctttttaattaaaagttcaatacgggaaatacaatagactctaatgtgcacaaacttcttcaaaagaaacacctacggttcttcccaatgtatacaccgaagttccactaaagtttcagagcatttaattaattacaacaggcattctaatacttattttaagtcactagtactatgatatgaaacaactgtaatataatccaataagtagttagttttgttttcatgtcacatattcctctactgcttgcactcctatgcactcttgatctagtcgtcaatcaaatgaaatgagggctagctagaaccacaccttgatccacaatttccacacatagaaaaacgatccaacagattgcggcgtatatttagtcaacacactcagataattcccaccagacttgagaaatttgtcatgataaactggtagtcttaatcgtcatagcaaaatctttgccaattcaattttatactctagtacgatttaggcggacatttatacaaaataatcaacatgttttaccttggcaccgcccacccagacccaatcccacaaaagaatctaaactagctagctaggatataatagctatagaattcccttaacattctacgttaatgtttacgcaaatccaaaactgccatgttgtctctgacaatgaggtagttttgcaccttggagtattacgtcagtaataatgttcttgttgggtgaacctgatgcgttgcctaggtggggtttgcctcgcacaagtgtcataatgtgcctgacaataaggttgatgtgaactttcaagaaagagaaaagatgtcatgtctcacgttgaggttatgtataagcttagttcccggtacatcctaacccaactactcccccgtaccattttaagtgtgtcaaatatttgaccatccatcttatttaaaaaatttatgaaaaagtttagaaaaataagtcacgcataaagtactattcatattttatcatctaataacaataaaaatattaattataaaaaaaatcaaaaaagatggatggtcaaacattggacactaaaacccacaactatacttaaaatgggacggagggactagatatcacttaaaccaactgttctcctgttctagtattgttgctgtggtggagccaatggagccattgaggctaggttactaacaacatttctagtggttgaccaatttgttttgaagctatctacagggcagacaccatcgtcggagtctgtacggccacccaacaagcccccatttgctccaccactgtgttgctgtgagtatctgtatatacgtgtactgaaaagagcgatggttcccaaacactatggtgtccaccattatatatgaacatggataccataagatcattgaatacccttaatgtgcactccagtaaatgagaatttgcttgctcctttaggactagttactcccatgtgatggtttggtggcaactcttcatcatccgcacgctatctttttgcaccgtgtatattaaggatgtaatatatcatccatatcttcattgtactatagctagttttgtttatatgcatgagtgggaatgtgggttgtgatatatatatgagcatgatgcaatcaagtgtgcctaactttgtaaattcgatttatgctaaactaaatcaccaactttgatttagtctaaactaatcatgttcaagcttgataaggagtttgcaacattcacatgtaaatcgtcaataagaaatcagattcatgatgtggaagatgtatatattcattacaggcagcaaaaaggtgtgatacatatatttttgtaaaccgatcaaaactacgaggtttctctgttgggccaacaaaacaaaataagataaaagtttgactaattttgttttattcgagatgatgtgtaattttgaattacttctgttatattgcctgctatttcttgtctacttgtgtcttttgtctcctgctgttttcctacaacttgcttcttgttccttgtgaataaatagagattagatgtggatccatattttttgctcttggggtaaaaaaagctaaaggtgtgtgctccattttccattttttttatattataccatggagattggattgttgatttcgtcagaagtgtacagaaccaattatcaattaactggctacagttcgtcatataaaacaagagttgtcggttgaacggcggatggatcagaagaaaccaatggcaatctgtctttctcatcaaacttttcccaattcatcctaatcctattgtgtactggtctacaagatatttcagaatgatcatgctttttatgctctttagtcctgtgtaatctttagcgggttttaggtagttcattaaaaccagacctctacatccaacacacatgtacatggccaaaacttagcagcttctaatttactatggttgtgtgggagtagatagaacttacaacttgagatactaaaaaacaagaggagatgtgtgcacgcctctaacagaggtagggttccatttatatatatagtgcgctgactaggatcagcgccttcttcttagcctattaattaaggggaatagccatggttggaaggccagctgattaggggcctacctctactaggatgggacactcccatttcgccccggagagccacatggatgcattaggccacctggattcaggggcatgaatctgtaggtggtgacactaaatctagttggtatgaagtgcggccatttagactggccttgtccaccctcctctttaaatggttcatattgcccttcaaccgactaaggggcttcaatggttggcccttgtaggttcctccctccaagaaccacaacaacgaaggcggaggtttctcacttatcctactttgtttcctcccttcgggccctagacatgtccatgaggatccaattcacaccctccgtagctcagggtgtcccatcaaagccttattggtttggtcgaggttggggcatatatatattcactgctctataatgttagctcgctagcagtcattcagtttgttgcgttgcgtatcagcggttaagtcaagttcaatgttttgaaagcaaccatctctatagtccaaattgaataaagaactccaaatttcacatgtacaaggggctgaatgatatccacaaatgccagcataatgtttaatatcaatcatctagactttttaattatccctatatatattaggtatgtacaacaacaaaaatgaactggcccatagcttcgctaagtagggaagagagaaaagcattgactatccactaaacatcaactcttagcaaaagattcaacagaacagaaaatcagggaaagtattaatgatcatagtcattatgttgtatgacaaatttatagatcagttaaggaggtcaaactaggctcaacagttgaacttgaccttatgcccaagtcgttccttcgtgcaattccatatcatttctttctcatccatgtttgcacaaaatgacgaggaactagatcctgatcttttggtagttactgcataggtcgattatgaagacttgacgttgatgatccaaaaacaatcgaacccctcgcaatcatcacttctcttttggttatcaactaggccgaaacacgattgacctcacaggttggggctccacaaaactgaactaagcagcgaaactgcaattgcagattaatctaaataaaacccaaccctaactcgatgacggctaacgattatatggttactagggtcggcgacccccctggacgcatccctaatattctccaacacgatacatagtccaatgcgtcaaaagacggtgatgtagcacccaggctgattctggatgcccacttgtttcgatgattcctagacttagaaagaattttggcattacactagatgtgttggaaaggtcatcttgttagcttttaatttcaagcatatgtagaacgtcgaaaatgaaatccaattgagatctgagcgacgattttagtacggactccttctggattctgaggtgaacttgaacttgatatgaattgagcatccatctcctagcctctctgcaagtgcttgctacctctccctcatgtgtatccaaaggagtgatgagctcatcacaaaaggtgctatgagtaatgccttgttaaggttgtacctgccccgtccctgtagcaagcattacatcagaattgtgtcctgtaaatgtataaatctctatcgtattttcgaaactaaacctgtagcattaagtggcgagtggaaatctccagcctctttttacattataggcaattgattacttataattttttacaggaaagttcaaccttacatcatattgaagaagaaataactggatgaaatatgtatagagtggaatagtaagtatgaaattctgaagtcacacttctctgtaacgtgacagtaggacaagcaatccattatgccctttttttccagcaccctatcaaacgtacatacagagatcattctaatccacctttataccaaatctaatctcgatcagttttccaccttatgaaatatttgttctagacatctatcagttttcaaagtggtacaatttaatccaagcaccctctccatgcattccaaacaagatagaaagaaagagctcgaagaaatgcaaccccaaacacctagatttgcatggacagctagccaagattatggcctaaagcctaatgatggcacaaagatgcagcagatgcttttcattaagctacggccccagcttgctttcatcttttggcagaagttgcactagatgtggcggatcagaattggcaggttggatggcctagctctatggcctggttgataactggtgtctggacagtagctgctcgtccataatgcctacaaccttgtacacaagctccaggggttactgataccagaaccctcactactaccctttctcaatcttgagttttgaccatggtgtgctccgtcaaacatggatggaacctgggccagcatgagatcaagagaaacagaagtcaggtttaggactgaggatatgcataagcttggttcccagtacctcctatccctacaagctcactcaaatggactgatctcttgctgatctagttgttgcgagatatatttgtatgcgttctgaaaaaaagcatgagcaggcatggctttgaaacactatggcgtccatttatatggaaatggacttcttatggtccaagactgcttttaatgtgcatttcagtacatgagagtttgattgcacctttagggtcgtatcttcattgtattgaagaagaaataactggatgaaatatgtattgagtgtggaaaagaatctgaagtcacacttcttcgtaacatgacagtaggagaagtataccattaattatgccctttttttggagcgccatatcagacttacgtacagatcgagatcattctaatccacctttacgcctaatctaatcttgatcagttttccaccttatcaaatatttgatccagacatctatcagttttcaaagtggtatattaatataatttaaaccaagcacccttagctcagctccatgcacattctaaacaagacagaaggaaaaagctcaaagaaatgcaatgccaaacacctagatttgcatggacagcaagccaagattgtggcctaaagcttcatgatggcgcaaagatacattggagaattttcgtcaagctacggccccagcttgccttcatcttttagcagaaggtgcaatagacgttctggagcattttggcagaggttggaagacctagctctatgcctctttggcttggttcataactggtgtctggatgattaccacgttgtacccaagctccaggggttactggttgcagaacccttactactactgtatagcattgccagtttccaatcttgaatatggtttaggaaccttggccagcatgagatcaagagaaaaagaggtcaggttttggactgaggatatgaataaacttggttcccagaacctcctaaccccacaacctcactcaaaccgactgatctctggttcatcgcgttgttgcgagatatttgtatgcgtacgtacgttctgaaaaaatggatgaacatgcatggtttcgaaacactatggtgtccacgtatatggaattcatagacatctttaaaggtccaatatatactgcattttagtgcacctttaggagtagttcctcccatttgatggttgatggtttggtagaaaaacccttcatcaataccgttttgcactatacatattgtaatcgatcgtacgtatcttcattacttgcagtatagttagttttattttgtatgattcggaatgagggctgtggtatatatgtgtctaagataaaacgctgctgcggttcaagcttaatatatgtgattgtgagacattcacctagaaatcgtcagtacgatatcagattcatgatgtggaggatatatatttattatatgcaaggaaaggtacgttcagtacctcctaagcactgtaaaggcacttttctgacaaacagatagaaaattttaataatcgcgaacaatcagcatgcacgagctagctacgtaccattgtgagataattgtatatctaccatcgcaaatgaataaaatttgctgaaatatcacgagcgacaaaaaaatactagtcttaactaggacgtgtttcttggaataccatcttggaccattttaatcctgggcttcttaggctgtcttcaccgttaggtgttcccaaccggaatagtaaatacggaaaacggaacgatccattaatggattaatttgttttttaagcaacttttgtatacaaattttttttaaaaaaaacaccgtttagcggtttgaaaagcgtgcgtgtgaaaaacgagggagaggggttgggaaaaaggggtgccgaacaaacccttagtcatccctccgacaaatctgttattttgttatggtggatatgcaattttctcataccattgtcaagcaagggacctgacatggatataatcgatcaccatcatatgcaacatattaattaacaacatgggctacctgaaagtggccataatccgtatggagaaaacattggttaaaatagtttgatatatattactcaaatgtgaccagggagagcttgctataagggagagcttaaataatcaaatataaatggttcaggagatatcttgaaattatatatatctggtaatggccagcttgggtagggaccagacaacccagctggcccaccctgattttaccatattgggctgggctggacaatcatgaagatatttttctctaataataattttggaccaacccataccaagaaattttttatgcaataaattttgcctttgtttaaattataagttccagtaaaaaaattcaaggttattgcattacccagatatggtaaaagctcccgtgtgctaacaaatgttaccgtgcgtatgtgatcacactcagtaatgtcccaaatgataccgggtgtttgttctgacacccggtaacataggagcataccgtgcgctgcagttgcacacacggtaacatagaaatataacgggtgcattcgtacacggtataaaatagtgttcccgcgtgttgtgggacgcacggtatggtacataatattcccatgcgcttttgtctattcctcaccggaaatgtgctcggtaaagtgatgaagccgttgagtgtacgttgtgggtaggggtgaaaacgggacgggtatttcccgcccgactgcccgaccgtattaatttgggacaaattcgggtcagaaattcgggtacccgaaattttatatggatatagggttcgaatacgggttatttttggtggatatgggatcggattcgggagcgcagtatccgacggatacggattatccagtaaaaaatacggatactacccgaatatatatacggatagtacccgtattacgtagtctgtacaaccagccaaccagatttgaggcaagctagccaaaaagccaacaaccaggcccaaaactcaccggcccaatagtattgctaacccgaggaaataggagagagatgaggagaccgagtggagtgattgttcgtctgttcctattcctgggcggcggcggctcctggctcctgccgtcacgggctcttggcgacggcgtctcctcctggctcctgccgcggccgcgcccttgcgacggctgccagcggcgccacccgcgccggcggcgccggctcccacggtgctcgtcaccaccgctgctgcacggcctgcgtcggtcgccatctccgtcgtgccgtcctgccgtgtgcaggcctgccgtgacagccgtgtgcgccggtcgtcgtctcctactgatgatttgagtgtcttgtccttaaatatggtttacgtgaaatggtttatgtttcctagttggctcaagactcttgtgaaatggtgatgtttcctggttggcatctggcaagacatgtttctgagtattatggtattatgtactggagtactatgtggctgtgagcctgtgactgtaatgactataagtctccgttatgaagaattggtgatattttggcatgtggctgtgactgacgtactgtactacttttagcttgtggctgtgagcctgtcacgtactgtactacggtgtcttgtttcctaagccctaatgacctaatataatcgcattatggatatagatttgttgaatggttattgtctatatggtatttatgattgtttcttcgacttgatatccgaataagtatttataaccgagagtgtacgtatccatttgggtacgtattcggtccatatttttgcccgatattatccgaacttatatccgtattcgacgctatccgtgtctgacccgattccgattatacaatgtgggttaggatatgagaagtgtgagatccgacccaacccgacccgatttcacccctagttgtggggagagaataccttgtccattgaccacagtcacaaaaaaaaaaaaaaaaaaaaaactacatcaatttgaggatcctctttatactctatatattgttcacaactccttcaaaacaggtcacctatctcagaatattgcgagcagctgaaatgctagcgcacaccagtacaagctcagtcgtgtgtggcacagcgatcacaaagcatttagctacctgtgttcagcttctgatttcaagttctaggttgggcaatcaggataatgatgaccagggtacgtatcaaagcctcttcgctccgccatgaatgatgatcaagttctctctctcagggtgtgtttagttcacgctaaaattggatgtttggttgaaattggaacgatgtgacggaaaagttgaaaatttatgtgtgtaggaaggttttgatgtgatgaaaaagttgaaagtttgataagaaaagtttacaactaaacacggtgtcagttacaaacaggcgttgttcctccagaaatcaaaagtccagcttgtttgaatggaagcaagcagaaaacatgtatcttcagtcagcgcgctcaggataattcccaccgggtcctgagaaatttgacatggtaaagtggtacgcctagccgtagcaaaatgtttgatctgaacaatgaaggaagggaacagaggccacgtctcacgcagacatcaagcacaagcttggttcccagtacctcctaaccctacaagagctcacttaaaccgactgctctctggttctacctgtcgttgcagcggtggagccagtggtgccgttgaacccgagcgactaacaacgtttttcggtggtcggccaattttttgtttttagacatgttgacatttatctgtagtggagaaatcagaggcggagtccgggcagccacccaatcagcctaggagctggctccgccgctgtgttattgtgagtatctgcatatatgtgcgctaaaaagaggatgattcccgagcactgtggtgtccacgtgtatatatggatatggacaccttaagatcattgactgcccttaatgtcagttcagtctatgtgggttaattctaaaaaaaaaaaaaactctatgagggtttggctgcttctttacaagtagttcctcccatactatggtttggtggctacccttcattatctacgtgctattttttttactatgtattttaaggttgtatgtaacttatcaaatataactttttttactatagctagttttgtttatatgcacgattgggaaaggtgtgatacatatatttttgtaaacagatcgaaactacaaggtttctctattgggtcaagaaaacaaattaagagaaaactttgtctaattttattttattcgacaagaagtaacaatccttttccgatgatgcctaattttgagttatttctattatattccctgctatttattgtctacttgtgcattttatctcatgctgttttccaactgctagcttcttgttcctcatgaataaatagagattagatgtgaatctttattctttgctgttggggtcaaaaagcataaggtgcgtggtccattttccgtttgctattttaccttgaagattggattgttggtttcttctggagtggaaacaactgattctttcaattaattggctaccagttgctcaataaggcagtggaacaagagttgttggttgaacggcagatggaccagatgaaaccaatgacaatctttatctttgtcctcaaaggcagagaatagagacgcgtggtaacacacatgtctttatctttatcttagataatgaattaaaaccgggtctctacgacatctaacacacgtgttgactggtaactcagaacagtggctcactagagcgcttgcaatagcactctggaacactattgccaattcagcaagattcagaagagagcagagtaagcagagaaaactagtgatgctcagagaactcgagacacagtttgtgccgctcaaatactgccgcaacttttctggttttttcctttctcttactccctccatcctaaaatataagtatttttaggaatgaatctggatatattttgggacggaggtggtattatatatgcaaggactacaactaaaacaccccgatttctttgccacgatctgatctgtacgcatgcaccatcccacgtccacgcaaatgaatgcgatctaccaaagtttatgcaatgactgggcacgacgaggacatagtaagtctctgcccaaagcaatcctaagtgaaggcctaacaaccttaagatcgtgcacataaaggtttgactgaaaaacaaacatgtcatacagctaactgaaaaaaaaatgcagtttgcacaagctttactccaataacatatacacggcaaaaatatagctgcatctagtgtcctaatattttgttaggacaatataattgcccctaataactaagtatgtctgtgagggtaaacggaacgaacaacttgagataatagaaaacaagaggagatgtcccctcaaagcccatcagcgcctctaac

SEQ ID NO: 82625 - DNA, 568 bp, Oryza sativa
ttatctctttctctggtaggtctggggtggacagccaggtgcttgggcgctgcaaacggtaccacggccgagggggatcacggtggccggccgacgactcctcttcgcgtgcgcggctagctgggaaatcatctcctgcgcggcgccagttggcgagctccttccccgccgcgtggccggccgacgacacctctccccgggcgtgaccggcaatcgagctgctccccccacgcatggttggccaacaactatctccccgtgcacggctggccagcgagctcctctcccgcgcgtggccggccgggacctcctcctcagcacacggccggtcggcgagctcccccccctccccacccccgtgtggccggcgggcgagcaactccgccgcgcgcaaccggtcaacgactcctctccatatgcacggccggccgggagcttctctccccgcgcggtgctggatggcaagctccttccctgcgcatggccagccgacgactcttctccccacgcacgactcgctgggagctccttcatgtgtgcgaacgtacggttgcgatctcctcctcat

SEQ ID NO: 82626 - DNA, 14380 bp, Oryza sativa
tatagtatatagtgttagtgagagtaattacataaatgcagcgcctacaaaggagatattttaaataatgaagtatgatcagttgatgatattgatttgggaaggaaagaatcaaatcattaatacgagtgctggatcgaatatcacagcgatcgagcatctgatgtagtaagaatttaatgatcagtcacagcactagattgttaatttactgtgatgaaatatcagtgcattgtttactggagtactagttattattagtactgaaagcagcatcttcttcagatgtcaaatgtataagggaggcgccgaccaagaaggcaaacagaatggctcagaatttgtctacttaacgtaggatccctgggtatagagtcccctgcacagacgtgcattgttcagactgacaatgaagacgatctgcaacgctgactttttcttcttattcatgtataaattgatctgcttcttacgaatttctatgttccaaaacaataggatctagatcggtctaagtagttatatataagccatttttttttgtcggtatacgcttattgaacgtgagaaacctttggttgggccgaaaaaaaaatcgaagcttgaataaaaaaaacccaataacattatatttgaaaatttgtaatacccaaggatccaacggcccatgtagccatgcatgcatgtttctttgcaaaagcagcccatagtagccgaagcccaataactgaccggctgaacgccacagttgatgtgtgtcctcagaaaagccgatcgaccagctcatccagttcatgatcagcaccgggttcacgattccgacgaaaaccggtcaaattccgtgaaatttcgacgtttcgatatggctcggaattaagtttcgattggaatttcgaaggttaaacagtagatttggtcgaaatttatcaaaaactgtgacaccgatagggctcgaaatttagtggtcaaccggtaatgtaaaccttgatcagcacttaaatgatcgatgttggagaattaaaaccgtagtgtatctgtttgatcaaatttcaacttatattgttgacaataagatttaaagttctatactggtttgttttggtaagtttaccgtgctggaacatgaaacctcatttagtttcttcggaattcaacggcagtagagtaggagacatggtttgtgtgaggtacttattaatttagtggtattatatagagccaaagattgattatgcttcatcatcatatggtaagacaacaagtaagaacttacaaattgattacacaaccacacattcatatacagccaaaggcaaggcctttattccatatattagttgcagcacacaaaacatctaatttatcatgtgtagtaccagcacacaaaactttaattcagtactttaattcagatgagggttttatgggtgcccaccaccagacccgcttcctgagccgcctccgtagccactaccacctggaccgctcccaccacctccgccgccgccaccaccaccgccgccgctagcataaggtccataatatggcccaccagcttgaccatatccaccgccagcaccataaccatacccgccgcctccaccaccaccgccaccgccgccaccaccaccgctagcataaggtccataataaggcccaccagcttgaccatatccaccgccagcaccataaccatacccaccgcctccaccaccaccgccgccaccaccaccgccgccgccgccgccactagcataaggtccatagtaaggtccgtagtaaggtccatagtaaggtccatatggtccataataaccacctccaccacctccaccgccaccgccaccaccgcctccaccgccgccgcctccgcccccaccacctccagcatagtaaggtccataataaggcacatatcctcctgtttggccaccaccacctcccccaccaccaccgccaccgccgccggcggcgtatctagctaccacccccatcctcgcattggatactccaatacttagtagcacgaagaaggtaatagccagaagcttgtttccagccattttgagcttattccggttgaaggatgagatatggatgccaaagcaagactgcacggttatttatagtgcaggcagggagaccatgcaattatatattgcaaaatgacacttgtatatgtaaatatatgtactagtgtgacgagatgcagcagtattgcccttcgcgaacgagtaatacaaaatggagtggttttaaacacattatgacttttgctggataaatccctgctagtgaacctttaaattttctgacttggcctgactgttacgtttggattatatatgtgagtttaatatttgataatgatgctgcataaggccaggtcaagtatcaataccacgtactcgagctcaggcatttgaccatgcatccatcgcaaaaaagcagcagatacagccagactgatgacaaaaaacatttgccactagcagtaacgcagatgacatttgttcttattacctatatataaaaatctatgaggcattgacattgtgctgcttaattacaaccaaattgtacatatgctcattcgtacactggctttgtctaatccgtgtaactagtgctttcagcgcacactgtaccactctgaacaccctgaacaaaataactgaacggttttgcagactgcagtgtgttgtttcacaaatcaacgctgctatacgtacgatctgggtgtttacgatattcgtactatgaaacgcttatgcgtttattaatggtgtgccgtacgtccgtcttattcacgttagatcattgataagtacgcatagcatttttcctttcgcaaatctcacaaaacatgtagcatgcgtgccatgccgtacgttacttgactgaaacatataaaagcatgcctgatttctaaagcccatcgatgatagcagattgatgatccggactgcaatatacaaattaatcatgattggcttccaagtgaactaagtgtgtgttcgtttgaatcactactaaaaaaccaaccggcttatagatgccgattcatttaaaactgatacttataagtcttttcccacctccgatatctttaattaagaaatataggtgccggtttattagttaaaactgatacggttagttaaaaaactaacacctataatataataacctataatatattataggtatcagttctgtaaaaaaaccagcacctattctaaatcaagccgatctaggcgagacgagccgatcgacctggcctatctacgcgcgttgctcgatccttatccttatcccctcccccccccccgggctcttctgtgcgctctccccctcgccccttcctccgccacgccctcccctccccctcccctatggcccccctcccccctctcctcctcctccgatccgccatactcccctcccgccccctcctaactggcgagcagtgtcgcctgcgatgggcggcctccccaccggcggcgacctcagcgtggggagggatgtatgggtgcggcgacctcggcatggacagggacctagcggctggcgacgatctcgtgcggagagggacccggtggctagcggccacctcatgtggagagggacctcggcggcgacctcgtgcggagagggacctcggcggtgacctcacatggagagggaccccggcggtgaccttggtggattgacgagtgagtttgtgcatcttgcttgtgttcttcatctgtgatgggaactattgttgtttgttgttgatgatttgtgatggagattgttgatgttcatatctgtgattggtgatggattgaattagggattgcttgaatggagattattattgttcatctgcttgatttgtgatatgtgaaagcatgcttgaatggggattattgatgcgcatcggctcggcttggagccagcttcttttttttttttaatccggaagagcacaaaggtgacggttctatgactggcaccaataacactaggtcattggtgctgaccaattggtgtcggctaggaaaccggcacctattacccgttcccaaccggcacctataggggaatatgtgcttcgatgcaaagcactacacacgagtacacggtacatggctatgttctttcccgatctttcctaactcaccttcttcgttttttgcgcgcatgcttcccaaagtactaaacggtgcgtattttgaaaaaaaattctatagaaaagttattttaaaaattaaattaatctatttttaaaatttatttcagctaatatttaataaatcatgcactaaccgccactctgttttgcgtgttgggagctagggttgtcaaccctcactcacttccgaactcagccatacagggcagttgctctgctcagaacagaacagcatgtccagcaaccaggcttcttcatcaaagaatcaaccaggcaaggcacctgcaaaatctgcaatcactttcagctttttacagagctgctgctgttgaaacttcgttcttgttagttaacttctctgaaaatcctgaaacttggtactcacatagacttaaatctgaatctgtgtacgtttacgcggtacatgacgggatgcgttttaagcattctcataattataaatttataacatgcagagaggcctattatgttttattatacatgtaaattggtttttgatgatgaaagtgaagtgaactgaaccggtgtcaggatacgcgttgacgttgtactactcgtacgttcgtagcgtgtggctgcatatgcaattgcatttatagtatgctatattacacgttgacacgcctatacccacgcggacttgtattccgtcaacgggacattctctcgatcgataaagctccacattaaactctatccattttttaatatatgatgccgttaattttttttgatacgtttgattattcgttttatttaaaagaattatctaattattatttattttattgcgatttgattcatcgtcaaatattcattaaacatgacttaatatttttatatctgtaaaaaagttttgaatatgacaaatagtcaaacatttgtcgaaaaatcaacgacactgtatattaaaaaatagaggtaatatgatgtcagttgccaaagatcgatgttctaattgttgtctttagtattatccataaaaggtagctgtctcaagtgttgaacatactcatttacttagtcctacataaatcgtgcacatgttgacttcgtaaaataatacacacggctgtgttagatagtgcagaaatgctgagctagttagttgcacgggaaccaaaacagattgttaacgtatgattaattaagcatgaacttaaaagaaataaatactaactattatttacttgcaaaataaataaatttatttttgaaacagcttctatataaaaagtttttcacaaaacacaccatttaatagatcggccgggaaacatgcttatgataaatgaggaagtagcccactcaataaacggttaaaaacacaatctaattaagcaagaacagtatgaatgttattttttctttttttcttccttcattagtataacatattttgaaacagaaactgtatgctttaatttcacaatattaattagcccaagcctatggattgctcaaaatcaaggggtacaccaaacagataaagacaataagaaagactaaacatatcttgacacgatttctacgtatatgtaagcatgctttgctttcgtcaaaatgtcacgccccgaactagtcccgaccggaactagcccgtgacgctccaaattaacctgttaatcgataccagtcctaggaaacagtgctggtatcacaggaagacagaatatcacagcaacagaggtctctttaatatagagaaggagtacagtcatattgggctgcagacagatcccgagctcacaactgcattacaaaaggaaagcggaagccaagagttggaccaaacaacacaggcgcgacttgggaactaggccgaaaccctaaaactcaacgtagccggcttgctcctggaagaactcctcgtcagcgggatccgcttcatcttcttcagcaactgggggggagttatttatatagagcaagggtgagtacgggagtactcagcaagccatgggaaataagtgtttaatgcaggcttcaaggaaaggctgttgtttttgcaattgattttatttgaactcttttctgaaaacaactaagtgagtgcttctcaaacgacacggatgagacagtgcgtctcgtccggtcggagtatgtgcaaatgtatcagtctttagaattgatcaagattggcacccggccaacaactttcaaacggccacccgggccaacaactttcaaacggccacccgggcctagctgatcccatcagctgcagattttccaagcatcgatcccctttccacaacagcaatttcacaagcagtagtcaaacaaaactacgctaggaatcacctcacatccgcgcatgaccgtgggcacggctgttcgaacagtttgttaacctctgcagaggggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggagtcctctctgacaccaccccggcgaatccacatgtctcttggcatcaaggctcccctgataagctagttactcagccaggggtgtcccattccacccatgtggtcgtacttgtcttatgttcggatgaaattccaaggaaacggtccttaggtgcaagagcgggaaaccgtacacccggtacgttccccggtccgcggttttggaaattcatttagttcgcaagcaccgacccaggtgtcgggttttccaagtcttttgtaaaacccaagttttacccaagatgtttttttttcagattttaagtttgaaggcggccgtcgatactcgtgcagagtgcacgatttccgaggcgcaactgggtggttacaagggaacatggtataacaattaacaaatgaaggatcaaatgcaacaaattaggtaggtccgtcaatctgccttgcagacgggacaagcagattaagtgcgatcctatcaatgcataataatctttcaagcaatataattaagttcaaatataggctcaagatattcaaaggtggcttgccttgctcgagatctggagcttgatcctcgaaatcctcgcactgcgggtcttcgggctccgaaactacacgcaaaacgggacaactcaacaaacggcgaaaataaagcctattaatgacctctaagcgtgccattagatagatctcaagatttgaggaattttggaagttgaacggagtcaaacggacttacggttggaaagatattgaatttctaagattattggatttttggtctaaaggaaaaggatttacttaattcctttttttgaaaaagaaaagaaaagaaaagaaggagggggaaaattagacttccctcgggaggctagggcgcggcccgagagaaaaggggcggctcggccgagctaaatgggccggtcggcccaacaaggcggcccagagcgcgcgcgcgggcggggaggagagagggagccggtggaccgggctcacctcgcgtggtcccgagtgggacccgcttgtcggtgacacggttcaccgagcggaacgcgcacgcggcgcccgctagggtttgggggagggacgcggtgcacgcgcgcggttcgcggaggacgcggatgcggcgggcccacgcgcagcctcacggctcgcggtggaccgcgcccgcgagcggggccgtggggagcggctaaccggggtcggctcgacccggtcttggccgagctggcgccgacgtggcgcctacgtgtcacgcccagaaatttagcccaaatttccagactattttgtgtattaaatccctgtccaggaccagccagggtacacaaaacgacaagtaatatacagttccaaacgtaaataaagcgtaaaatacttacaaaagaggcacttagtcctcgcaccgaaacgaaaacagcagcagcggaaaaaggcgatcctagcggggcttcagctccactccacaggcaaaactcaactggggtctgagccttggtcctctaacttcgtcttcagctcagaagcactacacttctgaaaagggggaataatcgcaaggctgagtacaaccaccgtactcagcaagccacaccaacgatgcagacgtgcaaggggaacacaaggacggtttgtggctatttgcataaaggcggttgtaaaacattttattgagcaaaacagtaaaactgttgagtaattaaagtaacattgaatctccactgatcaacgctacaccacgttgaacaggcccaaccaacccacctggactacggtgcattgggtcgatttattagggtgggactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgttcccagcgggcaacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataagttcttccagggcatcccgcgaaccggtccttaactgccatgggtgcgaccagcaaaaccatgcacccacagcccaccattcagtcgcattttagttggataattacgaccatgaagcatggccaggtgtctcgagcacgcagctcactctgatactaaaaaggtctaatattgtaattatcccatcaactgagctagtggtaattaagcatggctaagcatatagttctagctaggtcacataagtaacacaagctggtcgatttattacccaaggttgacaaagaacagatatcaagtaaacatggcacaagcgagcagataggtaaaccctgatcccgtgtaattagcaaaacatgcatatttatttgcaaacagtaaaacatttgtaaattaggatcaaaatgctcaaggggaatgtgtgacttgccttgcttcttcaaacaatcttccgaactcttttcctcgcgaccgcggacttccgaaacgacggaaactacacgctggcacgcaaaacgaggaaaaactctaataaaaaccaaggaaacagtacataaaaagtaaacaaacatgtagagctcaattttagatgaattttgcaagttgaatggctcaattcggagttcgaatgaattagatatgaattttagaagttttgagccatttaaatgaatttctataattatttacgaattattgcgcaattattatttatttttacaaaggaaatggatctcgctgacgtcagcaaggggcggccggcgccgacacgcgggccccacacgtcagcgagtcaaaggggcggcgcacggtggaccaagtccacacgtggcctcggggcgtgtccaccacgtggatggcccagatcggcccgaagccgatcggacggccacgaggcggcgcggctagggcacaggcacggcatgaaaccggctcggccgagcgatagcgcgcggcggcgtgcggccagacgaccgccggcgacagcggcgcgtcgcggcagcgggcacggggagcggcggaggaggaaaaagggagaagggacggtggggattcttaccgaggacggcgacggcgagacgaccacagggaggcggctggcggcggaaagggatggtgaacgcggcggcggcgttccaggggcagggaggggaaacggagtaggggccggggtgcggcgaggaacggcgatgccgatggcggtggtagcgcagcgcggcagcgacgggagcggtggtggcgcgcgactggaggtgacgaaaggcggctgtggctcggtgcacggtgggaatggtgctgcgggggtggaaggggaggacggagtggatgccggggtgtggcacgacgcggcgaagctgttggaggcaaaagcacggccgggcgaggcggcgctcgccggcggggagcggatggaggcggctaaaggcgaaggtggctcggggtggcggtggaagcggcgttgcggcggtggattggcgaagaggagcggtggacggggtgcgcacggcgactgtggtgccggggagggcgacggcgcagtgcggggttggcgagaatggcggctaggggcggccggagctcgccggagagcggcgacggctcgattttgcgtggggagggcgggggagagtgcggggagtacgggaaaattggggaaaagggggagggtggcacggggatcatttttataggctcggggaggagaaatcgtggccggacgggcggcaacggccggcggagtggggaggtgaagtggagctcgtggggaggtcaaaccggcgccgtttcttgcggggtgagtgggggagatggtggaggaaggggatgacgtggggtggaccgcgcccacacgcgcgcgggaaccggaagacgcgcggggaggggcggcgacgtgggcggctcgggcggccatggcagttgccggcccgggctggaggttggggatgaccccgacaggtggggcccacctgtcggtggctcgggggaaaggagagaggaggagacggttggggggacgatgacaggtggggcctcgggtccacctgtcggcgaggggaggagggaggaggctgggggttaagtggacttggaggagggggagccgagctgggccggcccacgcggagaaaggagggaaggaggaaagggagaatgggccgagcccaaagacaaagaggggaagtttattttgttttctttttatttaaattggttaaatgatcttcgtgactttaaaactatttctcgagctccgaaaattcacggaaaaatccggagagtattttagggcacaaagaatattacaaaatattcccggccaatgatttttaagggaaaatttcaaattctcccattattccacttgattaaattgatttaacttttatttaatttctagaaaatgtattattaattgatttttaaacccgaacgaaaatcggggcgttacaaatctaccccccttacaggaatctcgtcccgagattctgggatggctagaaagaaagctggagctggcgggcgatctaactgatttgcaccctgcactgttcctttctgattcaactgaacgattcctcaatggtccaaacctgctcgactgaactgaccggcattgaccattctgttcttttgctccaaacaactgaactgactggcctcattggattcgaccttggagttctggcgccccacaagactgaactctgtacgagtgatctggctggtttcagctctgcggtcctgttgctcccaaaactgaacagattggttctgcttgaactgacccagattaggactgcggatgctcctgaaacttacttatcttggactgaactgttgaggttggcaattttggtaacctgagaactcaccacgctggctatgagaggatgaaaattgaatctggcatttgtaaatcatttaccctatgtccgcttggattggtcccaactcaaaagacaagtaattccaggaaacctgcttgacccgtcttttgtctgaactgcaaccgtctgcttgacctgtctaagctaagcggttgaactggcctcatgggtgtaccttagaattcaacctgttgacttgagattgggagactccgctagtggctcgcaacggactcctttaattactaaccaaattgctacactgggttgaacattcaagtgaaatgccgacgaggtaagccaaaagtcatctctgagacctaccctccttacagtgggtagtcttactttcgcctgactgaggacctttgaactgttgttcttgaagaaaaatcgacacttctcgaatttacgaatggccctggctttgaaaatagaaaacttcaacgatcaatcaaaataaagcaatgacgatgcacttccatccaggacaagacttggaacttaacccttagttgtcgataggaaattccacataaagaaattctcatttagctcgtgatcttactaactcttgactacttccccatcagttctattgctggcatatctagcatgcttcaggcccgacttcggtgtcgtccacctaaatgggttgtgtagttgatatctcaaaactaaactgaccgactcgcattggaattgacacaacttgaggaactggggtgctgcgaatagagctgttgtcttgatgacgctaacgccttgccgacgaacaaccttgcaagaactgaccttgtaaaccataaccactataggtagcacttgttgcctctgggattggtggtgacttagctgtgctagtctgctgaagacttggtggcgtactgtctgaggttgcaggtgcttgctcctggaaaacaaactgactttcgctctgatcctgattccggcttgcatctgagcttgtacttgttggtgaagacattgtcgttgcatttgctgctttggactctgcggttgcggtatcaacatctgacacatccatcattagatcttggctagccaggatcttaccagagcgtggtgctccgactcagctggtagtttgtcgtcttgaactgatccactgactctgactgcaacacactactgctagagttgcttccgctacattcgaccttgcatcgggctttgcatcaatacacccatcttctgatcctggataccaaatgttgatcacgagcagggattcttctagcatcgggagtaccttgtagctttcgactgatccattgatctgtgactttcatacaccgttgttgttgctcttctctctgatacagaccatctgctaccagaacggaggagaggtggaagagaggggtggctaaagataaggtactaaaccacttgcctattgatctgctgtgagtagatttttatggtttaagttgcttaagcaaacaacctagtatggtcgcatccccaccaatgatgcaaaccatacccctgcacacaagcaaacaacacacgatctagaagctaacgaaactactcttctgggacagattgggtttaggtcatctccggggaaactcttctttaatcttcgcagaacgacgactctgaactgatcttctcgctccttgcacgaagcttgaggctcgacctgacttgacttccgaacagacatgacgctggcggtttgtcctccaggtttgacaactaaaggaattggaggggcagggaggagaattttgaaaaaccgtttcgcaaagaaaagccgaagggcgaggggaggcatttttcaaatagggttttcagaaagcttgtccttagggtttgaccatttggctcaacctacagtcaagttggctctgataccactttgtcacgcccagaaatttagcccaaatttccagactattttgtgtattaaatccctgtccaggaccagccagggtacacaaaacgacaagtaatatacagttccaaacgtaaataaagcgtaaaatacttacaaaagaggcacttagtcctcgcaccgaaacgaaaacagcagcagcggaaaaaggcgatcctagcggggcttcagctccactccacaggcaaaactcaactggggtctgagccttggtcctctaacttcgtcttcagctcagaagcactacacttctgaaaagggggaataatcgcaaggctgagtacaaccaccgtactcagcaagccacaccaacgatgcagacgtgcaaggggaacacaaggacggtttgtggctatttgcataaaggcggttgtaaaacattttattgagcaaaacagtaaaactgttgagtaattaaagtaacattgaatctccactgatcaacgctacaccacgttgaacaggcccaaccaacccacctggactacggtgcattgggtcgatttattagggtgggactaatcacggtgaatctggtcgaccgcccataaccgcgggcacggctattagaatagttttactctgatcagaggtgtacaactgta

SEQ ID NO: 82627 - DNA, 3743 bp, Oryza sativa
ttgaaacgtttatttgcctaacaaatccatctcccccttgtgtagatccaacatggaattgaggaagagcagatcttaatctcttttttgcactttttcctcttcctcttccatgcatgggaaatcccccaaattgtgagtggccagtgggtctggacagcctctgagatataggcttgttttgtgaatgcccataggttattgagttcgattgatgattgttttcctgatcttcatcagcccacccatcattgttgtcatctcgcaaagtaatccttgagaaaacattacgattgtttggtaaatcatatcttgcatcatatttgtcttggtcatcaaccatatcataaggctctgccattctctgaggtgataggtcatatgaatccacatcatcatcataatactcccgtcctagagggctatcatcagtttggtagtgttctgtcacatgatcacgatacatagccttccggggtcttcctctagaaaccacaggagaaacttcttggtcactaaactcatgggtatcatcaaatgaagaatacccatgttgaactgggtgtcttccaagtttaatacgctcagattcaggagaacgtgagtagcgcacatcagaattccttgtcctgcgatgacgtgttagtgcatctccacggtaagagtgctgcacatcacgctccatcccatcatgcatgccttggaaggtatcctcatcttctgccatcctaagtggcagcctcacttggtggtcaatcctttcatccttgcggccagtcaaagatgatgagccaaacatgcgcctgacactaggacttgaaacctgtgggccatttccatgtaagttctctggtggaagatatgcatttaccggatcccttcttacatattccatggacgcatctcttggagaatgattcgagtgtttctgtcttgtaatgtccaacaatatcttgccatcacgaccactgccatgctctaatggacttcctgagaatctgtgagcatggccacttacatgtcccagggtgtcatgagaaagcctgccaagttcctccatggcgtatccattggttggctcataactagttccatcatgcagtctgtaaggccgctccttggcaagcaaagatgaggaagaaccagcatatgcagatggcgcaaggtcagcaccaagtacacccttgctagggtaaagcctatccatttctccatccctttccagatgcaggcttctaccagcatagagcctgtcgatctctctttctctactcctctcaacatacgggtcatccaaacggtcacggtactgaaactcgccaccgccgtcaagcagcgacctgctacttcccgtgccaaagttctcgccggccttcatcgcggatccccctgtcaggaatccagtctctgcaggtggcactaaggtgtacagcggtggcgacgccactcgcactggtggaggtggcggccgtggtggcagcggcggcgacctcctgtccagatacagcgagctggtccttcccatctccgtcgaacaaacccggagtgtcatgccgggttccccgaagaactcaccgtccttcctcgcaggacgcagggatgacgggtggtcagggagcatgtagtctggcggcccgtcatacctcccgcgatcatcgccgcgatacggcggcggcgacctcccgcggggcgggtcgcggtcccggtcgtcgtcgcctcggcccctcgggcgtcccgccgcgtggcggtcacggtcacggtcgcggtgcggcgacggggtgcggcgcgggtggtagtccgggatgcggcggcggtcacgatacggcgacggggtgcggcgatgcggtggtcgcggcccggcgacggggtgcggcgggggcggtaatcacgggggcggcggtcgccgtgcctaaccctatcatcacgggggccgtccctgcccctgtcatcacgccgccgcgcgtcccggcgggggtggcctcccctacctccaggaccacctcctcctcctcctcctcctcctcctcctccgccgccgccgccgcctccccgccgcatgacggagacgcgcggcgacacagggatgggtgtggctgggtcagatctgggcccaccccgcgctgctccgacgcgggatggggatggcggtggtttcgattcgacggcgacggcggcggcgtcggcggcggcggcggcgaggggagtggggggagagggtgcatggggttcggcggcggcggttgggatggcaatttagggtgcagtggtgggccctcaagggctttgggctttggctgggcctactttgctgtttatgcacagactttttacgaattacagccctataataagaaagcaagggattattttatcctttttaacggccgttaaaaaacgcgaatataaaagaatggcctaatatcaaaaattagaagaggtgagtcttcgaactcagattttctagtccactaccttgtggagctagccggaagattcttgagtgtttctcatttgacaaccgttcaatttggttataaatattgatgtctacagtgatagtatttgataaaaaaaattgaaaactttaaaatcaataacttctcaagtagtactcagttgtatgttattttaaccatttcatactataatacgctttgactttataaaaaagttaacaacatttataacgtcagattagtttcactaaattcaacattgaaaatattttaatagtacgtttattttatgttgatagtgttactatgtttttaaattgaaaattttaaagcatcttatcatatgaaacagatgaataccaaatttccatgaagtttgatgttactatttgaatttcgagtaacaaaaatttgagttgacacgatgtgagcttaatttaaatggttagattctttatgcacacatgctcgtttttgtatcttgttagtattcattcagtggtaatactatcggcgttgtcatacgaatcatctgatcgttgcttttagttgtagtagtgctaacgggttaactcgtactccgtatgcagtaacttgtgtagcaacaattcccctgaatattgttccagatttctaataaccctacaacattcagaaacgaagccacgaccatttcaacatttgttccttattactgcaacaaatgcagagtggcatcatcacaagccatgcacccgcaaatcaaaaataaattaaggattcgtcatcacaagtcaatggatcagcttcagtatcatcaagaacaccacattttccccacatcgatcacatccattatcatcacacttctttcgctcaaaaatcatcagggagttgaaaagaagcatctgcagtgtgcatacatcgatcagcactgtaaactctcaaatcagttgatcagaatgtcatattactgccggcccagtctttcggaggtgctcataggggtagggtgtgcgtgtgtgcgttcataggggtgagtgtgcgcacgtttgtactatgtttctcaaaaaaaaaaaagaatgtcatattactgatgcacttaacctgatatttacagtgcatcagtaatcctgagtctcttctgatgcatttaacctgacgtactccctccgtcccaaaatataacaacgtttagcccttaggatttatcccaaaatataacaacttatcaaccaacattctcttctcaaccaattacaaccccccaccattcatttttctcacctacattcactactcatccaa

SEQ ID NO: 82628 - DNA, 1612 bp, Oryza sativa
tgcaaagatggattcgaatgagctctgtatgcaagtcagatactgatatggtgctgggttatggtgtgccaatggcaaaacatcccgggggcacagcctgtagatgacaacgcagcttggtgggctgatctcaatcaactacaccccaaacctttcaaattcagggttaaaggatctcttctcgccacttggtggaacgtttggttggaaagaaacagaagaattttttaaaacatctcttacacagaggatcgcgttgcgagaatagtaaagtccaacccccctaattgtcttttctttttcggattccctttgttttttcaggtttctcccttcttctccttcgatgtcttcccatgtattctctgaactgtttttctctcctctaataaaattccggcagagctcctgccgtaacctcaaaaaaatatatggtgctgggttaaaaggcttaatgacatggctggggaaaaaagagtaggtcattattttgaagaacttgtgcatgttagagtatattgtattggttgtattgaccttttaaacaggtatcagatatatcagttcacagacaatacatatgtgaagcttgcaaataatccttgcccagcactagtcaatgatgaattgcaaaatagtgccctgattgtgctagctagctagcatatatagaaataaaaacatttactataccacatttaatagtctagaaataaaaataaaagctaccatatatagaaaattaattgacgctagggcctagggaccagaactccaaagcgcaagaaatgcagtgaacaacatccattttctgtatgtgcgcacataaggccttccttacctcaattcagtttctgcagtgatgatttatgttcaggcagaatcctcttgcaccaaaaaccagggcgtgttaggtctaggatgcatccggaagaaagaccctatcctagtacttgtttgggaagcaaactgatccttctgtgctgtgttaagagatggtgttagccctcacacaagccatttgccaacaatttgtgcctacaggacaaggatgggcgcattgggctagtggatcagctcatagaggcgtggattatatatggtgaaaatattacttgctgtttagtgaatgcattatatacatttcattcgaagaaaaaaagatcacgactgtgaaccatccttttcctattcagtttttctccaaaaagatacgatgagtaatgtatcctcgaagtgagtaatgttttaacgaaaatgttgttcgtcaccacatcatattattgtcattaatttgaaaatacatacacatatattcacagtacgccactacactggtcaaggtcacctgtgacgggcccaaaccctcacctttgatggttttgggcttggtcagtgatcagtggtcactggtaagtccagtcacctttgacgggtggccggccgtcagtggtgacatccacctctgacgggcaagttaatagaaggccgtcagaggtgttggtctaagctagactagggcttgttaggacccgtcacaggtgtctcatctctgacgagcccctaaataaaggcccgtcagaggtgatgatctccggtatatagtagccgt

SEQ ID NO: 82629 - DNA, 8490 bp, Oryza sativa
agaagagagaaaagagaagagaaggagaagaaaagaggagataacggctgatatgtgggccccacgtacttttcttaatttttttactgactaggatgccacgtccgcaaaaccacccatatatactgccataggaccctgagtgcacggtttgtgtgagattaggggtacacatttatggttttgtggttaagggatttcaaaaaatctcgctgttaagttgaggacctccggtgaacttattccaatcggtaaccgcccccatggccaagtgggcttcatttgaggctcatttgtctccggcccggcccacttcccttcccatctcaccagtgacgtgcttcttcatcatccctatatttccccgacacttcccatcgagccgagcaaaagccctagctttcttatccggggaaagaaaaagaaaaaagaaaaaaccctagcgatcgatcttggcggcgaggcgagcgacaggggatggaggtggattcgggtcggaacgggaccggccacggccagatcgctggccccgacgaggagatccccgccggcggagacgcgaagaggtcgcgcgaggagggcggccgcaacaccaccaccacctgccaagaagacgaggacgaggacaacgactactacaacgacgactccaatttcctcgactcctaccgtaccacctgggccaccaactacggcaaaaacgacggatcctcctttgaggacgagagtgagtaacccccacttcttcttcttcattgcgcaccaatcacatctcatcatcttaatcttaaggacaattcattgcgcaccaatcacatctcatcatcttaatcttaaggacaatcttaaggacaagaagcccaaacaatttctttacaggcgtcatcttaatcttaaggacaagatttcgatatatggccatcaatttgctcatgtgcaaactagttttttttcccttcttttttgggcatactagtaagataaattttaaagtaaattgtactttggtccaccttttattacctaagtttcaatttggaccacccttaaacctatctttttaatttggaccgggtaaatttaccattgttgcggtttggactaccataaacaactttttctcatcatgtctaacttccctttcggcaaacatatgagctatacatagaggagttcggccgtgtactaaagctgatgtgtttaaggtcgctgattgtactgaaaaaaaaatcgttcatggtggtccaaatcgcaataatggcaaagtcatctggtccaaagtgaaaatatatgtttaagggtggttcaaagtgaaacttaggtaataaaatgtggcccaaagcgtaattcactctaaattttattaggcaaatggctccgttcgtttccacttaaaaaagtggattaagttttagatattcgtgacacgcttttcaaactgctaaacggtgcgtttcgtgcgaaaactttctatataaaagttgttctaaaatatcagattaatacatttttcaagtttgaaataattaaaactcaattaatcacacgttattaccacctcgttttgcgtgaaaaatttaatattcatcttcaggagattcaaacaccaccattgaccactctgctgtaagttaatctgagcgtacacaaacagtcctggtctgcactggatgtgtcaggaggaatgaggtcgcacgacagaatttcactatgaaattccacatggttcgagaaggtgctagacgcaaggtggtccatagggctaaactcttataacaaacctgtctagcgctttccaagcaattaacaagccttcttttttccaaaaagaaagtagaattatatcaatataaccagacaggacagctgcctagtgcacattcaaacacaaaatcacagtggacttttagaacactgaaattccattccatgtattcaataatgattcaactagtgctatatctatatgcctacagctgcaatccggcccatgcagcacactgatggacctgtgctgccgatatcctcgtggccaatggacgtgctacaaatattttcagtcaaggtgacagaggtcatggggaaccttgagtggccactgcgtgtctacggcatcgttgctgtccgtgactcgctggatcacaagaggaacgtcctcttccgccgcgacagggacgactgccagaccctcacctcgccacaggcaagcatcacattcaacgtatttatctttcccatgatttatactagtactagcttactcctctctttgatcataaatataagcacttttagaacaagccaaacctttttagttttgactgccaaattgttaaagagaacataatgatggatcacgtaagaaagatgttgctaggtttatcgttaaacaaattatcataagactctttttatttggaataatttatttttatagatacaggtcaaagtagcacattggaaaccgtgtctaagtccaaagtatttatatttgtaaacgcatggagtatttagttttatcagtctggcatcctttttaaaatggaggtaatagttagtatggttttatcggtctgaaattcggggtttgcatcctggatcacagttgttgcttatattttttgaactgaagatcaatgtgtaagatcagaatccagacatgatctgtatattgcttactgtgcatatatatttatgtgtgtttatgcatgtatatatacaggattcatctctgacgctcactggccctagccgtgccgtcgtgctgatcaaccctgtcatgttcgaggttgacctcaaggtgatcacccacaacaatagtggcttgccgttgtctgaatctgaagaggacgataaggtgctaagctacaacgccttcttctacgacggcgtagctcacatgaacaacactggcttcgcccggagatccgtcgagtcgacggagcactccacaatggagttcgtcttcgcacacctgatattcgccgtggaggccaccatcgcagttcgtgtcatcgaaggctcaaccgatttcagggcccgtctcaccgctcgcaccgctggcatcgatgaagacgtggtgctgctcgactccggtgacggcaaggtggcggtggtcaatgacgatgacgacagtggcccactcgtcgtgctgcagcggcgcgtcgtggtggtggaggagaagggaagcctgatccttggtgtggaggctgcagagattggcagcgaagagattgtgacgagacaggtggacatcaggcctaggcatgcgttgagaagcaggtgtggattcaatcttgggttctgcaggatgtcggtcatgatcgcctggtcagtgctaccttaattcatgtctcatgtgcattcaatgcttgactaatccatggctaactactacctttatgaggatgacacttagtactaattttaagcctctgtcaaattgcaagtactgctttgaactaattaagctagatgtgatgtgatgtgatggtgccgatggtttcttttgtacttgtgaagttgtgaccagccggttgatatacctttgttggcatttgtgtggcaatttcagttaatccatttgttgtttgcagtgcaatttttttcaggcgtacattaactatgaggtgttaagattttttttaggagctagatcagtgtgatcagtaacaaagtgtatgtagtttctcatttcctagtcgtattggcgattccgagaaccaattctactatatctgaatcccacaaatagagatgaatactctacattactagggatgaaactggttcggatagttccgtccgtccggaccttttttcggattcggatagtttcggtcggaactatccgaaaattctcggattcggaaacgaattcggattttttttctcggaaacgaaaacgaatacagtatgggtactatccgtcggaatcggaaaacggtcggaaactatctggaatttttttcggatatccgcagacattgagtaaattttagaaaaaacatgtatatatacataactttttcatacggaatcagatgaagacaaactttatatcaacattgtagagctcgatgagatctacaactttcatattgactattttattatttgaggttatttaagggtctaaatattcattataatataccatattaatttttacaaaatctcagatttacaattcaaacgatatctgatggagatgtgttccatatcaaagttgtagagctcaacgggatctaccactttgtagtttataacatttgtatttgaaagcatttaaagcataaaacaaatattgcaagtttcgaggatgtgaagtaaaataaataacatctccaatttatacaatggcaagtaagttatacatatagtaaaaggtcttgagaatagaaaatgataatcatatttgcatatggatctcttagaggaacaacaataaaaatcgatttttcacatacggttgtgagaccgtctacaaaattgatgatataattgttagcgatgtttaactaaaataataagtgatatctcttcctttatcaagaaactcaatttgaggggctttttatatatcggtaaatattcgctaccgtattcgttccgtctcgtattcgctccgtatctatattcgataatattcgatttcatttccgtatccgagttttcgattccgattccgattccgaaaaaaaatatgaaaacgaatatgataaagctagtttccatccgtttccgatccgttttcatccctatacattacttcgatagtgggtgattgctatttgagaaatgaaaccatgtttgtttctggtttgaatttttgagaactgattagacttaacaagttaaacaatctagcgcgtggttcagttcctcatctgaggagtggctattttaccggatgcagatgacagtgtcatctggcaaaaggatggtgatgtggtagaaagaagaaatatgaaaaattgttatatgtaaagtaattatctgggcttaaaataatttttcttgagttgatggtgtgtttgggttagttgggagtgcctgctgaattctccagggtgaaagtttgtgattcggaattctcaagtcggaaaaattgccaaaaggctagatttatcttattgaagtgatgtttctgttggaggaagaataacttcaattaattcattcatgcttgactagcattccaatgtaacacatgttaatgatccttttgcttataaatctttaattgactaagcttctggcttttctttgagagggtggtcaccctaaagaaaatatggcattttcagtgaaatgggaaaaggtgtttgcaaacccaagcattaagatggtccgcgtatcaaatcctttagactttcaaatatcaatttgctttgcaagtgttggtggaaattagaatgtgaacaaggattattatggccacaaattgttaagactaaatatttcgagggtgatttaactacttatatacctccacagctggatgattcctaaaggttagaaacaaatgttttgaaggcagaaaaatgcatcttggtagaattccagatcgttgtcaggtttgtggcatgggcaataccccgactatttatcatgttgatcattgcattactagaaaaaaaaatctctctgttggaagatggttaccagaagaacgttataaatgatgactttgaactttgcattcaactatcttcagaacgtttttttcccaacggatggctgcgtcgtaacaatcttgtactccctccggtcaaaattatttggagtttcagacaagaaaaattgcactaaatcactcactttttttttgttcctaaacgtcatataaaagctattggagggagagtacactcacaaaagagaaggcaatttattcaagaggaaatggaaggtggagaaatacagaaatgcctaatcttcatggacctctctcgattttatcttttttaggggaggttttattatcggttgatacgattctctgtctgaaaagaccatgactattcttcattccatgacctgaatagcaacagcaacccaagtgatgtactaacaattttgtgtagcaaataacttttttttgggcacccaaacaatcataatgcttgagtccagatatcaaatccagttagctgcctagctcgatacattgctttgttgagctcgtcgacgatttaagctgcactagatgtgcattcctgttaccagtaacatttcacatgtagtgcagtgcattttgtttcatgtcctcatctatattggagtaattaacaatgttatgatagagagctttcacaataaaattggtgacataaagatacccaactatagttatgttgcacatgagtttagttatttttgctttgcagcttcattggcgactcatatgtatccaggtacgtgatcaactgcagattcttcagaacaagcacagcagcaaatacccaaccgggaatacgatagtgtttttgacaggataactagacggagttgtaatactttctgccagatttgatgccaagtaacagtgttgctttgctgtcaatgtctgaataatgacttaatgagggcttagggacagggagactaagccagttcaactaagagcatttctgaatccatattacactgccagctacagctttgagcatttcagatgcacatgcataggcagccaatacattataacataatgactgactgcaggtgaacccaaatccgtatgtatgggattcattgttttctactggagaaaatccctaatagtgaaattgccatggatgtactgtactgttgcacaatgctccattgcttaatgtaaagggcgagatacaaaaggatcagactgaagatagccaaaatcaatctaggatgtcagataatcaggacatacttcattgcagaaacaaacattcgcgagaataaccacaacagcaaattaatgatcaacaaatgacgcatttaagaattcaaccataaacatctccactgaaaggtatgtgacattctatgatgataacagaaaacttttcataatcgaatagcaatttgctatgcattgaaggaactctacaaacgaaatcctctgttgactgaatctgctagtcatggataatagcattgtcaacctagttggaggaggtacggtatagcttgccgaaaacatggagaagggcaacgaccgcgaaaaacccgatgctcatgatcagaacagcattgggggacatcttgcacccagcagcctcttcagtgtagaactgaagcattgtgctggtgccacctctagcaccggcaccggcaccgccagtggttctgcgcctgcgcaagcttgcggcagctgctgcgctccctctggcagggccatcgccattagccggcatcttgttttagctctctgcaagggcaatacaggcttcaaagattagaatgacagcactagtggtatacacacaatgcaaagttcaataatcaaacatgttgcatcaataagttcaacaagaaattcagaagtacaggcacccatcatatgatggaagcacaaattgcagacgacagataggaaaggataacaatggcaaaaggctgaatataagaagtagaatctactcagtccccaaaggacatgagaccaataaacagttttctaatagactagctaaactgcatcttctaattgaatcgacactgtgagacttaggtggttttcgtttctattttacctcaatccccatcatcacgtctttcaaactactaaacaacacgtttcgtacgtacatataagttgctttgtaatatcaaacaaatccaacttttaagtttgtcataattaaaactcaacttcatcttcatcttcatcttcattagaaacgaacaccacttggatgacactatcaacaggcaacagagacatgaacaaatctacaaatgagccttatgcgatgcttcacttgtagttgtagcaccatatgcaagagatcacagagacaaagaagaagagctgaattatcgcggggatacgatacgcacgcagtaacgcggatcaggaattcaagtagtaacaacaagaacgaacagatcagagatccaaaccgttcatgaacgaggcggaaggaagatcaccgcccccataaatctcagaccaaaaaaaacaaaaaaaaaaggctcgggatctaacataacacgtcgctacgcaccacgcgtcagagatctaacatggcaagaacagatcgccctcggctcccaaccatccataaacatccatcagatcacacgtcctcccagaacgagcagagagaaggcggaagcgagcagatccgtaggaggagagcggaggagagggcacccagcatacaccgtaccttgcggcggcggcggcggcgacggcggcggaggaggattcgtggagggagtccggccgcagcagatgaaacggggaaggggagggaattggtgggggggggggggggg

SEQ ID NO: 82630 - DNA, 3642 bp, Oryza sativa
gcgatttagtgcaagaaataagtaaaccggtacatgaacttaacaatcacgtgcattttagtcaaaaaaaaaacactgatatatgtctttcattaatcctgatattataagcataactactagattgttggctcatggattcaatttcgtgtttcgccatgttcataacctgagacaattaatatgttgattagtcaaattgctcaaaaattatgttatttgcatgcacttacttttgataatcatatatcttttggtttcaaatcgatagattatttattattacaactaaccaattaaaagcaatacatataatacatgtagatctttatcaagatggcataaaaggtatggtgtggaatattttgatcttttaaccaaaatgcacgcactagccaagtttttacatctatatactcatttttaagtttttcactagattacacccacatactaagtttatataccgtagacgcagtttattactcaaaagagagtaaggagcaactatccacgttggaacatgtgacgtgcatatacccccggtccacgtcagcgtggaggacacgcgttacagatcttatccgctgtgggggtattgtcgtcgtgttaattgggtggtcgctttctggcactatttagtgatggctgattggtgctgattttcctttggtttagtacacccagatatatcaaacaaacggtgtgagctcaactgaatatagttttcaagctacctttttatttggtgccacaggatcgctgacgtgtacgtaatccgatactgacaccaacattatcaaattgtacatatgcctttgacaaaaagaaaattgtatatatgtgactcgtgctatggaaacatgatcaaattatcaagaattcttttttttttcgccagtccaaacagggcataaggttatttagtcgacttaggacctggttggagaaacttttggcagcggtagattttctcagaatcagaatcttccctgaacaatctaacttttcgttaagattctgaaaagttgtagttgtagaatccaatttttcaaaaatctaaataaggtagaaaacctagtttattcaaattttcagaagctgactaccaatcagctcttgtatcttaaactctctcaaaaggcatttaggcttgggccgagaagggtttttcaaattcgctccgattcgaattgtatctgggtactactttcattacccaacatatgaaatagacaaaatactttcattacacaacatatggggtgtttcaatctcacctcgtgactgacaagtagctgacctcaagacaaatgactgaaagaggccttccttggtgccatatatacagttcaaatgaagggggaaaatgaggatctggcatatgagatatgtgcatagtaaaaggacgggctcaacagaataagattgagacaggttgactcatttgctgaattcatggaggagctgaataatgtgaggaattgaatgagtagctgataagttgaatagctgatgctggccaatgtttacatgattgggaccatggtccaaaatccagcgtgtttactagctacaaggatatgaactcgaaagaaaatctctatttcagatttggtggtgtttggattcagggacttaactttaatctctgtatttagatactaatttagagtattaaatatagactacctacaaaactaattacataaatgaaagctaacttgcgagacaaattttttaagcctaattaatccataattagagaatgtttactgtagcatcacataggctaatcatagattaattaggcttatagattcgtctcgtgaattagtccaagattatggatgggttttattaatagtctacgcttaatatttataattagtgtccaaacatccgatgtgatagggacttaaaagttttagtcccatctaaacagggtcaatagacttattctatatggttacaagctacttatgccctagagattagggtgagttcgtttcagcattttggaccagttactttctcatttttcatgaaaaaaattttgtatagaagtttcttttaaaaaatcaaataaatctattttttaaatagtaataattaatagtcgattaattataggctaatggtttgcctcgtttcacgtgccggcgaaaattataagcactgaagcgaactcagcctaagaaaacgtagggaggctcttgattaagcaagatacgaggttgttacacattttctgctcttgttaaactctatttgctagaatttacattatatgaatatgtgattctctgaaccaaatcgctagtaatttaattatgtacatttttcagcatttatggagattattatgatatgtactcccttgattttaaaatagttttgttatcggtttgttttaacttaaatatatctatatttgaccatcaatttttataaatccgtatagtttagtatcgtaagatttataattttttacaaaatttttttttcgtaatatacactctttcctgtcgcctcctggaccagaatgaaggtctttgttaagttttcacacaaaaattttaaatcatgtcacatcgaacgtttgaatacctgtatgaagtattaaatataggctaaaaaaataaccaattgcacatattacgactaatttgcgagacgaatcttttaaacctaattgctccataatatttgacaatgtgttgctatagtaaatatttgctaatgacagattacttaagcttaataaattcttctcgctgtttactgacgaattctgtaattagcttttttattaatgcccaaacacaccatacgacaccctatataataactgatgtgatatgaaaaaaaaaactttacaccctcgtctaaacacccccgaaatatttggctgtagcagcaggatggaggcaatgcggcagtgatgatatattgataatttgatgtggatatgagttgcagaggttgcagcagtggcagtggtagtagctgctagccaatgggccacgcaggaaatccacctttgcatgcaatgcaatgcgtatttgcgtttgtttttgtgtgtgtgggtgtgggtctcccagaatcgaatcacttttcaatgataagaccactgcatccattcattcattctttgattttaatttccacacgcgcatttggacaggccaacaattttgactctccttgctgatctcttttaagtaattggttttctctttgcatagaggttggtaaaataataggtttttcttcccatgaattaataatttttagtagcctttaaaatcaaatgtttggatttagttgaagaaagtctggctctacaaagtagtccttagtagtcgctgtcgagtaggtttccttaccgttcgcggtttcaattatggtcctgttcttttctccaacaagatttgaatgaagattaaaattttcgtggcacgctttttaaactgttaaacagtacgtttcgtgtgaaaactttctatatgaaagttgctctaaaataccatattaatatatttttcaagtctgtaataattaaaattcaatcaatcatacgttaataccacctcattttgcgcaaaaaactaattttcatcttaaaaaaaaagcaccacc

SEQ ID NO: 82631 - DNA, 776 bp, Oryza sativa
ccaattaattatagtttggggttctgaaggttttgattatgactcaatgttgagaatcagtataatttgagttaccattttaatctggtggtctattattatttgtagttttaggatcaaaacaaaacaatcaagcctaccggaggggtaagggtaggaataccaaaaaccaaaacttttaggggaattaaaagttactctgaaattcgatgaagtatgtgacgaagtccgatgtgatcgccagatgtacacttgttagactgctggtctgaccggggcgatatcgttggtccaactgtcctctgagcaactattgtctgaagccaccgccagtctgaccgtcgctacctcgccaatctgaccgctgagatcaggagaaacatcgattgaagaactcataaaaataaatcatctttattacttctaattatgtttacaaaacacaacaattacacttgtctctcaacttttgacgaaactcgaaatctaggctaaacctaaacttttctctcaactaataatctcacaaaatctatacctagaggcatcaaccactcttttatttataccctgatgtggttgtacaaaaaccacaaatccactttgtagaaaaagtcataatttagtaggaaacctacccatacaagtaatccacctgatcaaactccaatcgtcctaaatttatactacttctaaattcgacttcgcatcccaaacacacaaaactcattttttatattgcatgaaatcttcgctactatgtgcactatcattta

SEQ ID NO: 82632 - DNA, 4325 bp, Oryza sativa
aggaaacatgccatggataatcttcatcggctcataaacattcgaacagggattaatattatttattaatcacgaagtactacttgacattgacgataaccctactacatactccctccgtcccaaaaaaaaaggcaaacccgcggtttgcgtgccaacgtttgactgtccgtcttatatgaaatttttttataattagtattttcattgttgttagatgataaaacatgatgaatactttatgcgtgacttatctttttaatttttttcataatttttttaaataagacggacggtcaaacattggacatggaaaccagggtttgtcttttttttttgggacagagggagtagtacaatattatacttatcgatcttgaactagtgaatgtgtacaaagaaagtggcacccaccctagctttgaaggggaagaagagaaggaaaaaagaagacgtttgccatgaatacccgtgcctagtcctctcgggccaagaggcaaccgttgctcgaaaagcctgtcagtggctggcactgcagtgcaccggtgcaaacaacaattcaaagctttggttgcttggttgatgccatctactgtactactcttctccacttaatctcatcaatggcagcagcacacgagaatggcaactattacagaacagtgttattgtagcagcaacagaaattcgtattgcgtagaaatagcaaaaggggttggttgtttctgcacattcaaggcacagattattctggtactgacacagctggggacagacaaaatagaagtactaccataacaatccagttccagcttagcaaatttctatgccatgatagatgtcaattttcaggcatggaaattggcaggaagcattttcatgctgcaatcttagattaccaatacagtaacagtgtaacacccctattaaccgcactctgttctgatgcccaacagtgttaaaagatggtcttaaactcttagtacatattagcaacagtaatgaggcacaagtttcacaactttgtggccttcagatgctctttcagtgagagcacatctctggccagtaatcaaccattttcattccatcattttccatcccaacacttccaaacaaaaatgatatcacggagacttaacataagaatcatgtgtgcatgtggcattcatttgatcacgcatcatctggaaaatatcacaactccaatttgaaggtgcaggagaaagaaaacgattaaatgacagaaaactagaatataaaagctcaagggcttggataaattgcattaaggttcaaccgtagcagtataatggattccaaggttgcagccacgtggtcgagcagcgatacaatttaagcaaaaagtaggataacttgatctgttcaactagccgcagtaaacctagcctagattaatttgttgctgttacttcacgaatccaagttcagtgtagcatctgctttagcctcaatgtcattcttgctcctgaccaggcatctcttctttgtttcctcatccaggtagcccaagtcttcggcgactgcaatatgcgcatatagcaactcctcgagttcatcaacaggagcatccttcttacctttgccacctttgatatgctggaactcttccttcccgtggcttttgacggtgaaatgctcgtggattctcatcgcctcctgaaatccagatatcgttggaagaaacttcactaggaacacgctctgattggctggtctgccatggctaatctttgccttgtcacatgcaaccccaatttctggatacagaagaaaatatcaacttaagggacactaagaataacgcatgagggcattttcaaaactcaacattatattttgtgccagaaactgcagatatacaacaccaagcattcctcttatccaaaagtactaacagattatatctagaagggaaaagcagttacatgatttcacactgtatcagctgatcttataaaaaattctaacagattatagccataaatgaagatgcatactagttcaaggaagcgtgcgaccaaaaaaatggtttgttcgagctagatagccacgatccttaggttgaatatctccagggacaaacaaataaaagggggactgatagaatgtaaattatattgggactaaatgaattactaacctgtcagcacaccttcaatttcttctttcgacacaatctttgcatcggtagcctttgccttggttgcaatggagctgttatgtattatgacaactggtggccacaacatgagatcatccttcatggcatttacttcctcatctggcatggaatgataggttttggtagtgtcaggagcaacatgccaattccatcccatcataacacagagtgccttgtgaaaccccaaatgttttgtcttcaaacccattttgcatgtatcataagcatgtgatatcaaggcatcgatgtccggaaacttccttgggacactgttatgcgaaagaagtgaacaaaaaagaaaacaaataaacaaagcagttcttcaggttagacatccaatgtaaatgttcaatgaaatcagaattctacgacacaagaaatatggtatccattatgcttttgagtgcagtataatgtatgacaaattgtaatgaattcagaagggtttatgcagaacatgctgtggcttctgtgcagcagacgaaaacatagtggaaaagaaaagagtatataagaaatagcaatgcaaatattccaaatatttagtatccctaaacaaaataaatggttaggaacagcaaaaacatcagccaaacaaattgttgcaactaagatggtaaaggtggaaaactatacagaattgaagatactttaccttcagctatctcaagaaatgaaatgcagtactgttgattcatgcacccagcaaaaacaaactgttgcttcatgcaataaattttaatagaagtctaaagcttaaaataaaccaaaaaaggatgacacataacaaactccaagaaagcaaagatcaacgatatctgatttgaacaagaaaaataaaccaagtgtttaaggtttgttgtatgcttagcaaccagaagagtaataaaacaaagttgaaacaaagctaaaagttaaaaaaaataaacattaagtcacttaactggcaaaaacttctgtagtaattggtacttcaataaaaagtaatattcaatatagagattccaatttaattaggactaggaagatgtcaaggcataaataatggcaatttctgatacctaccaaaggctacagatatgaaatgaaatcccaatccatatgaagcttatcagcgctatactaatgctcatattgtaaacagtaggaattgactaatgcaaatgcaaaagtgaattttcaagcataaattactcaccaggatggaaagagcaaaatagaagataacaaaatatgcagcatgtactgtgtacccgaaatacccaacatcaaatgcagcaattggttcaacctacagtctctactctctagccagaatataaaaaagtgacatgctgtaatactgcaagagccgatgctattggtttgtgtcttagttcgcaaactaacacatgttatccatcagccttaacgacttggcaagcgttgaatgcccttgaaaaaagacataacaattctgcctgattaaggaaacacaagtttttgtgccttccatgtgtttgattatggtaatccaaagaatcataacagcaatttggtttgtatgctcctgacctcaacaggatacaaacttggctgccccagacccagatactagcaaccaaaagcaacaatcagtcaacagaaccatatttcacttgtacactcttcatgtcatcttgtcctgataaatccttgcaatgcattagtccacagaatgtacatcactattggctgtggcattagggaagattgtcaaatggtcaactcatataacagaccattgctgcactgatcaaaatctttggcatctatctctcagtgcctgaagctgataaaaaatgccaacatgcggtagtttattgcctgactcttgattgaaccatgaacagacaatcttggcagtaactctacatgaaatttcctcaaaatcatcccgccacatactaccctatcgtccgatttcaccctaacagtaccatatacaagaaataacttgacctataattaaactagaaggttaacttctatgcgctgtgtggagggcacctaaagtttctcgtagaaccatgtggaagtcaagtaccataaaattcataatatgatttagctattgtaacctaaactacaagatcgaggg

SEQ ID NO: 82633 - DNA, 1049 bp, Oryza sativa
ggtgggaggttcattcccgacgcatcctaatcctacgtactgtagacaggacgtcggtctacaaaaagatttcgggaggatcatgaacgtgttcttgtacctataccactactttaatttcatgctctttagtcctatatatagttttaagaagtttaattagctgattctaattaatttccagtgtaactaattaactgctccatgatgctagttactcgcgatgtacaagtatgctgcattgaatttcaactagttgattagggttcatgtacaataatggttgttgaaacaggtacagtctgtttaagtctcctaataactgcacccgaggtccgtaataactaaaatgctccccctcacaacctacccccaccccggacatcgccgttgctcgctgctggcgcaggccgtcactgtgccggaggaagctgaggaagcccatgccggcgaccaaatccaaacttgatcaggttagtacttgttcgatccatacatatattggttttcattgcacgctccatgcattccaaacaagctaaaagaaaatgaaatcttaaataaactccgagcaacataagagtgacatttaattgtatatgcgaccaaaggtgggtttcttgctaccctatactagcaaggttatttttatattaccaactactaaccctttttctacaaacctttaattggatagcctaaaacctttaattggatagcctaaggctgtgttcagcaccacatgttcccaactcctctcgctcgtctttcatgcgcacgctttataaaatgtttctataagaaagtttgttaaaagaaccatattgatccatttttgaaaaagaaattagctaataattaattaattacatgctaatggattgctctgttttccgtgcgtaggagattggttaccatctcctccaaacgaactcagccaagaatggcctaatgccaaaatgataaggaggagtttccatgtgcggctaaggccgttgtgcctgtatatcttgttgacaaggtgtccctccttccctaaatgtttgacg

SEQ ID NO: 82634 - DNA, 8513 bp, Oryza sativa
ttgtggataattgattttagttactggcactggttttttcagccgaactcatccacagatcatctcccgacatcccaaatcatccacaatcccaaatcattcacaacaacaaaatcatcatccacaatcccaaatcatccacaacaacatatatagccaacaaaaaatcatccacaaattaagagggaaaaaaaggaaaagaaaaagaaaaacatccggccggccgaccctccgcgtgcgcccggccgcctaccgcccagcagccgccgcgacccctctgtcacgcccctccacgtgcgccctaccacctgccacccggcggccgcgcctccctcagccgccgcaagcccgccctgctcgctcgcccactgccgcgtgcgagaatagagagaggaaagggaaaggataagaaaagagaggaggagaataagggaagagatggttgctagaggataagtacgaggaattatatactatgcaccgatttttaattccggttggtgtttctaatcgggaataaaaaaagtagggggcaaacacttttttaaccgggactatgtttagtcccggttagtgtgttaccaaccgggactaaagatcataaaatggttatgggcttttcaaccgaggctaaagatgatttttagttatgattctttttggaaccggaattattgtggttttcgtccaacccagtaaagatcggttcttcaatagtggtggttgcttgatctctgctctgtctatctctctctccgtgaacttgtgaccttgaccaagagaggagagagagtggagatagttgtggacagatttgagcccattggtggtagttgaggcgaatggagaacagaggatacacttctactatttactagtgcactaccttcgtgtttgtttttttactggtcagagacccaggtttgcgtcgcccacagtcatccgtcgtcatttgcacggctccaatcttacccgacatcaccttcctcgactctgctctgcgcggcataaccggcattgtttatcgctgtgttgcattgtgtgctattggcctgatcacagtgcatgcccatatggccatatgtgacaagccttcgtaggatggaacatgtctactatgccaagcttcgggttgccgctagctgcatgcgtcgtccccttcggaccgccactacaagttatgtgtggcttatatgacacaggttataatgtcactatatcatctaatttatgacattttatttgaagcattttaacttaatgacaataaaaagttgtgtgtcacaataagtgtcatatagctagtctagtgtcatccagtgacaatatttactatgtcataagacctatttatgtgtcacaaattatttattgtattattttaaatatttttgtccatgtaggcaagccttattgccacatcagattttcttttctcattttcagatgggccaacctggtgctagcccaacagccgcttacccgaaatgggccaacccgtgcgctaggccgagcagccgcgcctaactcagcaaaatggctaaaaaatgttaggagttaggagtcgaacccgcaagctaaaaattgttgggagttgcgtgaaaaaattgtcaaaaacaaagttatatgacttatcgaaatctaccaattttattttagttatttctccatctgagtttgattgatctatataaaatttgaattttaaaatataagaaattcaaatatatatttttttgtgtagtaaatgatttcaaatgaaaaaattgtcaacaaaaaatttgtataacttatcaagatctacaacttttgttttggtcattttgctatatgactttgtttcaataatttgaatttgaatttcaaattatgactacttcaaacaatattttcaaatactaaatgatttcaactgaaaaagtcatcaataacaaagttgtataactcataaatatctataacttttattttggtcatatcttcatctggcaaagtgatattaacattgttcacaaaatttacaaatctctcttatagtttataaaaccatattaaaattttgtgaacaatcttactatcgcttcgtcgaatgaacaaatgaccaaaataaaaattgtagattcagatggattatacaactttgttgttgatgaatttttcagttgaagtcgttcactaataaaaaaattctatttgaagttctcaaactttgaatttcaaattcaaattgttcaaatagagtcagatggagaaatgacaaaaataaaaaatttccgtctcgatgatttatacaactttagttttggtgacttttccatttgaaatcatttattaaccccaatttttattcgaaattatcaatttttgaaaattcaaaatttgtattgttcaaatgaacttatttgtaaaaaggactaatacaatagttgtagatctcgattagttctataattttattatttatgattttttcatttgaaacaaaaaaaatcgacctaaaattacatttaatgttttcataaattgaaattaaaaaaaaaacatatgatcattcctgtttcggcccaaatggcccaactatttctgaccgtccatcttcgatctaatggttctgatcgccgtccctaaccctagccctatataaaaccctcctctccacccctcctctctctctctctctccaccctcagccgccacactcccatccattctcctctcctttcctctcctctcctctccggcggtgggtatcggcgatgacagcgtgcggcggcgtcctccttcgccgcttaccacgccgcctctatctccgccgccaccacgctcgggagcggtggatctgctagatcccgggcctagggcggctagatcgagcggcggcaatccccgggcggctcgaggacggcgtgcggctgcatcgacgggcccaaccgctagccgattccaaaccacgttggccacagcatcctcgcgccgcccgctgaccacccccccttcctcgtgctcctccgcgcatagcagcagccgggtcagagagagtgccgacacggcgtggacgcgtccgcaaatgccagtgctggtcctcacgctgatagctagtaggcccattaggcttgtttagtgtaaatgagacccaaatttccccatctgagtcatctgaccatctcctccaacctccgccaatccccatccccaatccccatcggcggacgggggctgctgtggtgcgcgccgcgcgggagggcagggtgaggtgaggagggcgcggccaccaggcttccagagctgcggctgtggcatctgctccggcaaggcggcagcacgaccagccgccatggcccaaatgggcaggcgcgcagcgcaggaagagcagagacagaggcagggtgggatgaatggcacaacagcagtgcaggcgtgcagcacccagcgacgacagcaagcaagcgacaagccaacaagccaagcatccatcactccatcaacaggtgcctacatatgtgaacattaatcaatctttggtactatatctatctatactcagtactgtacttcctatttgtgatgtattgttgaaagcatgaatcttaggaagttgaggtattttttgagtacctactcttctatctagtttacaaatagatgatgaatcatcaacttataattagttcttgtttaccgtgcttaatgtagacttgttgtgataatattgcatcgtataataacatgcattgagatttttcgttatgtgctaacttctgtggtaattcgtaggccacacctaaaattttttccgtcctccgccactggtgtggctgtgatgcatcaagcgccggtggttgatatggccgagacttctgtgccgaatcttggcatgaagcccaagatctctgaacggacaagcaacaccaaggccacaatgggcacaaggtgagcttgtttatttcttgtattaaagaaagctgaacggttctgctcgttcatagcttgatgtcacattccttttaatcttagagcaagagatgcttttgtatgattaaggatgaatctggattcgattttgtatggaataactcttcatttttgtgtgcaatatgtggactaaggctaaggctaaataatacttttgattaaggatgaatccttacggatgctgccgtcatgcacgttgtccacctgtgcgttgtcatgcggcagataaacgggctggagcagcaatacgtatgaacataaggtatttgctataatcgtaggctttagtccagacatgataattttgttgttgtcctgaaatttattatctttattttatagttgctgctcatacaatacatgtgaggattctaccattaaatgcacaatgacccaatttgaggatcagtttagcactataaaacctgatgggattcaagtcagatgccgtaaggtacttgttcttttttgcactggacttcggacaactctgtctgtttctatcaatgaaactgcggccaatgttttctaacgtaaatgcaatgccccgcgggggtttacttgagtctactaaattttgcttactcatgtattataggattcatagatacattatgccactggggtacatgtaattcaagtacaataagaaactactcaattgtttggcagcaattttgcatcatcagatgctgaatagtaagcactcctactcaattaggttcagatgatattttggtgacactgaacttgcgaccattgtgcttgtgggatgttatttaggtgctgctgtgcttctggccgttgtgctgttgctgctgtgcttttggccattgcgctactgctgctgtgatgctattgcagatgtgctgctgttgctctcgcagtagcaggaatatgaaatttgagagtttggatatgtactgaattggtggatggatgtaatgatattgcatttcaagacttctggaatgtgaaatgcatgtgacattgcaatcatttgtggaatgttaattcatttgaatctgattttgtatgtgctgaaatatagtatctgggctgaattgtatgggctgaaaaaatatcagttgagctttgtgggctgaaaaaattatttgggctggaaaaatatatgggctaaattgtgggggtggaaaaatcatatgggctgaattgtgcgggttggaaaaatcatatgggccgaattggtgtgggttgaaaatttgtacaggctgcattcataaacaaacaagcaaaaaatatactgggccagctagcaacaaccccagaaaaaatatatttgtggcccatgagctacatgggctttagcaggccgaatcttattttgtgactttttttttaaccatgtcaactgttatgtcagctgccacgtggcaagccccaggattttatgacaataaagcattgtcaaatgcttgtgacaataaatgtacaaacgtcacatactaaatttatgacgtggctttttgacgtttggaattacgtcaactgatttcatatattatgacataataaaatgttaaaaatccacacacctcttatagtgcgtggtatcgctgctcatgcttacttggcactgcatctacatgaaactgttgttgtggcccctttggcgatagcatcaccactctcgtcagactttcaccatcatcaacttttatccaataccccaaatcacaaatataccggccgatgcattaagaaccggtactaaagctatttataatcggttctaaaagcctaggtacctagaaatatatatctttagccccagttggtgttaccaactgatattaaaaatacatctttagaaccggtttgcagcaccaaccggtactaatttttgtggatctttagtcttggttactgttatccgatactaaagatatttttagcactggttgataatatcaatcgggactaaagatatttttaatacaagttggttgttaccaaccagtactaaaaatgcctctagagttagttcaaaatgaaaatacctttatccaagttaaacgtgtggagtaggtaagatggtaacacagataatggttgagatgcgagatcttaagttcgaatcccacatcctatatattttttatttagtatgcatctttagatcttaagtctcggttactataaccgagattaaaaagagtttagaatcggtattaaagatcatttctctagtgtgtggattggttataagttttacgctttctttaaccactcttatttattgtagtctattagggattatggaatatcaaagttctggatacatgtgtagctcacgattcaatgacaaacatagttgtcggcaagaattcttagagtgtgttttcaggtcaaaaattaaaagtttggttgaaattggaacgaagtgacggaaaagttggaggtttatatgtgtagaaaagttttgatgtgatgaaaaaaattgaaaatttgaagaaaaaatttggaactaaacaaggccttaatttgcaaggaaaatttacaatgtgagctacctccaccagatgaatcaaataggtccccgttatctacatgtgcattttgcctatatttttcccgcatttccccaactgctcttattcaagccagtttattagctaatttggtggaatatcaattatagtatggtacgtcgaactttgtaagatgtgaagaacttgtcaaagttctgggtaggtgtgtactcgctgaagatgccattgtctccgggtatcactacttgcaaggacaaatgacaattaattgatgagctaccgccacatgattttaacgcatgttttcaaacctctcttcgtcgttgtttattacggaattctaggaatctcaaagttctggatagatgtgaacgtacgtagctctcaagattccattgcttaaaaaacagggttatatatgcaagaatcctttgcacgttacccagatgcgcaatgcctatatatatttattacgcatttcttcaactgctcatattcaaggtagtttattagccaatttgagataatatcagtgatagtatggcagctcgaactttgtaaaatgggaacaacttgtcagagttttgggtagatgtctaggtcgaacaagattcaatttgtttcacaaatacgaatcggattctttattagtttttacgaaattgataatacacaattctgaaattacggactttccatttttaatttgaaataactaatttaatttgaaattttgaaaccacaaatgtgaagttgtaactaacgtgtgcgcttcttttagctagagtcagtataataaaaaaaatataaaacctacatatttaagctatgattaaaatttaaaatatatctctatactctataatacccgtgcatcgtacgggttagcggctagtgtaactaatgcatgggctttggaccatgtgtagagctatattttgcatgaaaacttgcacttctctctttttttttatatatatctcctttctacctaagctatagttggcttatactctcactggaaagttgacgtgcaacttttataacttttactacctccgtctcaaaatgtggataggtcttatctcattctaagttactagacgggggagaagtacattgtttttttctattataatatataaaataaataaatatttttttacttttagtacggtactttttttctattatatatatatatatatatatatagacacacacacattatcctattgtatttaaacaatgacatgctctttaaaatatatgtttgactatgtatagtcaatgatatattttgaagaccatatcattattcaaaacgtcataattaaccggagggagttgccaactattaaaattgctcttaggcaacttggaatatcaaacgatgcaaaatgtgaagatcttgttaatgttctgggtaaatgtgtagctcaagataccatttgtttaacaaatatagttatctggaggaatactttcctaggacaacttacaactaatcttgttactcccactcgattggatcatatagcttccggttatcaacatgtgcgttggctatatctttttacgtgtttcttcaaccactcttatttaagggagtttatgaggcaatttgatgtaatatctgttggcggatggcatgaggctcttcaaccaaacctgccgaaacccatggcgaaggctatagagcaagaacggcgcaaggcgaagagtcgtacaagcgccaggccagaggcgtctcagacgaagggtgcaaggcgaagactatctgccgaaggaggatgacttcgtcttgacaagttcgcccctgcgagggccgaggaagcctttttggcccatcaggccggcgatcgccagacggcccatcaggggcccatgagcccctataacattatgtacccctgtaaatgcctctttggtaagggtaatcatgtaaattcccctgtacaacctaaaccctagtaataagaacctgtaatggggctataaatagtcccctagggccgggctgcagga

SEQ ID NO: 82635 - DNA, 8803 bp, Oryza sativa
taggctgacgaggggcgggcccaacttgtacggcccgaacgtacgtgatactcccgttccgttccggcccaactataatgggccgcaggtgttgttccggctcaattagagggggcctaaacaaacgagagctcactttggtatcagctgcgtctgtgtgtgtcaagctaccactactcgtgtatcaggtggctgccgagccagtggatcagtggatggatgggcaaaagatcgaaaaataccggaaaccactgtagcagcagtccactagtgtgcaggaaatttggtggtcatcgctactactggctgcacctacgctactgttgcatcgtcgtcgaattcgttcgtctagtgcatctcagccgcattctctgatcatctcatcgtcgtccttctctgtagactgtagtgtgtataaatgtacacacgtactgatcaatagtagtagtggcggcatacagtagacaaatagaaaaatacgatatactgtactagctactacgatacacttgtacacgtacatgtgtagtacagcctgcaaaccgtgcacgtggattgatctgtacaagaacctaacaatttaatttcttttttccctagcttactatcacgtgtagcgtgtgctgaaaaggattggtggtagtatgacctaatgtatagaagcaaggtttacgagagtgaactaatgtgacttttggaattgagtttgtttaacaattcagatccacttgtatatactaagtaaaattcatgcttatagtatgagcatatacaccactagtacaaaaacgatgtctagtgcactagtattgtagggacactagaagacatttttctagtactatagagacacttttcaaatgtctttacaatactatagaggcattttaaaaaatgtctaataagtgccttatggtgaattgtctctataaacgaagaggcattttataaaatatctataaggtggtagagacattttctagagacattaaattgtaccacaaccatatgaaaccagtaaaatgagaataaaatattttcccttgtttttgccaatccttaaactcatgatctcttgaacaaatcattcttatcttcaaggcactaaccaactcaaccccatgtcattcattgtatatgtttatgccttaagttacttatatttagtcatttagtatatttttattgtaagaagtgtctctacagagtttaaagtgtctcaagcaaacgtctttacatgttagacacattttaaagtgccgaaagaatgcctctacaagatataatctaataaaatgtgttgaaaatatttctaaagtgtctctagagtaaaaattttctagataattttgaaagtgtctctataaagtgtctctacgctataaactcatgatcttagaggcaatttgcaaaatgcctctacaaaagtgtctttatataatgtttttgttgtagtggggagaaattatgaatggcgtataagtaatttgttaaaccactagcctcaacggaacccctcctcttgcctcgtgtcgtgtacattgctgatccccttccccatcatccacctaaggtggtgctgcaccagtggcggatccagcgcagaggctaaggggcataagccccctacttgttggatctctatggaaagagagggttatcgtttcacaactctagcctaatatatcaccatggcagtgaatgaaggggtcgttcctatggatgttggttccgcgtgtgtcatccgtaatatagttacagcttgacggttttactatagacgttgggccgtcatcttacatcaatcactgaaggatgaagtaatgggcacaaacttcctcttcccaagcctaacgccaagtcgttcaccagttcctttgctgaagtcgtctcaactatctctaagtccaaggcgatgtggttgctcagtggaaacctcctctacttccattgccattccctttctagccaccagcccttctccacccgaggtgatgtctccctaaattttttcctatgttttgggtatgccagtgcacaccgacaatccatgggttcaccctgatatgggataataagaagtggtgtcttaccatctattactgatgagaagaaaatttatgagaggaccgttctcacattggcatgataccgttctggtatgccgctaataacaacaattaatatgtaatttaggctcatagctcgatatatatatggatcggaattaattaatgtaccacacgtaactagaaaagtcagctaaaatcaaagatgacacgagaaactaacgtacacatgctaccttaccactcacgccatagctaaaggagtactacagtgtaaggccaaaatatgccgcatacgcttacacttccatcgccggctagctgagacaacggtgcaatgcagtgattaccggccggtactgcgtcaattcaagccaacacacgaccaaacatttccatgtaggagtataaatttaagtctcgtacatctgattaattgacggtcgttattctagctagcagctggctctcaaatctcatcggttcaattaattcgtctacagtatactaactactcgttgatcatgcatactctctccatacttgtaaaggaagtcgtttaggacagcgacacgatctccaaaacacaactttgacttcttatttctataaaaatatttattaaaaaaattatatatgtatacttttatgaaagtacttttcaagacaaatctatacatataatttttacatttttaaactcaagaacttgaaagttattcatgatttatatttttaaggtttgacttaaacattgtcctaaacgactttctttatgactatggagtagtatatatctactcgatcagagtctgcatgcatgtacctactatataggagtatatgttagcggctagtctctctaaaaagatgacagagtgttagattaatagttaggatttacggcctatcttttcgtttattcttatacttatcagctaaaatttaaattttcaatattaaatttaaaattgattttaatatttttttcatcatagtttatttttcaacatctgtttttagatcactaagaatatgtatataaaagttttattataaattattttccgtttgtaaatatgttgtttgacttatttcttgaataagccaaatgatgggactattagttttctatgggatggagggtgtactggtccatgcagctgcaacaggaaaccggccggtcgatcgagcaaataatacatgggtcgcagcgctactgtgcacgagagcgattgagcctgcacgcatgcagtaaactgtggtccaacacgtctaaaaagaggccgtttttgcacggcgcgacgactgtggcattgcctacctatagtacagccctacatatgctagctaaagaaaatttcgttccaaattaagatatattatatgatacatcatcgacacccaagtgatgaaaaacacacaccattcatacatatatattttttagaaataaggtgttgtctaatatttaagtacatcgacaaaacgatatatatacatgtatatatgtcggattaagtacgggtatagaaaacaattcagtctaatctcgcatgataaaccgtttaattacacagccacctataatctatggcaagtgaaaaatcaattgtttatatagtcgtaaaatcgatcgtctattatagtcttattaggccaagtcctagattgacctactattttaaaccacatttaaaacatgataaaaaaatgaatacaatattatcgactcataggctaacaactctgaaaaattgagttgtccatatattcaacacaactaccctaccacgtggatcggtggatgctacagtgcatccgatagcttataccacttcaattaatgcatatgcttccgtttccatttgaccaaattaaacgaagtgttcgtggtacaaacgtacgttccttcaattaaattcggaaatgattgcactaacgggcgtactttctccgtcctaatttaagtgcaaccataagttttcgcgtccaattttaatcatccgtcttatttaattttttttataattagtatttttattattatgagatgataaaacattaatagtattttatacgtaacttatatttttaaattttttaaaaatagttttaaataagacaaacggtcaaagctgtgcacgaaaaattatgactgcacttaaaattagacggagaaagtaattaagtttacgttaggtgctaaagtagctgtcagaacaacacgacaagtcggtacaatattcctatgaagtttgtcacgtcagagagagagttatggatcaatacgtgtcgtcggttgcattgcatttgcaattaacacgtccatcaatatgtaacagaggtacatcaaacgtacttaaaaacacattacctacaagcctaaaactagctagccatcgacactgttagtgcaacatgcatccaacagcaatgcaaacaaatacaactagacatgtttaatactttatcttgcatgagtaactagaaggtcgtataattaaccatataaaagtacattgaaacataaaccagtagatatcactttcttcattaacatatatgacctttctataaatgcagctatagtgtggacttttaaagctcgaaagttcttaaaatattatcacacattctaaatttggataaaaggataattagccactgttgtttcccttcatcttttgagggattttctctgaagttgttttagaagggagattttctctgaagttaacagttactacatgaacaaccatctgagatatatagaacgccaagtagccacgtaggatatatatatatatatatatatatatatatatatatatatatatatatatatatctgtgtgtgcgcgcgcgcgcgctgatgaggattgaggagacaagagaaggaggagatagtataacatcatgtcaccattaacaagagaaggaggagatgattcaccttattcaaaaatttatttatttattactttgctataatttattttgtcactacaacttacaagtaagggtggatccatcgtgggtgctagaaggactcgactctctcctatctcgttggatcaccattgatagaatgagttaaggagggggggctgaaggaggaaaaagaagatgagccctccctctaatcatctattttatttacaaatgatcgaacgttttgttttcgctgtgtcgctgacggaccttcactcacttgtcacttaatctctaatgggtaacgagggctctaccggtcagagattatatatagtccaagcccgtcagatggacgtaagtagaaaaaaaatcgtcagaaaaaaaatggactagtagattgagtagagactcgtggcatgcaactgtcggaggcggcaacccacgtaccggcggccaagcttccggaccctcgcgcggcggttgcggccggggccggccggagagacgtaccggagacgcgtcgcggagacggagcccccaccgtctctaaatgccgccgcccttttggtactttgatgctgcagacgtacgactcccaattcaattctcatgctgtttccatttaattttcgtatacagattgccagggattctgattaattaagtttgtggtgatcttaattagccccccgccctgctactgctagatgttcctttcaaatacagagaaaaagtcgcctagtagatgcgaatgtgatggaattttgccggaactgaatttaattatgagttggtacgcttgagggggggatgatgatcaaatgctgtaaacactgtacttaattttgcatgttgagtggtgctgtcgagtgtaaactgtatggttgctgtgctatgctgcaatggcaagagcagtaggatgtgtcttgtgaccacagttggtacgtagtacgtgatcctttttttctgatgatatgcatggctgcaaactgagactctgacaaaagagataaaactgcgcatatgtttggagtaatgtgctatatatgtaagcgttatgctgctaattaagctcgtgtgaaggcacaccaaacatatgcatctcaagcaaaggagataaaaattacgagtgctcctagtattcttcacacaggacacacaatagatgatattcaattgacaagagcgtcatgtatgatctatctgagtatatctgaccataggtaacagatatacatagactttatcagctccaaggcaagtagctagcaggcaaccaatttgtgaatgatatatattattcgcttgtgaatttttcagtggatttctttgggtccaacttgtggtagattggtggtggatgcatgtgtaccgggaagcagaattttcatatagtaattaattataacctggaattaatgagagtagacagtggaagttcattacagtatactagtataggattcaagatccatgcaagctcgatctctgtctactccttttgtactgagattttccttaacttttcaataaaaaagcagggttcttagaaaaaaaataataatgagagggccacttgatttttagtattacaattccaaaatggagggcaatatatgttaccatgtgccgtatgcactaattaatctgaagcttgactacttcagtggtactggctaaccttttcttttctgaaaaatgaacgcatgcatgacgaaaaaaccgacatcttgttacaaagaaatgttccatagtagctgagtactgtacatctatcatggattgtatttaaataatggatgtaagtagactttgtgttcttatcttgtcctttgtttattaattctttctgaagaaataggaattcttatcttgcaatcgattgtggttacatatcctcatcaatatgtggtcctcatcttatcatggatatgatgcatgtacatatatatactttgcattgtgtgtggttccttcccttttgaatcaagaaaataatatcaaaataagtatctagtaaggaccttgctctgcattaccgtttgcttgtgtcacggatttgtcttgtttcatctgtttcagagatgtgtcctgccttccttgttatcttgttcttttcaaaaaacggacaggaaatcttgatgtcttcctggaccagctgctagctagattcagcttgttgtagttaaaaactactgctactgctactaaatgttacagaaactatacaagttatcgtgcttaatcattagtcctgtcacatgaagaaactccaaagtttcatgtgatgtagtaccaagtcccaacaaaaaactaccagatacagtacaatccagagataagttacctcaactcctcaaccagacaagaaacaagaagacaagcagaagagggcactggcaataatattcatcaaagcaataaactggaaccatttccacagaagtaaattcagaaatattttttagataatactgagaatctcagaaatcttagcacagtaagatatatacggtctttaatctaaccttgcagaacaaagaaaaatagctagtacagtagttatcacctaaattgactcgactcaagagcagtcaaatgtaactgtcaattagtaattaagcgagtgaaattgttgtgctagtactctctgctgtccccaactgattgcgccccacataatgcaagaaagagatagagagaaaatgacttatcttgcttttttctaaggaaaaagaaccaaatttggccagctatatggattagatttagcccactgctagctcagagccgcctataaaagacgcccatatgcccagccatcccacaggcagaggaccatcctagcaaacgctgcacttgtgctcagttcgtccccatgctacaccaatctcttcagaatctatctcagatcggcacttacctatagctgaaatgatcagatatcctcactaatcaggtactcccaagatgcaataaaacactatttctttcctgtttttgttcttcttcttgatttctactccgttatgttaatcttggcagcaatagattctgttgggctagatatatatcttgcgtatgttgatcagcatttttggttgggagttagattctgaatttattgctaatcatgcagttgcatactcttgcatgtgtttctgctgacacgagctcatttaatttgcagttaattgcagtggtagtagcagcagatagctacaggcgagtttagctagccaatttggaagcctcgccggcggcgaccgcgtcatgtacatggacgccttcgggtggagcgcgccagccgcgccgtgccagccgagctgcggccccggcggcgacgacgacgacgacgtcctcctcgccgccgtcttgggcgcgagcttcgagctccactccctcgtcgacggcggcggcaacggcgccgccggcgccgttcgctctgacgatgcctacggcctcgacgtcgacctgccgtcccaccagatgagcctcctgcgttgccaagatggtctgagtgctcttcacggcgacgcgtccccgacggcggcggcggcggcgttccttgactcggtggatgtgttgccagtgccggccatcgccggcgcgacgcacgacgacggcgggctcctcgataggttcgcgttcccgaacgttgccgagacgacgaccgtgcaagccgccgcgtcgaacaccgccttctccggatacagcagcaacaccaccggcggcggcaacatctcctccggcgagtcgaacacctacacggaggtggcgtcgacgccgtgcgccgtg

SEQ ID NO: 82636 - DNA, 11882 bp, Oryza sativa
tcactcttctcgctggagcagcaggagaaggaggagatagagtgaggccgtgacggcgacggcgaggtctgggggcggggcgcgatgggagacggagcggaggcggcgggggcgaccgcggcgagcaggttcgggacgatctgcgtcttctgcggcagcaacgcggggcgccgcagggtgttcggcgacgcggcgctcgacctcggccacgagctggtacgcgtagataacgggcgggcgcgtggcgcggcgacggtcgagctgtctcgctcgccgccgccgccgccgccatcgtacttttccatccttggtttcacactttttttttcaggtgcgagccgtgagattcttctcctttttttgtttttcaggtgaggcggggcgtcgatctggtctacggcggcggcagcatcgggctgatgggcttgatcgcgcgtacggttctcgacggcggccgccgtgtcgtcgggtacgtacgcacgcagccagcttcgtttctgcgcctgagagcgatttcctcattacttttgctgccttgctttcgcggctgcacctgcggatgcctgtgattctcgtgtacgtgctacaccaccatctaatgcggcgtgataaaatttttgcttgatttattcgcagggtgattcctagagctctcatggctgtcgaggtctgcaatctcttcgacttcctttcagtatttcgtagatttttcagggttcagaagtgtcgttgaattcagctctgtattggtatgttttagcgtttgccatgttgtgttcttacttggagaacttgccgttggaatcctgtggtgtttggatcagaattccacatttgaaatgaaccctaaagtctaaacgaaatgatcaagctagacagggctaggatttccgaaagtttggtttctgtccatttttaggtggcaggtacaagccgtatagcagcatacttcaattcattgttagttttcagctgaattaaatagtaggaccagtacacttgctatcttgaatttgtcagggtgatgtttatcttgaatatgtcagggtgaagttacctgatcctaacataattgataatagtacgtgtatgcgatcatttaaaagagatgttttactttgacttggaaggactgtacagctttgtgaagaattttgtaaagggagtggtttgtgttgacatttgcaaatattgcttttctaacagatatcaggtgagagtgtgggagaagtaatagttgtacaggacatgcatgagcggaaagcggagatggctcggcgatccaaagcgttcattgctcttcctggtaattgataattccaatatatgtgagatggactgacgatctgaaatgttcagtaccttctttctaacatcatctatcacactagtaattgataattcaaatgtaacttggttattgatttttatcagggggctatggaacaatggaggagctgttagagatgataacatggtgccaacttggaattcatgacaagccagtaagcataattgagatatttgatactagatatattgtaaacggcaaagtagcataatgctttgttgatggattaaggtctccatcacatataaaaccttggccaattgaacaggttggattgctaaatgttgacggttactacgatccactgctcgcgttgttcgacaaaggcgaggcggagggcttcatcaactctgattgtagacaaatatttgtatctgcaccaactgcaagtgaattgctgacaaagatggaggtaatttgactgacctatgaactctgatgtgagcatttgcaaagcctgagcgacttttttcatgcccccatttggactcagcaatacactcggttgcaccaggaggtggcccctgcaacaagctgggagatctcagagcttggctatggaagaacaccgggcgctgatcaatcctagcccccctcacttcaaaagtgactagtacaagctctactaatgcctttgcttttgttttcccttgcttcttgtgatcaagtgtcaaattaaactcctcaccatggacatggtctccagttgctgtgttcttgatttccatcgatccggtgacgaaccaaagaagccggtcgtcaccgtctacaaatttatttgaagtttgaactgctgcatgaatgcatgatcatgtagtgggagtaatataatttactagtaatttatgttttgattattcgtggaatccggtatgggagcggctgcgggaaaagcagctgcaattttctcggtcgccgacgtcacgggtggatcagtggaatgacatctgattggatttgtactactcatttgaggcttttcttttggggctaagaatgatgatgatgatgatgcgagatcgcgagggtgatgcactggattctcatcgctttgaaggtaggccgcggggggcgtactttcctctgctgggtcggtcggtcttttttggcatttggtttgctttacggagcgcgtcttgtgttggtctcgtcgtctttggttgatgacggtcacgtcggcacgtccacgacgttgtggatggagatccctcgctcctgtgcttttccttttctttctcatttttcgcttggtttggctttgcttgcacccgatcgatcgatgtatctgcacgacacgtcgatacgatcagcggcgaaaccagaaattataagagaatagggctaagatataactctagagctgtatttaattcacaccaaaattgaaagtttggttgaaattgaaacgatatgacggaaaagttggaagtttgtgtgtgcaggaaaatttcgatgtaatggaaaagttggaagtttgaagaataactttagaactaaacacggcttaatgaagcattagttttctaaaaaaataatactacatggtgaattgaactttaagcatgttttttgatgcgggccaaagactcaaagccctagctgcactagcctgcccctgcccctagacacgatcactgatgtgcatcaactctgaagcgaacttctctgaagaaaacgacatgctagttccatcgcttgtctttttgagataagaggaaataagaagattgagagatgcgtaatgaattttaaaaacaaatatctttacataaaaattataaaaaagtttagaaaatgtgcgctttgaaaaaccagagaattttccatctccggacgaacgcagcttcgcaggtaggctgacgaggggcgggcccaacttgtacggcccgaacgtacgtgatactcccgttccgttccggcccaactataatgggccgcaggtgttgttccggctcaattagagggggcctaaacaaacgagagctcactttggtatcagctgcgtctgtgtgtgtcaagctaccactactcgtgtatcaggtggctgccgagccagtggatcagtggatggatgggcaaaagatcgaaaaataccggaaaccactgtagcagcagtccactagtgtgcaggaaatttggtggtcatcgctactactggctgcacctacgctactgttgcatcgtcgtcgaattcgttcgtctagtgcatctcagccgcattctctgatcatctcatcgtcgtccttctctgtagactgtagtgtgtataaatgtacacacgtactgatcaatagtagtagtggcggcatacagtagacaaatagaaaaatacgatatactgtactagctactacgatacacttgtacacgtacatgtgtagtacagcctgcaaaccgtgcacgtggattgatctgtacaagaacctaacaatttaatttcttttttccctagcttactatcacgtgtagcgtgtgctgaaaaggattggtggtagtatgacctaatgtatagaagcaaggtttaggagagtgaactaatgtgacttttggaattgagtttgtttaacaattcagatccacttgtatatactaagtaaaattcatgcttatagtatgagcatatacaccactagtacaaaaacgatgtctagtgcactagtattgtagggacactagaagacatttttctagtactatagagacacttttcaaatgtctttacaatactatagaggcattttaaaaaatgtctaataagtgccttatggtgaattgtctctataaacgaagaggcattttataaaatatctataaggtggtagagacattttctagagacattaaattgtaccacaaccatatgaaaccagtaaaatgagaataaaatattttcccttgtttttgccaatccttaaactcatgatctcttgaacaaatcattcttatcttcaaggcactaaccaactcaaccccatgtcattcattgtatatgtttatgccttaagttacttatatttagtcatttagtatatttttattgtaagaagtgtctctacagagtttaaagtgtctcaagcaaacgtctttacatgttagacacattttaaagtgccgaaagaatgcctctacaagatataatctaataaaatgtgttgaaatatttctaaagtgtctctagagtaaaaattttctagataattttgaaagtgtctctataaagtgtctctacgctataaactcatgatcttagaggcaatttgcaaaatgcctctacaaaagtgtctttatataatgtttttgttgtagtggggagaaattatgaatggcgtataagtaatttgttaaaccactagcctcaacggaacccctcctcttgcctcgtgtcgtgtacattgctgatccccttccccatcatccacctaaggtggtgctgcaccagtggcggatccagcgcagaggctaaggggcataagccccctacttgttggatctctatggaaagagagggttatcgtttcacaactctagcctaatatatcaccatggcagtgaatgaaggggtcgttcctatggatgttggttccgcgtgtgtcatccgtaatatagttacagcttgacggttttactatagacgttgggccgtcatcttacatcaatcactgaaggatgaagtaatgggcacaaagttcctcttcccaagcctaacgccaagtcgttcaccagttcctttgctgaagtcgtctcaactatctctaagtccaaggcgatgtggttgctcagtggaaacctcctctacttccattgccattccctttctagccaccagcccttctccacccgaggtgatgtctccctaaattttttcctatgttttgggtatgccagtgcacaccgacaatccatgggttcaccctgatatgggataataagaagtggtgtcttaccatctattactgatgagaagaaaatttatgagaggaccgttctcacattggcatgataccgttctggtatgccgctaataacaacaattaatatgtaatttaggctcatagctcgatatatatatggatcggaattaattaatgtaccacacgtaactagaaaagtcagctaaaatcaaagatgacacgagaaactaacgtacacatgctaccttaccactcacgccatagctaaaggagtactacagtgtaaggccaaaatatgccgcatacgcttacacttccatcgccggctagctgagacaacggtgcaatgcagtgattaccggccggtactgcgtcaattcaagccaacacacgaccaaacatttccatgtaggagtataaatttaagtctcgtacatctgattaattgacggtcgttattctagctagcagctggctctcaaatctcatcggttcaattaattcgtctacagtatactaactactcgttgatcatgcatactctctccatacttgtaaaggaagtcgtttaggacagcgacacgatctccaaaacacaactttgacttcttatttctataaaaatatttattaaaaaaattatatatgtatacttttatgaaagtacttttcaagacaaatctatacatataatttttacatttttaaactcaagaacttgaaagttattcatgatttatatttttaaggtttgacttaaacattgtcctaaacgactttctttatgactatggagtagtatatatctactcgatcagagtctgcatgcatgtacctactatataggagtatatgttagcggctagtctctctaaaaagatgacagagtgttagattaatagttaggatttacggcctatcttttcgtttattcttatacttatcagctaaaatttaaattttcaatattaaatttaaaattgattttaatatttttttcatcatagtttatttttcaacatctgtttttagatcactaagaatatgtatataaaagttttattataaattattttccgtttgtaaatatgttgtttgacttatttcttgaataagccaaatgatgggactattagttttctatgggatggagggtgtactggtccatgcagctgcaacaggaaaccggccggtcgatcgagcaaataatacatgggtcgcagcgctactgtgcacgagagcgattgagcctgcacgcatgcagtaaactgtggtcccacacgtataaaaagaggccgtttttgcacggcgcgacgactgtggcattgcctacctatagtacagccctacatatgctagctaaagaaaatttcgttccaaattaagatatattatatgatacatcatcgacacccaagtgatgaaaaacacacaccattcatacatatatattttttagaaataaggtgttgtctaatatttaagtacatcgacaaaacgatatatatacatgtatatatgtcggattaagtacgggtatagaaaacaattcagtctaatctcgcatgataaaccgtttaattacacagccacctataatctatggcaagtgaaaaatcaattgtttatatagtcgtaaaatcgatcgtctattatagtcttattaggccaagtcctagattgacctactattttaaaccacatttaaaacatgataaaaaaatgaatacaatattatcgactcataggctaacaactctgaaaaattgagttgtccatatattcaacacaactaccctaccacgtggatcggtggatgctacagtgcatccgatagcttataccacttcaattaatgcatatgcttccgtttccatttgaccaaattaaacgaagtgttcgtggtacaaacgtacgttccttcaattaaattcggaaatgattgcactaacgggcgtactttctccgtcctaatttaagtgcaaccataagttttcgcgtccaattttaatcatccgtcttatttaattttttttataattagtatttttattattatgagatgataaaacattaatagtattttatacgtaacttatatttttaaattttttaaaaatagttttaaataagacatacggtcaaagctgtgcacgaaaaattatgactgcacttaaaattagacggagaaagtaattaagtttacgttaggtgctaaagtagctgtcagaacaacacgacaagtcggtacaatattcctatgaagtttgtcacgtcagagagagagttatggatcaatacgtgtcgtcggttgcattgcatttgcaattaacacgtccatcaatatgtaacagaggtacatcaaacgtacttaaaaacacattacctacaagcctaaaactagctagccatcgacactgttagtgcaacatgcatccaacagcaatgcaaacaaatacaactagacatgtttaatactttatcttgcatgagtaactagaaggtcgtataattaaccatataaaagtacattgaaacataaaccagtagatatcactttcttcattaacatatatgacctttctataaatgcagctatagtgtggacttttaaagctcgaaagttcttaaaatattatcacacattctaaatttggataaaaggataattagccactgttgtttcccttcatcttttgagggattgtctctgaagttgttttagaagggagattttctctgaagttaacagttactacatgaacaaccatctgagatatatagaacgccaagtagccacgtatatatatatatatatatatatctgtgtgtgcgcgcgcgcgcgctgatgaggattgaggagacaagagaaggaggagatagtataacatcatgtcaccattaacaagagaaggaggagatgattcaccttattcaaaaatttatttatttattactttgctataatttattttgtcactacaacttacaagtaagggtggatccatcgtgggtgctagaaggactcgactctctcctatctcgttggatcaccattgatagaatgagttaaggagggggggctgaaggaggaaaaagaagatgagccctccctctaatcatctattttatttacaaatgatcgaacgttttgttttcgctgtgtcgctgacggaccttcactcacttgtcacttaatctctaatgggtaacgagggctctaccggtcagagattatatatagtccaagcccgtcagatggacgtaagtagaaaaaaaatcgtcagaaaaaaaatggactagtagattgagtagagactcgtggcatgcaactgtcggaggcggcaacccacgtaccggcggccaagcttccggaccctcgcgcggcggttgcggccggggccggccggagagacgtaccggagacgcgtcgcggagacggagcccccaccgtctctaaatgccgccgcccttttggtactttgatgctgcagacgtacgactcccaattcaattctcatgctgtttccatttaattttcgtatacagattgccagggattctgattaattaagtttgtggtgatcttaattagccccccgccctgctactgctagatgttcctttcaaatacagagaaaaagtcgcctagtagatgcgaatgtgatggaattttgccggaactgaatttaattatgagttggtacgcttgagggggggatgatgatcaaatgctgtaaacactgtacttaattttgcatgttgagtggtgctgtcgagtgtaaactgtatggttgctgtgctatgctgcaatggacaagagcagtaggatgtgtcttgtgaccacagttggtacgtagtacgtgatcctttttttctgatgatatgcatggctgcaaactgagactctgacaaaagagataaaactgcgcatatgtttggagtaatgtgctatatatgtaagcgttatgctgctaattaagctcgtgtgaaggcacaccaaacatatgcatctcaagcaaaggagataaaaattacgagtgctcctagtattcttcacacaggacacacaatagatgatattcaattgacaagagcgtcatgtatgatctatctgagtatatctgaccataggtaacagatatacatagactttatcagctccaaggcaagtagctagcaggcaaccaatttgtgaatgatatatattattcgcttgtgaatttttcagtggatttctttgggtccaacttgtggtagattggtggtggatgcatgtgtaccgggaagcagaattttcatatagtaattaattataacctggaattaatgagagtagacagtggaagttcattacagtatactagtataggattcaagatccatgcaagctcgatctctgtctactccttttgtactgagattttccttaacttttcaataaaaaagcagggttcttagaaaaaaaataataatgagagggccacttgatttttagtattacaattccaaaatggagggcaatatatgttaccatgtgccgtatgcactaattaatctgaagcttgactacttcagtggtactggctaaccttttcttttctgaaaaatgaacgcatgcatgacgaaaaaaccgacatcttgttacaaagaaatgttccatagtagctgagtactgtacatctatcatggattgtatttaaataatggatgtaagtagactttgtgttcttatcttgtcctttgtttattaattctttctgaagaaataggaattcttatcttgcaatcgattgtggttacatatcctcatcaatatgtggtcctcatcttatcatggatatgatgcatgtacatatatatactttgcattgtgtgtggttccttcccttttgaatcaagaaaataatatcaaaataagtatctagtaaggaccttgctctgcattaccgtttgcttgtgtcacggatttgtcttgtttcatctgtttcagagatgtgtcctgccttccttgttatcttgttcttttcaaaaaacggacaggaaatcttgatgtcttcctggaccagctgctagctagattcagcttgttgtagttaaaaactactgcttctgctactaaatgttacagaaactatacaagttatcgtgcttaatcattagtcctgtcacatgaagaaatgccaaagtttcatgtgatgtagtaccaagtcccaacaaaaaactgccagatacagtacaatccagagataagttacctcaactcctcataccagacaagaaacaagaagacaagcagaagagggcactggcaataatattcatcaaagcaataagctggaaccatataaccacagaagtaaattcagaaatattttttagataatactgagaatctcagaaatcttagcacagtaagatatatacggtctttaatctaaccttgcagaacaaagaaaaatagctagtacagtagttatcacctaaattgactcgactcaagagcagtcaaatgtaactgtcaattagtaattaagcgagtgaaattgttgtgctagtactctctgctgtccccaactgattgcgccccacataatgcaagaaagagatagagagaaaatgacttatcttgcttttttctaaggaaaaagaaccaaatttggccagctatatggattagatttagcccactgctagctcagagccgcctataaaagacgcccatatgcccagccatcccacaggcagaggaccatcctagcaaacgctgcacttgtgctcagttcgtccccatgctacaccaatctcttcagaatctatctcagatcggcacttacctatagctgaaatgatcagatatcctcactaatcaggtactcccaagatgcaataaaacactatttctttcctgtttttgttcttcttcttgatttctactccgttatgttaatcttggcagcaatagattctgttgggctagatatatatcttgcgtatgttgatcagcatttttggttgggagttagattctgaatttattgctaatcatgcagttgcatactcttgcatgtgtttctgctgacacgagctcatttaatttgcagttaattgcagtggtagtagcagcagatagctacaggcgagtttagctagccaatttggaagcctcgccggcggcgaccgcgtcatgtacatggacgccttcgggtggagcgcgccagccgcgccgtgccagccgagctgcggccccggcggcgacgacgacgacgacgtcctcctcgccgccgtcttgggcgcgagcttcgagctccactccctcgtcgacggcggcggcaacggcgccgccggcgccgttcgctctgacgatgcctacggcctcgacgtcgacctgccgtcccaccagatgagcctcctgcgttgccaagatggtctgagtgctcttcacggcgacgcgtccccgacggcggcggcggcggcgttccttgactcggtggatgtgttgccagtgccggccatcgccggcgcgacgcacgacgacggcgggctcctcgataggttcgcgttcccgaacgttgccgagacgacgaccgtgcaagccgccgcgtcgaacaccgccttct

SEQ ID NO: 82637 - DNA, 8036 bp, Oryza sativa
acattttttattgtagatgaaagatcatttcatctacaattcccctggtttctggcgatggaagaaatactgcaaatctgttagcatgcttccctaactactacatttttttcaaaaaaacctataacttaattaatcatgtgttaattttaaaaattcttcccgaactactactacctttttttcattctgtaacttaattattcatgtgttaatttaaaaattctataacttaattaatcatgtgttaataagccactttgctattcgtgccgaagaggaaaaattttgaacttccttgttcgatcacattattagtgcaacgacgactgcttatggaaatatataagtttgtcgtgatgcaaagtttgatcacgatagcgcgacgcaatatacaagtttgaatacgttaaaaaaaaccatgagaatttgttatagtgtacaatattcctagtggtttaatttattatgtttctttctaatattaatttattattgtatcatcacgcacgggttgatatatttagggggaaacttatattgttattggataatgctctagatctactcatatatagagggttcgagttaaacatagggttaaactgaaatctagagagggtttttacctctcttttttaatcactactcctgtaagcatttgttgtgtaatttagaagaggtaaaaagaggtaacattcactactagtggttttgctatttctattatcaatagtcctgaatttgttgtgtatacagtggtcatgactctctatattgcatgagtgcatgaccttatgggtcttggtttagtaaatcactagaaacgttatatgtgttgtttggttaattttatgaatgttttgaactgaggatatatctcaggacaattgtatttggattttggaggtacaataattggctttaagatattttttgccgttttgtttgtcttacacaatcacccatacagtccaacacaagtaattcatctaattgtgtacaggaggcgcgcccatgatctttcttgccgttttgtttgtcttacataattagttgaattatatgttgtgcctccacgtcacaggtggcatgttgtagcctgagtgaaatgtcatatccaatatactctgttaaaaattgactaggagacctttatactctcaattgtcaaaaaaaaaaaaaaaatcaacctagtattggatttgatgttttctatattcagattctttgtactagaaaacgtctcatccaatactagattgatttttttttgggacgaagggagtaagttattatgcggattatatattctctctccgtcctataatataagagattttgagtggatatgatatatcctaggacaataaatctgtacatgagattttgagtggatgtgatacatcttaggacaatgaatcattgtactacttcctccgtccccaaaataagtacagccatggttttccgcacccaactttaaccgttcgtcttatttaaattttttttgaaaaaaaattaaaaacataagtcatgagtaaagtactattcatgttttatcatctcataacaacaaaaatgctaattataaaaaatttcgaataagacggacaatcaaagttggacgcggaaactcatggctgcatttattttgggacggaggtagtataagatgtgtcacatccgcacaatatctcttatattataaaacagagggagtaggatctagacagagttaggatagaatacaatagaccaggggtgtgtttgagtagaaggagatcggggagattggaaagatacgcaaaacgaggtgagccattagcgcatgattaattgagtattaactattttaaatttcaaaaatagattaatatgattttttaaaacaacttttctatagaaattttttgcaaaaaatacactgtttagtagtttgggaagtgtgcgcgcgaaaaacgaggcgctttctcaccctatatcacacaaacgaaagcagcctaggagaccttatgcgataatacaagaaaaccagtctagcaatcaacgtgcaattttgtacaaatactctcctccaacccttgggctcaattagtggtaactgggctgggcctccgtgggccgcctatttcgcaacagtccagttagtctggtgtttcagcccattcagtaatacatgggccaaggcagattagagcagggtccaataaggtccataaagacccgagcaaacctagggtttatgagcacggagcgtataaaagcgagcctccacgccgccgtccctccctgcagccaccaccaccacccccacaccggagcacagcgaggcggcgccgcagccccatcttctccggtgagtcttcgtccctcaccctcgccttctcttacggaaccctaaaaccgtatgatctctactagtacgatggatggatggatagctcttagttttggtcagttcgatggcatttgctcgttctgctcgttgtctaatatcttctacgatcctatccggctgttggtccagtagtattactgcaagaactgtaagcttagttcgagatttttcttgtagacgatttgttacctacttagattttgtttactagcgggttatttgtttcgctcggttagatctggtaatataaaacgagccatgtagcgattttgatgtgtgggggcacgaactgttcttgtcacgagaaaggttgtaccccagatttcatttgcaatcgatgccaattctgggcaaatgttgcgttataataatcatatatatgggtcactttttcctgctgatcattagttacaggatcttacagtaggttgttggttttggttatgtaggcgaagcgaaatggcgacggttccggagcctttgatctgggagattgtcaagaagaacaactgcttcctggtgaagcagttcgggaatagcaatgccaaggtgcagttcaccaaggagcccaacaacctgtacaatgtccactcctacaagcactctggtcagtagtcgcttcttgcaacattgctggctttttgatggaaaccaagcatttcattcagcatctgcaaagtgctgacttgggtgatgatgtgttttgtaaggcttggcgaacaagaagaccgtgacgatccagccatcaggcgtgaaggacgcggccgtggtcctctccacaaccaagaccaagaagcagaatgccccagcgaagctctaccacaagtctgtgatgcgcaaggagttccgcaaaatggctaaggctgtcaagaaccaggtattagcacgtgaaactacttctttgcatagcttcttgtccttgttatgccttgcgatgctagaagctttaaatgcactgctatgaacataaagcatcctatattttggcttcattactcttttcttatttactgctgtgatgagccgtaacacataaggaggccaaccgatcaattggttcttcaatgaaatactcttgttacgcttggcttctgagcattttgtattgtcttgatatgttgaagtggctctcatttgtggggttcagacgttaggatggaactgtgagatcttcatacggaacaattaaaactcatacaatgttttttacagaagttggtataacttgctgttaaaaaaacagttaggtgtcaatgaactgcaagttagtttgtgagaattcctgtttttcgttttcagaaccatctttttttccctgtttttgttacattgctaattctaactgctgctgtgataagccgtaacacataagaaggccaaccgatcaattggttctttgatgaaatactcttgttacacttggcttctgagcgtcttatactggcatcatgcctttttgatatgttgaagtgcctgatctgtgaaaaccttcagattttcaaatggaacattttgatacttaaaacaccagttttagcagcagttgatacaactttatctgaaaattcaggtatttgacaatgaattgcaagttagattttaagtatttgctttttaataaccaagtttttgccctatctgagttaaattgataatgcaagatgcagctgtgatgagccgtaacacataaggaggccaaccgatcaattggttcttcaatgaaatactcttgttacgcttggcttctgagcattttgtattgtcttgatatgttgaagtggctctcatttgtggggttcagacgttaggatggaactgtgagatcttcatacggaacacttaaaactcatacaatgttttttacagaagttggtataacttgctgttaaaaaagcagttaggtgtcaatgaactgcaagttagtttgtgagaattcctgtttttcgttttcagaaccatctttttttccctgtttttgttacattgctaattctaactgctgctgtgatgagccgtaacacgtaagaaggccaaccgatcaattggttctttgatgaaatactcttgttacgcttggcttctgagcgacttatactggcatcctgcctttttgatatgttgaagtgcctgatctgtgaaaaccttcagattttcaaatggaacattttgatacttaaaacaccagttttagcagcagttgatacaactttatctgaaaattcaggtatttgacaatgaattgcaagttagattttaagtatttgctttttaataaccaagtttttgccctatctgagttaaattgataatgcaagatgcagctgtgatgagacgtaacacataagaaggccaaaccgatcaattggttcttcgatgaaatatatttgttacgcttggcttctgagctgaatctgcctctagtatttcttctctatacggcagctttcctttatgtaccttactgaacaatcatcagtagtttgttctttaatttgctgttattctgcccttcaggtgagtgacaactactacaggcctgacctgaccaagccggctcttgcgaggcttagctcagtgtaccgcagcctccaggtttccaagtctggtgccaagaagaagaacaggcagccaactaagctgtaaatcgcttaaagctcgcttttttttttgtcaaggggcctcgtggtgttcatgtttccagctacctctgttcgtaacagtgattgagacttgaattgatatctatgctagaattggatcaactatgctacaaatctactctagtttgtactcgctacaattttggtctgctgtgtcattgttcacgttgcacttgataatagcagctaagctaatgtcatcaaattgctggtgccgttttgctttgtacacatccccgtgtagcttctgcgaccagattacctatttttgatcaagctgtgtagggttgtggcatgatggcatcaatgtgctgttgccatttgacaaatcattctgcttattacatcaagcacttcatacgttagtgagagcggggcgaggatcttttaccatagggaaaattggttctatgccatcaaaagttttcaagttttgctttataccatcgaaagttccttttcaagttttgctttatacctcgaaagttcctggtgattttcctaccataatgttacatgggtcatatctttatactccctcgtatttgaccgttcgtcttattaaaaaaatttatgaaatatataaaactatatgtgtacttgaaattatatttaacaacgaatcaaatgatataaaaagaataaataattacttaaatttttttgaataagacgaatagtcaaacacgtactaaaaagtcaatagtgtcaaatattttgaagtatttgcaatgataatgttattatggtagagaatgtgaacccgtgagggagatgattttgcattgtgagtttctgacaagcggaagctctagaaagttctgccactctgtgagagtgcaaagctgttgtgatgttgcacttgcacctgctgctgctgctgaggcccgaagcgttgccggaccgagcggtacgccatgagcccgagcttgtgcgccttctcgtacatggtctccggccgcagcggcgcgacgtgcaggccgacggcgtcgagctgccggccgctcctcccccagaacccgacgatggcgccgccgtccaccgggaacgcgaacggcgtgccctccgccgcgccgccgcctaacggcccgtactccctccggttggtcctgaacgccagccacctgatcaccgccggcgcgccgccctgcgccaccgccgcgtagtgcccgctcaccgccgtcaggtactcctccgggaagcccagcttgatctacgtcccagccaaacagactcagggggtatttagatacatggatgtaaaatttttgcatgtctcatcggatatacggatacacatttgaagtattaaacgtataataataataaagcaaattacagatttcgtttgtaaaccgcgagacgaatttattaagcctaattaatccgtaattagtaaatatttattgtagcaccacattatctaataatgaaacaattagggttaaaagattcgtctcgcaatttacacgaaatttgtataattagttatttttttcgtttatatttaatacttcatacatgtgtttaaatatttgatgtgatatgttgaaaatttttgccagggatctaaacaggccctcagctatggctgtgccaagaacattacaaggtgcagatggtattgggtgtgcacctgggtggtctggttgccgccggcgccgccgtgccgctcgccggcgacggcgacgccgttccggtcatactcgacggcgatggagtcgatgcaccggtcgtacgacagggtgatgctacgaacgccggtgtgaccgccgtcgtcccaggggctccctccggtgccgccccatggcccaaccttcatgatcttcttggacacaaccatcttcttctgaggttgctgctcctgcaaaaaaaaaagggatatcctgtataattgaagtgtatgagttgctcactgaacttttggatagaaaaattcagatgatttttctgttctgcaagactgaaaatgaagtgcatgacttgcataccatgtttggttcagatatgttaagaactacaccaagtagtaaggtgagcagctaaacttattcagagaacaagtgcgctaacagataaaaatggatagggatttttttttgtttgcaggaaacaaccagatggaagaacagaaatattaggatatataggaaaaataccacacagtggcaattgggtgataagtgggaatcagaaccggatgctgtaatggcagtacgctgctttctggaaagctaagcatattgtacaggaagtttttgttctccaagagtccaagtataaattccggtaacatgatcctgccaatacctagttttcagttcaatgttaccactcctggtgattttttatttacatatcgcagagctttagtgtagtacaagttttttagggaaaagaaatcaaagtttgatattttggaaaataaagccttcatgttatttttgttcttcttcttatatggaaggatatgcagctctcctgtctattcgagaaaaaaaaagaaaaaatgccttcatgttgaatcatgaattgctcacttaaactccaagttcataagcatttgcacgttaacatcagataaagacctgaaacaaatgttgtacctcatgtcattacagtgctttgaaaaacagaaatgaagatgtagacagtggactcatactcataggtaactcctagaacttagttcgttccaaattcgtctgtccccagtccccactgaacaactcaatcctttgaattttctggaaataaactcagtccaaattggacgcatgaaattcgcataacacaatttatctcacatattattacatgcctattacgcagggttggtgcccagaaataccattcatggccagttgggattgagtactactactgctgaaccaatgttcaatacaaccttgtttgacagcatccagaaagtctgaaaacacaaccagcagttgtcgttttctaacttcagatgt

SEQ ID NO: 82638 - DNA, 22187 bp, Oryza sativa
  unsure (1)..(22187): unsure at all n locations
gcccacgctttatccgcactgcgcggaagcgtgttgttggttcttccaccgtgttccgtttccgccacccagctcccccaccgccagcggcccgtgctgctgccggccctcgacaggtcccgccggtcccttcgcgccagccgatcgacgtttcttcaactgaggagccgactacaggaggcagccaggccgacgaggagtagaggaggcagtcttcagcagccgtccgtgtgataggccccttttgttccgccgccaactcttttggagtcgtggcgaggtagtgcgtgcgtgtgtttgttgtgggtgttgtttggtagtctggttctcctaggtggtgtgtgcacagtcaagctcggcgtagctctgtgacttgtccacacccgttgtatcaggtgtttttatgatttgaaaaatccagtttatgcctagtgtgtgctatctgagttgctatttgctttgctccttgccctcctaagtgcttatctgactcttaccccgccccttttctgggagtttagatggctagccgcccccgtcgtacagctcgtgcaccagcccgctttggttttgaagatggtagagttgaagcagaagcaaatcacgaaccagctaatgagcattctcaccacagcaaccgttcgcaccgtactgttccccgcaacgcagaggttgagcaacctcgccgcagtagccgctcgcatcgcacagtttcccgtgatgcagagctggagcagtctcaccgctctcaccgcactgccagtcacaattctggagaagaacgcctcccttccccacctcatgtggaaaacaacatgcaacacataatggcagttcagacacaaatcttgcaaggactaaccacagccatagccagctttcagcataatgcgcatggaaatggccaccctcacgtgggcaacaatagatccaagctgacagactttctgaggtcacgtccgccagagttctctcagaccgtcgagcccgtcgaggctgacgattggttgaaagatgttgatagaaaactcaacttagtgcagtgtactccggttgagaagacgctctacgcctctcaccagctaagaggacctgccgcagattggtgggagaattaccgcaatgcacaccctgaacccactaacattgcttgggatgagttcgctacggctttccgtgcagctcatgtgcccgaaagcactattgacatgaagaaagaagaattcaacagacttaaacaaggcaacaacagtgtcaatgagtacctaagtcagttcaacaagttggctcggtacgcccctgaggaagttgacttcctagccaaaccgatagtcctagactcgcaaagcttggacatcatcctagggatggattggttggctaagcataaaggacagatagattgtgccgaaaagtccatcaccttgcaaggacctggaggaaagcaagtccgctttacccctaacacccctaccgcaagtcggtctatcctaacctgtttgcaagtcacctccttggagtcggtgcccatagtctgtgaatatcccgacgtatttccggaagaattaacaagaatgccaccagaccgagagatcgagttcaccatagaactggctccaagcacagctccaattgcaaaaagaccctaccgaatggcagctaatgagttagcagaagtcaaaagacaaatcgaagagttagggagtaaaggttatgtgcgacctagctcatccctttggggagccccagtgctcctggttaagaaaaaggatggctctgagagaatggtaatcgactatagagccctgaatgaagtaactataaagaacaagtacccgttgccacggattgacgacttattcgatcaacttaaaggagcaagagtcttctcaaaaattgacttgaggtcaggttaccaccaactgaaaatcagatctgaagatattccgaagaccgctttctcgacgcgttatggtctatatgagttcacagtaatgtccttcggactcaccaatgctccagcattcttcatgaacttaatgaacaaaatctttatggaatacctggaccagtttgtcgtggtattcatcgatgacatcctgatatactctaagaacgaggaagaacatgctgaacacctgaggctgataatggaaaagctcagagatcatcaactattcgctaaattctcgaagtgtgaattctggttggaccgagtagcatttcttggacacgtgatctcctccaacggtgtcgaagtagatcccagcaaggttgaagctgtacttgcttggaacccgcccaagaatgtgtcagagattcgcagcttccttggcttagcgggatattatcgaagattcattgaaggattctctaagctagccagacctatgaccgagctgttaaagaaggaaaagaaatttcaatggtctgtagcctgtgaagacagctttcaagaaatgaagaaaaggctgaccactgccccagttcttaccttgccagatatccgaaaagatttcgagatcttctgtgacgcatcaagacaaggcttaggatgtgtcctaatgcaagaacgtaaggttgtggcctacgcatccaggcagctcaggcctcatgaagtcaattatcccacccatgatctcgagttggcagccgtggttcatgctcttaagatctggaggcactatttaatcgggaacagatgtgaagtatacaccgatcacaaaagtcttaaatatatcttcacacagaccgagttaaatatgaggcagagaagatggttggaactaatcaaggattacgatcttggaatccactatcatcctggtaaagccaacgtggtcgctgatgcgctaagtcgcaaggcctattgcaatgtagctcaaatacggcctgaccaagatcatctgtgcagagaattggagaagttaaggctgaccgtggtacagtcaggagtcccagccagcttgacagtacagcctaccctagagtcgcaaatccgggaggcccagaaagacgacgaaggggtaaaagaattaataaaaagaatacagttgcttttagaaaagagttcaaataaaatcaattgcaaaaacaacagcctttccttgaagcctgcattaaacacttatttcccctggcttgctgagtactcccgtactcacccttgctctatataaatatctccccccccagttgctgaagaagatgaagcggatcctgctgatgaggagttcttccaggagcaagtcggctacgatgagttttagggtttcggcctagttcccaagtcgcgcctgtgattgtttggtccaagtcctggcttccgctttccttttgtaatgcagttgtgagctcgggatctgtccacagcccaacatgactgtacttctactctataataaagaggcttctgttgctgtgatattctgtctccctgtgataccagcactgtttcctgggactggtatcgattaacaggttaatttggagcgtcacgggttagttccggtcgggactaattcggggcgtgacacatagatagaaagagttttcattcatcataggcatctgccttgcccaatggccgagagttcaagccaccaaagttgacgggactatgggcaagcgaccaaaatatgacaaagagcaatcttccattacatccgtaggatgataggcttgcggccccattttttcgcttatacttatacttattagccaaaatttaaattttcaactttaaatttggagttgattttggggtttaatcattgtagtttacttttctgcttttgcttttatatcgttaaaaacacgtgtataaaagttttttcataaattattttttatttgtaaatatgttgttttgcttattcctctcaacagccaaacgatggggctgttttcttcggtggttgatctactatcactattgaattcatggtttgtccaaaataccaggttgtattgggtttttcgccggccccatgtcttgttattatcataacatgcatgattataaatggacaatttgtgactaatgatatatatgtcaacattttaaattgttgaagtcccgagaatcttgttatgagataagaaataatctagtgccaagcagttagctcgaattttatcatacagaggtagagataaggttctaagctgtaggttcagtactatactacaattatgcattttgggtgcaaacaaataagttagagacaaagcaggtaacccaatttgggtgcaggaaaatgagtagagaggtgacagaagagctaatcacatggaagtatgagcatctttaggtattgtctactgggctgtacacatgccaatgctggaagcctggaatccttgaactacaccatagaccagaggtcgtcctctggtcttaaagaaaaaccatttcgacaacagaagtgcagtttcagccactataaatgctaatgttcccaaacctttaatttcttcatccatgtaccaatcgatctacaacaagctaagagcacattcagctattagctttcattttgctctccttgcatagtattctcgatcggccatggacagatcactgtctacttcactgcttcttgtcctcgcccatttcatcatcatctttgctcatcttttggatgcacgaacactaggtaggcaacacaacagcacgcagaattgcattggttcctttcagtcgcattgatcatgtgaaaaagaatggttttgattgctaatctggcctagaatagtgggttactgggtttgatagctagtaatttgtcattcaccgagaaaatttcttgtgctgtttctgtccatccaggagacgcataccaaccacacgtacatgcgtcgtcgtcgtcggcggcggcgttgcggctgtggagcagcgcggatgccgacggtggcgcgctggcgaagtcgtcgccgcgcgctccgccgccgccgaggtcatcacattcgccaacgccgcgctggcatgacggagatggcgcgccggcgaggtggccggcggcggctgctcctcctcctccgtttgcaggagatgtcgttggccaacctgtgctctccccaagccgcccggcagtgtacacggcttagttacgaggtcgtaatctttgatcaattcgaggtgttgtactgctcgctgacatatgagcacgagatcatatgttattaatgtcaatgattagtactccactgcactgagtccaaccttgatgtttacgagtcacagagtcactgtttcatttcctgatcacaagcccgttttcttatgttgtgtactcatgtgtgaactatcgaccgttcttttgtgtgtgtgctcgtgttaactatcaaaactgttaccataaactcaatttttaactatcaatccattgtccatcaggcttgtttagttcacgaacagattttagatgtcacatcgaacgtttgaccagatgtcggaaaagattttcggacacgaataaaaaaactaatttcataactcgcctggaaaccgcgaaacgaatttattaagcttaattaatctatcattagcacttgtggttagtgtagcacttatgactaatcatggactaattagtctcaaaagattcgtctcgcgatttccatgtaaactgtgcgattagtttttcattttatttatatttaatgcttcatgcatgtgtccagagattctatggctctatttttttcttcaaacttccaacttttccgtcacatcaaacttttctacacacaaattttcaacatttccgtcatatcgtttcaattttttcaaacttctaattttaacatggaactaaacacaaacacagtttatgtgatgttttggggaaaaaaattggaaactaaacaaggccagtacttcaaaacgaacgtgtgtgtaacgtcacgacaaacatatacttacagttttgcactccttaatttcctaaaagaaaaaataaaacaccctttcacaccagcgtgaaagcgttggtttgacagtccggccatgtacgcgttaataattgacgatgatatgaccgaaacacgcggcggacatacatagacaaaattccgaattcaatctaaaacaatatacttcctccatctcaaaatatttgatgccgctgatttttttttaaatgtttgaccgttcatcttattaaaaaaaataagtaattattaattcttttcctatcatttgatttattgttaaatataccttaatgtatacatatagttttacatatttcacaaaagttttgaataaaacaaacggtcaaatatgtttaaaaaagttaatgacgtcaaatatttagaaaaggagcaagtatgttctcagaaaatctaaaacgatatatgaattatgaaacttccagttcatctcaatgtctcgatgcatgtgtggtcgtcgatatatcccatggttgccgtcgattcctcgtcgtccgtaactccgtatgtcttggtgtttgtgtcctacgtgcactggcagcggagcgatggtggtgcgggtagaatacgatgtaattaattttgaaaatatattatttctttcttcaattttttttggttagaaatatacctcgctatcacataaccaccgcacgagaatgacgtggagtaacgacgcgccaaggttttgcaagggaattccacgaaagcgtacggtctcgcacaaccaatacgcgagaccgcacggcatggctgaatgattaatgttttaatcacattgattagcaactaattaatcttagttatcattaaataataactaattatggtaattaatcactaattttggaccagagattcggtatgctgtttcttatgcgatactgttcggtattgctgtttcgttatgtctcgcgcaacgattatgtgaggtcgatgtatatttctaccaataagcttgcatcctgaatatttttaagaaaaaacaaattaacagtatattttgaaatttatttcgaatacaatgcacgtcgtcctacatataccacaggaatacgacgtggaaaaaaatcaaaaatactttacagatctatcatgctttaagattggtgaggatacatgtacgtgtacgcgtacgtggcacccatttagccagctaggtaggatggtgctccacttggtgcggtttagggcggaggcttcacaccccggactactttcgccgttctaaaaaaacataacctataaacgaaatatgatataatataatacaataaatttaaaaaacatttagatagaaattcatcccattttaggtgtttttttatacagttcctgttccttccgtgtcaaaccattaacttgtttttccttccgtgtcaaaccattaacaaatcaatccgagcattttctttcttttgatggattaattaggcaaaaaaccgttgactcagtcatcacacatgcacaccacgcgagtccacgacgaccacacgagcgccgtaccaaatcctgcctatataacagagctcatgtgggtgtggctagctgcagcctagtagcttgcatcagagtttcatctcatctatcgatcggctaatttctagcttaattagcttgtgatccctttccttcccgccatggaggcctcgtcgtctccttgcaagcttcttcttcttcttcttcttcacgtcgtcctgctcgcgttcgcgccgctgctccaagcacggccactcggtcatcaggtggtggtggcgccgctaatgttgccgagcgacggcggcgaggtcgtcggaggtgtcgggcggccggaggatcacatcccaccgtcaccttttgcgcctggcgggccgatcacgctcgccggcggatggctggtggggaggccggtcggccccactccgccgcctccttcgcaccccgttgtgccgactccgacgcagctcgccgccgacgatgacggcggattgctgaggaggccgggcggccccactccgccgtctccttggcaccccggtgtgccgacgcagacgcagctcgccggcggcgacgacggcggcgtcggcggattgcttgggaggccgtggcctaaggctcccccgccgcctgacccgaacacgccgccggtgcagccgctctccaactacggcgtgtcgcggtgttgcggccggccaggacccgctccgccgacgccggccggaaacccgccgggtgaaaccaacgtcgccgtcgcgctcgcgccgccgatcccctgcgccgcttttctccgggtgatccgcgacgccgtgcagtacatggtcggcggcggactcggagcctgaaacgatcgagagctcgacaccgagaagaagagatatatacgagagagttgtacttgtacgtgtatatttgtacgcatacagaagcaaagctataggcaagtatgtatacggtataacgactgtataatcgtatatattgtatagtcgttttttatttaattataagtgtcgtagcagagtctaggtaagtagacaccagctgagcaaaaagactagctggctagtagctgcacgttgttgcgtcgctcaactacgaaaaatggagatgcagtaattataatctctctgtggccaattggcgcagtatatgcatatatatatacacggtggtgaatccggctgaaatcagaggatagatttaaagtctaaatcttttttgttaaaaaaaaagataaaaatacatcctctgtatcaacccaccatatttggtttgcaattgaaatttcaaacattagttacaggggacaacaccggatactttttgcaccacggatccataaagcatcaagaaaaaaatagatgaaatcccacgtgttgctgctagaattttatatgatattagtagaaataacatgtgacagtggattttaaagtcttcggcaaacattcctttgttgtttttatgccattcaaatagttatgaaaaaaattaaaaaaattgagaagatgtactaatatgtgatatatcacccccacaaacatgcaatttaaaaatccaactaatacaagttaaaaatccaactaatacaagttaaaaaaaaattaaactacaactagttaacatatattcacagccaatttttttttaaagttacagaccttacatgcttgtgaagtaatctatcacgtactacactaaatagggagtagtaatccatcttatcatttttttctagaatatatagtttcccttaactacactagataaactttatagatatatatatgatgttccacggtaccagagacactgacaaatgagcgttggatggtttgacatcatcgatacatcgaaaataaaaatattaaatagatacagaatatatatatttgatttagaataaaactaaaacgatttacatatttacagtataaaacgaagaaaggtgtgccgcacatcaggatcatatcccctggcaggtgcaaggtgtgcacttgatcaggccactaaaataagagacatccaaatctattagtcctacaatttatctaagctaattaacaaggaaaagaaaaaaaagaaaagaaaaacagcacaagtatgaaaggcccaggcagccaaacacactagcttggccgggctccatgttgccatcacggtttctctccgtgaacaaaagttgttttgactcacgcggtggctgttgtctgtcgcggttgtttcttgtctgttgaatggtcaactttgaccgcaaccttagctcgtagcgaaaatcttcgcccggtagcggttccaacagctagctatttgcagcaactaactgacgatttacgcacatttatacactgctattcgtgttcttttcaagttaaatattggctctgtttggggaacttgttccagctgcagcttttcctaaaagctgcttctgctagaagctgccccaaacagtatacagcttctgagaatctgtaggtacaggttctgaaaaatgaactaagaagccagaagctgggtttcagagcttttccagattctcagaagctggctaccaaacaactgcttctcagaatataaaactccaccaaacagacccattaactagtatatcgaagattctttttgaaaatgctactatcctattcgaacgggataatatctcaggggtatcacctgatatataaaaatcaatagatatgtatcacttagagatattatccagtttaaatagttataaaccgatatctaacacgtatcatatcagataatagcttagaaatatcatatcgttcgaatgggatattgtcatgtagcattttatggattaagaagaaacagttgacttgtcaactttctagccgtcataagcaattctaatctttgcctatatatataagagctcacgcggccatgtcgttcttcgcgcgcgctgccgcttgcaacatctcgaattctcgatcgatcgattcattgcttttccttcccgccatggcgggttcgtcttcgtcttctccaaagctgctgctgctgcttcttcttcccgtcgtcctcctcgctccgctgctcgaagcacggcgtctgcacgtgctgccgccgctgatgttgccgagcgacggcgtggtcgtcggaggcgccgtcgaggtcgagggcggcaggtcgggtaacgccccgccatcgcctcgtccgcatggccgggtgacgccgctcgccgacggcggcggcggcggcgtgctgaggaggccgccaggacgcggtccgccgccacctggtccaggtggccatgtggggccgctctccggcggcgtgtcgtcgtcggccgggagatcgtcgacgaggccgctgatgatctccgacgacgacggcggcgtgtcggggaggcagtggcctgctcccccgccgccgcctgacccgaacaccccggtgcagccgctctccggcggcgacgggcggccgcggcagctcgcgccgccgccgccgatgggaaacccgccgcccaacacccaccgtcgacgcaccgatcgtcctccccgccggctgccggcggacgacgacatggccggtttgctactccgcgtgatccgcgacgccgtcgaatacatggtcggcgaactcggagcctgatatccatcgagaccgagaagaagatacgagagatccgagaattatacgtatatttgatttgtacgcatgctgaagaaaggcaagtacttacgtattaattaacgtataccaactgtatagtcgtatactcgtatgtatgtattattgtatttgtattagtatacagtgtacagttgtaagcctagctaagaggctagctgagtaaacgagatcagacagttgcatgcatgttggtagctactcaagctgttgaattcgtcggtctggttgtggttcacactgaagtttgaaagtttggttaaaattgatacgatgtgatagaaaagttacgtgtgtatgaaaggtttgatgtgatgaaaagtttgaagtttagaaaaaaaaactttgaaactaaactgggcctctgacgtgtatatttggaccctaattaattaacagtgagtttttttttcaattacatggtagaaacatgcgcacacgcaactactcacactccgtgaatgtgtcagctaacatatgctctaataaacggaaattaatgatatatcaccgatctcattgattttctattgaaactccaccagtatatacgtaatattcatgaacaacaggacacttgtaatggagtagtatttaaattataattacacagcatcataatctttgcaaaaaactgtttctgatctatctgcccaggccattcaagataacaagaccggacagtttctagccggaaaaagctctaaccgatacaaaacaggatccaggggggaaaaataaaatcataaacagcaatcatgcgctgtagtgtacttatataatgaacaaagcacataaattaaccaaaccctgtaacaacgaaaggctaacaaccataagaattcagaagggagtggttcacaaaaatctgccggtatggtatagctctagcactactaattatttttaactaattatccgtgcttgccattagcatattaccggttatatataaattataagtatatactagtaataattaatcaacaaattcaactcaagacgagttttgaaaaactgtcctagtactccatgtcatacgacgatccttgacttttaattgacgacgtgtctttgtttagagtccactaattaattatagcttgcagccaaaagttaggcctaccaatcgaacatccgagttcataatatatgataatgagtacagacaaacgcatcttagataagctgagagcgcccattaactgtaatctatcaatatttgtccatcatttgatatagttaacgtctgtccatgttaaatattggtcagaaaaagaagaccttcgagaagatagatttgattactactgacacgcttggtgctgatatatgagttagaaccgccccataaaagtttcggcctaattaagataagtttacttggtgaaaaatcaaggttttcaatggacctttaattttatcccaggccccagacctggcctagctttgctcggggcctggatttgcccccgctaccggaattcatctaccgacaaaacatcagacaggagcaactaacatactcatgatatgatggatacacacttcggagaagtcgaaagtttgaatgtcatcagtggaacaagccaaaccaaactcgaattaattcatatacggccaaatatccatcaaatagtcgctcaagttttgatggttgttgatatagcgtttgataatcatcatttttagcaagcagttttgcgctacggcagactcctccaccagctcatcgtacacacaacacacatgcagctagtcatcgtcgtcaaggacgctccggcgcctctgaatctgcgaaataaaacatagtaaaaagaatcagttgtgtattggatgctttcccttcacagactagcctatattagcatcattttctcttcctttttttgatgatgtacaatcagtgacttggaaagaatcacaacaaacgagaatctttacaaaccaaactaaattagttgtagtgaagctacccaaaaccactattggaagcatggtaggtttgtttagttaagtgcacatggtatgtcaaaaactgatagaagtttccacgtttatcataccgtaactttcgtctgtttgctagtgtgggtattgatttgctccagaagtgagataagcctttcttcagacacctgaaagccagaaaattccccccaaagaaagtcagctttcagataaacctttcttctgagtctcttgacacagtaaagattatgctacccgcctctattaccttttcagatattccaccggactgagcagctctcagaagaacatcctctacccctcttgctttatcaggtttgaccaaagctatgcgagagactgaaaactccagagagtaaaaaattacatcattatagaaccttttcatcaccttaacctcaagtgagattaacggtatgactttttcatagaatcatccttattcagagcatttgattctgataagcaaactatgcattatgtatccatgcaattgtttgccagtttggtccagcctactgcataacatatgttcggagctgtggagattttgaagtgtgcacacagtgccccttcctagttcatacggttttcatccttcagaagcctcatctttttgttccattggtttgtaataatgaagcctgcctagtgctttgctattgttcagttccttacgatacagtatacactggcttgtgaatatatccaatgatactgtttgagcattggtatcgtatggatagctcattagttttagttttgaacggaagtgaaataactgaagtgatgaagtttattgtgatgaacagcaagttaaaggttgggcattatagtggtataaattaaatgtgtagggtggtaaaaaaattcacatgcttacgttagtgattaaatacttcagttttgctcttcttgtttgactgtgtcttatgatgctatcttgatcgatcagaaccattatatgttcaccggatgagcagctacctttttggaagggaacggaaagttgcagacatccccatagatcatccctcctgcagtaaacaacatgcagttcttcaatataggtaagcatagcaatcttattgttatttgcctttattagcatattgcctgtgcgtggcaacaagattttaaataaagaaaattatcattaactcattattattatcattttctgtgtatatcgccccttaatttatgtatatatttgttactgacatgtgcactgtccttttcttctcacaaaaagtaggaagttggtggtaggggtggttgacatgtaggccccccttttctattaaaaaaactagggagctggtggtggggtggtggnanatncaccactcaccatcaccactactcccttttacaagaagtatatattgagaaataatattgtgattcacccatctctttgccttttcagacttgtagagaaggagcagccagatggcatgatgtcaaagcaagtgaggtactccttgctagtaatgcatataattttttttaataacaagtactaataattcatgattatcttagttctgtatgctactctagattatgatgttttttgctgctttgtttgataggccttatctgatggatcttggtagtaccaatggaactttcattaatgtaagtcctccaatgatacttttactactaatcagatacactagtcgcgtttctaataatattttctacccagtcaatatttatgttttgatttttttttcaggagaatcgtattgagcccagccgttactatgaactctttgaaaaggataccattaagtttggcaatagtaggtatgatcattgaaattgaagagtaactttccccctctactgtttaagataactttgcttgcttcatgccctcatcatatcaattaaagaaagcatcacttttttgtttatttattgctcaatgtatatgcatctttggtatgtgatgacttaaattaacaacttattatgaaagtgacagtctggcttttggcattctctttagttagagattttattttgatttgtggtactcttgggataaacattttttctccaataatctaagtaatatctttgtaaactacgcctaattgtttttctcaatacaatttccaaatgaatctttaggtggtatattaatgtttataaatatcaaggaatctcaaaatatctacattatggaaacataattttcctttatggagccttgacttgcaagctcaatcatgtataaatgtataacatatattcagagctgtggagattttgaagtttgcccatagtgccccttcctagttcatacggttttcatccttcagaagcctcatctttttgttcttagatggatggtactatttctaatccagatttagggtccttttgagtccagttgcccaaaagtaaataatataatgatgtgatgcctccgcttctatatgcctccttactaaccccgttcatctaaaatatgacaaatgttttattgtatttttgcagccgggagtatgttttgcttcatgaaaattcgaaagaatgaggattgaaattgctggaaactttgctacattgttacttgagattttgacgtccctctgctgcttgttgtttgtactatggtttcagtcgcctgaatatttttcaagaatgcctgaaggaacatagcagaggccggtaatcttccgttacatttataggattctagagcctagacatgttttatccagtggttgatctagtaccgctacatacttcatggttttgtcaaataccatgtcatattgtcactgccatatcataattataatctgcaatttgtgactattgaaatgttggcactctaatctatttgaaatctgcgaatcttgacacgagatgagcaataatctagatatagcgaagcactgaagcagttctgttggttccaattttatcatttagaggtagccagctggtagggatattctagcttcattactattctacagttaaacaggcatcgagaaacaaagcaggtagccactttgggccccccaaaaaaaatgagagcatctttagttgtgtccactcggctgtgcacatggtagattgctaatgtatctctgtaagtgaaggcagtgtttggctaacgagaaaaggaaatgattttccacccaccaaaagatatttttaaatcctaaccgtttattttccctcttccatttaatcctaactcttcattcattttccaatctcaatcccaatcccacctcccatttcccattatccaaacacacccgaaaagttttcctcacaatgcttctagggtgagccacgtcatcaagtgaaatatgaccgttggattcataggtgaaaccaatatcaaccgttggatgaaatgtgatggtgaagaaaggatatagaaatggaaaggaggaatccggaaccttcatgtggcttaggttggaaggattcatcggatattgagagaaatgagaaaaacaaaagcggctaaaaagataaagatgtaatgaccctttgcaatatttattttacaaagtaaaaatttatttacaaatagatccatagattcacacatatttttaaatgagtgtttaacaaataaacatattttaatttacctaaattcacataagtataatacatataaaatgtatctagacttacataagtataagtatagtaaaaataagtatgttctaataaatatgctactccctccgtatttgaatgtacgacgtcgttgactttttgactaacgtttaaccatttattttattcaaaatatttatgtaattatcatttattttattataacttgatttgtcatcaaatattatttaagcatgatataaatatttttatatttgcacaaaaaatttaaataagacgaatagttaaacgttgataaaaagtcaacgacgtcacacgttaaaatatggagggagtataagacatgatggaaaactgacaaatttcaatggaatacgatctacatgttaaattaaaggtcattttgaatgtataatccttgcaataatttaatggagaataaatatattaatccagtaatcctacaaaaatcatgcattttctttagaggctctttatcactaatgcatgggctacaaagaggggctaaagagtttgtgtcaacaagaggtatagggtgtactcttttaccataatggaatagaacatatatatgcattttttttaagaaaaatgctacatctgactttcttttctttaaataccatttatgtatttttcatccatgggttcctcgaatcattaaactttcaaccttccatattccatctgattcagccttataaaataacacgcctaaacctaaacagaacatgtttacacctatgaggaaattcgaccaagggtggctactcatggccatgtaagtaacttagcataatttatcgcaaactttatattaccatgtcagtctattacatagttttaagtgagtagttgttacaaatttaaactaattactactctctccatctacttttgatagtcatatttcatcttgacacacagaccaagaataagtaattgtacctatcatccatttaaatatactactagttatttctcgtaaagaagcgatttatgaatatttacatttctcgatgtccatgtagctaatcttatgtggaagaatagagagtcatgcattaaattctagaaaatcattaagaggataggttgttggattgaaatatgcttatcaaaaataaatttttcagatttagaaaatatgcctatcaaaaatagatggagggagtacaatataacgtgtaaaagtatttaataaagatggtggttacagtcgcctgaaaacgcgacttaatagactagtaatgcttgaaagttgaaacctcgacagctcgtcaactacacaaggtcggtggtctctagccgctatatatactgccagtgttcccaaaacctttcttcatccgtgtaccgattgatctacagcaagcttcagcttgctcctgcatctatcgatcatggatagatcaccgtctcatagtcttctccttctcctctgcttcttcctcctcttcgctcagctgttgcaagcacggatgctaggtaggcaacatagacgctttcactcgcatggatcacgtgaaaatagagagaaacagagaagagtgcatttcatttggtagctaatttgtcattcactgacgaaacgcatcacgcattgaccatgtgaaaatattataacaatggtttgatagctaatttgtctgtcctacactgacgaaatttctcctgctgttttctcgcttcaggagaagcctactactcctatccacatcggatccggattaaatgcagtagtagtatggactgcaacttaagcagttgtagctgctacgttggatctaaatccaacggtaaggattaggccggttactgtagcaaaagtaccacggcgtaaaatattgttcagggtactgtagcacgagtactgtagcagttgatctggactgttgatcacaaaaatgaatggctgaaaatgcatgcagtccctaagactgcacccgatctcaatccatccacatcttcgtgcgtcggcgtggcggagcagcgtcagcacggatgacggtggtgcgctggtgaggccgtcctcgtacaccccgccgtcgccgaagcacccggggccgcctcaccagcacggcggaggtggtgcgccgcccgccgatgtggtggccggttgctgttgctccgccgttggcaggacacaatggccggccaaccaagcccggcagtgtacacggcttagttattcgtaaccttgatgttacaaggtagccaactctgccattcgtgtgattggaagcccgtttgtttggggaatttgagagccatccggtgagaatatggaaaaactaaatcctacgtttcttaaaatctaagtaaaaggttagactatttgaagacccgaagattctaggaaaaaactgtagttacaataagctcccttaaacatgatttgattatgttgtcaattatcaggctggtttggtttgtgtcataaattgattttaccaattttcgtccatgtctaattttagcaagttttagcatggctgatcttagtaaggtaaagttgtgtttgaattaaagctaaaatagcctaaattaactattgaagtgacctatttttcttaggtttgctaaaatttggcttcaaaccaaatagacactaagtactactccctccgttccagaatataagtatttttagagttggacacggttattaagaaagtagatagaatttaatagaggaaggttgtgattggacaagaagtggatgtaggtgaaaaatttaaatggtggaggattgtgattgattgagaagagaatgttggtgtagaaattgttatattttgggataaattctagaggctaaaagttgttatattttgggacgaatgcagtattaaaattatcaaatattggtaatatcaatatagaccacagaccaaaccagcccatcaaaactccagctcctcaccatcaggcttccaagacctgctagtgactggttgtagcaagttccaaggactccaaagccttccagtccctccggagctgttcaagggctccggaggaagccagggcttcaagagcccaagccctgggcgtaagatgggtgatcggatgtgtagtgggacgccataaatacgcactacgcatctgccaaccacctctgacgccgctgacgagggcagacaacgcacgctattacccagagcacgcctttactcgggtaatagcaggcgcctttgggaatcgacgtcgctcccttaatgggcgcaaccctcctgtcaccgaggagctgaccaaagagccctaaagatggcccagcagccagccgcctagataattcagcgattaaggtagcgatgtaaattccccttgtacatccttgtataaatatgtaaacattgctcacagctaggcatattgaatacagaagtgatacacatacgcttgttggattttgtcccaacatttggcgcaatccatggggacgaaagaagcaagcaggcaaagaattttcataagaaaaaaatcaaacgacttatgatatgaaacaaaggtagtaaaaagaaggtttttcggacaggacgcggggtcgggagatttgtttgatgttgttcttctcgatgtcgatcatcctatgatagaacgtagccatatgcgcattggactcgcggaaagcgggcttatcctcctctctgaagcagtgagcctcatcgctcatgtccaagctgtccgcgagaagctcctcccatgtcatgggcccctttatcaggcaaggatgaggtagtgtgcgagggatgagggatcctcctccaactcctaggcgtcctcttcctccttgtcggggcctcgcctgaccccgccgccggcacggaggtggaggaattagcccccgattgcgacagcagcggcgacagagagtccagccactcctacgctgtgatcgggacggtggatccctgatgaaactggaacatcgagtaggtcgcaaatttctcttctatggtgggccttctcatctccgtctgccgaatcgcaatctagggttaggattcttcctcctcgtgaacacgatgggagaaagaaagtggttagggctgaggagaggtgacacgacgcgtccctgatatatatatgatgcagcacctaccggagccatccaccctaggagaatgaccggaggcatctactgatttaggctccggagctagctcgggagccaacacgggtcctcggagccacctaggggctccggggtcatccaaggccttcggagccatctaatggctccggggccgatcaaggccaccagagctgttcgtgggctccggagccatccaaggactccaaagccttccaggccctccgaagctgttcaagggctccagaggaagctagggcttgaagagccctgggcataagatgggtgatcggatgcgtagtggcacgccataaatacgcactacgcatctgccaaccacctctgacgccgctgacgagggcagacagcgcacgctattacccagagcacgcctttacccgagtaatagcaggcgccttcgggaatcggcgccgctcccttaatgggcgcagccctcctgtcaccgaggagctgaccaaagagccctaaagctggcccgctagccagccgcctagataaatcagcgattagggtagcgatgtaatttccccttgtacatccttgtataaatatgtaaacattgctcacagctgggcatattgaatacagaagtgatacacatacgcttgttgaattttgtcccaacatttggcgtcatccgtggggacgaaagaagcaagcaggcaaggaattttcattaagaaaaaaaaaatcaaacggcttatgatatgaaacaaaggtagcaaaaagaaggtgtatcagacaggacgcggggtcaggagatttgtttgatgttgttcttctcgatgtcgatcatcctctgatagaacctggccatatgcgccttggactcacggaaagcgggcttatcctcctctctgaagcagtgagcctcatcgctcatgtccaagctgtccgcgagaagctcctcccatgtcatgggcctctttctcaggcaaggatgaggtagtgtgcgagggatcctcctccatctcccagatgttcgcttcctcctcgctgggccttgcctgaccccgccgccggcaggtaggtggaggaattagcccccgattgcaacggcggcggcggaagagagtccagccactcccgcgcggttatcaggacggtggatccctgacgaacctagaacatagagtaggtcaccaatttctcttctgtggtgggccttctcatctccgtcttctgaatcgcaatctagggttaggattcttcctcctcgtgaacacgatatatatatatatatatatatatatatatatgtatgtatgtatgtatgtatgtatgtatgtatgtatgtatgtatgtatgtatgtatgtatgtatgtat

SEQ ID NO: 82639 - DNA, 12210 bp, Oryza sativa
gatcatcaaaccagaatacttcaagttaattaaaacatgcattccatactaccgaaaatgcctaccaataaggacaattaagctggaagttgaaacattatatggaaattcataaacttgacctagtatatatgtcctgaacagcattagacaaagtcacataagagaaagaagcaacccataccagattaaacaagacctaggatgtgtgctttcctgtcaccaatttagttcaatttgcagaacaaaaaaaacacagctgctcaagcaggtttgatttataatcaaaacaaaatatccacacatcacatattgccaatttgctactaatgtgtatacacagctttacttgcaatatagttcccaactgacaaacaaaaacctcataatacttctgcaaaacacaagtctaaagcacatttctaggtgaacttatatatatatatatatatatatatatatagacatccaaaaatgccaatctatcatccgcacactgtcactgacttcaatgatcacaccagtagcatctctgcattttcataaagtgtattccatgccatcctatgctcccacttgtctgtcctatctagtaaaggcatacacaatggtttgtcaatagtggtctcttagcgttgctaattaggaatacttgttgacatggaagaaatagaaagaggagagacaaaacatcgttgttatgcataacaacgactcttaatcactaaaatatagaaatatagttacataagggtaaaaaaatggaaagaatattaacaaaaggaatattttttgagttaatgattgagtctttgtcgtcccaactattgtaaagacacggtctctaaataatcttttattgtttaagagatcatactcgtctctaccattgaacatgccctaatggtgattgcgcttgcggaggaggcaccgactctctaggacgcaaccagagacaagcagcgacatcgtgaaggcgccctgaagtagctatacactagtacaaaatactaatacaaaatattcatatttggttatgtggcctgctcgtgcttcatttgagcagtcttgagctagatcctgctgaaatgtctatttttctttactcaaataatgcaaaacaagtccaagaaataacagcaagacttcttgacaaagagaaatggtatcacctatgctatatgggtaccagctagtacgtacattgttaatcttaaacacaggttgcaagatatttatatttcctataattaattggtatgttttactatacattctcgaaaattgtaccagagaggcatttttgcaaatgttctcctaacataatttacaattaatggaaattataaagtgcacaaatggatggatttatgtatccacaacaaatatatattcaagctgggatctcaaagaaacaaagcctagttaagattaataaaaactggaaattcatttttattaaaaatagatgtaaataatttttgtatacaatacgttagatctatagtaataagaattgagtagtgtattcttagatggtctcatgcatgtatagcactgtccataacaatataacattgctctatgcaagttcagagaattatcacatatatttggaatataacataagtgaccctttgataacctaaagaatcatgactgaagctatcgacaaatcctatataaatatgcaaaaaggataaatacacaataagtatattgtattgaaatgagtactcaaagcaccaaaacaagaggatttctcacatcatacatagaaatatctttggttcatgtaccaagttgtatggaataaaatctgaagaacttctaatataaaaattaggttggaaaatgcaatatgcactcaagttcataagtatagtaggtcactgacaaacacaagtaatagacagcagacttgacaatgtgtacctatgtgccaagcagccatatcaaaaagttgtgctaaatacaactggataaaattgtgttcaataatgtacacagacccaaatggtaaccaagctttttaaatatgtaagttccaaacatcttgatacattttatttggtttatttgcaaaggtttttgcattcataaacagaaacagtgaatattgtggtataaaaatcaatatcattaatagtgatagtaactgataatcactttgttagaaagtatggaaacggccagctactatacttgaaaaatggaagtagcaaaaatggaagcttctcttttcaaatgtgtactcgtataacactataaagagccaaaaagaatttgtctagtttttcatttacctctcactattgaacatggcacatacacctatctattcaactttccacttaaatgacaaaaaatgcccctatgtgggggcatgttttctttttcttgtttgaaagaacaatttatgagttctaactgcctttactaacaaagtttcatatgagtttcacatagggcaaaatgggaaatgcctcttggttaaccatgtcgtgatatattactaaattaaagaagccatcaaagtgatattggccttgaaatttcctttcataatattataacctatcagtttttttaatatttagcaaaataaattagcgtcgaaaatcgcatcttaaagccatatgatgtccaaaacacaatttattgtgaccaaagggagtatatacttaaatatgtacaacctcatctcacacatcagtatcatagaatattataatagacgcatttggtgcatgaggcggcctagcgacaaccaatccacaagcaacaatattatttgcaaaagaaaacaagaacttgcagacaacacatgcaagttaaaattagggcttgtctattttgttaccacttttaactatatcaaaatacgaaaaagacaaaaagctattcatatcattatcattgttatactaccaaaaattttggtaacattaaaatatgtcaaaatttggtagtgttgatagtgacaatgaaggggccccgacaatgaacaaagcatttaaatacagtgaatgatattatcctctcttaaaaactctatctcctaaacgtgtttaggtcgtccaaccaacttgccgctattatatatgtccaataaatccactagccatgtagtcaggtgagtgatttttgggatctgtcatgccaataggtagaatatggacgaatctgatctcacaacaatttatagactgctagtaccagacaaattagtcatatataactaattatccgcaacgaatgcatccacaaaacttccctttctaaagcgtagctttcgtgccgcccgatcgcagcaacagtattcaataccccaccaatcataagtggatctaaaagcgcacacacaccaaaaacaaaaaaaaaaaatctgccgtatccacctggggcctcgcggttctaattataccaaacttaactaacctaatcaccgcctcaaccgcattgatttcgtaccctaaccgcagtaatttcggcgcgtgtcgtccggatgcttgcccaactagcctgatctggtcccgtcccgacacaattgaccgcttgtactcttaactcctcgctcgcctcacgaagaatcaaatgccgttgaatgattggggaggaagaggttgaggaggaggaggaggaggaggggtggggtggggtagcgatcgcaccgcgaggggatccaccgccagtgccatcgctgtcctcctcgtcggtagcgagtggtagtagctagcacgaagacctcggtcgcgtcgcgtgccaagaggacacaagggcaccaggtgtcgactcgctgggatggttggggaagaaaggatgggggaatggcggcgcggcgctgtgggggtcggggttaggggtttggtagggttcgctttcgattttgatttttcactttctctcttttcttttcctctactttttcaccgcgtaagaggggctcttcacacacgttctttttataatggaataaacatcccggcctttactcaaaataactacagccaattattacatagtagcactcaagaacaaagtgtaaatttaaatgaatagaacacaccatagagaataacaaagaattcagcctaacataaagagatcacaattattgaagtctatttgtaaatctccaatcataattggcaaaaagttgcataaccgtagtctccaactttcgacatgaaactcttcatcttcatcacacctttgtagttgtgcccaaaatcgaagccaatgagttgccctaaaaatgacctgcatataggaaaatgatggtgatttatcaaaaaccatatcgttcctacttagccatattgcccaacaaatggcagaagctccaaagtatcagtttgctttttttcttatcaattcccaaaagccactcattaaaaatatgagatatagtaactggaagattaaaaccaaaagagaactgaactgctctctatatgaactttgcaaaatgacaatttataaagagatgttgaatagactcattcttcaaacaaaaagaacacctcaagctgccattcgagttacgccttgacaaattatccttagttaacacatcccctttaagcaagtatcacatgaaaattttaatcttaagtggctattcacacatgtaagtgtatattactccctccgtcccataataggtgatgtttttgactttttatttgcaacgtttgaccattcgttttatttgaaaaattagtgcaaatataaaaaaagataagtcatatgtaaagtacttttgataataaagcaaatgataaataaaataaataataattttaaaattttttgaataagacgaatgatcaaacattgacaaacaaaaactcaaaaagacaagtaatatgggacggaggtagtattaatcagcgagctagctgtatgtttcaacaataaacagtaatatttcatttattgtgctgccgttcaaccaagaacaaaatcaataagaccgggccgacaggatgtacactttgcgtcgcattaactgcgctaattcattactagaaatatgtacaatattttaattctagattctattaagaaaaaataaaacttagggcaccgtaaaaaactatattacctggttcattattgtgaggttggcaataaagcagatagtaggacatgtttgattagcaattaaatttgccatgtctatccttagataagccacaattttgataggcagtatttgattcttatcacaactctattttgtctaactagtcatttggcccacatgttatacacttttgttactgtctaagctttagtttgtcattttgttccacaaaagcgtgacaagactaaacttagccaccttagttaagaatgtgtggcaacattagttaccaaccaaatatgtcgtatggcctcgtcgtatggccagatgctttggctgaggcgcgtaatatcatctagccatagaccggatattaaaaactaaacaaatacttaaaatattaaaaactaaacaaatacttaaaaactctcttcccttaattctccattcctccgcggacgttcatcttccctccaatatctatctgtctttttttctattgtatcatggcccccatcttactacccgctacttgttacatcttgttacctactacttttgtaccaaaataaaccaatctaataaaagatgagacatattctaatattataaattttaccaaaaaaattctagaaaaatatgcatgtattttcagtagtattacactgctatgtaaagtcttaacctcaatgcattattttaaccataacaaaaagataaaaattttaacagttttaagagtataagtatgatagattttgtcttcttttcttcctattataatgaatttgaagatgatacgtatttttataattttcttgatgacatttattagttcatgggcatattacgtaaaaatgacttgtatacatatcttacggatgcacccgtatcaaggtcgcataagagcaagtagggatggcaatgggtcgggtcgggcacgagcagagtgaatccatgcctgacccaagacccacgtgcccacgcccgacccatgcccgcaaagccaatcgggcaaaaccccatgcccgtgcccgtgcccatgcccgccgacggatatccactgggtcatgcgcagtgacgaagactgggtcaggtgagcggcggcggttgacgaagattgtggtcatgcgcaatggagacgacgaagtcgctattgcctaccatggtgaccgccgctcccgtttgttcccttgttgttgccaccacctgcaggcgccgctgtcgccgcttgtccccctaccgccacactgcacgcgccgtcgccgccgcaccctcctgcacgcgcgcagccgccgcttgttccactgccgccgcccgcccacctgcacacgcaccgcggcctcttgttcccctgccgcagcccctgcctgcacgtgcgccgccgccgccgttcccctgccgccgccccgcctgcgcgccgccgctcccccacctgcacgcacagcaccgccgccgttcccttgccgccgccgctgcctgcacgcgccgccgctttggattatggagaggagagaggcatccgggaaagatggggtggggaaatgaggaattaggttaggtttcattgagtgagtatatatatgtctcagttaatgggctaaatgggctaagaagaaggccatgggaattaagagatgggccaaatatagctaatatgtatatgtatcgggtcgggcatgggttatccacgggtaaaaaataaaacccggctgctacccactatatgttcgggtatcgggcggacatgcccacggataaaatattacacccatacccatgcccatcgggtcgggtatctgcgggtacccgacccgtaggtaaaactgctatccctaagagcaagtataataagaggttgtaagtcggctaaatgctaaggtggaggagaggagagaagagagagaggagaagcgggctataaacttacagctggcttggacacaagaaccatgaaattatgtgagagagacactgtattaattgtaaatagctaactattatacgtgtgggctaagagaagtctgcagagaaccttatagccaacaaatcgtctgtattattagccttactctaagcgagacatacgtgagacatgaataggtgacaggacatccaactctttttattgaaaattgtgcacatgacccggtaggatgatgggggtacttaggacatgacaggacatccaagccttttatagaaggaaccattgcacatacggaaagctaactatcaatttaaccctaaattattaacttcgcttatttaaccctctttttaaagaatgaacatgttgtttggctatattctaactagtgttacaaatatattttaaaaaatacatttagaaaatgataaagacctaaatacccctggagagaaatacacgcaccatatcttatcctcgtccctctcgtcttggagccttggacccacatgccctagggattgcagactcggtcggcagaggcggaggcaaggacggtctgatgggagctaaggcccttcacagtgctccatgttggagcgtttcttcatcccaccacgtagactgtgtgatgccatggaggagagagggtgtggtccctcacacctccacaaagcttttcgttcctcaacgaagaggcgaggaaaaggcacagacaaagcgcacaaagccgtttgccatgcctagtctctcgccacatacaaccactgcacatgagctcgacaacggaggcctccatgaccatcggatgagctcgacgacggttgcagcggggagctcgtcgactcgatttgcgccgctgacatcaatctccgcccccgccgcctcaagccaggcgactgtggcctcccactccacactgccgccgaggagctcgccgacccaatttacaccgccaagatccacctctgcccacgtcgctcagcaccacaccagatccggcgacaccgtcaagcttcgcatccgtccactctagaagccttagaggagagaggcgtcgaggatggcgtcgatctggtcgctcgattcacacggtttgtcacggagctcgtggccgtggaaggggagagaggacgttgtcgccgtcgctgctccgctcaacgccgagctcgtagctgggtcagggaagatgggagaggtagaacggcgttcggaagtggagaggcgccaacggggagaggggagaggccgccggcagcgggagttcatcgtagaggtgggggagtggggggacaccggaggcgagttcgtcgccggtgaacttgccgaggtgggggtgtgtggggggataggaggggttgtgggggtggatccggtggtgggtttggggtgggatttatattcttctctcaattttaggggtggttagtgtaaaatttggacttctttgtaaatcaaaaaaaaatatgtggatgaaattgaaaggggcaagggctgaaatgaaaaattaaagttattcatgaggccctttgcactgcgggaatatcaaaattaggacccgtgtatttagcctatgtggtatcttgtggtttcttgtttgagtgacttgcactgtaagtgccctaagcgcaggcgtggaggaaacccagcacacagctcgccggcgcatggacgcgctcgtggatagggccaggagggcgcgtagcgcgggcagagggaggcgcgtgactcccccaacgaccacgccaggccatagggttttttgaaaaaaacccaagccataggccttactcagcgccgatgtgctagcggagggagcctgagccctgctggattctgtttttttttcgataacaaagtttattgatcattataagcacagtcaatgaactacactagatatacattctccataactggagatgattccaaagctaccttatgtttgatagcacaaatgagatattctttgactggctattggaacaacattagttgaagtattctctctagccttttttgcaagaaagtctgttgttttgtttatttgtcttcaaacccacttggcaggaatacaaggctgggttgctacactctcacggctttgatgctcatgtccacagaagagtacaacatgtaatcaatggaacacctagctatgtcatttatatcctttgtttcaaactacaacattctatattcgtgttgcttgtcatatgaactaccttatttgtagtcatggacattatattgtgaactctattgtttcagttttgtgtggacttcataatgctttgaaatgtgaggttgttgaattattatgctatgaaatgttgaattgcttcgaagtccataatatagaaaaggttatgccggatttttgtattttacactcaaaagttagatttgtaagtattctacatattcttccaattatacctaatttctacacacatttaaccatattttcaatcaattacttcctcaccttttctccccaagctacccatggattttgtaggtcactctggcaccctagaagccactactcccctccatcgtggcatccgagcctagctgaagcttgaaaccatggtacaacctaaggtcatgatgttggacatgcccttactagtatatactgctaagggtgatgatttccctatcggtaatagggacaaaatcttagagcatcctcagcagatgctccatctgaaaattagcatatgggggtgaaaaatcagccaacaactgatacaccatcggctacgccaaaaatagcgcgtgtgctaaataggagagaggaacgtcaaaattggcgttcttctctcctcacaccatacgcaaccgccacatttcgatcaaactcctgctcccatacagagttccggatcaacctcccacagcatctgcgccagcggcaaatagaggaggagagggaggatgagttgcagctctagttggattggctccggttgtcggagaagggaggtagagaggtggcaccaacaagatctagggagtttgaagaagaagtagtccccttccgatgctgactcggccttccaccgccgctcccgccacctccccacctggccacccacgcctttccaccatacctccctttcgcccgtgccttccttcgcacctccccctcccgcagcgctactcctccacccggcgaccgtgccgcaccagcacggctcgcaaccccgtcgccttcgaaccgtccgtcagcccttcttgtcctccccgtcctatatatgaagtagaagagaggaagagttagtgagaaattaatataaaatgtatggtagttgaaagatattagtaaaataaaggatgatataatatggacaatttagtatagatgatctgttgaagtgaaaggaaatatggagagggaatctttttggatgagcatccaaatgggaatatggaagataaaatttggatgtgctgttgtgatgctcttatggagccgggacggcgggatgattttcgtcacctatgagtcaagtggtcggagccccatattggcatattcaaacggggacgtaaggtcacaagcggccaaaaagtttccacccaagcacgagaaatataaaacattgtcaaataatatattggatgaatggaagatctacaagatattcaagtccaacaacttcaaatggacctagcgccttcatgtcaactccggtttggatgatcttgtacttgttggaaagcggtgcgtcgtcaccttttaaatgcttctggtctcatatcaaaattcatctcgagtcaacaggaatttcaaaacaagacagtttgaaactgaatttgggctttgggccttgtaatagattaggcccatctcggaagtgcctctctccacctccacgaaccagcactaatcctagctttattttcctttataaatagctttgtacgccctaaaaagaacaattgggttttgtttagttgaattttgccaagagtcattcaccttgtctctagttctcgttcgattagttgacgactatagattcagagcccccaactgttgatgtgttgatttgtcggatcgattagatctatcacttcaatcgcaactatatatttgtgcttaattacctattcgcaatatttagattgcatcttatcttgttcttgtagtgttctctgatttgcattgcagggaacgtcaaccacgcgtcatggttggtacgatatcgtttgtggcatagtgattgcacgatgtcatgaacttgttctggttggtagccatgtcgcaaacatcatattcaatcaaagtgagagttatcccattaccaaaaaatgggccacgggagagagtgagtgtcatcactactgtagcaaactgttaccatggcttaaaaaaaagtaaaattaaggggttgttcagttcattgccagaaaaaagaaaaccttaccatttgttggtaatccaaaatttagtaatgccaaatttttgggaagatcacaatgtggaggtggtgttttgtttgataccttaccaaattttggtatagttttgtgagtagaagtttctagaattataaagtttgtagggattgacaagattgtaacaataaagtctcatttagtttgttgttttggaaacaaagtaaaaaagccctgaattatactcataacattccaaatcggtaaggaataagttcaccgggggtccctcaacttaacagtgagattttttaaggtcccttaaccacaaaatcagaaatgtgtacccctaaactcacacaaaccgtgcactcacggtcctatggcaatatatatgggtggtttagttgacgtggcatcctagtcagcaaaaaaatttaaaaagtacgtggggcccacatgtcagctacacattctcttttcttctccttctcttctcttttctctcttctctcttctcttcttcagggagggaggcttgctgcgggtggcaagcgagcgcggtaggcgggtggatgcgggtgtggagacgcgcggggaagaagtgggagatagggagaggaggccggctctcattgcttgtcaccagcagacgggctaatgcgggcatggcgacgcgtggggaagaatggggagagggggagaggaggcgagcacgggcgcggcagtggctgcgggagagggggagagaggcggtcgggacggcgggagcaatggg

SEQ ID NO: 82640 - DNA, 80616 bp, Oryza sativa
  unsure (1)..(80616): unsure at all n locations
taatttctagaaaatgtattattaattgatttttaaacccgaacgaaaatcggggcgttacaaatctacccgaacgaaaatccagtggctcggattcgccggagggagctcgacagcggcggattgcggcagcggcaaccggcggagagaaaagaggaaaacgacgacgaggtcacgaggggccgattcccggtggcgagagcatctacgcggctacgggaatccgtcccttgtgccggattaggaggaaacgcatcgagggaggccggcgacgagaggcgcttccgagcttgggcggcgacggcggcgagcacacggcgagcggcggcaacggtcggggcggcgctggctagctacgggaaggctactcgtgctactacccgagtctaaggggaggaggtggaacgaggaggatgaacggagggaggcactaccgtgcgggcgggcgcagtgacgagagccgacggcgcgaaacgtgatcgttttggcctcgggccgaggaagaggagggggagggcgcgcccggagtccccttccgcgtccttgctcgtgccggctcctccgacacgcgcaacgacgaacggggacggcgaacagagcacgggaggcggcgacaatggcgtggcggcgagagacgaaaacaagggagattggaggagggaggagcttgggtttataggggcgacaatgtcagtttgggagaggggaaccgacattggacggtcaagccggcgagctggcgcccggctagcggccaaaacgacgacaggaggtgacgccgacgagaggaggaaaaagaagaaaggaagagggaaagggggcttgcctccttgccgctttgggaaaaggaggagggagcgggggggtgatgcggcagagggaggaggagctctgcctcctctccttggaagctagcgcgtggaggggaggggccgagtcgatgacgacggcgatgacggtggggcggtttggagcggggcgacgacacgggcggcaggcgcgggcaggcgcggcagaggctgatggcggcggcgaccaggcggtcggccaccacggcacgcgcacgcggaaagcaacgggcggcgcggcggtttgagcggcgcggctcggtacgcgtgctgactcgcggggccgagcgcctgcgcggctacaggcgcggtagggcagcggggccgggcggcgcagacggcgcaggcgcggcacgggcggcgaccacgcgggcgcgcgcacgcgagcaacggcgcgcgggggccgattttggggcggggagctcgctagggatggaggcagggagagggagagcgagggggaggggtgctcggcgcggcttacgcgcacgcgcgcgcggcgcgcgcgcagagcgagggagagagggagagagagagagagaaagagagagagagagccggggagggaggggaagatgggccgagagagatttggcccatcgaacccgagggaggcaaaatagacttttgcggaggaattgatttgggaaggatttggattcgggattgaactcgacgatagatcggggatttgagatctgagaaggcacggacacttgacaacaagcaaagaaacagatttcgcaaataggatttttaagagataatttttcccgctaggcgccacgacggaacaggcgctacacaaaatcagttattttcaagccattgaaatataccaaattcactctgaagaaaacaatataaacctctctgatgcaatcccaacacttgccctacctcactctgcatgcatgtcgtaactgacatcacttttcctctcctaatgagcgatccagactggtcaagtgtgatgttgccaccgaagctcattaattagagatggagaaggcaacttttggtgtagtaatcctatagatggccaaatgggccgcccgaccaggcacggcccaggcacgatcggcttgggccgaggtcagtcggaccggcacagcctgatctacacgccgggctgggccgtgcctgcccacgggctgcacgcatggccaggcatggtccaataagtttcgggttgtgtcgggctggctcgaaggcatgacagcctattgcgcttctccatagaataagtctacttctcctccctcatctctttgggctgtgtttgttatggatggaataagtctattttgtatccctcttctctttgggtcgtgccttatatatcttatgtaagtctattttggttccccccaactatttttctttgatcgtgttgggccgggccggtccaccgtgccaaggcatcggcccaggcacggcccaactatcgggtcgggccagcacgggctcgacaccagttgtgccgtgccgtggttgggccgggcctagggcctagggccttgtggccatcttgaaggaatcctatagcatcgtgggaagattggaaattgaatgacctaccactcaaaatggatacatgtaacacaattatgcgattaacttttcatttgtgtggttatttggaattgtatctgtaacatgaagaaattggtgtttcttgttagccaacttaccctctaagaaattatgaacactctccctccaatggtgtggtggatcgcatctagcctccttgtagatctgtcggtgcccacatgcatgctggtggaacgacgatctttggcctccctcccattttcaatccgtcagtcctcaccttctccatggtgtgttggccataggtaatgttgccagctagagggaagcggtggtggacaccctccaaggctatcattgttgtcaccaccaaatccacccttgagttcaggtcaactggatccaagaccactaagcccgtggtgatcgggatctaactccaagcttgtggtggtcaaatttgaccgcctctaagcttgtgcagggctggccagaggaaagggaggtggtggcgccggaggagaggggagtagtggcacgtcagtcagattcggatcatagagaggtgagggcactcaggacgctaggtataggacatagagaggacagagaagaaagaatagaggagagagcggtgtcatgttggcttaaaattttctagtctcggcctccacctcgtcttgttcttacttaaagtgacgactatacttgctttctttgcagcaatggcctagtttcactctcagttcaatccttgaactggaaatgatattgagtaacattgtcagttcatattggtttggaaaaaaaaaccagacaaccaatagtaatactcttacatcaccgtactagtacggaacaagacatctgtgtcgggaaccttcatctgtatcggagggaggctgcgtcacggattattggacagtgatgtgaaaagttatctgtgtcaggcactcaggctacataccatcaccaatgatagtgatctatgtcgggccgacacaaaagaccattaccaataggtttgacccaacaaaggagtgaaactagagcctgtcacggatgattcatccgtgatgatcccctactacaaactgataaagatgtttgtcacctttgtcgatatggttttgagaccgtcaccgatgacttattgggatggtttctgttttagaaccaacgttttttatgcgcacccgtgacgttgcttttttttaacccgtcaccgatgagtaatttaccaaaaaaaataaatttatttttttggctagcgtcaagcctttgctagccatgcctgctgcaaaataacaaaaacacagatacatattaccattcctagtatccccaacatcccagcattcccagctggagcgcggactactagtacctcgttcaggcagcgacgaggtgaagaggaggagtgaggagaagtggtggaggcggctagtagggttttgctgcccgagctatccctcctggagtgatgcaaggttcttcgccaaaattccctcttgtccataataattgaataggttaccgatcatttaaggagaaagtgtacatatattgtatttagtagtcttaaagactactacttttattacaactatccagctatgacaactatgccatggcatattattttggtacaagacgtattatttggtacatatttattttagggccatatatgttggcacacatcattcacatagttcatttagataacagtcctatgggtgcccaccactataggcagatccagaaccgcttccagagccacttccatatccatggccacctgggccactctgccctccgccgccgccgccaccttgaccacctgcatgagcatagccaccaccgtagggcccgtatgaaccagcttggccgtaaccagatccagaaccagaaccataacctgatccaccattgtatccaccgccaccaccaccaccttgtccgccaccctgagcatatgctccaccatgaggaccgtagccaccagcctgaccatagccagagccagatccggaaccatatccagacccaccatttgccccaccacctccaccaccaccttgaccgcctccttgagcgtacgcaccaccatgggacccatatccaccagcctgaccataacctgaaccagatccagaaccatacccagatccaccgttttgtccacctccaccacctccaccgccaccacctccactagcatatgctccaccagagcctccagcttggccataccctgagccagagccagatccccacccagaaccattccctgacccaccaccacctccgcctcccccaccgcctcctccagcgctcacatacctagctacccttgtagcattggtcagtccaatgccaaggaggacgacgaagctaagagcaacaaacttgcttctagccattgttatctcacagatgtgaatctgaaggttgagatgagagtacgaagcgtgtgtctctatttatagtgctggaggccatacaaagtgagtgtaaaaaaaaagaaaaaagaaggccatacaaagttgctgtgcaaatatgcaatctgtgccatttggtcactggttttatcaaagcagagcagcgttgccgtgtgcttcgtgagtacaagtccaagaagaggttggcatcgtatgactattgggacaatcaaacgcaaccttttctttgattctgcttgactacatgtgtgtacgttgtaaggttgggcgcaggtatatatgccctatggtcagggaaagtagcctgtcgatagtcgataccatgttctatgagcccaggcatttgaccatccattgtactccagcataggacataccctacaaaaacacagtcaagtttatattttagtggtacactggttgtcgtttaggtcagatacgtagagagcattggaagttgcaaaagaaaccaaaacactgcagcaatctgcttgctttctccgtgtgcacgcagatgctgactagttgattccaacaaccaattttatcttgcgttaagagatgatcacggtgagacataagccaaactaataaactatcttctggatcgaaacactatcaatcatcaaaacacaaatacacaatcgatcaatatataggagtatatgtttgcatagaccaattcacctgcatctgtttgttcttgtctaaaacgaaaattctccaacatctgcatggctaattaactagccagaattggccagaataatcgtagatctctctttcagtgacagaatactgttccattcatttaactgaatttgacaaggcgaagagaagtataaagcgcctccgttcaatcagccacgaggccgccgtctccgcctcgccggcgccggcgccggcgccggaggggatcagagaatttggcccacaaacaaattcggcctactacctcttatcctcgatacaatccagcccatatataaatctagcccatctcttctggacgaaagaattcagcccattcagcccgcaaaagaaattgacggccgaaacgtgggtccaatcttgacggcccattgatttaactagaggcccacactgagatggatcgctaccatattgggcctcgtccatgccggcccacagtactaccttgcccattagcagacgcgggggcggagacgccgccgccggcgtcggcgacggtgacctcgtctagagccgcgccccctcccgcggcggcgccgaacgctacagcgacgggcggtggattcgccagcggcgcccacgccgttgttgacttcctcgaggttagtcttcgagtgtttctgtatttacccccaattcgtagttctgttgattgcttcgattgaactcacccatgcatcggacgattcaatttggatttgaaactcaccggtggttaggaatctggagggtgtgtgtattctccgtgccttcatggtgattcactgtattatattacctccacagaaatgttgttgaatcgtaatgtaacattgaattcccacggtaatctggcatttgtagacagggttgacagttgcattttagtagtgagacatgaacctgagcactagcttgggtagcttcggtgaaaattcttccctatgcaatctttagctgtttattgttaattgtactcgctgagatagtttttattttgtgatgttagaaatttataattgctcagacactggctctctgctgtttttcatcccaaaaaataacttggtggttagtagctagagtctgtagatattgcagggcgaactagaagctcaagataagttcagaatgcattctttccatgcccctttagttaactgataaacagtacctggtctggaattcacaatgcttagctttgttccttgctgttaaattaaccaatcatattcctgattcaaatttaggctttgagttggttgcaaaatgtggaactttctcccggccatgatgtgctgtatgtatttccaaggatgagatgacggaacgaattgcatggtgcataatgacattttggtcaatagtgttcgacaggaagcttttgaaaacgcagtgcacccatcatcatctctaaagataaaggtgagttccagcagaatgtctattgaactggtactaatctgatttcaaacaatccaggaacttccataacattggcgtctcgtcgcaaggctcatttttagttttgggtcatagggcggggcaaatataggtataaagcctgggcgagtgtctttgtccagcgctttcactaggggtacacacaactctggacttgtgcagcgcgaacatacccgaccggacgtagagccaaaattcgttttttctttgatgttcgccaaaacaacttacttttctttccgtgcgctggggtgcgagaacgagtaggaagttctggtcccacccggaagagtgcactgatagcctatctatcaatcttctacagccaatgacataagataggaaatgatcccaaatgacaaatgaataggtgtggaagttataattgtaaataaaccacgatcgaatcagttttggagaatagtgagcatatattgcagtgtgcttcaggaataaaaacaatagccggagtaggtaagggatgactcgctaaagccagcgtttttctcataaggcttgactattacgtccagggtgtttaagatttgtctgacttttttttcgctaacgcacaaaaagaattgcacgtcggtatattagaagaaaacagggttctggttacacgacgcaaatggctagaaggccattgccaggggattggaaaaaaagatttgtctgattttgcagtttgttctctagttcagggaaagtatcaaaaccatggacgtacataagcccatgcatttgaccatctctagtttagttgcaagtatatatctgtacatggatatccctttttagtgttactgaattcagggaagtgaggttttgtcaacaatatcattaagaacgctggcagctagccctagctttttgtgcaacatcacaaagctctatgacgaacattgtcgtaatatttatactacctactgtatttgatattgtcgatattgtcagtttgtgactttgcagtgtaccaagctaggaaacttaattacgtggcaaaataaactgaactacatgtctacatgtgcagtgttcttgtcagtcaccccatgcaagcgctgactctccaacatgattagaccatgcacgagtccttaatctacaaatagaggtatgattactggacaaatatggctgcatgcatgcttaagatgtaatgaaaaaaaatgaacaacatataattttactccacgcagaaggaaaaaattggaaaaccatttatccagttatgataaattaagataatatttggtaacatagagtaaggtactgcccatcaatcttaaattaaatatgtaaggtaaaaaaaaatgatctacttatattaaaagggagaaaattaaaaagcctatttaactcctataattaagcaaattatctggctcactaccagatatatatatatgtcaattttgtttctcctgtggttctttgttttgaatattaattgcgagtgatagatgatttgtaattttagtgattgattgattgtacaaagtttggagcacatcgacaatttttcgacaataaggctgaataattttcagaatattatgcttggttggggcttggttctttaaggaggatattatctcttacatgtttgtaggatgaaataatgctctctcttagcttcctcattctttcttggttacaacatttgtaaacttcaattttttttgttcctttaaaacaacattcaatgtcagtgagaatctgtttatattttaaaatgtttcattcaaaacttctaaagttgtcgtccaaaaatttttttcactccactaggacctactaacataatagtttctacaatagtataagaagcataaggcaagaggttattcattgcaccagtaacattacatagtagtttacattaccactacttttattctattatcggttaccacataacaagggcctctttgatattatttaactgcataaaatgcagttgttcactatatagaagttctatggatgcccacccccgccaccgccgccttgaccgcctgcctgagcatatcctccaccgtaaggcccgtatccaccagcttggccagaaccagatccagagccagaaccagacccgccgtattgtccaccgccaccacctccaccttgtccacctccttgagcatatgctccacctgggccataactaccagcttggccatagccagagccagaaccatgcccagacccgccatactgtccaccgccgccacctccaccttgtccacctccttgagcatatgctccacctgggccataactaccagcttggccatagccagagccagaaccatacccagaccctccattttgtccaccaccgccacctccaccttgtccacctccttgagcataagctccaccggggccatagctaccagcctgaccatatccagacccagagccggaaccatatcttgacccaccattcaccccaccaccaccgcctccaccttggccacctccttgagcgtacgctccaccatgagggccatagccaccagcctggccataaccagaaccggacccagaaccatatccagatccaccattttgaccgcctccaccaccttgacctcccccgcctccactagcatatgctccaccggaagatccgccggcctgaccatacccagagccagagccggatccccatccagaaccatcctcggaccctccaccacctccccctccactaccgccaccctcggcgctagcatatctagctacccttgcggcattggctagaccaacgctcagcagaacaacaaagctaagagataccaacttggttctggccattgctaattaagtactctatgtgtttggatgatgagatgggtgcagagtgtgagggttgcttgggtatttatagtgttggagaccatgcagagctctagcacagagtgacacattcggtctctggtttatctgaatcagtgttcttcagggaacaaaaagaagaacgagtaggcaagatatgactctcaggccagttagttaagcaaacttttttgtttcaggcatggcttgactatcactttgtgggctatgtatgttgggttgaaattgttggtagctacatggtcagggaaagtatgaaaaccacgtactctgagtccacagtttgacaatctgttaatttattactttgtcacaacatatatacctccattctttacaatataacattgttgtcttttgtacaaacataaaaaatattagttatgtttaaagaacttttaataataattcaaatcaagaaaataaatattaatcatataaattttttaaataagatgaatggttaaagtgttttaaaaggttaatgacatcgtatattgaaaaaacggagggagcacatcccaataatgtgatggaaagattcagtggtaggcaatgtacctgtcgacaacgagacgcctgtggtgacttcgtcaatctcaatgacttgccggcccagtcttcgaagatgctcgtagaggtagggtttgcgtgcgttcatagggggtaagtacgcgtgcattgcgagtgtctgcgttgtattgtgtaattctaaaaaaaaataagagaaagaaaagagcagagcacgcgtttgtgacttgagctgaaacgtgtttcttgcagaaggcctgtacttagtcctctcggtaataacaagtgacccccactgtcttcacccgtagttattaggtagatttctgccagaatagcactttgcatctaatttaacaattaaaaaaacaatgaagtggcttaaaaatataaacaatgatctcgaagaatcatggaatgggatatgtacgttcaatatgcattacttttgggctaattaatcaagtgggtttttagcatgtgcgaatctaagcttatggggaaaaaaaacgaaaaaggcaatgaacactcgatatgtgtgtgtgcttcccaatcaaaacaatggatctaattaactgcacgatggatcatgggtcgagttgcccagagactataaacggggtgtcacgattatagttacgagcaaaacagtttattatttaacgattaaataatattttatgagtaaaacatttatatacgtgtttgttagtgattttaaaaacaaataaagaagattaaaatatattttgaaaattcaaaaaaataaatttaagttttaaatttaaattttcgtttatatttataagctaaaggctaaacgaagcagctttataaggaaataattatcgaaggaaggataggcagtgccagtgggggtatgcctgttagtgctgacaaaatgaagataaccaatttgccataataaatcgtcgatcaacactttaatgactcatgtctcaaagaaatacacatcacaatacacacaaaaaacccaccacaaccgcactttggcaagctatactattatcatgcccacacagaaacatgctatttcgcacgtgtgctctcgtgtcccgtgtggccatgcgccacacgagatgtgggcttctttaaaatttgatttaataattactttgaatatcttttaaattctagcacaaatttgcactacttagttaattttttaaattaaataacaactttcaataaaaagttaattatttgatttttttcatagaattttaatttgctctaaagagaaaaagaatcgatgctggattaaaagttcttaattttcagttgatttttttttcatactgggtatacgttgttatgtagaacattgttctatggaaattaaagcttttatccaaaatggttctagagagagtatttctacggaaataattagtacgtttctagtgtaagtcatacccatatagtcaaaagcctaaactaaaagttcagatatgaaaatttaagggcaattgcttatttgacctcgttttaaaccctaactaccaatttgaccctacttttcgaagtttgcttgtttgacccttcttttcaaaaacgaagctcccgtctgaccctgtttccactagtccgttaaggtttgatttaaaataaaaaaagaaatgcaactaatatttataatacccagaatacccttaggagaccctatccatccacccaaccttatccacatttctctctctttctccttcctccttcctgctcgctcgacttgtggcggcggtgctagggggcggcggcggtgactgagggggtggagggagggagcggcggcggcgacggctgaggggcgcggagggagggagcggtggcggttgaggtggcaccggcgcggcagctgaggggcgcggagggagggagggagggagggagcggcggcggctgaggtggcgccggcacgggatgagggaggcggcggctgtggcgctgagggggcggagggagggagcggcggtggcggcggctgaggggcgtggagggagaagatccacgccggctgaggggcggcggcgactgaggcggcgccggcgcgggatgagggaggtggcggtggcggcgccggatccgctgaccgcagctcgagctccaccgcccggactcaccgccgccattcctcgttgtcgtcgtcaccagggccggcgccgtctcgcctttcgtcgcctctccctgtggtggatacgtggaggagaggataagaacgcgccgccgccacttgtcgtcgtcgtcgtcatcaccaaggccggcgtcggctcgccgtctcgcctttggccgcctctccctgtggtcaatccgtagagaagagagaagagaggagaggagaagagaactgacgggtgggtcccacatgtaatagggtcaaatgagtaagggcagaagagacattttgtgcttcagttaacaccgttagatgcccttaacagaatagggtcataccgtagcttcgtttttgaaaaggagggtcaaataagcaaacttcaaaaagtagggtcaaattggtagttagagttcaaaactgggtcaaataagcaattgccccaaaatttaaaatctaggtagaaagctatgcgaatagcaagttttagtgtcatatatataaaaataaaaagtattgattttgaaagggacggaggatgctaaatgcatgtgagtaggacctgatatgcgttccatgtgaactatatggcggatggcaaagctttttccattgctttgcactcatatgaagaaaggctaaaaagcaaaggaagaaaaaaaaaagggtatatagtgtgagtgtgctcacaagttgggtttcatgtagatccacaactaaaaaggggagggcaggggagagccgccaccggcctcccgctcgaacccgtccctggatctgcgcgggggagagccgagggggccaccaccgtcgcccacgcccactgtcgccgtagctatcgcccacaaccgccgccgctgccggtcgaccacacccaccatttcaaccgccatcgcctgtgcccgttgtcgggagggtggagaggggagaggagtgggctggggtaggtatacaagtgggagaaagagaggagtgaagaataaaaaataagttagaatagagagggtaatcactgctctggaaacctttttcgctaaacatatatggctgtatgctatgtggaccctgcatcgacggctgcatgtgaaaacgtattttcatatatgtccgacaagaccattcgtgtggcttaaggaagctaattactcgggttcaagtagttcgacgttgtcggcaagagagatggacctagagcacccataagacaccaatacaaatcaactatttttctgctcccctattgtttctcctatatatgtcttttagttaagctacattcaaaatttaaattttaaaactcaattcaaaagttatttttttatatttttatcgtagtttattttacttttaaatcgttaaaaccacaaagatttgttcttttaagtcaaacttatctgtccagacaaaggtcagcttaaccttatttgcacgatctttttttcatagtaacctaatgcctctccatgcatactgctgcaaagcacatgtatggagtctgatctgcagaagagcatgcaacagcaaccagagattcaaatgctctcttgactttaaagtatgacgcaacactgtcaacactactatgtattgatcaaacatctagttacaccggtgggctgtgtagaattgtggtgtacaatgaccagtacattttgttattacagtgtattcaacggaggccctttattacccattatttacgtaaataacacatctctcaaacatgcaatcagcacacatggcctgtggtgctagtttatttagattctacatgtttttatgggtgtccaccatacgcacttccagatccgcttcctgatccactaccatacccgctgccaccaggaccgctctgtccaccaccgccaccgccaccttggccaccggcctgagcatatccaccaccgtacggcccataccctccagcttgaccatacccagagccagagccatacccagatccggatccaccattttgtccaccaccgccaccttgtccgccaccccctccttgagcatatcctccaccatatggtccatacccaccagcttgtccataaccagacccagaaccggaaccgtatccggatccgccattctgtccacctccaccacctcctcctcctccgcctccactagcatatgctccaccgccacttgcctggccatacccagagccagaaccggatccccatccagatccaccgtttgacccaccgccacctccccctccaccgccgccaccgcctgcactagcatatctagccacccttccagcattggctagtccaatgctcaccaagacaacgaaggtaagagccacaagcttagccattgtgattgatctagataagtaagccaaggatggatgggatggatttcaagcgaacggctcgtcggtatttatagcactagcttagccattgtgattgatgtaaattaagctgtcaagcaagatgccactagcatgatctctagtcaattacgtagtactacataattacaaagtctacttcacaggggaaaaagagtgcagccgaattagatggactatgacttttatgcctggttatacatactttcttattagttggcctgaataaagataacgtgtgaattgatacgtataatattatatatttagatagctagagaaacataaataataataccacttactgagtccaagtaattgagcacttccaatgggcaaattaaatttaattatgggcaggatgatatatagatcacagctagctggactaagcctatagatacaatagctagtactacaatatatcataaaatgagtcgctgtcacatgttaataattaagttatatatgctacacgtacatacctttcatgtgtggtaatgtgtggctgtgtagtgtatgcatgcaagatgcatagctgtatgcactaaatataatttcttgcatgtatgacatctgattaattagtcttttccgtgttgtgcttatccaccctttgattttcgtagggcatattataattcaacaaggtgaacaatgtagtgctcaaggcccgaccattattttctagaatatacatttaatagtatagtgatagcaatattatgtgatagtggaatcaataccttgtatataattagtgcccgctagtaattattagaaactaaaactcaagatgcaaatataccacatcatcatctactagcaattactattgtagagcatcttaaatcacatgcaagcatgacacatcatctaaaatataatatcgtagagttcaacatataaatatgtgaaatcatcttcctcacattattttcataatatttcaacattatcatttctataatatttaacatatatccatccattcattccacagcaaagcacgggatatcatatagtattaatgaattggtataatcaatatttttttattacctacatttcttttggaggttattataaactttatttaaagtactatagaaaaactgttttgttagatcattttaaatcacatgcaagcgtgatatattatctaaaatataccattatagagttcaacatataaatatgtcaaatcatcttcctcacatcatttcacaatatttcaacatcatcatttctgtagtatttaacatattcatccattcattccgcaataaagcatgggtatcacctagtattaatcaactggtataataaatcattttttgttactacattttttttaggttattataaactttatctaaagtattaaagaaaacgtgttttgttaaaatttttaaggctcaaatttactactcaatatctccctcatcctaaaacgaatctggacagattacgtgtctagagtttggcttgatacttatgcttctagagtttctagagttggagaccatgcaaagctgaagtgaagagtgaaattttccgttcactggtttattacgagaaccactgttcagctaggaaggtatatgactcttatttaggccagtttgcaggaaaaccttttgtttctgataaggcttcgcctaatacgtgtggttgttggcttaatttgttgacttgatactttcttcagcaagaattaatgttcagtcgatactgtagctaactaatcagggaaagtactacgaaaacaacgtactctgagtgtcgcttgctagctagtactagcagtaggaatacatatatacttagaaaaatgatgctgctgattcgtatgatgttgaccatgtgatgtattatacgtatagctttgaccaccgtacctactgcgacgcgagcttttggtcaggtaaaaagctcaacattaatatctaaaaaaaaaaggtaaaaagctcaatggatcgacctgcatgtggcgcaagatcgactgttttttctttactctttgaaagaggaagctgcaataatatactccctccgtccaaatatttgacgctattgacttttttaaacatgtttgaccgttcgtcttattaaaaacttttgtgaaatatgttaaattatatgtatatataaaagtatatttaacaatgaatcaaatgatagaaaaagaattaataattacttcaaatttttgaataagacgaatggtcaaacatatttgaaaaagtcaacgacgtcaaatatttatggacggagggagtatataatatcgtttctattaaataatcattgctcatgtctagtggatcatgctgccaaatttacggcctctcacaaggatatataaatcattcatccagcagtggcatatcgatgctactgatcaccgtgatccctactcttattcagaataggtagaattaccaccgaaattccaaaccagctcatgcatccctgacatatgtgaccaaatacacgtacttttctgcgtacttggtactccctccgtcccaaattataggatacactttttttaaaaaaaactaaaacgtggtaacttttgactaataatcatactaaccatatatatttatgctaagtattatgcatgttactctctccattccaaattgatctacatatagttttttcgaggttattcctaaataatctacatatttgtgttcattcattaggtctattcgttatttatgcattagagtaaatggacattgatgcatccatgcacacaagcatttataacccacatgcaatatcttgatttactattggctacaaaatagtagggatggtgcatgcattaagtttgttgctagagtaaatatagtataagagagttattagtttttcttggtcttggtgtacccatgaaatatatagataatttggaatggagggagtatatcactatattcatattttaaagtaattttatgtgatgctaattttatatttgttaggaacataatatggtataaattaatggttaaagtatatcattaaagaccgtgtatataaatataggtcttataatttgagacggagggagtatatatatggcatgaactaagaagtcagcgttgctgccggtgtggttataccatctgcttccttcctcttgcgacccacttaacgtagcttgaagacaactcctttaggcctttactatatatatatatatatatatatataagaatcactcagagccaatcttaaaaaaaatcattatttttttcatgacaatttagatgaacacaaacttcatatatataaaagttatagctcttgacaggttgaaaacctttttgatttagagttattatatgctctaatattcattaaaactgacaatgaatatcaaaagacaatccataattttttttttcatatacatgaatttggacaaactttttatatataagtttgtagacaattacgaaacctagttaataactttttatttcaagtgatttatctacccaaaaatgtgttaaagttttagcaaggaagggccaaattaatgaaacaaatatgataacatggtatgttgagttataccggagatggtaaactggcgatgcatgaagggagctgtgttggtttcgagtcccatactcccatatactacatactactagaaaaagggtttttcatcgtgacacactatttttttactgacggccagactctaaattcacttgcacgaatacaatgaggggtggggggaaccgcgagcaaagattgatgggcatatgacttgtgacatgtcctatatatacacgagatataatatatttcttttttagtttggcatattaaaaatcaaatcctggaaactaattatcactactggttctagccatgattggtagcaatactactggtttttattatatgaaacccactgacagtttaagacgatcgatcatgcatgattcgcaattatgcaccggccgtagtgtgattaggctttctctactactagtgaaatattctctagatcatatatataggatacaatacactcattgatcgaacatttcaattacactgatgagcttacatctgtagtggtatacaagaccactttcattattacatccaagtgaagccctttatttggttattattcacgcaaactaataacaacacctctcaaaccaggcagcacatagtgtcagtactgctaggttatttaggtgaagcacttctatggatgtccaccgtaggcacttcccgaaccacttcctgagccactaccatatccgctgccgcctggaccactctgtccaccaccgccgccgccaccttggccaccagcctgagcatatccaccgccatacggtccataccctccggcttgaccgtaccctgaaccagagccggaaccatatccagatccaccattttgtccaccaccgccaccctggccaccacctcctccctgagcatacccaccaccatatggtccagacccaccagcttgcccatacccagacccagaaccggaaccatatccggaaccaccattctctccaccgcctccaccgcctccttctccacctccactagcatatgatccatcaccgcccgcctggccatatcctgagccagagccagatccccagccggaaccaccgtccgacccaccacctcctccctcgccgctaccgccacccccagcactagcatatctagctaccctgctagcattggctagtccaacgcttaggaggacaacgaagctaagagccacaagcttacccattgtgattgatctagcgagaagctagtgaaggatgagatgaattcgaagtgatggggctcgtcagtatttatagcaccggaaggcatgcaaagctagctgtgtcttgcagttaagatgccacttgatctctgatcaattacaagatgatgactggctgactgctaagtctagtttggcaggaaaaagattacagcggaattagatggattatgactttcgatggctatcaggtatgctgttttcttctctcttttgagtaggccaggatataatttggctaactctaggtcatgcagagaaacatgcatataccgtgtactcttaatccaggtatgtgagcatccaagaggcaaaatttagcagcacatattggattgtagctattgcaacacaccaggcatcctcaagtccacaatggctagtactactacattattgtcataaagtgagtcacccatttccacatattaattaattaataagttgatgagaggtattgtgatatatatatagggacaatgtttgcatttatatatacatgcaggatgcatatataagttaactgaatgtataacctcatttcgtctaattaatgacgtctaaccaataacaagatatgccggcccagtcttccggaggtgctcataggagtagggtgtgcgtgtgtgcgttcataggggtgagtgtgcgcacgttgtgagcgcctgcgtttatactgtgtttctcaaaaaatatatatatatattcttgcatattaatgcacccgatatgtatgttggtcatattataatttcaagtatcttaggtactcctatattgatctcagataaaaaaaagtatgtatttaaaaccaattaatagtgaccgaaagcgtattggaatgcaaatatattggtcatcatatctatatataatttgataaactatatattgagcagaataaactgaactagctagtgtctgtaaactactacaaatacgacctaaaaaacagcggatcgagaataagcatatgtgttcgtcaaattaattgaatgcgaagtgtcgagttggctcatgatcgaacttctagtacgtgtagccgcgtagtgtaggagaccatacaaagctaggtgtagagcgaagtgacattttgggtcacttgtttaatttagttaatttatccaaacaatcagtgttctcattgagaaaatatcaggtcggcaaggcacgactgttaggccagttaggacaactttttttcccttttatgattaggctttgcctaatacgcctcccatgcatggtcagggaaagtatacatatagtagtatatatgaaaaccacgcgtactctaagtgaggaaatgctagctggtgccaaactgcatatgcatgccaaccttggatgacatggatcaagtggcgccgcaggcatgcactccctccgtccaaaaattaatactacctctgtttcatattataagtcgttttaatttttcttcctagtaaaacattttcaagtttgaaccaatttataaaatacctagcaacatctataacacaaaataattttcattaagtctaacattgaatatattttgatgatacatttattttgtattgaaaatactactaacttttttataaacttggtcatacttaaaaatatttgacttaaaaaaaagtcaaagtgacttataatatataaaaaggagggagtattaacttctagctacaaattaaaaaaataaattgttttctgttttaatatcagcaaggacaatgtaaataaatatcaatgcattaatttttggtaataaattgtccgggtgcttcggacacttcaaacagtttgtgtctcgcccacagcctaactaccagcctgtagaatagaaaacatgtggtagtagatcaaaatacgccttattatttcaaatagccggatttactcgtgcttctataacaagctatacagacaattaaaatctctctttcccacccgtatctctctcttccttcccaccatccctctctcccttcctttcctacctttgctcctaccttttgactctctagtgaggcatcactgtaacaagcttaggtgtcatctttacctcggattgggatcctctaacttaagctcactttgagacactgacatgtggcccctctttactatagacccagatgtcaatgaccccaaaagtcacctgacttaagtcagaggatctcattcccttcacctaggaggtgcagatttacaccagccaaaacaaggaattaatactaatcaatgaaccaaacactagcaaaatagttaatttctaaaaggcatgttttggcttcaaaccgaaatggtcctcagtgtggttcgatcgtgaattatcatgcatttggaataacatattgatcaaacattcaattacaccaagagcttacaaccgcattgtggtgcacaacaccactctaattattacattcagtgaagccctttatttcttattatccaagtaaaaataacagtaatatatctgtccaacccagctttcaatatagaagctctgctaatgttggtggaacactactatgggtgtccaccataagcacttccagaaccacttccagaaccgctgccatacccgctaccacctggaccactttgtccaccaccaccgccaccaccttggccaccagcttgagcataaccaccaccatatggcccatatcccccggcttgaccatatccagatccagagccagaaccatatccagatccaccattctgcccgccgccgccaccttggccaccaccccctccttgagcatatcctccaccataaggtccatacccaccggcttgtccatacccagatccagaaccagaaccatatccggatccaccattctgcccacctccaccaccaccaccacctccgtctccactagcatacgatccatcaccacttgcctggccataccctgagccagagccagatccccagccagaaccaccgtttgacccaccaccacctcctccaccaccgccgcctcctccagcgctagcatatctagctacccttgtagcgttggctagtccaacgcttaggaggacgataaagctaagagccacgagcttagtcattgtgatggatggagccactgaagtgaaggatgagatgaatgttgagtgaagagttcgtgggtatttatagcaccagacagcatgtgtaacttgaagctgtcatgcaagacgcagcttctttagtcaattacaggataactagaaagtctacttcagagggcaagaaagagtactgcagaattaggtggaatatacgacttctgtgcatgcaaggcttgtcatgaagacatgaagactttgatcttatgagtagacttgaatataaatattacatgtaagttctaaagttcatatgtatatagtttagctatctcgatagatctaggtcatgcagagagaaagctaagcttgcataaagaacaataccgagtacccagtctaggcatgtaagggtgcagtgggcgaaattttatgggcgtatagtatgatatatatccagtgtatatattacaacacgacaaatcaacaatagctagctagcacacacatatcattatcatcattatataatgagtcaatcgtctactcagggtaatactccctccatctctaaatgtttgacgccgttgacttttccaaacatatttgaccgttcgtcttattcaaaaaatttaagtaattattaattctttttctatcatttgatttattgttaaatatacttttatatatacatatagttttacatatttcataaaagtttttgaataagacgagtggtcaaacatgtttaaaaaagtcaacggcgtcaaacatttagggaaggagggagtatatgttagatacacttgctaacacacaaagtgtatctttcatgcatatgcgtacgtagtatatatagtgtatagttcatggatgcacgcagggcgcatagctgtatcgatccactaaccttaattagctcatcttgcatgtgtaatgacgtctgttcaatatagtttgcatgcatatattattgcgtgtatatgtactacggagtatagagataagaagaagaaaagataaggtcaaaattgacggttttactccattaaaaatttgggggaaaaaacctaggcaaaattggttatatagcatcgaaagttcgcgtttttggttttatagcatcgaaagatatcggttcactttaatagcatccaaagttcaccctgatccaatttttaacacttccatcaattctcgatcgttttccgtccgccttgattgctattgatctagctatacacacgatatgatgtttctcccctcattgccatgcattttacttatacttgtgaggggtagaaacgtcatattgcgtgcgtggctgggtcaatagagatcaaggcgaacggaaaaagattgagaattgacagaagtgtcaaaaatggaaatgggataaactttaggtgctattaaagtgaacaagtatgtttttttgcagttgcagggttaattattaggccattgttggagtcttctctagcatatgtgcctaacttaaatttagtctctaactctaaaggtatgcggtagaagacacaatcgaactaatcaagggcttggctcatggtaatgatatagctatttctttttttatggcatcagcttctttaattgtccagtatgattaattgggttttgcttgtgtgccaaaagtaaaagggaaaattcaccacctggcacctggctttctcatccgaaggagtttcatatatacagctacagtgcaattgcaatttcttccctggttaaattattacccgctccattccaaaaacaaaaatataaagatgcaacaactttttttcgatgtttcataatatgcatacatgcaattaattactagcacccctatttcctctaaatttgttttttaataccctaccctctagatctctaataccatattgggtgcattatatgcatcgtatttattggagtaattcaaacaagaaggtgatactattttttcttaatctttacattagtggtggttgtgtcttatattttaggatgaagaaagagtaattagcaatataatatttcaatttaatttttgtttgtatttctgaggaattttttggccatgtctcaattctttgttcggtttaattttccacacttataaccctaaaagcatctatatccctcaactctcatgatctgatgagaattgtatttctgctttatgacgtttccaccatcgacatataataactcgatgtacatcttcatgttctagatgaaactttagtcatgtttaatttatatgagtatcaaaggttcatttaccggttaacggtcaaattttcataggaagatttcaacttctttaaagaagtatgcataaagcttcgagtatagaattcagagtgtttcacaagtttcatatcctgttgcaaaaatgttctatgaaggttttagagttttggaggactactttatacaagattatcaccatgctttagcaaaatttgattatttatttttaataatgaaagtgataattcatagccttcaaatcaattaactatggatgcgaaaccaccatttcttgaactacgaaatccatgaaagaaaggaaatgaaaacgaaaactattgaatcaaacatgcagccaggtgtgtcttaaagagtgtagaagtggccatttaattgtctgcaattgcaacaacatccaaacattcacaaagtgtatgtaacattacagcagctccacttctgttgataaacaaacacgcgagaagccctttatttagttcttattatcatccatatataacaacatacaaaactagcattctatataggcttcatccatatgtcatccaggtagtgcgtaaattctatggatatcctgcacttccagatccacttcccgagccactgccagatccgctgccccctggaccactttgtccaccacctccaccaccaccttgtcctcctgcctgagcatatccgcccccgtaaggtccgtatcctcctgcctgacctgatccagaaccagaaccagatcctgatcctgatccaccattttgtccaccaccgcttccaccaccacctcccccaccctgggcatatcctccaccataaggcccgtaactcccggcttgaccatatccagacccagaaccagacccatagccagatccaccattcgccccgccgccactacctcctccaccgccgccgccgctagcatacgctccaccagacccacctgcctgcccatatccagaaccagagccagatccccagccggaaccaccccctgacgagccacctccacctccaccgccacctccacctcccgcactagcgtattttttcggtctagcataggctactcctatgactaggaggacgaggaaggtaagtagtactaccttagagccagccattgtgaagttaaggggatatgatgactgaaagattagctttgcattggtatttatagtgctggagaccttgcaaagctgtagtgcaagaggccacttgctcagtaatatatcgaatctgcaaacctcagcgagagagaaaatagcccggttagggaatactatacatatctgttcaacttctaaacttggccttattaagctggcttctacatatgagtttgacattgtacaagtcaatccactaaacctagtgaagttagtccaggcattagacttgtgcgtaatataaaaattttgacggaaaataaacgctaaattaactagccagagttgttactaacttaattaccactgctactaggagaagcagcgcagttgattggcacaaatcatgtggcgctgagaccttaaaattagattaattgttcagctagctgccaagctatagctctcagatttgtggtcttgatcgatttcattctctattgcattgggttttctcaaatacttgcagctagctagatgatcatgatgtgtgccgacgtgctcgcgtgcatcggtgcatgcccagatccccttcaagaattcttctgcaaattttataaatggatggtataatctttattatggcatgtgtgcgtgttttccttttctttttttttctttttctggtctaggatgcatgccttcctgtgcagcagtgtgctagctagggctgtcaacgagccgagctcgagcgagctcgtcagcctaggctcgagctcgatacaagctcgagccgagctcgagccaagcctataaaatgttcgagctttccgacaggctcggctcgagctcgatcaagccgagctcgactaccgagcttgtaaaaaatatatatatatttcaaagataacctttaaaaaaattaatttctagtttatcatactaataaaagaggaaaaaagaataaaataaatatattatgtcaatataagacatacaaataacatatttgatctcctaatttattaaataacaataaaaatgatatattactaggctcgttagaagctcgagctcggctcgacaaagctcgcgagcttagggagatgctcgggctcggctcgtctggagctcgagccgagctcgaatcgagcctagaacgagccgagctcgagcagctcgcgagcctcaagcttttttgacagccctagtgctagccagtgagatatatgaccgttcttagcttacagtatatatgatcatcaaagttttggcccatcaagttaaaacaaatttcgaagacaaaatcagcccatatatgtgtctcgtactccggacggacagaaaaaactgggcccataacatatgtatccctgggcgaataagtttactttcgtccctcaatttatcgccgagtctaaaatccatcctacaccgaaataccagatagaacgggtctctcaattaacaaaatcggatcatctgatgtcctaggcaatattatgtctggttttaactgatgtggtaagctgattcttcacacatgtaagtactggccacttacatgtggggtacgcctgggtcccacgctgactcagctcgtcacgttagctcaaatcagacataaaattgtctaggatctcgggtgatccggcggttttgtaaattgagggatctgttatatctgtcgtttcagtttatggataaatttcagatttgatgacaaattgagagacctaaagtgaacttattcatatccctggtttatctatgcactgtgctatgatatgggccgaaattgtatggcggccttgaataaatgggtacgtgtatcactctactctcagcctcatctttgtccaatatgaaatctaggatattttctttttaaaattttcaaacttaattttacattttttatgatttttatttaatttcgttttcataatttatctttaagtctatgagggcatatatataaaatttttactcataaattattttttcttgcgaataaaccgttttgctcataactaatcagctcatggtcaaccggtggtgccttttatcttttatttgcctgttcgatcattttcatttcccttgtaagctagcaacgaacgaattagtaacagtcatatcagtaaaacaaaagaaaatgaaagaaaactatacttgcaatagagaccacaccaatgaacaaaacattatgcatgcttcaattcattgctcttgtagagtgtcatcacatctcatttccgcatgctgggctaccatgcatcttccattacaatgatggagcccattaattattaagaaaaactgcctaattaaaacccaagtacaaaccctagaaattaaacttcttgtcggacagcataaaatgacgagaccaattcatgcattgtctcggcctcctccggctctagggtttcccgcgacaagcgaaaacctaccggaaatttcaatggtatccgccgctaccggatccggatcccttgccgctgccgctgccgtagccgccgttctcgccgccgccgccgccgccgcccttgccgccgcccattcctgacgcgtagcctccgccggaggagccatcgctgccggcgtcgccagcgccggagccagcgcctgcgccaacgccgtagctcggagatgctgctgggcctccgccgtgcccgccgccgccgccgccgccgccaccggctgcgtcggcgtagccgccgttgtagtcgccgccgctggatggagacggcgccatcgctatcgacgagccgctctcgccggcgccctggccaactccggcgccagcgccgtacccgctgccgccgttggagccgccgccaccgccgccgccgccgccctcgccatcaccggtggcgtaattaccgccgctgctgagagcaaccggggccgacgccgacgagccggagccgccgctcgagccactgcccatgccgtagccggagccggagccggagccgtacccgccgttggtcccgccgccgccgccgccgcctccgccagcgccgccacccctcccgtagttccacgtgttgccggagtcgccgccgctctcgccgtatccggcgccggcgccggcgcccgagccggagccccacccgccgttcgtcccgccgccgccgcctcctccgccgccgcctcccccgccgccggagtacgagttcgtgtacctggccaccctcgcggcaccagcgaacccgatgctgaggaggacggcgaggcccagagccacgagcttggtggtggcagccatggcgatcgagagagagaggtggtggtgatcagcggataggtttgcgcgggtatttatagcgagcggcggatggcgggagatttaatttcctcttcatgagatcgacttggcgccatgtgcgacgatcaaattaaaggagattcgataaccattaaccatgcatggattagagcagatacaatagcaggctataagccagctataaatatattttaaaaatataaacaatagcatgctataagctagctataaacatattttaaaaagataaaggaagagagagaagagcagcgagctacagatctgtagccagctgcagcacggactccaagacataatgtgtgtatgacaggtagggccaggtattaatagtatagtaagcaattattgtatgaattggctattatattgactatatatgatttagagcttgtagttggctatactattaaacttgctcttagtagtgtagtgcatagcatctgttgattgttgagtttgttgaccaacatgactgcatcgatcaagatgcctgaatttcctatgcgaactttcgaatcgatcaagatgcctgaatttcttatgcgaactttcgatgtggtaatatattttgttggcaattaattgatgcagaagtttatataattcggtgtggagttaattagattagctagctgtgttgcttggtttcttcgaagcctagtgagctatactagattcgattcccttcatctgatgacaccgattagaaatttctcctactggaacagtgtgcctgtgcatctcaatccttaattatgcaggtaatgctaagttcacagtgacaattaagcggtgctcttgcactattaacttccctctaacttgaatatgcatagttgaggttaaacaagtgaaaaatccgtatgtattgcgtcatgctaaattacaaaattattcgtatacgtatgtaatgccagtcctgattcgagccagattatatataaacccattggccagctgcctagctcgatcaaagtgtacgtagatgttaagcgattcgtatgaatgtttcattcgtcggtgcagcaactcggtcgagttgagattatcttctgctaagtagtccatcgtggtaattaatcacaatgttgaccagcatatggattgcggatttgcacacggcgtgtagtgcatcgacctggggattcaacgcgtcgccgacggcgaagtcccggaaaattattagccacattggcagggtgagatcgatgagagggcctcatggggttttttgtttagtttttcctctgaaagtgtatacttaacgtgccttaattatggctgtgcagacaccgagggagtaatcagcgacaagtcgcagtgttcgagttgacctcgagctctgcatgcagtggctgcatatgcagcattcgatcgatcgatcgattctgccaaatagatagtacacgagatgtgcccccagaaaagatgaacagagaagtatttgaaaaccagcaagtatacttgatgaaaagaaagatccaatatatccatctttagcaatgggaatctcggatccgatcgttgaaagtacaacaattgcagatagtaattaaacaagtagtagcaacttgatcagtagactattaagctttattattgtgagcttttgatttggatttgactatttagctaacagtatatgtgggcaaaggaaaggaattggatcgtcatttctacggcagaggtacagcagcttgtatatatatatttaatatttgtacccaccattatgtggtaaatatcgagaaaaaagtaatctgtgataaattacagatccaaattaaatactacaattaatatttgccatggtcgtaatactaatttatgatcggtaaatgtgatctaaaccgttaatatatgtgcgaaaaatattatactaccgttagttaatttggtattataaatagataggattcattaaattaagaaagttgacggtctagattaattctaatatcagttaggaccatcgtaaaaacatcttatacagtggtaaattgatttctctctgtttataacatatttataatatgttttgattttcttaaatcaaacctctttaagtttgacaacatttataaatatatatatatatatatatatatatatatatatatatatatatatatatatatagcaatattttttacactgaacaaacataccatcaaaatatattcaatgttcgatttaatgaaactaattcagtattataagagttgctatatttttctataaatgtggtttaaatttattgaattttgacatgtcaaaacatcaagatgtcttataatgtaaaatagaggaaatattatttataaatgttaaaatagaaagtaaattggtcatcgatctttctctaccagcttaaggtttttggttgagctaatcggtacatacatatatcaaagccaaatatctcgagtttagtcttggttggctgtaggagacaaaagaaaatcgatccagtttagcaaaatacagtaatcaatttaccgcttgtatatatattgccacatattgtttctctgcactaataacgcagaggatccatgcccaattgatcgaggcgaggagaccaaggaaattaacgcggcgtttggttaattacgcagttcgagatatatatgtggggtaaacatagtaggagtattcaatcgactcgttctctgcgttgaaattaaagcacgcatgcaacagtagcacccggcctcatcaattttcagtgatgttaatgtctacttgtcgcgagagatgatgaaattaatggcatcaaagtctcgtccaggttgaccgcgtatctgtgaaaaacaaaataccagttgatgtgattcacagataattaactgtgcaacagtatactgtagactgtaattaggtctaatcatgttgcttgattcttccaaactctgacatgatctatctaggaatctgccgtgcctctggctcgatttttgttgtagcctagaacgtaacacgccacaccaagctgcagcaggatctgtgcatgcatctcactggtcaaaaacagggttttgtacgtgcatctcaatgaccaacatggattgatttgatcgatccaaaataaaaaataatggtcaccttttttttaataatagaatataatattccggcttttgctcaagaagagctacagccaattattacagagtaacactcgagataagagtatagctcaaataaaaaagaacacacttaaataggaaaagccaaaataatgagaacacatttattccagtctatttatgaatctccatccatagttgacataaagttgcataaccattgtctccaacttgcgacatgcaactttcagaaactctccatcttcatcacacctttgtaattgtgcccaaaaccggagccaatgagttgccctgaaaattacctgcatataggaaatagatggtgatttgtcaaaaatcatatcatttctactcaaccatagagcccaacaaatggccgaagctccaacaagtatcagtttactctttttcttgtcaacccccaaaagccacctatcaaaaatatgagatatactaattggaagattaaaaccaaaagaaaactgaactgctctccatatgaattttgcataatgacaatccataaagagatgttgaatagactcattattcatacaaaagcaacacctcaagctgccgttccaaatccgtctcgccaaattgtccttagttaacacaacccctttaagcaagtaccacataaagatcttaatcttaagtagcatcttgagcttccaaatacacttatttctctcaacatagctattattaattaaagctaggtacattgatcttaccgagaatctaccgttctgatggtagttccatctgaaacaatcaaaagaacgattcaactggatatacacaatagaagcgcacaactcatgccaataatggtcacctagcaaagcaaacagagaatgggctggcttatgtgcacccaaaatgttgtgtgaagaagtgtgccctcgaaaatatttctcggaatactaaagtggatcgattttgttttgtctcctgcagccttaattaattacgagtatcaattaaatcatcacattatcaaatcgatctaagcttcatcagcaagccgaagtagtagttgggcttaggacaggcctaattttgtcttgctttgggcctctatgcctggtccaatccattttgcatctcacgtcctttagacgtggcttggaatgaatggataatttatggcttattttgctttttaatttctaccgagttttgccgtggcaattggtaaaccatcaacatttcaggcccagcataagaaaatgaatccatcgatctatattgggcttgctattcatcactcaactgatttttctaaaaaaatatatattagtcactttttgatacccctaaccacttctaatttttttaaaaagatattaattaactaactggtctcatctcactcactgtcgatcgagtactgatcaccacatatgtgcagcactatagcatcttcccctccctgacctcctcctatctagggtgctctaccattcgtcttgtcgtcaccaacacgagcgctagtagtgaagcttgtcaaccttcgcgttcccacgtcgtccctcactccctctttctgcttggttgtagtcggtacatctcatcatctttttgttgctcctgctaccagatctactgtcgctgcacccgcctcctaactaatcaaaagaatcgcacctgcctctaacactagcacacattcttccatccccgtggctttaacatcgccttgtcacctactcgtccctgctgctcatcatcggtcttctaccaccttggctatcgctctaaagttatcctcattatcccctacctcccacctggccaccacctctaagcctgaaacactaatccaaaggaagtttgtttgagttaatcgtcaccggtgggaccatcaaccctctccctctcctttcttcctatctcccccgtctaggtgttataacgatgcccttgttattaaattgtgatccaatgactagggcgaggtgtaacaaccctagtttgttggtagcccttgtagggatttgttcggttaatccatttcaagggggattgaaaggccctcattgagaagtgattaaccaaataaactatagtaatagtgtggtttaggtccttatggcccaaaagtggttggcgggtgaggatgagtttataaacctttatgctcccgcaatggtacctttagattaacccttttacatcatatacgacaggaggacgggaatataaatagggtactactgatagatgggcatgtttgacgtgtaaaatgaactaatgcagatcttaaagacatgatattagagtagctaggtgaatttcagtgacctgatttaactcttgctcttttttatgaacacaagaatggggtacaaatgcaacttcctcacttgagagctcagcacaaccatcaccacccccaacagaaccggagatctctacatatggtctttgaagatattatacatgcagctggttcaacatatatattagagcattaattgagatcatgtatgtgcccacgatttactgtgcggggacaggcacattattgtgacttcaagtgcagaaaattttaaagctgatttctagccattaagtgcggatactttgaaataatcgtgtggacatgcatgaggaactatatattatttttaagaaagcattacattcatgaaaaaaatccatttatttgttcctccctggcaggtacaagtttaacaaaacaaaaatcatgagataagaaagctaggttgagctagctccaatgtagctaagaacgatggcacaaaactaaagatctaagggtttgcatcaccataaccagatccaccacctacgccattgccattcccaccattttgaccaccacccgttccaccaccgttagcagaggcatctgcatttgcatatgatgggttcggcgaggagaagccgccagctccctcactagctccagatccagttccaaaaccactcccgtagccactggatccaacggtgccgcctccttgcccaccaccattgcctccgccacctccaccagcgctagcatccccagtataaccttgataatacccgctgctcgtctgactagagcttgaacctgcaccaaatccaccaccgtatccggtaccatagcttgttgcaccaccacctccacctccaccacttgaatgcgcgtgcgctccgtggccactcgtagccaccccgtacccgcttccggaccctacaccacccccattcagatacccaccaccattcccccctcctgaacctgttccctgagcattggcatacctagccaccctggcagcatgggttaagccaatgctcatgagaaggacaaagctaagcactgcaagctttgttacagccattatgaatatagctagctagctaggtgctagatggaatggacggcaaatcaagaattgtgtatttatagtgctggaggtcgttttacaggttctacatgttactagtatgataacatgatggaagtgtctagatggtgagggtcgacagtcaggtgtacctacagttaaatttttttaattaaccagatcgaatcttgtgttgactagcagaaatgataaattaactaactttgtaatgctcatcccaatgattcaagctagctattgttcagtggctgcctctgtttccaaaaactatggtacactttgtgaaatgcttactactgttaaaatgcctagctgtaagatatatgagaagcaaattcacatgtattacactgttcaaatatttcttatgggctctttctccttcgaattcgtttgacaaactcccatctatttgagaagttatgtactttttttaagataatgggaaaatttcattaataaatgaaattacactaggcttttgcatccatcagggatgcacagccaaaaaacaaaagagaactaagacagtctcaacaaattaagctcaaaacctcatcttaatgttagatgaaattagcataatcactcacatagaacgtcattatttttacagtcaatttttataatagtagagattaatggaaatggagggctaaggcccttcgataaaaaaaaaacatagaacgtcatagggaccgtctgtacactagaccagttttagttagagaaacttatctactaatttagcatctattaagcacgttatgaactatatactcggcatatgtaaggcatgatcaacagagcagctgtagaatagagcaacaaactagcaggttttcagtatatgattgattggctttcagtttcagtttcagtcatttgagttctaggtagaaaaggcaaataggcgatcgacgaggcagagaccgttgctgggtgtaaatttgtcgatgatgcattgtctttgtgactttcacaaagaggcaaggcaacgacatgacagttcagactgctgcaccagcgaagatgctcatgtctacatcacgttgtagctctgatctacatggagaagctgtctcaactctcatcacgagccatcagagctaccccaaggagacaagcagatcagagctactccacggcatattgggcacaaacagttacacaacccatacagatgacaactacttttacaacaagcagagagccaaaaggccgcaaattttgttcaatcgccatcaggaactttgaatgggatgctgctagcatgatttggctagaaaaagttgtcacactaaccgggggtcatggttcattcaggttgcgattacttggacttggacgatttgtgcttcttttttgggcgtgacccttcattacttgcaacataagactcgagtctcacattttcctgtgcttcactctttctgaattcctttgctttcttctgcaaattgagcagattcacatattatgagatgaccattctaattacggtaaacatgtcacgctcccaagaaattaataagaacgaaacagtgtttacctttagggacttagccatatcagcaatctcgtcgttgttgctggtagacttggcagattcgtatggagttgcagtgtcctcctgaaacaaattgttattatttagaaccaaaatgaggaagataatcctgaaaatacacaaataagaatattctaaacctttggaggaacaaatgcagcttctctctttcttttgttctcttcagctttctccgattgcttttccagcttctcttgccatttctttgcggacttctttttgtcactcatgaaatactcaccactctcaagttcaagatcaatctacaacacccagaatgaaacgttcaataaaatggtattgcagtacccaaagcaaatagccagcagtagctacacttgcactacaagcatatcattaggcaacgaggaaagaggaaaaacacatgacccatggatgctgttttcaccaaattataatgtagcaaaagaaatacactaatcttctatacaaataaaatgaatatgaacagagcaacctgcataaatacacaagttgtaggaagcaaggaaggactactaatcacaactcatatgctggtcaaaaccagtataacaaacagtacaagtttgacactacaaacgagtttaaacataaagaaattacttcaccttgctaggttgctgaggaggtggaaagggtgtgtatggcttcttctcctttgttatcggtttcttttgtttgacatttttcctgaggaacagcaaaagcaatgatgtataaggcctttagaataattgtcagtagcactaaacgtcttaacaaagatgatgcaagttccttacttcttaaacttcgggagaaacctgtcccagctttcattggctagcgcaggatttttggccagctcacgtttaattaggagttcctatgtagtttaacagaaaatataagtaataatcaacaatagttctgtaggaacattccttgaatcaaacatctgagaaacaaaacctgttaccttgatgtggtacacagggtgcttgatgttctttatgcagtcctccacaacccttcggacttgtttcaatcccttccaggaacccatagcagcaacagtgtttcccttttaatatagcaatagcaatcaaatcagttgatataaagagtaaaaaggaggttatcccacaatgaaaatttaaatgtagcacataaagtaagaagtattggaaaacctgaactaagatgtagcagccagtcaaaatctcgatggcctgcagttcataaaacagcatgagaacaaagggatgttttttctaaccttccaataatgagatgtatcaaaattgaacatattacaagcagtttaccttgagagtagataaattagggcccagaagacgttctctccttttaacgaatctttcctgcagatggcacattatgagcaggctgtagagtaagtaaaattcatcaagactgagtgaccgacaaacataggatgaagaggtgatgattgcattatttaccatatggcaagctgtaatcatgtaaaaaattacacaataagttaaatcagactaattaaagaaaccatatgttgtaggctgtagctcgttaaaccagtttgtctttttgtatttacaagacaatacagataacttagcacagaacccgtgaatatgtgatgcaggtgcttcagattacgtatttatgtacaacaagaaaatccataaacgtcagaatagctaaatcttggatcaaggaacagagtcctaatatgaaaatacaaagctgcaaactataaggtgaccatcttggcaataacatcatgggaaacattcagtaacagatgtagctatttggaaacaagaattgagttgagcctcatgaggaatgggcagaatgttttccaacatccttatgcgctcggtatcatgattatattacgtgactaacaaaagctggtatttaaacgtacatgagtggggatatttgcaactgatgacttactcaaagttaatattaggaggcaaattgatattaaaccatgatggaatagcctaccttgttccgtataatactaccaatcttgataatatcacagctcatctcatcgttgagtattttaatcgcctgcaaaattcatcagaggtttagcgacaaaacaagtcttacacaaagcaagcgtaggtcagcaacacaatattagcatcatgtggtaaggacatattatacctgaatactagaaatctaaattagctctcacattttcctataatctaaatgactcaatgcagtggatacaaagagagtgattaacacctgtggagcggggacgctcctcgacaacaattttatcagctccttggccttaacgataatgtagggatccctggtcttgcgcgtggtcgaaacggtcatggatccttccacctacacaaacatcaaaaaaggatatctcaaatctcacccgcagaataaactgaagaatatcaccaataatgtcttatcactcatcggctcatcgccgtaccagattgagctcgcaagcgaccccaaactccttcagcgcgcccttcacaatcggccacgcctcctgcaggtacttctctgcatccatccaatccggacaagcaaaacctcgtgaaattttcacatcatcttgggacttggggatttctatcaaatcgaatcgaaccgcgacttgcctcggtactgggggaagagggtggagaaggagctgacttcgagcatgccgccctcgttccacgaggggtcgaacttctcgatcttccagtggtcgatgttggggtcgtcgtcccacggcttcggcttgtcgtgcttccccttgtgccgcggcggcttcttcctccccacctcctccgccgacgacgcggcgttcgcttcttccccctcctccgacgccatggcggcgggaagtagtggaggtggcttcggccgaaggggtggtcggcgtcgagggggacggcggcggtggtcggatggtcggacggcggcggcgggggagaggagtgaagtctgggccttacagtgttacgaaattttagggttagggtagtgggtggtggtgataaagcgatgggccgaacgggcttttactgggctttctgctgaaatatggtcttgttgggcttttcggttaacagaggcatatgatcgaacaaatcgaaataagagaattgaggaaaatttgttggagatttatttcatatttattgtgatgtgaaattattctcactcaatctccaccgatccctctctatttacaaacaaattgtgctcatggggttaggggtagtgttttattttgagaacttgaggcttttgttagctttggctaggcttgaggcctaatccatgggagaaaaacaagtgactagcatgaagcaacattgtcaaatgacctttttatacctcaaacaaaaagcacaacgtgccatcattctcctagctctccatttccattcctcccagcaacttgaactagatccaagtaccatgccttcaaaattgcccaaacttaattggtgtagggacaggaaacaacaaaaagtggtcgcagtcttcatcaacagagtctcaaatgtggcatttctatcgatgaggcttatctcacgtgatgaggttatcaattgcaagacatcttcaatgatcgaattgccaaccaaatgaagaatttgactcaggtactctactactctagccttctctagtgtggcatagatggagtcgaccatcgcgtcgaagagacttttatgttagtccattctccggcactgtcatgcctagctagaaggtggcatagttgagctacatgttattctgaccactttcttagtcgtgtttgtaggtgaagtaggggtacacattggctagaagaggtgatcatgtgccggtggtcaccaagcacctcgcaattggcgtatgcaggcataagttggattgtgcatctatggtagtttacagttaaatctagttacgctcctgtttaatttggcacatcctaactcacattacgtcagtacatagttatatttcctttatttaactcgtagaaattaaatttaagcttgtatgattgttatttaactcgtagaaattaaatttaagcttgcatgattgtagagtatatatatcacatttaatctatcttgttatttttaaatttttttataactatttagcagatgacatgtacaatggatgttccccatagagattaaaagagagtttcccatgcttatggttgctgaagtgcttggactttgaaagatgagatacgcatttagagggaatattaactctacttcttcgcggctgttttgtaagagaatgattaacaacgttcagagatcagactggccgagaaagatcgaaaagggaaattaatcctctggtttggcgagaggatggatcatggatgacagtgacacagtggaaagaatgcagcaaaatatatatttgtctttttaggccaatttttttatttatagtaattaataatttacaaattaaatatgtggtaaataagagctcctatttagtaaaataggatggacgctaactctaatagcgtccaggagcggacgctgttcacctcgatgtccacctctggacgttgttcatctcagcgtccactgcctggcaccgcctcccaacctatatcccacaaaatacagaaagaaaaaactacgtatacccatatatctcgtcgctaacacaaacaactggagtatttggtaggcgacgctcgcctcccaggcaggatcggactaagcggcagcccttgaaattttccgtttgtcgcctgccgccctcggcatctcgctgtaatgaaggcatgaagctttcgtttccgccattcacctgtgccgccgatggcaggcccaggctgggaacaggcacaatgagttcttgtgcgttaatcgttattgaaaagctcacgcactgcctcgcaactcagatgaaatacagatgtaactatttttgtgggtattcacatgaagtagaagaaaaaaataaaaattatacatcacactcctaaataagtccattcatataattgagtatttcggatttcagaatacgtgcatgcttccaaacttcacactacagaagaatatcacaacagtaccaaacaatagatcatatgactataggcgtgtaagtaattcagtactagtacacatagaaccaatcaaacagaaaagagtcatagaaggtctgaactctcatgaatacacatacatatgcttctaaactaaaacacatctttgagctacaacagcaccattaactgcaaccccaagcaaaaattataacttagatttccactactaatcctaaaattacttgtcgtttccaaaagaactgatagatatggttcttgtgtccttggcggatatcgccatatcaggctcccgacaaggtggggacggcagcggcttcccacttcccagtctcctgttggatcggcggcagtaagccagtaactgccctaggccctagcctcgaatcctcgatgccgcaccagttctccctgcagggattcctcgcttctatttctcgtatatagaatggatatggctttgggatagttaggctgcacaacatagctggacgctgaggtgaacgacgtccagacctggacgctatggaaagcaacgtccttttttggacgctattagaattagcgtccatcctattttgctaaatagcaactcctatttaccataaatttaatctgtggattaataattactataaataaaaaaatcggctttttaggagttctatttcttccagtatagtgaggtgacgagatgcattaattgtttccactgtaccaaacctattattttttcgaaactaatcaagttgtagtataaaatacacagctataggtatttcaggtgatcctggttcacaatctatctagtcgtaaagcatgtggaggtagtcttaataaaagtggagatacaagtgcacaaatggaaagaagattcggagacaacatcatataaacctgatcacatatagcactcaaagatcactgtgacagcttttggcattcccttgaactctaaaagtgatacattaacttaactaattaaaattccttccaaaagagaaaaaagggtacaacaaactagaaatgatggagccctttattagttgctccctaatacatcaaaggataaaatcaaaacaaaacaaatactaccatatcaaggtgaatgaaattattaatgataacgtgggctccaatgtaactttggtcggcacatagaaatgaaaattttaagggttggcatcaccgtaaccagatccaccacccccaccgcttccgctcccaccgctttggccaccaccgttgccgttaccatcgccagttgcattggcatttgcatatggcggggaggatgtaggggaagcaccaccgtctgccgcagcagatccggttccgctgccagtgccagtcccataaccgccggatccatcaacacctccagcttgtccaccggcaacaccaccaccgcctcctccggcgctcgcactcccaccaccctggctcaccgagcccgagctcgagccttggcctgatccagaaccaaaaccagtaccattgtactgcgagccacctccaccccaaccccctcccccagcattcgcatgggttccgctcccgctctggctaactccataaccattcccgttccctacaccgccgccattcacgtacccaccaccactcccggtacccgagccttgaccttgagcattggctaatctagacacccttgcggcattggctaacccaatgctcatgaggacaacgaagctaagagctacaagctttgttgccgccatttttgagcttagctaagtatgcttagatgggatggatgataacccatggattgcttgggtatttatagggctggatggaggtgttcatagttatttttatgttagtggcatcactgcaatgcattgatggaagtgtctagaatatggcgagttggtgaaaatgtactaggtctaggagtgtagctagctgtagctagtgatacttatttttaattaaccggccggatccaatcttgtttgactgccacaaaacttattactataccccgtaattaaaatatgtgtgatgttgacttcgaatcgcttaaacctatagcttagtccaaattgagaggtgttgacgatgagcatctgaaattcatggagggtgttcggatcgtaaaggaaaagatctcatcggcacgaatgatctgatccgtaaaattcattcgatccgacggttcaattcactgacaactcttcgttagagcggtcggtgagccggccggcatccctgtacttctaatcagttgcacataagtgtgttaaatggttaaaccaacgaaaaccacttaactaaaataagttatgtatttacttattttgatctattagtgagtttgcgggttaaccagaatacattcttattgtacgttgtgcgagctgttcggtgcgctggtcgatccattgaacgctatctatatatcttggccgatgttatgtgccgtgccaccgctgacgctgccgacgatgccaattgataacatttttagtaccggttgataaacatcaataaggactaaagattcaccagcattagtcctgattggtgctaccaaccggtactaaagatgcatgtttagttccggttggtagcattaacatagactaaagatatttcctcggactttggcttttagaactggtactaaagagttttagtacttattcttaatacatctataatatttgtggtttgggacattggacaaaagatgagttctttggtagtgtgcgctagtgtgtgctcgcattcagttaagtgatcattttacgtacacttcatctgaccatcgagggaagagcaatttcgcttggcggatccggatacgtttgaagaggatttactgtgtaaatttgtatccactggcagctgtttttttttttaaagaggagaatgcgatgctgagacaatgggagactatgttttcacatacccgatcgactggctgaaataaatgagaaaaataccctggtttggcaattggacacaacgaaaacgcaaatggttttgctaaaaagaagtttcatattattatttttctcaaaacttttgaattttccaccatcagatatgctttaagatttgtgctactgagaggaaatatattagcgtgcgcgtgcttggaaggaatcaaatccagatacgttgcccgtgtggctgttgctatataatttacatgctaattttaatgtaattatgtttaaaagtttttcattaagaaactatcaaatataactcaaattaaggatggacaaggatatagtgaaaactatattgctagcatctggcctgaagctttgctaaaagagcacgtagtttagtagttgcagtgacccgagtagcacatcaagtttctaagtttaaatcttttttttttcgaggggactgagtttaaatcttcattaggagcgaatttcagattatattgtttgagggataatttaaaaagctggatatatatccgaatggatgtagagaccgggtaaaaaaaacccctttgaaaaaaaaaaggtcctaaggcgatgatgccaccatgagaccaacccactgcactttccaaccgaccaagttgctagctgtagtacaaaatcgagctagctagttgaccgtcgatctcattcttcaaacgaaaagtatcttcctggttcaatctagtcttaaggcatgtggagatagtcttaaagaagagggcgtgcatgtgtatacaaatctaaagatggtagcaacgtccggagacaacacacatgatccggatcattttagagcactactcaaaaagattgtcatttctcatagataatggatatttcattaagcaattactcagagatcatagtggcttatatagttttctcacttgtttgtgaactctaaagtgatacaataactaaaattcctcccaagaagaaaaagatacaacaactagaataatggagccctttttattaattagttgctctctgatacatcaaggataaaatctaaccaaatcaaatactacaatatcaggataaaaaaaaatcaaagatagtgtgggctccaatatatctttgattaactacataaaaagaaaaattttaagggtttgcgtcaccatatccagatccaccgccaccaccactaccactgccaccactttgaccaccaccgttcccattgccattgccacttgcatttgcatttgcataaggcggtggcgtgttaggggtaccattgtttgccacactagatccggatccattcccaccgccagtcccataaccaccggacccatcaactcctccagcttgtccaccgccattgccacctccacctccaccagcacttgcatgtcctccatagccagggtaataaccttcggccatctggccagagcttgagcccgccccggatccactgccaaatccagtaccattgtactgtgagccaccacctccccaacctcctcccccagcagttgcggtgactccgcttccgctctcactagacccataaccattaccatttcctacgccaccaccgttcacgtatccaccaccgttcccaccaccttgaccttgtccctctgcactagcgtatctaaccaccctggcagcattggctagcccaatgctcatgaggactacaaagctaagagctacaagctttgttgcagccattttgggctcaactagttaagaactttgatgggaatgggttgaatggcaaagcaaggattgcttaggtatttatagtgcccaatcgatagagtcttgcacttgcactgcagcacgcatgcatgatccaagtgtttggatggcgtgttggcgaaatataggtctatgagtgtagctagctatagctagtaaaacttgtgtttagtaagccggatccaatcttgtttgactgccacaaaacttacaaattaagtctgtgtgatgctcatcatctcgtatatcgcttaaggtatctatttctgcacctctttccaatggctagctaggcactgcacatcctgtacttccatatatactggctatatagtagcagggtgttactcaaaccaccggtaacctaaccgcgaggttaccgtagtaaccacgcttatcgtgcggtacggtaagggttatcggtggatggtaacgtaaagcctagctagtagttcgcatgcgagtatatatatatagtcctaatataagtctaaatttcattattagctgaatatagttttttcgagcaaaatataggcatataaactgattggccggcgaaaaaaggcatgtaataaagtgatctgatagcagatccagttttcaggaacaggaagttgtgaaccaaccaagggtgtgtttagttccacaccaaaaatgaaagtttgaagaaaattggaacaatatgacggaaaagttggaagtttgtgtgtgtagaaaagttcgatgtgatttttttgggttcaaactttgcaactaaaccgacccatttagctaaaccaaattctggaaaaaaaaatcaacatcacaattaatgtagcatcatatataacgttcctttaaaaatatataatgctaaagaaacaaatataatgctaaaggcacatcagttaacgaatagtaattcatcgggggttccgctttaaattaatctctgttgctacattgaacgatgagtagaggcgtggcttgattacttggatcatgtgtcttccggagattccccacgaaagatgagtcgatgccgcaatccctaccaatttgaccatccattcaccattatggagttacagctgaatgaaccgatttccgataggttccttcgtcagttaatccaatgcacaattaaaaactcatcactgatagagtttaccagatcagtaactaattaactgttaattgattaggtcgatcgatacgtacagtgtgtactccactggtgaaaactctgaacaattttgattaatatgcattacaaccttagacatactttcattaattgttcagcaggcgagaagacgtagatgtctgtaattaacttgcatatctactgttactgagttactgacacacatcatatatataccacaacgaagtaaaaactgccagatggttcctacttcatccgttttacaatgtaagacttttctaacatagcccatattcattttgatgttaataaatctagagatatatatgtatttagattcattaacatttatatgtatgtgggtaatgctagaaagtcttacactgtgaaacggaaggagtagaagaaattagctagtagtaaacctggccgatgcatgtggagattggaattaatctgaccattcaagtcatcgacaactgtagcaaaaattaagaattctacattcaataaatgtacatatgcaaattttatatatacaggtgattccagatcataagctagatcatgccgacgagatatgaatcggtgactggctgactgatgcaatgcaaaacctacgcgatcgacgtgcattcatgccggtcgacaggctagtgtacgcgtcaacttggatgactgattttattattatctgcaagtcaaggagattgcaggcgaggctagattctgctactcatcaagttatatctgtactgaggtctacaagtatatataatatatactacaagatataaacaattgataccaagcaaccatgcatataataatccaagggataatcactctgatttgaaatacatgtacgtgttagacttgtacacaaatcaattaagaaaaatcatcccaaatagcttagttgttgtccataattcactctagattggaagcatgaaaaaaatagtatgttagaccaatgcaaatataaaattttatagggtatttaaaagaggtccagattttcggagtaacttacacttaggtaagagctgagacggccaaacaacttatattggaattgaagggagtaaaaatgtttcacccttgcactaaaaccggccggttatatttcacattttcaccttcaaattttaaaactgaataaataataatataagctatattctatcattgttttgattgaaatatagtagtaatcttctatatatgaaggctaactattgttagccaagttttatagggtatgtaccaaattagatagtatatctacatcaacaaaatgagcattttattaagtgtttgcaccagtgaaaatcaccatcatactaataaaatcattatagatggtatgttttatctagcttttaaagttgtgagtaaaaagcaacattttttttgttcgtcaaggaaaattgacttcgagaagatcagttagagtgccaagaatagactttccatccatatgcctgaggtcaaaacgggctacccggatgccagcgctacctcctcaccattctgtcctcgtagtcaccgtcgtcggtcatgggaaatcatgcagccgtgaggatagcagtggcagggcctcctttttccatgccctcgaaaattttctcttggcatggcgaggttggcgtggcggatctcgccgttcgagatgggctagagacacagtggtggcacggctagatggagatgacggcatcgttacagcgggatagagacggcagtgtgcgtcggatggctagctcgcaatgaaggtagccatggcagaggcgaaaggcataggggatagctggagctgctttcnnnnnnnnnnnnnnnnnnnntccccaaacaaatctgatgatagtgaggctgtccacgattgcagaggtgacgatggcatagactgcgttggtgcaagtggtcattggccgacgaggcactggcgtatgtgccagcccagggtgcgttgtgtaggtgactttgtcacatattaggatgacggtggtcaggcggggctcaaggtagctagcagggaacatgcccgctagagaggtcgcaaggagaggctgcacagagaggtggggctttcgcctagaggagcgcttggagagaggcatctcggctatgtttcgaccgctaatgctactcgggtagccaagacaccacttgctagctcggatagcagggacacaatgagcaacagtgtggatggcggcctagacaacagcgagcgggtgtaacaccccagcccgtttgaagcctagtagtagtgtgtgtttggcccatgtggcccagaagtggatgtgtagtggtggtttagtaccacattggaagtttaggtgggtgagggcctgcttataagccttggtgctccaaccatggtatccctgggttaacccttttacacgaagcgaggataaaagtgtaagcaggataccatgcgaacgtgggtccgctcaacgtgtagagcgtactaatgcacattttggaggcagggtgttacagcgggtctcctatttccaggtggacctcttccctcccctaggagctaccctctctaatggctatggggatttagtttgatggaggatgggagaccttcgacatcatcagcgttttgagaaaacctatgtagaaggtgtaccgtttgttgaggtggtgtatgaggcttctgtggcacgactgcatgttggtttcttgggcagagtaagagctacttggcaccatgaccctcaacttcttacgtttttgcagcgctgagaaggtgtgataaatgtggcttatgcgatgtgactgcttgctggtgtgttggggcgaagatgagctagttgccggtggtggcaatcttggcaacgataaccgtcaactacttctgttctagtagtgctgcgatggttgtggaagtcgtggttggtaggtggtgagagcattgggcaaaagcctttgcgtggtctacccggttccgatgacgtcaacacctatgggtaccctttcccttcttgaaagcatcgttgtgttgtttcccactttttttttcaagtggaaacctagtttcggtgttcagacaagcgttgaaagcgttttagggtgcgttcgttcgtggtcaagattggattggatatgaccatccatatttgtagggatatgttgatctagttttttatttgattggatagatatggccatttagttttctgtttggttggatgaatgagaagaaatataatgcaaataaaaacatgctaattaataataaaatatgttaattatcaattatatagcgtaatctatactaattaacaacaaaatagactaatatctaattaacactaatgttgacaagctaattactaattaccaacaaaatatattaattattgccaatttactaatgattaatattagtaaagctggatatcctcatccggccaatttaacgaatacgctcatccaacattttagtggaatattctctccagaccgcccatgcacccttgtccaccaatcaaacacactcaaaaactggatcctcatcccctatttaagaatatattcttccaaccaaacacacacttagacattagttttctcatgcatggaaggtcctgttcctcattggtaactgaatttttctaataaattagattaactatcttattgttaatggaagcgcaggaactcctggtcttcttttcaggtttaccttttaaaaaatttgccctaatttgattaaataaatatataaaaatatcaaaatttttccataaacataaaaaatacatcaatttttcatagctttagctctcaaatatatagacaactagtatcttgtcacttgtcagagcttgcactagtgaaaaccctaggcatctaaaaaaaaccatcttagaaaaatgttgtttatctattactaatataaaaaggaggagttgccccctccaatcctactggtgaaatcacccggatcatccctaccgtccatccacatctatctactaatccggaccatccatcttcttctatcctaaaccgtttcgtcgtcctcctgatgagcggtggtcctcgcgcggctcttcctatcctactgccgactcccgcgatgaccgcgcgctgaccacgcctcgctcctcctcgctgattccaacagcgatagcgattccactgattccaccaattccgccgctgttggatctccactgattccatcaattccaccaatttcgccccgaagcggtcactccgccacacaaaacccagtcgcgatgactccgccgtgcgcatcctctctcgctcgaccagcgccgagccaccggcgcactgccacaacgccggatcagcgccgagccaccaccgcacaaccgcatccccttccgccggtgccacgcccgggactgcccccgacgacgacggacgcacgcccccattgctcctccgcaaatagctcctgagcttcacgcgaagcccgtgttggccccacgaaagcctctcctccgcgaatccctccccatggaagccctaagctcctctctcttcctcagggagcgtcgccgatccgtgggtcgctgctcaccctcccgtcatcggctgccaccctgcgtctatcgccgtcgctgttggatgcaggtcgttgtccggcgtttgactgctctcgctatcggatcaaggttgtcgcccatcgtcgggcatcatccactgccaccgccgctcgccggctcgccgtccgatcgagcaggccagcacccatctccagcgcccaccaggtgagttcccacccttgcactgcagccaccctagccaccatgtccaattaccatgaaacattctctttcttccctctttcatgttctttgtaggtgaaccaggtatagaggatgtggtggaggcgtgggggctaatcactatcagttagattttcgtggatcgagcttattacctgagttttctcctcttcggtgatggagccggttcaggtgcgctgcaaaggaaatagttgccacacccccaaaaatcaagtagtttaaatacttctctgttgaataaactagcataaacgacataacggtgattcagtagtttttgttgttatagttgctatcgttgttttcttgcaggtgaatgtgctcttatcctaatacggcatagtgaatcattgtggaatgactgaaatctgttttactatggaatgagcaaaaaatgtttacttgcgtcgatgtcgagaaggttatatatgtcgggagctgtttggaaagggttttatcggagcaacgttattgggaaagtattttgcggagcagtttggaaagggttttatcagagcaattctgggaattgtacttttattggatcaataatgattggaaaggattttatcagagaaatcttgattaggaaggtatatgtacgtgtggtcagaaatttatccctttgcaattcaatagatgcattctctattttgctaacaggaattaatttgcatttttttgtaagaaaacagatgatgtgcattgaaataattattgttctttgagatcttgataatatgtttcttgtccaggcattcccatgagttgcaaatccaaggaagttaataacacgacctgtctacaggattacaagctaatcgatttatcccattacgagctaaagctcactggtatgtttttgtttctctgccattcaccattgaaatatggaatgccatattcttttttccttcgatgcgctcttaattgtctgttctaatttcttcaaccactaataatttgcagtttgatattgctttatcccgctgcttttccattagaaccaacaaaaggagaaatgcctttagctgaagttctcagattcaataccaaagttgattgtttgattctaaacgtaattatcatggtttcttgtggtcctttaatggtgatattaagatttgggcaaaattggtacaaaagcaacatgcccaaaataccttggtagcttccccatttctattatctctccaatttactcttaaattgtatgatgcaacattgtcaagtttcatagtagttattttggactcacctcttcaaagtacctgtcatctgggttgggaggtaatttctaaatctcagctctactatttgatgatctgacattcatattttactatatacttcttgtcactagaattcctgctgcatacgtactagctaggtatttcctcttacaataatggttgtcagaattagcagcatatcagctcaactccatgcttgaacaatctgagtttttctttactccagaacacctgagagttgacatatatgatatatttaacagattgtgttgattgcgcataaagaagtagccgaacatatttctgctatgcacattaacatattggtacatatttacaattctatttttacgaggcactatgctactgatagtctattgatgggctacagctgaatttattttaaaaacaactactgttttttttttcacctacgttgccattcctccgttcctgcatgtccactttgttgcaaatctagaattgtggagaaactcttgatgttcatcatatgccagttcatacttttctaaattgccaaattgaaaagagggttacatatttattcagtcctatctgcaggttggaaattgtatgcagctagctagatcactttcttatcacaactcacaagattgccgctttattagctatagtttgaatctaggatggtctgccataaggtgctttaattacttctatgaattttgttaaatcaaaattgatccatttgtggcttttattgtttgagattgaaaaaaaaaatcaggttgctgctcaagagcaaaaggcaataacatggggcagtgataaaactatttttgggcacagttagtctgtgaccatgtcttcatgggcataaatgaaagggaaactcattgttaaaaaactgaaatggaaacaacttttccatggtaatccgattgaccatcgctcagatattggatatcaatactgtaattcataaagtgcagaatacatgatttagatggagaaaggcaatacatgaggaagatgttttgaacaaaatattatcttaggttaaactaatgtttgttttcttatctggtgttttgtacccttactaataataaatttgttactataaattctatctcattatatgcttggcaaaacatatatcttattttggttgtttgatttgtattactaaatatttccgtagcgttagcacgggtagattactagtttggttttaaaagttagagatgaaaaagcagttttcatggtgaaaaatagcctttgagaagaattcaagcccaaaatggacttctccttttctccataatgcaagtcgtcgttgcaggccggttgattaacgagagcacacacatatggtccaacacagactgacaggctgcagctttggcactggattaacgaatccactaattgggtcttacacgttgtgacaatagcctcatatatacgcttgatactattacctacgtgtaactaaagcaagctaagctggtctttaatttgcatcgggcctggacaactaccgtacttgatcagaaattttcagtaacgcaggattgtgggcttgatttattgatcctacctggcctgcttgggcattgtactcctttcaggctgtggaatcgattgaatccagccggttttgggtttgggctccctccggctgcagagtgcaacctgagccatcagtttacatggatattaccgcagagtgaaaccccgcgcattgctgcgggaatttagtatgataacaaaaaaaataccgtataagatagttagataacatcagattaagtaaattaatgtgatttatgataatttaaatttaaatagtatgtagaatggtgattcaaatgtaaaaagtaagctggtataactttatgaaagaagaaaagtagggagatagtttgggccgtagattaatcatctgaaggctaaagataatttgaaccatagattaatcatttaagtactaactaagtgagaattaactatataagtatataggttatcataaaatataataacgatgtacattgaaacattatgtgaattatgttagatgataaattaacatgtttgtatttaaaaagctcttaaattataataactataaagatttagcatgcttgcatgatgtttaaatgtgatgattgttagtggatgatgatgtggcatcttgttagtggatgatgatgtggcatctttgcatgtcaagcttaaggagttagtgggggataactttataggaagataggattacaggcttacgtgttgacagggggactgtgcggtgcatatgtgaaacaaaatccagtttgattccctcgaatataggtaagatcgatctaattcgtatgcaacagtcacttcgactcctccaacttttaaaattaatttaaaattagtgactctctgatattgaacatggtattggcttatgtggtgtccatgttacatgttaacccaatcttaatctgacgtggcactcacgtgttacaataaaaataagaaagaaaaaaaaaataacggagggcccaaatgtcagtgtccctctatcttcttctcattccctcactactcttgctctctgcctctcatctcttaggttcagcccgcaaggtgaggatcggaggagaagcaccgagacgaggacaaactgtcatagctcgagctagagcggcttcccggcgttggcattatctgcacgacgtcgtcattcatctccgcctttgcggatggtgatgacatggtggaagccgtccatggaggctgatagcctgtgcacggcgaccacctcaattgagaagaggcagaccggcggctgcgatgaccaacgagctccgttgagctcgagttcgctcgctgatctacgagagaaaggagtcaaccgcggaaaggaggctgcggtagcggaggcaagctttggtggcttgacggaggattggcatcgatatgtagagaagatgttgacatcaattgcagcatcttgtttgttttcccctccccctcctaacctaggcggcgatggcatattttgaacatggcctaactcgagctcgagtgccaagccgcgctggcgccacccatcgagtttgatcaaagtggggtgtcggccggtgaggccgctcgaggttgagctcactcgcctatatgtaggaagagaggcaatggttcaggttgtctctgttgcctatctctactgtcgtcgcctatagggtgaccgatgcttgttctaccaccacccctctaccatcgatgtgtgcacaactctactgcaaccccgtcgccgccctgctgcctctcctgaacctcccaccaccggctgccgtcctacatccttgcggccgagaggaaatacagcggagagagaagcagtagggaaggaaggagagagaagggataatacgtgggcttcactctattttttaatttttatgatgactggactgccatgccagctaatctctaagagttattttatatcgttagaacgattgaggagtgcgaatcagattctaaccatatttagcgaagtaaagtggacttttttccatgacgtgtgatggagaggaacttggcccatgctgcctccggcgtgctccatccatccatgccactgccgccagcccgccaaccatcttgccagcctaacggcctcatttgtttgggggcctaaattaatctggcccatatatatgcttgaaagttaaactaaagtcatattctagcctatctatcgacctaacggctacatgttaccctggctagtttcgtcatcctcttgtttcagtgccctgtcagatttcaaccggattgcgcatcctacgcgtctcccccaagacggcaaaaagtttgatgggagtaacagaaagatgttcatgcgagagtcatcagtgttcatcactcatcacaccccaactcatctcgtgatcaaccttcattacagatttttacagagcccaattatttgtatatatgaatttcacgcctaaatgactgaatcgggagatataaaacaagagtaatttttgtgacactaagaaaaacagaacaattaatataggtcgggctctagctagttttatatcgtttggtactttgaagcgattgataagagacaactttcatggctctccgttgccatacgcagatccgctgcctttgccgctaccgctcccaccgttctgactatacccgtttcctcctccacggccaaaagcattagcattggagaaaacaccccccgggaagtcaccgttcatagatgcactagagccaacaccggtgccacttccagacccataaccactagatccatagtagccatccgctcgcccaccgccttcaccgccacctgtaccaccagcattagaagacccacggtatgggtctggaccgacctggcttgagcttgagcctcgaccagacccagaaccatgcccagatccactgtaccgtccaccaccattgccgcctccaccaccaccaccaccacttccgtggacagagcctccctcatttacgatactcacactagatccagtaccactcccggaccctccaccggccccgtcaatagatccaccaccctctccccatccggtgccatttccattagaagtactcgaagcattggctaacccaatgcccaacatcacaatgaagctaagagctacaaatttattgtccaccattgttagctttactagtgcgcgattcaagatgtcgaatactatgtatgtatttatagtggtgtttatggactacccccatgcagtccctctgtctttgtagtagacactgctacgttacaatgtggagctagctagctagatctccctaatcaagcgatcaggggatacaagtggaggcttggaaacagcaagtggtattatattcacgagtagtaattatatactataacttgtgttgtacttgaggctatataagcaaaaagtctaatatatagtaatgctcttgctgtagctacatatgcatgtatttcttttgttcaaatgccgttcaaatcaccaaattaaaagcttgaacgtgttttgtatcatatcgatatgttatttcatagctggattacgcatgcaccgacgttttctttccctcggaattgacgcatggtttgacatttacaacaagttggcactgcagtcttgcagatgcgacgaccttggagtccgtagtgttggttgacatgaatatcagtacgcgagcaactgaagatataggtactgttggtcttactactcatccgtcctaaaatatagtgttctaaaatatagtggattttagacgaataataggatactttcgagtacaacaaatttggatagggagcctgtctagattcatagtgctagaaaatataccatccatccaaaatcctttatattttaggatggagggagtacggtgcttatatttttatgattttttagttcgtatatatagtattggttctatttacagttataatcacgcacacaactacactctctccattttatatcataagttgttttggctctttttaaacttctcaaaacttttatcaagttaatttgtagaaaaatataccaacatctatagcactaaattagttttattacatctaacattgaacatattttaatattttatttgttttgttttgaaatattaatatatttttctataaagttcataaaatctaagtaagtataacttaaaagggttaattggatatatgccattataaatttgatggttttgaaaaaaacgccattacaattcacgtatttggtctagtgccattaccattcgcatatattttgaaacatgccactagcctacgttttttactcgtattggacaaaattgccctcacgtcaacctcccgtcttctacctcacgcacctccagcttcctattctctctcaccccagaggaggagctctcctcgggagctcggcgaacctctccctggcattgtcgttgctttgggactcggctagtgttcatcgacaaattggcattggaccggtgacgaagggtcaacaattccaccggatcaggtggtgacgatggtcaggcatggtggatctcagcctcgtccaatcgagggggcagcggcgcggatccggtgacgacggagatggggagaagtagaaccagcggcgacgagcaagaagggaacgggtatgtcctcatctttctcttcctcgttgcccttccccgccggttgccaccacccgccatcttgtgagtcaccgctctggaccgccaccgcattcacgccgctgtagacgcaccggaggacaaggcactacagcgaggagagctagccctctcacccacggcgggtggatcccctctcctccggagcggtgaatgcagtggtggtggtcagatccgtgtcctctgcatcggcgtccacctccacgactcgcaatcgacggcgtcgggaggacaacctactgtgggaggtcggctgggcggtgagggcggtcaggccaggaatggtgctgcctcagggctagggcgcgacgccggctatagaatggagaggggagaggttgatggaagacaaggacatttcatccaatatgagtaaaaacgtaccctagtggcatgtttcaaactgtatgtaaattataattgcactattccaaatacacaaattgtaacggtatccgtttaacccaaaatagtcaaaatgacttataatatgaaacagaggtaggaaaaacattatgttgtttaggcagcttcttctggtcgtgttcaaaataagattaagttaattttttttcgaaactttgactaccaataacttatcaaataatcagttcgagaaaattggatgcttagatttgatttaaaattactgtcatgatatcatgtcatacgctaattgatgttcaaagttttaaatgttttagcaaatcccactacgccacaaccctacatctgtgatggcacaccagtgacgggcctaaagattggtcacatatgatcgtcacctttgacgggtcgttaggtttgccatcatcagtgaagcatcagtcgtggcccgtcacaggtatcacctcacctgtgacaggccataattttaagctgtcacaggtgaggtagtgatgggtttgctctccaacccgttattggtttgacctcacctgtgacgggtgttaaatttgcaacccgtcaaagattagatatctcatctcaaacgagttaaaaaattatagccatcagagatgacttacaaaaaaatcccccactccacccccctgcgaccctattcctcccctcggtttcccccttccctcctcatcttcccttctcatcttctttctctccctcccttactctctctccctcatcttccttctctccatcatcactctctccctcacagatcaggctgtggcccccctcccaagcgccggccgctgacgcctccccgcctcccgatcgttggccgcaggatctggcctacgaggcgtggatccggccaccgcggcctctcccccgatcgttggccgcttcctcctccaccaccaccacatcgccaaccgccggatccggccatcgtagcctctcccccgaccgccggccgcttcctcctccgccaccgcaccgtcaaccgcggatcccgccaccgcgacctctcccccgactgacggccgcttcctcctccaccacggcaccgccaaccgccggatccggcctcgacaagattgtggggcacggatccggccactgcggcctctcccttgaccgtcgaccacttcctcctccgccaccgcatcgccaaccaccggatccggcctcgacaagtttgtggggggggggggggggagggtgaggatccggccatagcctccctcctgaccacaggccgctacctccgccaccgcaccgccgccagatggagttatcctttttgttattttcccagatgaatatgattgtgatgacttttgtgattttgttttgtgcccaaatgattgtgaatgtgaagtgattttgttctttggctagatgaatgtgattgcgttgatttttgtgattctgtcttgtgtcaaaatggctatgaatgtgattatttttgtgatttgtgatgcctaatggtctgcgaatagctaggcttataatattatatttttttgccctatttttgaggtttgtgacgggtcccaattcagacccctccgtccgaggtgaaggttacctgtgacagattttagtttgcagtccatcaaaggtaactcttacacctctgacgggtctttacccgttacaggtgactccgagtcatcagtgatcactgatctgtgactagcgcttaacccgtcacaggtaagggtatgagcccgtcagtagggttgaaactggtttggatagttttcgtccgtccggacctttttttgggatttggatagttttagtcggaactatccgaaaattctcggattcggaaacgaatttggattttttttctcggaaacaaaaacgaatacagtaagggtactatccatcggaatcggaaaacggtcaaaaactatccagatttttttcggatatccgcacacattgagcaaattttagaaaaatacgtgtgtgtgtgtgtgtgtgtatatatatatatatatatatatatatatatatatatatataactttttcatacggaatcagatgaagagaaactttatatcaacattgtagagctcgatgagatctacaactttcttactgactattttattatttgaggtcatttaagggtataaatattcattataatataccatattaatttttacgaaatctcagatctacaatttagaacgatatctgatggagatgtgttcttccatatcaaagttgtagagctcaacgggatctaccactttgtagtttataatatttgtatttgaaagcatttaaagtataaaacaaacattacaatttttgaagatgtgaagtaaaataaataacatcttcaatttatacaagggtaagtaagttatacatatagtaaagggtcttggggaatagaaaatgataatcatatttgcaaaaggatctcttagagaaatagccatgaaaatcgattttctcatacagttgtgagaccatctacaaaattgacgatataaatgttggagatgttgaactaaaataataagcggtatctcttccttgatcaagaaactcaatttgtggggtttttttatatacggtaaatattcgctaccgtattcgttccgtctcgtattcgctccgtatctgtattcgataatattcgatttcatttccgaatccgagttttcgattccgattccgattccgaaaaaaaaaatgaaaacaaatatgataaagctagtttccgtccgtttccgatccgttttcatccctacccgtcagagataatctgatccagcgaagtgtccagccatgaaatcaaatatttataattggagaaagtagtataggaatcttagcagagggcaacaaatcaataagcaattaagcgagcagagctagctcaacaggttagtaattggtcaggcaaatatagctgattatgtgatagcctgattggtcgagtacatgtaagtagaccatccaagtgtcgcctaattaatcacgccctacttacaactaaataactatagcatacctgaacggctactgatgaggcatatctaacaaaatcgaggacagagagataaagagtttgtacgggagtagcacccaatcgtacttttgaagtgttgacttgtattatattatcgccaagttgatttctctgatctagaatataagagatttagtaattattaaatcgatgttactacgtatgcagttttatgatatactccatccatttcataatataagacacaaccattttttaatgtgccataatataagacatgcatgcatgtaggcaattaactatggcccattctccattaaattattatatttttaaatcctccactcttatgttctctaattctattggatgcatgcattatatttattaggatgatccaaactacaagatgataataattatttcttgttctttgggttaggggtggttatgctttagagcaggtataatagcaggctataagccagctataaacatattttaaggagataaaagaggagagagtagagcagcgggctacagatttgtagccagttgtagtacggactccaagacgcagtgtgtgtataacaggtgggatcagatattaatagtgtagtatggaactattgtatgaattggctattaagtcgactataggtgatttggagttactagttggctgtactattaaacttgctcttatattttggaatggagtatctttcattgctttaaaaatgggcatcgattatccaagctcaaaagtcagcaaaattgtagtgacaaaagttgttctaccacacaacataattctatgcatagtaatagtgcctacaaattggagtatctacactcatcatgatgtccaaaaccattgaagtactaatcaatttccatttgatggcaaactcttgagtagtacaacagtatattaaaatttccagtgacacacataaagcacttacaatcttctaggtcgtcgctgcattgtcaactccagcctcttttcgttgatctatcatccatgcgtgcgtgcttacaaattaagctactttactacttcaggtgcagagataatttgttaatccacaagttgagcttaattacttagttaaaggtttagaagcatcctggctaaggcctcggccacactataagtacccatgcaatctttcgctcccaatttcaactgaactactataactgttgcattcactcacaatggctaacactaaaattgtggcacttgggatttttctagtcttatgcataaatggactatcccatgctgcaagagtaattagatattctagtgctaaaggtgaaggagaaggtggaggagagggctctggatctgtaagtggtgctgggtcgggttctgggggtggctttggtgctagcaacactagtagttccgggggctattttgggacaagtaatgcacatgctaatgctggaggtggagggagtggtgatggtggtggaccattaggaagtgttgggtctggttctgggtctggttctggctctagctcaagtaacagctcaagcgtaatgagagcatggtatggtggtggagaagctaatgcgggtggtgttggtggtggcaatggtgatggatatggcggtggttactcagggtcctctggttatgggtcagggtttggaaccggtggaggctctagcgcagtggctatggatggcttttacggggcacatgcaaatgccgatggtggtggtgatggtactggagtgggacatggcgaagctggtgggtacggcaatggtggagggagtggatctgggtatggtaatggcaaatacccatagttccttattggatttgctagtagtaacactcctttattcgatcagttggcttagttgaagcccattttggttgtttacactgtgtcacagaatgaattaatgttatggttcctaagtaagcatgtgtcgatgagctagcatgaaattaataaagggcttcgttaacctttaggttgtcaaattgttttaacatttaagcatgtggcctagatcagatgctagactacgtgtgcatgtatgtgataactgataaggtgtaatttttatatgtgttgttccatgcgaatgtgttgtttgtcattctaatatggcatattctcaatgtagtatcatgattcatgcatgatacttacatggaaaaacaacaactcccaaatataaacacaggcctactttaaaaagttaaaatttaggatgactagattatacactaagtgtcaatattccccaaactaattagtaattactagagcgggcaagcaatttatatgcacaaggccagttcactagagaagcaagtaattagtacagtctttatggcaattaatactcttgccacataggattttagatgatgtggcacataattaaataaggaagagagcgagatagcaccttgcatgagacatagtttgaacacaaaatctaataaaaaaagacactgtattgggaatgagaaatgtcttcaacaatatgaccaattgtgagcagtaagagaaaaaaaaagaacgatatcatatttattgttgtctacttacatacacaccagtgatatttacaagttacaatgaccctttacataatatcttatcgaccacttctctcgtcacttgcgcaccacaactatatttattaattgactaggcccatctcggaagtgtctccctccacctccacgaattagcacttaaccctagctttattttcctctataaatagctttgtacattctcaaaaacatttgggttttgtttagttgaattttgccaagtgccattcaccttgtctctagtcctcgctcgattagtcggcgactattgattcagagcccccaatagttggtgtattgatttgccgggtcgattagatctaccacttcaatcgcaactatttctttgtgcttaatcacctattcgcaatatttagattgcatcttatcttgttcttgcagtgttctctcgtttgcattgcatgaatcatcaaccgcgcgtcacggttggtacgacatcgtttgtggtgtagcgattgcacggcgttctggacttgttctggttggtagccacgtcgcaaacgtcgcactcgatcaaagcgagagttatcccctcaccagaagatcgggccacgagagagagcatcatcagttggtatcagagcttcagttgcctggtgaggattttagttttgtaattttttcccatcatccactatacagccgcaccactttttcctttaccaaacattagttttgagccttgtaattttcattcaattttgctttattgagttttggtccgctgtcgtgtcagtgctggtttttgttctagcttcgtctggtttgagttttgcatcttggttgctcactgcctgtacgttcggttgaaggagaagaaaacattagatctgatctttttttcatcctcctgtgttagtgcatgcatgccgtggaattctggtacgttaccaagtaaatagcgcgtgaaattaggaagctaatcgtgtttcaatatatccgaagtgcatgtgccaaaaaaatagcaattcccagtttttcttccttttgagctgccacgcgcaaatagaaagtatataaatcaagatcggttcccatattccttgcgccacaaaaataggaggtatccatcgttttctcttgtgaccgaggtatgcatgcaacacaatcgtgcatatgtgcttgagttaattacttgaaaaagaaaaaaagaggaagaaatacaaaaaaaaaaggcagacggtgcaaaaaaaaaaaagaaaaaaaaaagagccgcaccaaaaataataataataaggagaaaaaaaaagtgtggaaattttttttaggctattggtgtggagattatggataccccatatctacacggcaatgatatttgggctgaatacaggataccgaatatacatagaatatcttatttgtatctcgggtttgtttcttaacttgtacatcaaggaaacaccttgagacttagtcggttacgactgtattttatctgtatttgcatattccgttagggatatggattatcttttgtaacacggactccttcccatatataaggggggtccgggtgcctctaggggcagatgttgattttctctaaatcatacaatcaatagtacactcggcggattcatccccggacaggagtagggtattacttcttgaataagaaggcctgaacctgtataaatcctttgtctccaaacccatacactttttgtcacgtcctgataaattcatcccaaaataaaaatcatcttctaaaaggaataatagaattaattaaaattcgaaaagaaattggcaaacactaaaatacgtacaagaaaaattcaaatgtggcccggagaatttttgttaaattctccttggtctaaaaggagccctcaaattttagtggaattttcagagcacaaataataattgaaaagaaataaacaaagttaaaaaggtttataaaaagaaaatcctaaaagaagttcttttcccccccccctttttccctcttgggccggctcggcccatttccctctccctctctctctcctctcccgcggcccatcggctccccgcgcgcgcgcacgccgctgacaggcgggcccgcccgccactctcgctgacaggtggggcccacctgtcatcgccctcctcccgccgcgcccgccgccgcgcccgtgccctagcgccgccgccgccgcgaatctcgccgtttcccgccgtccccgcgcgccttaatgaggggggaatcactccccgcgtttccctctcccgattccccctcttttccctctctctctccctcggattcgtccggattcatcccgcgaagttcgccggcgtcttcaatggcgcccgagatctccgcgcgcgttttccttcctccccggccgccctctctccctctcggcgctataaaatcgtcccccgtgctcttctcctccgtttccgccgctcgccgctcgctctcgccgtcggattcgtgcccgcgccgtgctcctctctctccgccgtcgccgccgacctccggtacgccgccgacgccgctccggtcttcctcccggcttggcgccacctccctcggcatcgccgcatcgccgtcgacctcgtccgcgcctccgtttcgctcgccgaccgtcggagcgccgccgtcatcgtcatcccgaaccgtgccgccgctttcctccgctccggccgccgttatcgtcgtcgtcgttgtcccggggtgagccgaggaccgccgttcgccttccccctcccctcctctctctcgggcgccgctccgccgcgccggtggtcgccggcggtgaccatcggggcgcgggcgcgccgctcccgtcggccgtgccggcgaggccgccctcgggcgcgccctcgcggctgccaagtgggcccggccgtcagccgcccgcgcccgcgggtgcggctgacgcgcgggacccacggcgccgaccgccgccagccgcgtgctctcggtccaccgtggaccgaggggctgacgcgtgggccccacttcccgtggacccggtccgcgcgcccgccccctcggctgacgcaataaatgggattttaattaaaatttaaatgaagaaattcgtaaatatccatttaaagagcatataaacttcaaagggccatatcttggccgtttgaactcggaattggaccgttcaagtctctaatttttccttaagaagtaaagaacccatttttgtgctttgtttctgcttgttatgtggagtttattagtgttaaagcctttttcttttccgttggtcgtgtagacgctgcagcttcggaagatccgctcttcgtggaagtcgaagccgtcgattgggaaaacgagcaaggcaagacacatcatcttgatcatattgaatcccagtttataaaattatgttgatttaaattattgcattatcgctttatttaaattcccgcgttatcactgttttatttagccatgcctgtttatctttgttatgaccatattattattgttattgttattattatcaccttgttcaccctagatcaaacaaaaccccaactagtggactctctactcatagtaccactagtataattttaggtagatgcttcgcaagttaactaggcaacattaggtggttttataactctagacttgggaaattctcatatcacctggacactttggaattgttggtttttggtggaattggacatacacctctcttcccctttcaaaacccctaaaacctgttttcggtggggtttgggtgcatgccagttgtgggaagtagcaccccggccactataaggattaagctcgggcctctgttgcaaagcactaccgtacttccacatgtctaatgggtaaggcttagtttgtggctcagtctagtcataaacaaaagtacacggattggagatggatgaagtcgggcgtcgatggacattctccagggcaaatgaaggctacacgagctgcggcccggtagtcgagatgtcatacggcggagggttggtgcccaatgctaggggctcagttctgcctgcctgtcccgggtatcccggccgtaggtaggattgggtcggtactcttgtctaaggctaggatgggttggaaactatgtcacgtcttccgtccgtataccgtggtggtatgtggcacgtggcaacacgtgaggaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctgggacccaggtcgggttgccagttcggtccaaatcatcgtaggccttgggttaaggcaggttcgtgagggttcacggccttgtttaataatactgtgtagctctaggatcgtctttacaaaatggctttgggcaactaagtgacttttaaatgctgtttactgcaaaacttaatccctatattattatccccttgtactcccttgcattaattatgcatctccggtgtggcttgctgagtactgtggttgtactcattcttgctcaatctttcccctcttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtatggtgtaccccggcttttcctgggacggggattaatacactagcgttcgggaaaaggcaattttcccggtctcgacacttttccagcttgatagccacccccttttattattgccgaaatctagtttcgacagttggcgcgccaggtaggggtagcgtcaagcttttcgccgatcagtgcaatgggttccgtctccggcatcgacgacctcgtcttcccgcccgggcagatgtttcggttcggcagcctcgacttcgtcaccaacaacttcggcaagatctctctccttgactcggagtcggaccagtcgggagagaactggatctcagtcccgtttggactcccaaacgcggctgaaagttactccaagaccatctcaatcgagtcggcttcaaaccactcggctgagattgcatcttctccaacgtcaccagatcaagatgatggggcttacccaccgatcctgatgaagctccccgacgatttggcggccatctccatcacgacagcgtctccatcccgtaggcctaggcggaagtcggcttcaacaccgatttcacctagcttcagggaagtcggtgtcatcctccaaccactcggcacggtttcgacggatcagctggatagccactacagctctcccaccgtcgactcgcgtcccaccgacgtcgtggagtacgacgagttttgctctcgctaccacgacccggatctcgacgacttcgacggaagcctagatgacaactacaccccactctactttggcgtcttcatggccaataacgagacggaggagcaacgccaagcccgggagaccgaagcgcgtcgcgagactgagcgtcgccgactggaggaggagcatcaagcacaagaacaagaacggctacggcgtgagcagcaggagcgtgagcggaccgcgaaggaggctgaggatcgacggcagcgagctttggaagcagggcgccgagcgcgtgagctcatcggccaacaagatgttgaagggacaccagttttccgcacccctcaacagaatgcggttgccgcgatcaccctcctcgacaccctcctcaaggaaaacgagctcaatcaatccaatcacgtcgtcaacatcttgaaccagacgaagaccatgattgcggcttcggtcccagttaactccgaaagcgtccacacgccgactggtagccgagtcccccacttccgatctcatgactaccgtcatccaagcctcagcatcaccggcgcaggatctaatcgcaggagcaggggtcacgacgagcggtctgttcactcacctcccgaccatcatagggagcgccgagtggaacggcctcgctcaccgcctcgtcgccgccccgtcgatcttcgcgatacaatcatacagcgccgagcagctcgaggccttcatcattcgccggaccgccacgacgacgaccttgacggagtagcagccttcaccgacgacctgcgtcgagcggattggccagccggcttcaagccgactggaatagagaagtacgacggtactactaaccctgaatcgtggcttactgtctacggtctcgcaatccgcgcagcaggaggagacagcaaggccatggcgaactatttaccagtggctttagcggattccgcccgatcttggctccatggattgccccgtggtacaattggatcttgggccgaattacgcgaccacttcatcgccaacttccaaggcacctttgagcgtcccggcacacaatacgacctctacaacgttattcagaagtccggagaatcccttcgagattacatccggagattttctgaacaacgtaacaagatttccgacatcaccgacgacgttatcatcgccgcattcaccaaagggattcgccacgaagaattggtcggcaagttcggacgtaagcctcccaggacagtcaagctcatgtttgaaaaagtcaacgagtacgccaaagctgaagacgccgtcaccgcatcaaagcagtcgggtcccggttggaagccaaacaagggtacgccggctacgggaggaggtggaagtaacaatcataaggaccgcaagcgtaagcctgaggaacttgttgcaaccgccactcactcatctcgacagcgtccgcgcgtcaacacgttcgacaagatcatgaactcccaatgcccgcattatcctaactccaaccacgtggccaaagattgtttcgtctacaagcagttcgcggagcaatacaccaagtctacacggaagaactccgacgaagaacaaagcacgtcaaggaagaaggacgacggcgacaccccggcaggatttcaagaccaccgcaaggagctcaaccatatctttggcggccccctggcttatgagtccaaacggaagcagaagttgactgaacgggagatcaacgctgttcagcccgacacgccccagtatcttcgatggtcagagattgcaatcaagtttgaccgctcggatcatcccgaccgagtggtccacccggggcggtaccccctggtactagacccagtggtccgtaacgtcaagcttcgcagaaccctcatcgacggcggcagtgcactcaatatcctcttcgccaagaccttggatgatatgcagattcctcgctccgagctaaaaccaagcaatgcgccttttcacggagtaattccaggattatccgcaactccactcggccagatcactctcccggtcacttttggcactcgggaaaacttccgcacagagaatatcagctttgaagtcgccgacttcgagacagcatatcatgccatactcggacgcccggcgttagccaagtttatggccgtcccgcactacacttacatgatgatgaagatgcctggtccccgaggagttctatccttacggagcgacatcaagcaagccgtcacatgcgacaaggagagttgcgacatggcccaaacccgcgagatggcgtctgcccgagaggacatccgactggctgcagccacggcgagcgaaggagaagtacccgctaccaagacttcaaaaagtggagaaagcgaagccaagaccaagaagattcccctagatccttctgatcctactaaaactgctgtaataggcgccgagttagattgtaaataggaaagcgcgctcatcacctttcttcagaacaataaagatatctttgcgtggaaaccatctgatatgcccggtattcctagagaggtgattgagcactccttacatgtccaagaagatgccaagcctatcaaacaacgactccgccgattcgcacaagacaggaaggacgcgatcaaggaggaattaaccaagctgttagcagcaggcttcatcaaagaagtccttcatcccgactggctggcaaacccggttctagttcgaaagaaaacagggcaatggcgcatgtgtgttgattatactgacctcaacaaatcctgccctaaagatccttttggattgcctcgcattgaccaggtagtcgactcgaccgccggctgtgagcttctcagttttttggattgctactcggggtatcatcagatccgactgaaggaatccgactgcttgaagacttcattcatcacgccctttggagcatactgctacgtcactatgccattcggactgaaaaatgcaggagcaacttatcaacgaatgatccagagatgcttctcaacgcagatcggccgcaacgttgaagcctatgtggatgatgtagttgtcaagaccaagcaaaaggatgatttgatctcggatctagaagaaaccttcacgagcatccgcgctttcaggatgaaattaaaccctgaaaagtgcaccttcggagtaccgtcagggaagctgcttggttttatggtgtctcataggggcatccaagccaacccggagaaagttacagctatcctcaacatgaaaccgccaagtacccagaaagatgttcagaagctgactggatgcatggcggcgctcagccgatttgtttcaagacttggcgagcgggggatgcccttctttaagctactaaagaaaacagatgatttccagtggggacccgaagcacagaaggccttcgaagatttcaagaaactcctcaccgagccaccagtcttagcttcaccacatccgcaggagccgttgttgctgtatgtatcagccacctcccaggttgtgagcacagtcttggtcgttgagcgcgaggaagaaggccatgtccagaaagtccagcgaccgatttattttgtcagcgaagtcctagccgactccaaaacgaggtaccctcaggttcagaagctgttatatggtattctaattactaccaggaagctatctcattactttcaaggtcactcggtaacggtggtcacatcatttccactcggtgatatactgcacaatcgcgaagcaaacggacggattgcaaagtgggctttggagttgatgtctttggacatatcattcaagccccgaatctcaatcaagtcccaagcgttagctgattttgtcgccgaatggaccgagtgccaggaggatacccccgcggagaagatggagcactggaccatgcattttgacgggtcaaaacgactttcgggcactggagcaggagtggttttgatttccccgactggagaaagattaagctatgtgctttggatacatttttcggcgtcccacaacgtcgccgagtatgaggccctccttcatgggctgcggattgcaatttccctcgggataaagcgtttaatagttcgaggcgattcacagctggtcgttaaccaagttatgaaagagtggtcctgccttgacgacaacatgatggcatatcgacaagaggtacgcaaattggaagacaagttcgatggactcgagctcagtcatgttcttcgacacaataatgaagccgccgacagacttgtcaactttggatccaagcgcgaggtggcaccttctgatgttttcgtcgaacacctttatacgccgacagtacctcacaaagatactactcaagctgcgggcactcatgatgtagctatggttgaagccgactggcgagagcccctcatacgatttttgacttctcaagaactccctcaagacaaagatgaggccgagcggatttcaaggaggagcaaactttatgttatgcatgaagctgagttatacaagaaaagcccttcaggaattctgcaacgctgcgtatctttagaggaagggagacaattgctgaaagacatacattctgggatatgcggaaaccatgctgctgcacgcaccattgtcggcaaagcttaccggcagggttttttctggcctactgcagtgtccgacgctgacaaaattgtgcgcacatgtgaaggttgccaatttttcgccagacaaattcatctaccagctcaagagttgcagactatcccgctgtcttggccgtttgcggtttgggggctcgacatggttggcccgtttaaaaaggcagtcggcggttacacgcatctctttgtggccattgataaattttccaagtggattgaagctaaaccggttgtcacaatcacagcagataacgctcgagacttcttcatcaacattgtgcatagatttggagtgcccaatcggatcatcactgataatggcacacaattcactggcggagtttttaaagacttttgtgaagactttggaattaagatttgctatgcctcagtggcgcatcctatgagcaatggacaggtggagcgagccaatggcatgatacttcaagggattaaagcgcgtgtttttgaccggctaaaaccctatgccggcaaatgggtgcaacagctgccatcagtactttggtctttgcgaactacacccagtcgggccacaggccagtcaccttttttccttgtctatggggcagaagcaatgttgccaagtgaagttgaattcgagtctttgcgctttcgaaatttccatgaagatcgctacgaagaggaccgagtggatgacttgcaccgattggaagaagtccgcgaagcagctttgattcggtcggctcgatacttacaagggttgcgacgttatcataatcgcaatgttcgatcccgtgcctttctagtcggcgacctggttttgaggaaaattcaaactacacgagatcggcacaagttatctcctttatgggaagggccatttatcatctctgaagtcacccggccaggttcctatcgactcaagcgcgaagacggtactctcgttgacaactcttggaacattgaacatcttcgtcgtttctacgcttaagcttatcattgtacttccctatcttgactgtcaacatcaagttctcttcttgaagttgtcagtcgggggctatcatcataataatggagtgtgattttttatcaatttaatttgcttacttggtctatcattgccttgtttggttttttctacttagtctgcgaggactgaaagtttttaatagcttctttgggttttaggctcaacaaagcttgataaaaacttttaagaaatcaaagacttggctagaactatcaagcacagcataaatataccagtattgtacaaattgagcctccatttgttacattcatactcagtcagaatcagtcctttcatcatcagagttattgttgcttggctgaaggtcgttgttgcggaattgctctacaacgtcacttgcaatcttgtcagccgcattttgagcactactgataagatcaagagcagcttcttcgcttgtcccgtctgcaaagccatcaatggtgtcaatttcaattctcgggtacaaggatttggtcatcgccaatgccatgctagctcccatacttccagctttcttgatattcttgaagtatacatccggtgcaactctcagcttgtcaaagatttcggttgcgtcaagtgcactcggaccactgttattaaggaacatagcttggacgagtggtgtagcgacattggcgacttcatctcttgctccttcaagcctcttgatcttaccaaccaggacgtcaaactgagcttgagatttgattttacggtctacaaaacacatttatgataagaatctgctgcatttaaaagagagaagtccagattgttagctggcggtaccttcaacctccttcaaggccgagtccctttgtgcagccagttctattttgtcttttttcaaggcttcaatttgtttctccatttgagccatcctggcggcttgcgctgtttgaaatccaaatggttgaggacacagttacgacagcgtaaataaatgggacagatctagagattaccttttgatgaaccactcagctcgaaatttgaatcctggagttgagcaattcgctcccttaattctttttccgtctttttggcgtgctccttggcctcatgtagctggtccctaactgcttcaagggttcccaaatgaggaaccagcttttccaaagttgtagtcttggcctcattgcgaagatggattctctgcatgatggttcatggtttagttctgctaaagagagaacaaagttatcaaaggcagtcacccggaagatttacattcacgatgcgagtggcttctccaagtactttcttcagctggcacacttcttcatcttctttttgacgatttatgacgataccggcaacttgtgagttctcgtcccaccatttgagcaagataggaggacgagagtcatcagccgcctttatgcgaggaattgcttcttcgtcatcgcctggtgcccctgatgtgtttccaagacattagacgaataagttgaagttatttaaatcggcatcacttgagaagatgggttacctgaggatgttcctagctgagcgtgaggtgatctttgttctttatttggagacccaattatcgggtcgttaccagcctctggtccttgagaagttgtcgtctgcgtttcaacttcggggatttcttggtcgggacctgcatccgactggtttccagtcgggggctcttgtgttgttgcagtttcagctgctgccgactggtttccagtcggcggctggtcactcggatcgtccttgtcacctgaagcatgggcgtcagtcggctggctttcggtagtcggctcgggatccttggataaatttggctctgttgcagcttgatcaggatcttttccagttggatctatgtcggatggtttcctgcaaggtgttctttcaatattcagtattatttctattagagaagcatgtcgaagggaaatggtaccaagaggtttatacctggaagatgttctgatctttggcattggacggccagccagtttttttctgggcatggtacgctttgggggtttattaggcgagcccttgtcctcagatttgttgtcatcgccttcatcgttgtcaagcaccagttttctcttgcgagaacctgtctgtccagttggattggagatttgagggtgtggatctaatctgattgttggtcctccacctccctgaacagtgtgttggcgaggagaccggtgctgagcgattgggggatcagatttcatcaatacatattcctgaatgagatgccttcacggttagttaactcaacatgaagataagattatgttttgatcatgggttgaagatttccgatacacacctgtggaggcggattgaatgcgttatatggcacaaccggcagctgatgtgagtagctgacgacaatagcatttgagaagattttatacatcctctccttcatgattttaaagtccagagagtctggttcttcacgattgggatcatgcttgccgtcaaactcgaatgctgtacgggatctctctttgattggtgccaatcggcattttatgaagtgccgagtgatctgctctccttgtaagccttgttctttgagttttaacatgcgatccatcaattcc

SEQ ID NO: 82641 - DNA, 17092 bp, Oryza sativa
cgataaccccttgtcgcatgctaaggtaaacccaattgtctaccctagatactctctcgatatcatagagttgcatacttatatcatatcatagagttgcatacttatatccaaccgctagtcaattcattctaaagcaacttcctccgttctcaaataactcataccatcactatttaaatttaaactttggtccatgtttttttaagaaaaaaactataaaatatgctacgtatattattaaagtgtgtactatcacagatagacccatataccttccatccatcgtaatctaaacatttaaaagtaatttgtagaaaggaaagggtataaaatttttcactatactgaaagaagtcagcaaagacagtgcagcgttacaaaccagcttggacagtgtctgaaagagatctcaattatgggataagcaatcagctggttgctgtcatcgacggtgtagacgcaaaatactcatcctaaaaccatactaacaaaatgaaaaataaaaaaagtaattttctgtagcaaaaccaaacaaatatctgggccaacaaacaggctacgccattggatatgcctcgagatccacgcggcagcagtatagcacagtagcagcaacagagagagcagagcagcagcaaactgaaagctgacgcgacaggcaataattaaagggataaaccaacttgtgttaccacccattccagataacgacgccctttcctctgttaattaatccaatcacccgtgaaaacgccatctctctctctaatgaaatagtacagtacaccctccatctcttaataagtgtgattttgatattttgcttatattgttttgccattgtcttgttcaaaaaaattttagaattattatttgtgacttattatccaaagtactttaaacacaactttttatttttatatttatataaatttttaaataaaacgagtggtcaaacagcaagcaaaatatcaaaatcccttatattagaggagtgagggagtacattatactagtcctagtactataaataattttctgattttctcacccattttttaaaagctcttttgtctctgtaccattgcatcaccaccgaattatcttcactgacatgctttgctgatctcttcattaggtttgcttgcttttccaccctttttttattttgattaatttggtatcctttttagtaatatcttgtgtgtggggtttgccattcatgattcaagtagagatgtgatgaccaagccctgaaaaactttgggagtgtgtctacttgtgtgaaagagatccatcatctccaatgcatgaataggaatagcaaaatgaatcatttctatttggccaacccataaaagccctaaattagctcatctcattctactaacagaggtgctaggacaagggggacattatccacaatgttctctctttgttcatatctcggaatttatagtttttgtgaaattccggcgcaccaaacaaggtaatcaagtcttgtaaaacaccctttggtaatatttttaaaagcttattcactttattatccttttcagcatgcaaataaactaaatatgatcttagcaatgccatagttccggaacttttctctcataaaagtgctatcaaattttacaaaggcgtcaaactaaatacattcaacgctatcaaaatttgacaaggttgatttggctacaaagtgaacaaaccctaaaaaaatgttatagtagctgggataaaaatccaccaggtgaactacaattaaacaaagatattgagatagtagtacatgcaaatattgtttcagtaaccacagaaaagaatggaaattgctgataatgtttgctgccatacaagataggagtagtaatactaaacagtgacatcacaagacaaaggagtagtagatcccaaggtgataagcacaagatcattgccatgtagagcaacacggttgtgtttagttcagcgtaaagtttagtttagattttaattgaaattggagatgatatgactgaaaagttgtgtgtgtatgataggttgatgtgatgaaaaaggaccaaagtttggatccaaattttggatctaaacataaacacagccacaggcacactgaaaaaataaaattaagagagagagagagatatacactagtactagtagaacacacatggaaagaatgaaaaataaactagaattaattaacagtgcaacagcataaatcaagatgatcaactgtacaaatcctccccttctctctcaaactccttttttcttggccctcctaatttggacccactactaatcatcatcaaacacccgtctcaacaagacaaatggttcttgaatcttgatagatcaatccaaaaaaaaaaacaaacaatacaaaaataaaaacaatacccccaaaaaaatttaattaacaaggctaattgaactagcaagaagtgttgctcttgcattgcattgcattggcttctcttggctttgctcaacataagctttgtcttgctctgcttcttgcacaaattgacactagtgtagtgatccattttcttgattgattcctcctttgcccaatccaatggcagcaaaagaagttctaaaccctaaggtgatgcttgcttctaaaccactagcaccattaccaagatatgaatggacgatcatggcgaattcagaggtgatggtgatggtgcgagcttactgcgagctgttgttgttgttgttgtttgcgccgccgttgtcttcgtcgccgctgtcgtcgccgtcatcgtcgtcgtcgtcgttgcggccctgctggtccatctccggttgctgctgcggctgctggtctccggcgccgccgcggttgtacgcattgagcgcggcgagcatgccgaggttggtgtccgacatgccggcgccggcgctgccggggtagttgacacgcgtcgacatgaactggagcggcgcctgcaccgtggcggcgccgccgccgccgccggcgaaggaccacatgggctgctcggtggggcgcgcggcagcggccgagctggcggacaccggcagcatccagaacgcgccgccgggcgccgcggtgttcggcgcgacggcccacattgccgccgccgcggcggcggccgccgccgcctgcggcgtcgtcggctgctgctcgcgcgccttgggcgcgctgggatcttggcggtcgtcgtcttcttgaagaggtcctccctgtatcgcttcctcatgaacgcgcccgcgccgccgggatcctggggcgactcctgctgctgctgcggcggcgggaggaggtggtggtggtagccgagcatggcggacacgtcgtgctgctggtggtgcgggtgaagagccagcgccgggaagggggaggcgcggttggggttggaggcggaggaggcggaggcggcgccggagcggatggagatgttgagagaggagaagttggccgggatggtgcccgtgccggtcgccgcgatgatggccggctccgcctgctgcagcagccactcgatggtctcgccgtcggacttgtgccccagctcccgcgtcagctggaacacccgcgccgcgcacagcgccggcatccgtatcctcctccccctcccatccaccttcgtgtgccggtccttcgacggccgcttcgccagcgtcgtcgtcgccgccgcccccgccgccgccggggtcgtcggcgccaccaccttcttctccccaccaccagacgacccctgcggctgctcagcgaccaccggcgttatcgccagcgcgcccatgaacgtctgctgctgctgctgcgccgccgccgccgccgcggcggcggcagccggaccggagtagtagaacgggtggtgcgggtggttctccctgccaccaccaccaccaccgccgccgctccctccaccaatattactgctcgacggcgccgctcccccaccaccgccgccgccgccatggtccatcctcccaagaaaccaagaaaccgccgccacccaagcccgcaagtggaaaatacggcgagtccttccgccgcacgggtggtccgagtggtcgccggagttggaggcctccgggaacacgtggaggacacggtggtggtggccggagatggggctggggggggggggtggtggtggccgccggtggggttggagaggagaggagggaggagagagaaagagagagagacagggagaggtggggttgcctacttactcacctatggttattgttttatttatggagccatttcttttcttcatttttttacacactctctgtatatatgggcatgttttatttatagatctccagtaaaaattttcaccctatcacatcgaatgtttggtcatatacatagagtattaaatatagacgaaaaattaattacacagattatttgtaatttgtgattcaaatcttttaagcctaattactccacaatctgacaatgtggtgctatagtaaacatttgctaataacggattaattaggcttaataaattcgtctagcagataataggcagaatttgtaattttattttgttattagtttatgtttaatactttaaatgtgtatatgtatatccgatataacacgccgaaatttttcatcttggatctaaacacaacctatatatgcaaattccataaacgctagagaagatattgggcaccctgctagtgtagcgtcccctctccttttcactttccacttttgttgcctcacaaaaatttcaagttttccctttgattggggtgagcaaaactgctagaaagttctgatgttgaataaacattggtgaagatcatcatgcaaatggaattttgaaaaaaaatgcttgagcttatcgaaatgtcatctggtagattattggcgtatcgacgtagatgacgacgtattaacttgagggcggatcaatacgaccggagaagacatctacgcggaagcgatctgttccattgattttaatggtaagatgaaacatataattcagtaacaataattatcccaagctacaaatgtctcatgcgggacattaaattctatcacaaaatacgaaatggcatgtagtatagtggttataaaagcctaagtacattttaggtcgtgggttcgacttcctacaggagcaaatttatgatttaacctttcagtggtaggcgacgtattcgtcgacagcgaggcacatgtggtgacttcgtcaatcttaaggatttgccgatccagtcttcgaagatgctcatagggttgagtgtgcgtgtgttgtgagtgtctgcgttgtactttgtaatttaaaaaaaaatctatcacaaaattactcgttgttcttttgacatggcttgatgaaaagaactcgaagcgaagcactatatatgaatatgccatttcattacaagtatatgctttgtctccatgatcaatcatgtacagagtaaaacgatttcaatcgtttgcttttagaagctatcaacatgaatttgagatctcatccatcttgatctcgagttcgatgcataatgctccttgaataaattccttctaccatataaccagattggcagcaacaataacctactatatccacttgaattcaacatcacattcactccgatctcctgttggatccatcacaccccttataaacaagtttctcttaactcatatccagacagacaccaacaattacctactaaacactaaaaaggatataattaaaaaaaagatgggtgtcatagcataataccaagtgtcaacctaaatgttgccaaactgacagcatcttgtcttaaaaccaaaacatccacacgtgtaaatataatccatctcaaagaattttttttgaaattccaatgggtgtattgggtgtggtggcagtgtcactttttcgtccctctctttttcaacttttttttgaaggggtccttttctaattatttggagagaagagagcggcagagaagtaggccactcgtgggtcctcggaatgatggacgaacccaaagacgagagagcgcgaaaagcctctgcaaaagaaaccccacatgcgcccaacactgcacataccacccccatatttcattgaatttcaacacaaatttttcttttgagggaaatttcaacacaaaattgaacaggggtgcatggtgatttattttttgccttattttgtttgtgattggatgttgaaacaggttgtccttttttttatcataatgattggtcacaaatataggaatgtaataatgggaaatatggttgtgaagcatgtgttattatagccatcgagtaatagcgatggtctgtcatttttttgcacgaggcttattatcaatgattcattagttattatatgtgctactggattggttttttttttctttcttgctgcgaagtggtctataataatgatgagataattgggttttaagcttcgtataatggatttttcgtttttatgtgggctctctttttaccaatagcaagctatgacaatcatgtgggtgtgaccttgctgttttatatacagttcagtaacctaaaatatccagatcttacaatgcacacggcgttagagcctaagtattttaaaactactacaatgttgcactattagcattgtttgccttttgaattataattgaatcatgtaaagctaagagttgaaagcatggaccaataagtggcacttagatggagggggtggctttttgtaacttttgcatgattgagtgggggtgttttcttgtgtaggaatgaggggggaagtgaagccaagggagacactgcaggtggagggtgtcagagaggggagcatcccaacagcaccaaccatggcctctctctccctctccttttcccccctttctctctcctctcttcttggctcttgctgcctgtactcctctactctacagcctacagcatccatttatcacaataaataatcccatccaataatttatcatggacaaaatcaccaattatccctaaaaataaaggcctcaatttgcataaccactggttgtgcactgggaaaaaattaaaaataatactagtagccagagaaaggaacatctgtgaccagtgagtataacagggttatctcaagtatctatacactttatgcaatataatgataaagaaactgatcacacagaatgtcttttacctgcacataacatggcagaatataaaattgcagggaatatatattttaaaaatccacccatgaggcagataaaagaaatggaattccaattaaacaaagagctgggacaggtaggggaaaggtctcctgccagtcaactccaggctggcccaccagcctccttcaaattaaataataattccatgttggttccaaaaggagagatatttttttaaaaaaaaactgaaaaatatacttaactgatcagcagtttcatacacagagtgtcagcttggcgtcttcccaaattgccatgattagggtaacagtatggaattgggtatgcaatgtgagaggtgattatccaccccatgctacaccaaagtgggactgatcattcattcctagctgcaggcagtgtcttgcaccttcgtcggttatccatattttttaataagctaaaacaatatattagataagaaaaatttatttctaggcaaaactttaatatacgtgtttctagcaacttaaaaaccaatgctaaaaacaaattgcattgaaaatattttaaaatcaactttaaaattaagtttgaaaaattatcccaaaactataaatttaagctacgtatcttataactacagatttaataataaaactatcataaaactacagattttagggtttaaatcatgagcactaatgtttgagttatcaacattcaagttttgtgcttaatttggcactaaacacttagttttactataactttgttactaaacctatagttttacgatactccaatttaaatttgtatacatatgataaatttagtgttaagtctatagttttgtgatacttcatcttaaatttatagttttgcgatagtttgagtaatatatctgtagttttatgaaatttacttaaaattaattataaagtcacatctaaacaaacgctcgtaggcatactaaagagaaggtttagccaattactctatctattttcgaataatcagcacaatagactacaccgtttcactttaaatatagtttacttttaaatgattatattatgatgaataaagtgtatggtctatttattacactataaactacgataatataccacatttttaattattccaaacttcctttgaaaagataagatgtcaaagtttacaattgacactcagaacccgtttgagttcactgaagatggagattaaatacagacacgcaaaacggagatgttattagtttaagtttaaacttaaagttagatttatcttaatatttgaaagcaatttttatataaaaagttttcgcacggaatatattgtttagcgatttgaaagcatatcaatcaatataaactaagataatatatgcatcttattcagaaaagaaccccaatgtaattatttcaggacagatgggtaccttatttcccttttttaattactgcataaatgccagcacagctgagttgatgatccaagccaggctagccagtcaaagaggaggtcaacgtccacattgcactggtacatggtacacgtctcaccagacatagcagtgttggccaagcttcccagtatgaacgaacacactctcttgttgacccgggttgctaagggcatgtataatggtagccacaagtaattgtggtctcgagacgccacgtaggatagaatcacagaaaggtcacactacccacagtggaaaccactctaaaactttttttatgtcagcccttgtattatcaaacctattgaaactttatattttgaaccctatagtaaaaaaaagtatatgtacacccctaaataacttgggacccactgtcagcctcttcccatccattctcttttttattcccctctctctctcttcgatttcttctccaacgaggcaccaacagcgtcgctcggttctcttctcctctcccctccctcctcgtcggcttctcccctcccctcgctgctctcttctcctctcccctccctctgcctccggcggcagatcggcgccgatcgagctctggcggcgatggatctagcgaagacggggagcatcggtggcggcggcggcggatctggcggcggcaggaggcagtggtggcggcgggctcgccggatctggcggtggcggccacaacgcgactgtggttccttgacgccgccgtcctcctccccccacgacggtgcgaacgagctcgccgacggcgtggcgagcttggtggcggcgggctcgccgaatcgaggcgtgggctcgccggatctggcggcagggagcagcgacgacggggaagcggcggcggcggatccggcggcggcgagcagcgaagacggcgaagcggcgcggcggatctaggggcggtggctggggagcagcgacgacgaccacggcggctgcggcggtgtggacccccgtttttataacaggaatcaatcgtgtaaacagtaccatttccctggatcaagtagtttggtacacacgaattcatagctggaatatcaagtgcacatacacgagtgtctaatacgaattattacatcataggcccgcaggcatagtcttaaatcatcggaccgagaggtccggaatacatccaaaagcagaaatagataaggcagcggaattcaggctgcggcatgccattgccacaggcaacgaccgtactaagacctactggacgccatcgtcttcatctccctcctgatagtaggcatagggatcctccgaggcttcatctcccgcttctgataaattttatatttgcaaggatgagtaccaaccgtactcagcaagccaccacagcaacaatgcatatgaaagggggagttcaaaggatggccatagttcttttgcgcaaagcaagttttgtaattcttttcacaagcctaagacctagcattgactgatcaaattttagtaccagagtttgtatttaaacaacgacggttctgtccaccatccattgtgatcccaaggatagcttcccgccattgattcgtcatggttttctgaggacgtccaccttcctgcctctcaggaagtggctccaacagcataaaattgatcatgcaatatcccctcccacacaagttaagaatttagagtctagccaagtgtaatacatgtcccggtgctcaataaccgcgagcacggctattcgaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttttcatcctcatgcactctaggcgtacacggtttctagcagtgagaggagttctggcgcacccgggaagggaagactcacacatgcattaagttataattatgttttagattctcacatggcagtcctaccgatggcgacaccactgtagacacccgcctcgcggtcctaccaatggctgccccaccgtagagcccctgcctcacacatcaagaaaccactatgcatagatactgcctccgctcagctatctactccgctaggtctatacccatacgagaagtgcggttatacgggggtcatttcatgcttaacttcatggctcggtccttaattgaccagggacggcactagccttttccggacaccacccaagtcctccagccgccccagtcgaaaacagttgttttactttattttcctttcacaaatcatgtcatcaatatcatggcaatgtggcgctcatgtctccacatgccgcatctcaattaccttcccaaaggtaattgcccaagcatatagcatttgataaatatgagtatgcatgaatctaaaatagcatttctaagcaagtgtcatagttgactagggactcgtacgtatctatggttacaaagatttaaaggtgaacaataatcaaggcatggtataatcacaagtaggatgttcataattgcatgcaattttatttgtaaacaaaacaatttcgcaattgggatcaacatgttcaaagaatagtgatgacttgccttgctcgaggtcttgtgagtcttggccttcacttggatccgcggctccctcggtctctatagttacgtgcgtaagaacaatttgaattcgattagaattcaaacaaaatccaaataataaccgaattgaaaaacgagcgcgggagatgaattctatataggctacttaattcgcgaggtggaattatttttctccctaagatattttgtaatttatagtcatgtcctaagactcatcgaattattgagttcttaatcacatgtaaattattaccgcgaaattgatttcttagggagattactaaaaataatctataatctataggaattcatccaattatattttcattaatcctatatttaaatgctagtatttttggtatttaattagtaagaattcatctaactatattcattaatcctataattaaattctaatatttgcaaatattttaaatttcccccttaaattttccctttcttttctctctttctcttttcttttcttttcttttctctccctctattttcttttcttttctctcttttctctccctctctcttttcttttcttcttcctcctcccggctcccccccttcttcttcctctctcggctctggctctcccggcgacgacggcaatagacgcgaggagggggcggcttacctacggcggcggctgcgacagcggcggcgtcgacggcggcgacagcggcgcgagtcgcggcgcggcgtggcggctctaaggtggcggcgcggcggcacggcgacggcggcacatggggaaagggaaaggggaggggaagatgggggaagtgtgtgtggggaggcttggggatggagggagggcttatatagggcgcgggagaggggcggcggcctcatggcgttggcggggtggcgcggcgcggggctcgacgcggcgatgtgacgactacgcggcgcggcagggcgcggggcgcgaggcggcgacgcgacggcgtaccgcgcggcggggcagccgcacgagaggcgagcggcgagcggggcgcggggctcgaagcggcgacacgacggcgtaccgcgcggcggggtagcggcacgagaggcgagcggcgagcggggcgcggggctcgaagcggcgacgcgacggcgtaccgcgcggcggggtagcggcacgaggctcgaagcggcgcgcggggcgcgaggcgcaggcgcgcggcgcgaggcggcgacgcgacatctgcgcggcgcagcagcggcgacgcgacggcgatgggacggcggcgcggcgacgggacggcgcggcagcggtggtgcgcggcgcgaggcgcggggcgcgggcgcggcgacacgacggccaggcggcgatggcgatgggacggcgcgcggcggcttaatggcgatgcgacagcggcgcacggggctcgggacgacggcgacgcgcggacgacgacgcgacgggcggcggcggggcgcgtgggcgcgcggggcgacgagatggctgcgcggcgcggcagcggcgaagtgacggcgcgcggcggctcggggtgcgaggcgacgtgacggcgcgcggcgcggcagcggcgacgcgacgggcggcggcggcgcggggcgcaaggccggctagggcgccgggcgcgcggcgcgcgggcgcgacggcgacgggacagagggggcagagctaggggacgcactcgagcacctagcgggcaatgaatagtgacttttcctattgatcccgattttaatttatttcccatataaatttgattctataattcctaattttacatatatgcattttactcaatatgtgtattatcccaaccaatggatccacccctgattaattttacccatattttatttttatataattttcttgaatttaattagagttaattcttattcctacatttttaaattgaattgatacaaatatgatcgtgataatattttatttattactgtccacaccaaatcttattttaaattgcactttaattatttactttgtccatttattttttttttgggtttattcctaaccaattatccattattcgcgatttataaactccaaacccaactccaataaaataatcgaataaaatcggcatgatgcaatttatttaaaaagtttttgaaaatccgtatttttagagttttgatattttgtcggtcgaattttcagggtgttacaggcggatttggtgaggcgacgacgaccacgacatgaggagaccggacgaggaaatgcgcggggcgccgactcctccaacgcgaggcttcggcttgtggcttcgcggttcccgaacctaggcgtggcgcttgcaccggttcctctgcaagctcactgacagcctgcgagaccacccaaactcgtgccagctcggctcggctacgacgtggacctgcaagaccacaggccaggtcacgtgttgtacatggcctaaatgactaacatctggatcttctgaatgttggctgtgtacaccttaaaaggtgtagaggccaggttaatttataattctttatctaaaaatcttctgaattagaaaaacaatgctgatcagggacaaaaattgtaacagcaccaaaaagaaaatcagtgccacacatgatcgagaacatctatgaaaaaactgtatcttgtattaatttggtaacgtgagacggtaatttaacgttatactcaaataaaatagattgaaaaaacatactactactatgttaaaaaaagaagagatcctaactacaaacctagctagatactgacacaattggtgtctagtgggagccaccacctgacaaccctggacggcagcgcaactcatcgacgaacatgcagggtttacccgccccggcggttaccgcgcggtaaccgcggtaaccgtgaaaaaccgtacaaaaccatacaaaatttatcaaaaattcaaattattttttaaatttatttgtatttaaggaggttaccgcggtatttatattaccgtacccccgcggtaagcccggtaaccgcggtggcggtaagttaaaccctgcgaacatgtagggattaaaaataaaattttcatactatatactcaggtctcgttcaagtaagcgtaaggatgaatattatcatcagtatagaaaataagataagttattagtgaatgattaattaagtattaatgattaaaaatttgaaaaattgatttatttaaatttttataaaacttctatataaaatcattttacacgaaacacaaggagaagccaccagcagtccagcatcagcgaatttgaattcaaccttcatcgtggttagatttgttcaggctctagaaattattggtttcacagctgagcacattgcaaggacctgttggtaaagagaaatggcgcagcagtaaagagagagagagagaaaattacaaagcttttccagtaaattcagcatctatctcatgtcgcgtttcacctggtggctgggtgggaaattcagggatcgagctagcagtagcacctggtcctccctgcaattggcaagtgactgataaccatcactggctacacacgtgatcgatccatccaatcccaacccatatcatgcatcactactcaactagtatcagggtaacgacaatatatatagcaaaagtaatctatatagatgggactcacacatatagactataactatttttctcttcacaatgtatatagatattactattggttactcgttggattcatgctgctatactcattcatctatggccccgtttagttcgcgaaatgaaaatttttgggtgtcacatcggacgtttgactagatgtcggaagggtttttcggacataaatgaaaaaactaatttcataactcgcctggaaaccgcgagacgaatcttttgagcctaattaatccgtcattagcacatgtgggttactgtagtacttatggctaatcatggactaattaggcttaaaagattcgtctcgcaattttccccctaactgtgcaattagtttttgtttttatctatatttaattcttcatgcatgtgtcgaaaattcgatgtgatgtttttggaaaaaaaattttggaaactaaacatggcctatgttgagcagtatatacttacttttcgacaggtgaggtcgtcattaatatttgagatggtaagtatcacagaatctgttgtaaatacttgttgggggctagagtcatgatttttgtatttgattgctaaccaggaaaactacaaatgttaagtcgtgctattgatatgattgttttaatcttcagcatcaaccaatgccaaaatttaaattttaaaatttaaatttgaatttttttatcaaaagtttatttttcagcattagcgtttaaatcactaagaatatatataaaaaagttttacctataaaagtcaacaatattatatattttgaaaataacggagtactatacaaagtttacataccactctatgctgctacgagacgagtatttgtcgtcttagataatgtctttcgtcaaacacgaacttttgccgaccaaagattaagttttgaggctccctttgactcgcgggatagtaaaaggtataaatagaaaaatgtattaaataaaatgtgtgatttttaaatcccatagtaacaaaagatcacaagaaacaagatatgaacccttcaattgtgccataggaaaagccaagaaaatattgagacacaaattctaccttggttttcattaacatgctttttaaacgatcaaatggtgtatacgtacaaaaactttatatatatatatatatatatagttgttttaaaatatctgataaattgttattttttaaaaaataattaaaacttaatttatcatgtactaataactttcttgttttgcgtgttcatacttaatctttcatccaaagcacttttgaatgggcccgcaaaacgagctcatacctcttgttattttcctataaagtgtaaaagatataaatacaatcatatgaaaagtttccttcctttatatataaagggaactgggcctgtttggcacagctctagctccagctccacccctcctggagctggagctcagccaaacagtttcagctcctccaaaactgggagtagagttgggtggagctctctcacaaaatgtactagagttgtggagctgggtttacgcagctccacaactccactccagcctcaactcctgaagttatatttaggagttggagctataccaaacaggccctaaagagggaaaaaatccataggaggtttgactcctacgaaaaaaaatcattgcttatcatatgaatcaaagtaaccataaattttggcggttaaaattcaaattcaaattttttattagggcggtaactctaaccaaactggtacggaactcagctttgatgtccggtagtatgagcttgactatttgaggatgaacaattaaacacccaacccctctgttgacccgatctggttactaaccacctcctccattaattcggaccagtcaacgaccatctgctcggtcaatccggatcctctgtggccggaaacctggatccgtacatgtggtcaccacaaatcagctagcacacctgtacatgcttgaatttaccaagcacatttaatatttcttttacataatttttaaaagtgctatattttagaacgaagatatcaattacatagtaatcagtttcttaatatacgatgacgcagatttttgtatacactaaccattcgtgttctttaggtcatttattttgggaaaaagtacgaattaccccccgaactatcacggtcatctgaattaccctcccgaaccacaaaaccgagcattcttcaccctcaactataca

SEQ ID NO: 82642 - DNA, 2448 bp, Oryza sativa
gaatgcattggggtgggtataatgttcattcgtatgattgctctaagtcataacaataattgtagagtagtatttggtagtataagcgaggtgcttagactattgaatatcattatatggggttatatgctgcgggtcagtcgaggtgggccgctgatagtgatagctcagtataagtattcctccatattagtatataatcctaagttacttttctagggaggttacttctccgtatttagcaccggttggatggccataatgggttgtcgtaagaaactcggcaaccaggagtggtctctcgaaacaccaggagggcattgtaatgggggtattggctatataattatatagcagataatattaactaaagttgtatgtatattagaggtgtaagaatagattattttcttattcttttccattttgcctagacttattatttatgagagaatgagtttttatgcttcgtgtcactctacccttgaattaaattaacacctgcttagactgattattacaagtaacatataaatattagcatagttttctccattataatctttccacgggactaaacaaatatgatacccttgtaatacttccgggtgaaatgctactatagtatatccgtgtgcttgcgtatatgatttgtaaccataatataacataaatatttctgttccattgctgggcattatatttctagtaatgtcgttaagaaataccaacagtgtgggggtggcgacggcgccggacatggcttccctggccagatttggccccttcctgggatgacggtggcagccaaggaggcgggaagggagatagcaagcggcggggaagggggaagacaagcggcggagtggagcaggagcgacggtgaggccagatccatggcgggcgctgccagatctggagggggcgaaggtggaggaaggggagaacgaggtggcaggcggcgggggcataggagaggtggtggtggggcagcggcgactacgctgggagccaccagagctggcaattggcagccgtaggagcaaccaagcaaggggcgcgagatggcgccggaggcgccgtcgcgacatgaggaggtggtcgtggccttagacacggcggcgacatccctcacagttggcaacatgcaggggagtttttgggcattggcgtcgactcgtgctccactagtggctagacatcctcttcttcatggagctcttcccccccccacccccctcctcctatggccagcctcagatctggtcacgggaagatccacgaggagggtggaagccgatactacagaaacacaaataggtgccggtttaagatccgacacttttgaggttccacgaatcaaaaaaaaatccggctcgatgcatcggctagtcacgacgaaggaaacaaatgcggatttcttttttctcggaaaataaaacgaatagagtaaggtactatccgtcggaatgggaaaacgttcagaaattttgtccggatatccacatacatagatcaaattttagaaaaagcacttatatatacataacattttcatacggagtcagatgaagataaactttagatcaaattgtagagcttgatgatatctacaatttcttgttgactattttattatttgagatcatttttgagtctaaatattcattataaaataccatatctatttttacaaaacctcatatctccaattcaaacgacatctaatggagatgtgttccatatcaaaattgtagagctcaatgagatctaccacttggtagtttataacatttgtattttaaaatgtttaaagtataaaacaaacactacaagttttgaagatgtgaaataaaataaataacatctctaatttatacaataagatcttgataagtgatatggtaagtaagctatacatgtagtaaaaggtcgtgggattaaaaaataaataatcatatttacatatatttacatgtgagtctcttaggggaattgccttgaaaatcaattttcacataaggttgtagtaccgcctccgaaattgtcgatataaatgtttgagaggatttttatataccgacaaatatttgttgccatattcgttcatttcatattcactaggtatctttatttgataatattcgatttgatttccgtatccggttctcgattctgattccaattccgaaaaaatctaaaatctaatatgataaagctagtttccgtccgtttctgtttcgttttcatccctacatacgtgcttcttctggccgtatataatgtgccgtgccttgttaatataacccctgttatccaacgtgcgcattaaagctatctaaacttgtgtttcagaaaaaactccaacatatatgcttgatcaggcaagtctagtgttgcagcgtccggaggcattacttttaaaaatatctgtttgaaactatatat

SEQ ID NO: 82643 - DNA, 8701 bp, Oryza sativa
ttggcatgccttgggccgggcctcaggccatattgctatctatattcagaacccatccactaatttgctatctgactttttttttccgtctatatattaaccgtggcatggtgcccgggggtgggggggatacatctcgatgctttgctaggtcgctctagctagctagccagccaaccgctccattccaatggctatgcatccacgcctcttgccgccagtcaccatgcacggctgcaattaaatctgcaagtgaaacattgattgacgctgacgatcatctggttgcatctacgtgtaaaagagaatgtgagaagcagcaccagcacatcacgttcgtcgtccgatctttcttcatccttgccacagctcaatccaatttgccatatgttgttagtgagtagtgacaagcgaggaccttttagcttactttgttaggtttctttctccgatcctcttctcagagcttagagattgagcttggatcattggacgaagctgcatcaagcccattttgccgactcacttgccatatgcatccatgatcaactaattgttgaatggtaagatttacaccaatatttgtagttttgcagcctttgtaatttatatgagttcaaccactaattaaaagcattactcttttcattagtaatttaacctgcccttaatatcatgtcattgagaaagtttgtatcggttggcaaaaaaaggaaaaggagagggaaaacagtggatgatttgatagaatcatagaagagggcaatggataaattttaaggtaatattataaagcctattacgtaaatattgtttttgacgtaattcaagtgctaagcagtaacaccttatatatctatataaattattatttagatgttatattaaggggctcctattttgataggaacattaatagctcacttcgacggtagaaaatactcaccatactttgtggagaaaatatgaaggaggagaagaaccgttcatcctcacttcattatcttcttaattaaaagtatatagtgtttgtgtatatgcgctgaattcggaagtagattcagaaatgttttccattggttacacctttagacattgtttacaaattgcttgttcaagaaacaaccgaattttattgtagcacacaaggactagtctgctccctgaacagataattggacttggataggggcttctttcctgatgcatcctaaccctaccgcacactgatttactagctagaggttatctttctgcatgaacagaagtcatcactgcagaaactgaattagttcaatgtgagatgaactggtgaggatcagtctttgtgtatggatgtacataaatggatgtggttcaccgcatttcatgggcttcaacagccttcaattagttgatttgatatatgatagcttttcatttggagagtactattggtgaaatggaagagagacagtggagaaaagataattgttgctacatatgacaacagtgagagtcaacttttagcatttatcaaaggaaattttgatgtatggagtgaagaaaagaaaacaagagtgataaaaaaaattatttcggtgcagtaataattaaaaggctttgttgtgtcaactattatagaaagatagtttttaagtgatatttattaaatatataaaagctttcctacatgcccttacattaattcttgaagcttgggttagtttctaccctgcccaaataattaaatataattaaattataacctaattaatacttcgttgtaaaaaggatgatgtactacagtacagtgggtaggccaacaccccaactattaatcataaattaacaccaaatattcaggattttaatcacccaatatcaaatcccatataaattaaatgtctcattttgttcatcacaaaatatattaatcaaaacccttgatttcacaggattgagctcatttccagccagagaaaggacatgaagacaaactcactcgatcacttgtattaatcgattacccttttctttgttgtaatagtttttttttttttgccttcgtataattatgtttgattcgcttggctttgattcggaaaaagaaccccatacactaaaatccacacgttttttaatttttgtgccatttaagtgtgttaaagccttcattgctgaacactttttaactgccagagcatattttctaacaatatttgttctgagctcttctttttctttgtcttgcaaattggatcactatacaagccatggaaataaagatcaacagattttgttaccttgcgtaactcgacgtctgttgacagtatacgcattaattttcttgcacggaagaatcaaaacaagttgaaaaaatgtggtgcatacagtccactttaacaaacttttatccattcatgtccaaatcgattaggtgtgagtcacaataaatgttctatgcaaacaagctaatcacaattatgaacagcaaaaaaaattgtgtccgttcttgagatcactttagtctttatagctatatatagaaaccacccatagatagctatccctctcataaacaaattgatagttaagattttctgcaacaaaaatatggcttccaacaaggtagtgttctcagtgttgcttctcgccgtcgtctccgtgctcgcggcgacggcgaccatggcggagtaccaccaccaagaccaggtggtctacaccccgggcccgctctgtcagccaggaatgggctacccgatgtacccgctcccgcgttgccgggcgttggtgaagcgccagtgcgtcggccgtggcacggccgccgccgccgagcaggtccggcgagactgctgccggcagctcgccgccgtcgacgacagctggtgcaggtgcgaggcgatcagccacatgctgggaggcatctacagggagctcggcgcccccgatgtcgggcaccccatgtccgaggtgttccgcggctgccggagaggggacttggagcgcgcggcggcgagcctcccggcgttctgcaacgtggacatccccaacggcggaggtggtgtctgctactggctggcgagatctggctactagctaggctactgtagctagctgtgcatgtatgtggtgtggttactaaaataattagtgttttccttttgtttggaagcatatgtgtggtgaataaatgatgaactccgatgttcctctctataaatcttgatgattcgctagctatccgtacgtcgttgttctttgatttgatgatgagattgaaaaatggaatgtcatgctaaggagggtgcccatgtcggtggccggaatggtgccgctgcagggctgtggtggccatagggtcgtcggcatggtgaccgtgccgacggtgtattgctatgcagcctgaagatccccctctatagtaaggccacttattttagaacgaaaagagtgattctaattttcacatccacgattgctgcgtccctatgtatctgaagacaatctatctatctattctatatctatactaattgggcattttccagagctctcacgttatactaattgggcacttttccagagctctcacgtcaatcagattaatctgaccattgattaactagatcgtaaaatcatgaccgtagattaaatattataactatggacctttaattaaagcccaacacgtgtctgggccaccattcaatctatacaggcttccttcaaggtctacaaattgtacccatatcggtctcagcagtcggactcgactctgcacgcgacgagatcacaacacggcaggctacgtcgatctacttgaccctgcagccgaggaactccgtcgaccggatgcattggcgaggaagtgttttatcgatccaagatattgatctctgcaggtacgatggctatttaaaatactcaagtgagcaagatctgattcaatctttttagggtttcattcagttgtttcttacatgtttctcatctaaactaactataaattaatttaagattaattaacaggatacctttgtgcattgtagatgtaatgatgaatcatcttatatgcatcagtcgattgtagatgcgatggtcaccgatggataacctagattcaaacagaactttggatttattgatgaatatgtaaacacctgaatttaattatagggtcaactcccacatcatgtaatatgatattcttgatttttttattttaattgaaataaagaattaattatgttgctgatcttttttttattgctaatgagaaagttcactataaattaataacaagttttaagtggacatttcctttttccagataagttaaacatatatcgctaacaaatctgctccatgcttcatccaaatacatttgtttaagtgaatctatgatttctcgaaattttaatttagcatactaatttaatgtatgatgtaaaagtgctaattaaaatcgcgtatctaaaaacaggagcatagtaccaaattaggagaccacacaaggacaatataggtagtgattaattccaaaattcaaaattattaaaacatggaaatgacttatgcttcagatgtgtgacgatatatattactttcgaattttgttattttcaaatctacctggaaatctgcagatgatctcagcagttaattagcagctcaagctacctggaaatctgtagatgatgcgcgtgatcatggacttctacatatgtgctatacttaatttttgtttgtaaattgtgtgtccatctgaaacataaaaatatgatacccttagaatactctagggtgaaatgctataatgggatatccgtacgtttgtggatgaaatctgtaaccctaatataccagaagtatttatgcgctattgctgggaattatatatttatagtaatgccgttaagaaataccaatagccaccgcaccatcgccgccccaatctggtcagggtcgtgggcatcgaccctgcgacctcgagggagaaggaaggccccattgtcaccatccttgcagctgcgcggttttcggctgaccgctcgggcggcagcgaggcggaggagggtggaagacgggggtgaggaggaaggcgctggttgccgccgaccgtgtcggccctgcccctggagcgacacggggcccccgttagtccgacatatgacaaactttttgtgtatggcttttattgatgtcatgaacgaacagaatgtccaggaagcagatggactagggagtctaaggcgaacttggtaagatctggaatggactgtgctgctacaaggatggcaagggatgctatttgacaggtcatgaaactaatacctagttatcatatttaacaagccacgtacgtacgtaatagaaattactaagaacattacataaaaaaaatagaatttcaagaacaaaactatagaagagaggaacgtcgtccattccaccttttattacttattactagcggtcaacccgtgcattgcacgggttactgtgaatgacaaaatattaaaatttcactggataatgataaaatatattgttaaactcataagttaaattttgtttaaaagaaagttgatacaaaacactttcatttaaattatagtggccaaaaacataattagtaatttcttatataacccattctaatatttcttctattactttatgttttttttgaaattacataatttcaaaatttagtattagaaatatagatttatactcgttttgctgtctcttgtgagcattttgctataaaatagtttagcaattttgaattaatatgtacagaaacaaacttggtttggatttaacctttttcacgatttgatgattcctattgtggagattatgggtaccccatatccacacggcatggttatccgactagtaataggggataacatatatgtatgaaatatgtaacagatcatgacttgggtattacgtttccctgtatattatggaacggcctaaagtcctggcttgataagattgtaaagtagatttaggaaaccgataccgtgttggttaaggtttctatcttgtaatcctgccccccatcctatataaggtgggcaggaggccctctagggggcatatgtcacaacctgatcgtcagatctatactacacccggcggattcaaatccccaaacaggagtagggtattacctctcattgagagggcctgaacctgtctaaatcctttgtctctgcatccatccacttttaggtctcgtgtgctacccccttttattattgccgaaatcatgtttcgacagttggcgcgccaggtaggggttgcgtcgagtttcctatcaacaagcgcgatggaatcaatttcatgagtcgccgacttcgttttcgctttgggagttttcacttcctttccgtcgaccacttcttcaagctcctcttctctaacttgatccaaatcagtcagggggaaactcaatctgatttttatcattatttatcgtattgatttttaatcccagattaatctcttgctattttttgttgttgttcgcatataattacgcggcactattgaggcgattgatgctggtcatggactcgaggcgtctcagctttccggtcgatcggccgcgagtccactctgccggcttgtcttcgccaccgccattgctgataacaacaacgacttcaccgccggcctgcctccgtcgccgccgattggtgcctccgcctacacggctggcctattataccgccgctgttgcgcgtctacgacttcaccgccggcctgccttcatcgccgccgactggtgtcctcgcctgcacggctggcctattatgccgccgctattgggcgtctacgacttcaccgccggcctgcctccgtcgccgccgactggtgtcctcgcctatacggttggttggtcacaccaccgttcatgggcatccacgtcttcaccgaccggctggccttcgccgccgccgactggtgtttccgcctgcacggctggcctattatgctgccgctgttgggcatctacgacttcaccaccggcctgcctccgtcgccgccgactggtgtcttcgcctatatggttggttggtcacaccaccgttgttgggcgtctacgtcttcaccgccggcctgcctccgtcgccgccgattggtgccttcgcctacacggctggcctattatgccgccgctgttgggcgtctacgacttcaccaccggcctgcctccgtcgccgccgactggagtcctcgcctatacggtcggttggtcacaccaccgttgatgggcatcgtcatctacaccgccggcctgcctccgtcgccgccgactggtgtccccgcctatacggtcggttggtcacaccaccgttcatgggtgtccacgtcttcaccgaccggctggccttcgccgactggtgtttctgcctgcacggctggcctattatgccactgttgttggacgtctacatcttcaccgttggctcaccttcgttgccgtcgactggtgtttccgcttacacggctggcctattatgccgccattagtgggcatcttcgctttcaccgtcgaccgccttcgtcgccgccgactggtgtcttcattgttattgatggacgactttgttccctcattggccacttctgccatcaccaaggggaatattacaaagctaagtcatcatttattttattctttatatgacatttttccttttcctctgcctcacgacatcaattggtcttccattgagtagtgagtcgggggctacagatgttatatcatattttttataatatttatcttgattgcttgcgacataatctgagtacaaaagtacctatcgagttatggagttctatcttcctatgctttccatttggtttgccaatggatggttgcctttgggccgattcctagcacccgggagctcgttggatggaccgagtaacgcaaggtgctaagtattattcggaataaatcaaaagcatagagatgagataaatttattttctgctcttaataattgcaaaagtacccgagtagtaaattctgattcgtgaaactttgttctattaatggcgaactcatgtcactcatatgcatgtctgggaagtgcctaggccgactcccgatgcttgggggctatgactagtcggacagagcgtttaaacgtaatgaatcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacatcaccaccggctcgcctcgaccgccgccgactggtgcttccgcctgcacggctggcctattatgccgccgttgttgggcgtctacgtcttcaccgaccggccgcctcgtccgccgccgactggtgcttccgcctgcacggctggcctattatgccgccgttgttgggcgtctacgtcttcaccgaccggcttgccttcgccgccgccgactggtgtttccgcctgcacggctggcctttatgccaccgttgttgggcgtctacgtcttcaccgactggcttgccttcgccgctgccgattggagcttccgcctgcacgg

SEQ ID NO: 82644 - DNA, 6134 bp, Oryza sativa
cctttatgctgccgttattgggcgtctacgtcttcaccgaccggcttgccttcgccgctgccgactggtgcttccgcctgcacggctggcctattatgccgccgttgttgggcatctacgtcttcaccgaccggcttgccttcgccgctgccggctggtgtttccacctgcacggctggcctttatgccgccgttgttgggcgtctacgtcttcaccgaccggcttgccttcgccgctgccgactggtgtttccgcctgcacggctggcctttatgccgccgttgttgggcgtctacgtcttcaccgaccggcttgccttcgccgctgccgactggtgcttccgcctgcacggctggcctattatgccgccgttgttgggcgtctacgtcttcaccgaccggcttgccttcgccgctgccgactggtgtttccgcctgcacggctggcctttatgccgccgttgttgggcgtctacgtcttcaccaaccggccgccgcatccgccactgctgactggtgtttccgcctgcacggctggcctttatgccgccgttattgggcgtctacaccgaccggtttgccttcgccgctgccgactggtgttttcgcctgcacggctggcctttatgccgccgttgttgggcgtctacgtcttcaccgaccggccgccttgtccgccgccgactggtgcttccgcctgcacggctggcctattatgccgccgttgttgggcgtctacgtcttcaccgaccggcttgccttcgccgctgccgactggtgtttccgcctgcacggctggcctttatgccgccgttgttgggcgtctacgtcttcaccaaccggccaccgcatccgccgctgactggtgtcaccgcctgcacggctggcctgttataacgccaactgatgctatcttcttcacggctggctacatcgctgtcactactaataggcatcagtatcttcaacacaagctgcctacgtttgccatggctgccgactggtttcttcacttccatggccgcatgattctgctagtgttgattggccttaccatcttcatcaccggtcggtctcgtctgctgctaactagggcccttgcctctacatttggtttatacagctaccactactgatggacatcatcgtcttccgccgtcgactcgtgttcacttcatcacggcaacacaactttgtcatcatggtggagcgacttcatctttattatcttcggatttctacttggacatcttcaacacatatcttcaatcaagcaatgactactcgacgacaagaagctataattctcgactctatgttcagttgtttcccaactaaccaaagagtcgggggctacacaaatataaggctcaaaatttgacaaattttatataagccaatgagtcaactccaggagtcattatcttcatctttgcttcggaacagacattctactccaacaacttcaaatatttcggtttggacgagttggacaacaacatcaactctcctccaagtgaagcatctacaacagctataacattaatttgatggattattgtcactaacatcatctccagcacctctgcttcatcgaccctgacatctccgctgttgctaatggatgattatgttttcgccgacttattatttcaccttgacggttgacctactacgcaactgccgatagaggatctcatcgttatcatcggctgctacatcgctattgactggatcaccgacatcgtcatcttcatcaacatcttgttaagcctcttcaacatagcctactctgctgccgttgatgggaaacttcgtcatcatagtcggctatctctgttgccgctaatcatcattaccgtcggatgcgtttgtcgccgccgattattttcttcatcttcatgattggtgggtttcgccatcaccgttgatgcgcgtctatgtcttcatcgtcggtttgcttttgtcaccaccgactgttcttttgttgttgttgggcgcctacatcttcactgctagctgacctgactgttgccgactggtttcttcgcctccatggttatgcaacttcattacctttgattggtgtcactgtttttactaccactgacattttccgttacttctgatgagcaatttcgtcttcatgttggtcatttcatctccatgccgactgcatcagctattgccaatagacaattttgactatgacagaaggacaagctatatgctcaggggctcatcaactcaagcgtgaggattatatctccaatttggacttgttccggatacattccacatggattcatagtcatgagtctattttatatgctcaaagactggaccaattattattccccgtaagggctatcaaccgaatacttgcgccagtcgggattcaattattatattacccggaagatttattactcgggagcatgttatatgcgtcatcctttaaagggtgtcgaaggcatattttttggcctaggcctaatatgtctgcagcccatattttcaggtgtggcctatcacgttcttttagggacttaggcactttttgcttaggccaaagtgcgcgtgatcaagtgcccaataccttaaaatccttttataccacagttattcaacttttttaggagttggtacaatgcatcttaaaaggtgtcaaacagtaaagctttatatagctgtcccgctgacttttttatataagtcaaggtgctgtttgggtttttaagcaattgattggatacaatatcattgctttttgccacgtaagtgtgcatttttattgaccaatattatggcttaggctgattatatattgtagtcattttccaggcggttggtaaatcctttatgagtttatttactcggattttataccacatatgccatatatttccaggtgtggtggaaccatgtgtcttctagggacttaagcacatctgttaaagcagtgtgcgcatggggtatgcccaatactttggaaatttctttattcacagcattcaagcttctttatagttgttttgctatgtgaactttcaaagatgttgtcaactttaggttgtacgcatcatattttgccaagcagtcggtatatcacttggattatattattcggggattcacaccgcatatgctatatattgatatcaagtcacttggttgattacaattatcaaaaccactcagttggtacatctatttgatgcacctgactttaatttttcagcccttccacagtctttatatttggtaaaagtactcgggagatcatggcgaggatgattgaagcactcggctttggagtaatctagttcgagagaagattatctttccgactgtgaaggtctcaggggctactgtggagattatgggtaccccatatccacacggcatggttatccgactagtaataggggataacatatatgtatgaaatatgtaacagatcatgacttgggtattacgtttccctgtatattatggaacggcctaaagtcctggcttgataagattgtaaagtagatttaggaaaccgataccgtgttggttaaggtttctatcttgtaatcctgccccccatcctatataaggtgggcaggaggccctctagggggctaagaagacaacctgatcgtcagatctatactacacccggcggattcaaatccccaaacaggagtagggtattacctctcattgagagggcctgaacctgtctaaatcctttgtctctgcatccatccacttttaggtctcgtgtgctacccccttttattattgccgaaatcatgtttcgacacctatattcgtagttattaaatatcaagttgtattccatgtggagtagtctcaaatatatatagcatcttcataatttagttttaaaattcctaattaaaaaatattacactctgtttgaagtcttaattattgttttatcgtgattaaaaattattccaaattttggcgtgggaagattatagtagagggaatcgtactaataatttatatattacttgtaataaccatagtttaagcaggagttaatgtaattcatagggtagaatgacacacaagcataatactacttattttcatattaaatcatctaagctaagtggaaagaaaagagaaaagaatctattcctatatttctagtatacatcttatacatacatcctaactataagattaactagctaataccctcttttcgatgccctcctggtacttcgagaagccacccctgactaccgagttccttacgacaggtcgtcatgaccatacaaccggagctaaatacggaggagtaccctccccaggaaattaacttaggactatatacacacgcggaggaatacccgtactgacctgtcaccatcagcgactcacctctcttccgtagcatataacccaaataatcatacccagtaatttagacaccacgcctaattaccagatactactctaatatcatcatcatgacatagagtaattacataagcaaacactatacccgtaccattgcatctcctatataagctagcagtataatcaatataacttgaatataaagtaaagttggcattcatatacttggaaagtattacaataccagaattgaataaagaagaatattctaaataaagtacaagtcttacaaaagaagaaaggagaactgctagagccatgcccaaactcttccgaagacttccagactctgatttctattctattcctactccactagcttgagaatgctaaactaagcttgagagagtatgagagaactttgctcgaagtgtgtgaagaaagtgaggagatgaaggccttaaataagcaggtaatgatggttatgacggttggaaaggtcggtaataccctccaatcgccatagggaagcaatccacaccgtctatcgccaaccctggatccatcggctgcacggcgggttcggccgaaccaggcggtgggtttgtccgaatgaggggacggcccaacccagcccattttcggctggcggcctcctcttctgctgttcacttcagacttgtgaattttgacccaattggtcatgtcatttctgcattcttggcccactcattgataagtctgattctcctcatcgtccgattgattgattgtctgttgtgatgttgattctcctccattttatgttcattctctgcaagaggttagtaatcccagtactagtggaatatttattattctaacacaaatatgcattgcaaggataactagctctctattattttggtagtattgacggtcgaaactgatcgctaacgacagtcaacagtggcgtcggagcgtcaggctgggcatgcagaggcggctgggtgcggaacggttgtgcgtggaggcggttgggtgcgtattgacgatcgtaatcgatcagttttgcaagttaatattactaaaataaaggagaactagttatacttgcaatgcatatttgtcgtagaataaactattttcaagtaccactaggattctaacgtcttgcagagaataaacacaaaagggaggatagtcgacaacaaaatagacgatcactcaatcagatgctatcgagaatcagacttatggacaaatgggctgagaaaaccaaatttaaaagatccaacaagcccaaaattcactattttggataaaggaggcagagaggaagcgatctaccgaagatgggccaggtcggcccagcccatggttcagccgaaccttgcgtggcgccgtcagatgcagcgtttggtgggacggctgggattgatcccaatgatggttggagggcgtttccgacctttccaaccgtcataagctgcctagaaaaggccttcacctcactccctccatgacacactcaagcaagaagctccaagctctctcttaagtttagtttagtattctagtgctagtggagcaggaataaaatagtttctttagtcctcggagccttcggaagaattcgggtatggctctagtagctcttccttcttttgtaagacttgtacaattattagaatattcttcaaaatatatttacagtactttacttcactctgattattggagtacccactttccaatgtattatttga

SEQ ID NO: 82645 - DNA, 11836 bp, Oryza sativa
tccggggtcatccaaggccttaggagccatctaagggctctggggccgatcaaggcctccggagctgtccgtgggctccggagccatccaaggactccaaagccttctagaccctccggagctgttcaagggctctgaaggaagccagggcttcaagagccttggacgtaagatgggtgatcggatcgtagtgggacgccataaatacgcactacacatctgccaaccacctctgacgctgttgatgagggcataccgcgcacgctattacccagatacccgggtaatagccggcgccctcgggaatcggcgccactcccttaatgggcgcagccctcctatcaccgaggagctgaccgaagagccctaaagctggcccaccagccaaccggctagataaattagctattagggtagcgatgtaatttccccttgtacatccttgtataaatatgtaaacattgctcacatttgggcataatgaatacagaagtgatacacatacgcttgttggattttgtcccaacatttggcgccgtccgtggggacgaaagaagcaagcaggcaaagaattttcattaagaaaaaaaatcaaactacttatgatatgaaacaatggtagtaaaaagaaggggtttaattaacacacggtgtatcggacaggacgcggggtcgggagatttgtttgatgttgttcttctcgatgtcgatcatcctccgatagaacctggccatatgcgccttgcactcgcggaaagcgggcttatcctcctcactaaagcagtgagcctcatcgctcatgtccaagctgtccgcgagaagctcctcccatgtcatgagcctctttctcaggcaaggatgaggtagcgtgcgagggatccttctccatctcccaggcgtcctcttcctcctcgctggggcctcgcctgaccctgccgtgggcagggagtccagccactcccgcgcggtgatcaggacggtggatccctaacgaacctggaacatcgagtaggtcgccaatttctcttctatggtgggccttctcatctccgcttgccgaatcacaatctagggttaggattcttcctcctcgcgaactcgatgggtgaaagaaagtggtcaggactgaggagaggcgacgtggcgcgtccctgatatatatatgttgggggaatggctccgggtagcggagccagcctccgtcatgtgatgcaacacctaccggagccattcaccccaggagaatgaccggaggcatctactgatttaggctccggagctaaccagaggctccggagccaacctaggccttcggagccacctaggggctccggggtcatccaaggccttcgaggtcatctaagtgctctggggccgatcaaggcctccgaagctgtccgtgggctccgaagccatccatagcaacccgtttgcggtgcgtgcaggagaatcgtcgaatgctcgtatggtttgatggattcgtactctcatttcacgcctaactgttagccaaaatatcagctattcacggccagatcgatcgagtgagcgcagaaggctgtgtttagttgctgaaaaaagttggaagtttggggaaagttaaaagtttgaaaaaaaagttaaaagtttatgtgtgtaggaaagttttggatatgatataatgtgatgaaaagttggaagtttagggtagctgaggtgaactaaacacggccgaagtttgacactccggccatgcacgcagcctgatgcacgcgctggtttaattacctggttttcgctgttgcttcctggagtagctgttgaacaggtgctagcgaaaaattgcgtcgggtagctttcgctgtttaattacctggttttcgctgtttgcgtcgtgttcctttccagtttaaacattaattaggctgcgttcgatatcaggagttcctaactccccctgtttttcgcgtgtacgcttttgaaactaataaacggtgtgtttttaaaaggtttatatatgaaagttgcttaaaaaaattatattatctttttttaaaaaaatagctaataattaattaatcacgcgttaatagaccattgtgttttccgtgcgtgaatgatgggttcccaacccccaccacccaacacagccaagtcattagccgtcctatttttaatactccatgatttaggaagaaataaaccgttgactgccactcgatcgccatacacacgtacaagagcagatgcaataatcctagtcagcaggctccaaaagctattatattgtttttttttattagatggagggaagagaatcgatgagagagaacggagcgggagctaatctggcgcccggcgatagcacgcgttttcacgcgcactcacgattaaaaacatattttgtgggtcccacggtcacttatccgatcccgtgcgcatcctccttcgttccaccctccggtgcttcgtcgaccgacggacggcgtcttccactagcgtaatctgagtatttctcgtcggcgagcgagaaaactccatcgcccccacagatcacgtaggcccatcctccatcctgaaccacgcacgctcatcctcgattcctcatcctcgtccaggaagtcttggcggcggaattgcagccgaccagaagcatctcatacgggcgtcggatcctgtacgcggcgaggtacgtagcgatgactgtgctcgtcttgtgcttttgcataggctgatcaatcatcattgatgaagacccgggaggatcgatgtacagatggagctaatccatcgcgagcttgctccgctatgatcaaccaccggctagctgcaaaaccgttttcctttgctgttttttcccttccttgcattttcatgcttccatgtgaatggagatggataacaggataaacaatctatcattatcttttagttgctatttctgttgtcgattttaggcagggtgactgttgcgatttcgcctaggaagaagaagagaggggaaactcgaagaagaaagatgagccagcatgcacaaaaccaaacgttttctttttctttgatgtgttcaccttcatagttcatatcacagcaatggccacaaaaataggatccacttatgatcatacatgtcaacacgtgcatacataattaattgtttgatataaaattatactgtagtcagctccctccgtctcacaatataagtattttgagtttttccttgtaacatttgaccactcgtcttattcaatttttttttgcaaatataaaaaatgaaaagttgtgcttaaaatactgtagataataaagtaagtcacaaataaaataaataataattttaaaatttttttaataagacgagtggtcaaacgttgcaaacagaaactcaaaatcccttatattatgggagggagtacaaaatatggttagagccggcagtcggcggcactattgaccttgctcacgtaatcctgcccatataaagagctcacgtggccacacatagttcgtcgatcgatcggctcccttcccgccatggagggttcgtctcgatctccttgcgtttgcatgctgctgctgctgcttcacgtcgtcctgctcgctccggtgctccaagcacggctgctcggactcggacatggacgtcgtctgctggtggcgccgccgctaataatgctgccggtctcgattctattgccgaagcggagacggcaggcgtaacaaaaaaaaaaaaaaacgcaatgcacttgtcgtgtccgaccttttttttttcggaaaaagtatacttcgactccttcaactatgacccgagtatgattcatgacctccaatcacaaaaccttgactcctccaactatcaaaaccaatacaaactatatccctcggtggttttggaagcggttttcgctgacgtggcacttacgtggcagtgttgacccggtcttcgtcccacgtgtcgcttatgtggcattagagtaaaaaaatattgtgggaccaacatgtcattcaaaaaaaaaagtaggacccaccgacatatgggccccacataattatcctcagctctccccctctttctttcatcttttctactcccctcaccttcctccatcactagagacggggcggcggcgacggtgacagtgacggcgcacgggggaggagctcgccggccgtccacgcgagggggaggagcccgctagccatcccgcgagctcgccgcccatccgcgcacagagggaggaggtcgccggccgtccgcgcgctgggaaggaggtcgccggcgtccgcgcgggagaaggtctccggccgtccgcgcacagagggaggaggtcgccggccgtccgtgcgcgggcgaggaggtcgccggcgtccgcgcgccgggaagaaggtcgccggcgtccgcgcgccggggagaaggtccccagccgtccacgcgcgggggaggaggtcgccgtctgtccgcgcgcgggggacgaggtcgccggcgtccgcgcacggggtagaagctcgccgccggccgtccgcgcgctggggacgaggtcgccggaatccgcgcacgggggaggagctcgcggaccatccgtgtgccaccgcgacgccatcgtcacctctccccggccggccattgtcacctctcctcttcgtgcttcgttgcttcggccagccgcctctagtgatggaaggtgagaggcgtggaaaagatgaaagagagagggggagagatgacgatgacatgtggggcccacgtgtcggtgggtcccacatttttttttgaatgacatgtcggtcccacaatttttttaactctaatgccacgtaagggacacgtcgacgacacgtgggacgaagagcgggtcaacactgccacgtaggcgccacatcagccaaaaccgcttccaaaaccaccaaaggatatagtttgcatcggttttgatagttggaggagtctatatacctggttttgtggttcgaggatatgaatcatactagttgagggagtcaaagtataatttttcctttttttttcccaccgggccacggcgcccatgggccaggcccaggcgaggcatcctattccgtgacgtggataaatttctttttcgtctcccctgatcgcttctttccccatcgagagttcgccagaaggaagaaacctaaccctaagattgcgattcggcggcagcgacgaggcgcgggcggagatgaggaggcccaccatagaagagaaactggcgacctactccatgttccaggttcgtcagggatccaccgtcccgatcaccgcgcgggagtggctggactctgtgatggctggagttggctcgatctctctggcggtgcggggtgctggctcgatctcggcggcggcaggagcgggagatggggcttgctcgagctcagtggcggtggcggggactggctcgatctcggcggcgggagcggcagatgggccttcctcaagctcagtggcggtggcggggactggcttgatctcggcggcgggagcggcagatggggcttgctcgagctcagtggcggtggcggggactggctcgatctcggcggcgcgagcgggagatgggcctttctcgagctcagtggcgggggcgggggctggctccatctcggcgacggcgggagcgggacatggagctgggtcgagctcagttgcggcggcggggtcaggcgaagccccggcgaggaggaagaggacgcctgggagatggaggaggatccctcgcacgctacctcatccttgcctgagaaagaggcccatgacatgggaggagcttctcgcggacagcttggacatgagcgatgaggttcactgcttcagagaggaggataagcccgctttccgcaagtccaaggcgcatatggccaggttctatcagaggatgatcgacatcgagaagaacaacatcaaacaaatctcctgaccccgcgtcctgtctgatacaccttctttttgctacctttgtttcatatcataagccgtttgattttttttttcttaatgaaaattccttgcctgcttgcttctttcgtccccacggatgacgccaaatgttgggacaaaattcaacaagcgtatgtgtatcacttctgtattcaatatgcccagctgtgagcaatgtttacatatttatacaaggatgtacaaggggaaattacatcgctaccctaatcgctgatttatctaggcggctggctagcgggccagctttagggctctttggtcagctcctcggtgacaggagggctgcgcccattaagggagcggcgccgattcccgaaggcgcctgctattactcgggtaaaggcgtgctctgggtaatagcgtgcgctgtctgccctcgtcagcggcgtcagaggtggttggcagatgcgtagtgcgtatttatggcgtgccactacgcatccgatcacccatcttatgcccagggctcttcaagccctagcttcctctggagcccttgaacagcttcggagggcctggaaggctttggagtccttggatggctccggagcccacgaacagctctggtggccttgatcggccccggagccattagatggctccgaaggccttggatgaccccggagcccctaggtggctccgaggacccgtgttggctcccgagctagctccggagcctaaatcagtagatgcctccggtcattctcctagggtggatggctccggtaggtgctgcatcatatatatatcagggacgcgtcgtgtcacctctcctcagccctaaccactttctttctcccatcgtgttcacgaggaggaagaatcctaaccctagattgcgattcggcagacggagatgagaaggcccaccatagaagagaaatttgcgacctactcgatgttccagtttcatcagggatccaccgtcccgatcacagcgcaggagtggctggactctctgtcgccgctgctgtcgcaatcgggggctaattcctccacctccgtgccggcggcggggtcaggcgaggccccgacgaggaggaagaggacgcctaggagttggaggaggatccctcatccctcgcacactacctcatccttgcctaataaaggggcccatgacatgggaggagcttctcgcggacagcttggacatgagcgatgaggctcactgcttcagagaggaggataagcccgctttccgcgagtccaatgcgcatatggctacgttctatcataggatgatcgacatcgagaagaacaacatcaaacaaatctcccgaccccgcgtcctgtccgaaaaaccttctttttactacctttgtttcatatcataagtcgtttgatttttttcttatgaatattctttgcctgcttgcttctttcgtccccacggattgcgccaaatgttgggacaaaatccaacaagcgtatgtgtatcacttctgtattcaatatgcctagctgtgagcaatgtttacatatttatacaaggatgtacaaggggaatttacatcgctaccttaatcgctgaattatctaggcggctggctgctgggccatctttagggctctttggtcagctcctcggtgacaggagggttgcgcccattaagggagcgacgtcgattcccaaaggcgcctgctattacccgagtaaaggcgtgctctgggtaatagcgtgcgttgtctgccctcgtcagcggcgtcagaggtggttggcagatgcgtagtgcgtatttatggcgtcccactacacatccgatcacccatcttacgcccagggcttgggctcttgaagccctggcttcctccggagcccttgaacagctccggagggactggaaggctttggagtccttggaacttgctacaaccagtcactagcaggtcttggaagcctgatggtgaggagctgaagttttgatgggctggtttggtctgtggtctatattgatattaccaatatttgataattttaatactgcattcgtcccaaaatataacaacttttagcctctagaatttatcccaaaatataacaatttctacaccaacattctcttctcaatcaatcacaatcctccaccatttaaatttttcacctacatccacttcttgtccaatcacaaccttcctctattaaattctatctactttcttaataaccgtgtccaactctaaaaatacttatattctggaacggagggagtagtacttagtgtctatttggtttgaagccaaattttagcaaacctaagaaaaataggtcacttcaatagttaatttaggctattttagctttaattcaaacacaactttaccttactaagatcagccatgctaaaacttgctaaaattagacatggacgaaaattggtaaaatcaatttatgacacaaaccaaaccagcctgataattgacaacataatcaaatcatgtttaagggagcttattgtaactacagttttttcctagaatcttcgggtcttcaaatagtctaaccttttacttagattttaagaaacgtaggatttagtttttccatattctcaccggatggctctcaaattccccaaacaaacgggcttccaatcacacgaatggcagagttggctaccttgtaacatcaaggttacgaataactaagccgtgtacactgccgggcttggttggccggccattgtgtcctgccaacggcggagcaacagcaaccggccaccacatcggcgggcggcgcaccacctccgccgtgctggtgaggcggccccgggtgcttcggcgacggcggggtgtacgaggacggcctcaccagcgcaccaccgtcatccgtgctgacgctgctccgccacgccgacgcacgaagatgtggatggattgagatcgggtgcagtcttagggactgcatgcattttcagccattcatttttgtgatcaacagtccagatcaactgctacagtactcgtgctacagtaccctgaacaatattttacgccgtggtacttttgctacagtaaccggcctaatccttaccgttggatttagatccaacgtagcagctacaactgcttaagttgcagtccatactactactgcatttaatccggatccgatgtggataggagtagtaggcttctcctgaagcgagaaaacagcaggagaaatttcgtcagtgtaggacagacaaattagctatcaaaccattgttataatattttcacatggtcaatgcgtgatgcgtttcgtcagtgaatgacaaattagctaccaaatgaaatgcactcttctctgtttctctctattttcacgtgatccatgcgagtgaaagcgtctatgttgcctacctagcatccgtgcttgcaacagctgagcgaagaggaggaagaagcagaggagaaggagaagactatgagacggtgatctatccatgatcgatagatgcaggagcaagctgaagcttgctgtagatcaatcggtacacggatgaagaaaggttttgggaacactggcagtatatatagcggctagagaccaccgaccttgtgtagttgacgagctgtcgaggtttcaactttcaagcattactagtctattaagtcgcgttttcaggcgactgtaaccaccatctttattaaatacttttacacgttatattgtactccctccatctatttttgataggcatattttctaaatctgaaaaatttatttttgataagcatatttcaatccaacaacctatcctcttaatgattttctagaatttaatgcatgactctctattcttccacataagattagctacatggacatcgagaaatgtaaatattcataaatcgcttctttacgagaaataactagtagtatatttaaatggatgataggtacaattacttattcttggtctgtgtgtcaagatgaaatatgactatcaaaagtagatggagagagtagtaattagtttaaatttgtaacaactactcacttaaaactatgtaatagactgacatggtaatataaagtttgcgataaattatgctaagttacttacatggccatgagtagccacccttggtcgaatttcctcataggtgtaaacatgttctgtttaggtttaggcgtgttattttataaggctgaatcagatggaatatggaaggttgaaagtttaatgattcgaggaacccatggatgaaaaatacataaatggtatttaaagaaaagaaagtcagatgtagcatttttcttaaaaaaaatgcatatatatgttctattccattatggtaaaagagtacaccctatacctcttgttgacacaaactctttagcccctctttgtagcccatgcattagtgataaagagcctctaaagaaaatgcatgatttttgtaggattactggattaatatatttattctccattaaattattgcaaggattatacattcaaaatgacctttaatttaacatgtagatcgtattccattgaaatttgtcagttttccatcatgtcttatactccctccatattttaacgtgtgacgtcgttgactttttatcaacgtttaactattcgtcttatttaaattttttgtgcaaatataaaaatatttatatcatgcttaaataatatttgatgacaaatcaagttataataaaataaatgataattacataaatattttgaataaaataaatggttaaacgttagtcaaaaagtcaacgacgtcgtacattcaaatacggagggagtagcatatttattagaacatacttatttttactatacttatacttatgtaagtctagatacattttatatgtattatacttatgtgaatttaggtaaattaaaatatgtttatttgttaaacactcatttaaaaatatgtgtgaatctatggatctatttgtaaataaatttttactttgtaaaataaatattgcaaagggtcattacatctttatctttttagccgcttttgtttttctcatttctctcaatatccgatgaatccttccaacctaagccacatgaaggttccggattcctcctttccatttctatatcctttcttcaccatcacatttcatccaacggttgatattggtttcacctatgaatccaacggtcatatttcacttgatgacgtggctcaccctagaagcattgtgaggaaaacttttcgggtgtgtttggataatgggaaatgggaggtgggattgggattgagattggaaaatgaatgaagagttaggattaaatggaagagggaaaataaacggttaggatttaaaaatatcttttggtgggtggaaaatcatttccttttctcgttagccaaacactgccttcacttacagagatacattagcaatctaccatgtgcacagccgagtggacacaactaaagatgctctcattttttttggggggcccaaagtggctacctgctttgtttctcgatgcctgtttaactgtagaatagtaatgaagctagaatatccctaccagctggctacctctaaatgataaaattggaaccaacagaactgcttcagtgcttcgctatatctagattattgctcatctcgtgtcaagattcgcagatttcaaatagattagagtgccaacatttcaatagtcacaaattgcagattataattatgatatggcagtgacaatatgacatggtatttgacaaaaccatgaagtatgtagcggtactagatcaaccactggataaaacatgtctaggctctagaatcctataaatgtaacggaagattaccggcctctgttttgttccttcaggcattcttgaaaaatattcaggcgactgaaccatagtacaaacaacaagccgcagagg

SEQ ID NO: 82646 - DNA, 40559 bp, Oryza sativa
attccccgtcttgtgatgcagcacctaccggagccatccaccccaggagaatgaccggaggcatctactgatttaggctccggagctaactagaggcgctggagccaacccgagccttcggagccacctaggtgctccggggtcatccaaggccttcggagccatctaagggctctggggccgatcaaggcctccggagctgtccgtgggctccagagccatccaaggactccaaagccttctagaccctctggagctgttcaagggctccgaaggaagccagggcttcaagagccttggacgtaagatgggtgatcggatcgtagtgggacgccataaatacgcactacacatctgccaaccacctctgacgctgttgatgagggcataccgcgcacgctattacccagatacccgggtaatagccggcgccctcgggaatcggcgccactcccttaatgggcgcagccctcctatcaccgaggagctgaccgaagagccctaaagctggcccaccagccaaccggctagataaattagctattagggtagcgatgtaatttccccttgtacatccttgtataaatatgtaaacattgctcacatttgggcataatgaatacagaagtgatacacatacgcttgttggattttgtcccaacatttggcgccgtctgtggggacgaaagaagcaagcaggcaaagaattttcattaagaaaaaaaaatcaaactacttatgatatgaaacaatggtagtaaaaagaaggggtttaattaacacacggtgtatcggacaggacgcggggtcgggagatttgtttgatgttgttcttctcgatgtcgatcatcctccgatagaacctggccatatgcaccttgcactcgcggaaagcgggcttatcctcctcactaaagcagtgagcctcatcgcttatgtccaagctgtccgcgagaagctcctcccatgtcatgagcctctttctcaggcaaggatgaggtagcgtgcgagggatccttctccatctcccaggcgtcctcttcctcctcactggggcctcgcctgaccccgccgtgggcagggaggtggcagaattagcccccgattgcgacggcggcggtggcagagagtccagccactcccgcgcggtgatcaggacggtggatccctaacgaacctggaacatcgagtaggtcgccaatttctcttctatggtgggccttctcatctccgcttgccgaatcacaatctagggttaggattcttcctcctcgcgactcgatgggtgaaagaaagtggtcaggactgaggagaggcgacgtggcgcgtccctaatatatatatgttgggggaatggctccgggtagcggagccagcctccgtcatgtgatgcaacacctaccggagccattcaccccaggagaatgaccggaggcatctactgatttaggctccggagccaacccaggccttcggagccacctaggggctccggggtcatccaaggccttcgaggtcatctaagtgctctggggccgatcaaggcctccgaagctgtccgtgggctccgaagccatccatagcaacccgtttgcggtgcgtgcaggagaatcgtcgaatgctcgtatggtttgatggattcgtactctcatttcacgcctaactgttagccaaaatatcagctattcacggccagatcgatcgagtgagcgcagaaggctgtgtttagttgctgaaaaaagttggaagtttggggaaagttaaaagtttgaaaaaaaagttaaaagtttatgtgtgtaggaaagttttggatatgatataatgtgatgaaaagttggaagtttagggtagctgaggtgaactaaacacggccgaagtttgacactccggccatgcacgcagcctgatgcacgcgctggtttaattacctggttttcgctgttgcttcctggagtagctgttgaacaggtgctagcgaaaaattgcgtcgggtagctttcgctgtttaattacctggttttcgctgtttgcgtcgtgttcctttccagtttaaacattaattaggctgcgttcgatatcaggagttcctaactccccctgtttttcgcgtgtacgcttttgaaactaataaacggtgtgtttttaaaaggtttatatatgaaagttgcttaaaaaaattatattatctttttttaaaaaaatagctaataattaattaatcacgcgttaatagaccattgtgttttccgtgcgtgaatgatgggttcccaacccccaccacccaacacagccaagtcattagccgtcctatttttaatactccatgatttaggaagaaataaaccgttgactgccactcgatcgccatacacacgtacaagagcagatgcaataatcctagtcagcaggctccaaaagctattatattgtttttttttattagatggagggaagagaatcgatgagagagaacggagcgggagctaatctggcgcccggcgatagcacgcgttttcacgcgcactcacgattaaaaacatattttgtgggtcccacggtcacttatccgatcccgtgcgcatcctccttcgttccaccctccggtgcttcgtcgaccgacggacggcgtcttccactagcgtaatctgagtatttctcgtcggcgagcgagaaaactccatcgcccccacagatcacgtaggcccatcctccatcctgaaccacgcacgctcatcctcgattcctcatcctcgtccaggaagtcttggcggcggaattgcagccgaccagaagcatctcatacgggcgtcggatcctgtacgcggcgaggtacgtagcgatgactgtgctcgtcttgtgcttttgcataggctgatcaatcatcattgatgaagacccgggaggatcgatgtacagatggagctaatccatcgcgagcttgctccgctatgatcaaccaccggctagctgcaaaaccgttttcctttgctgttttttcccttccttgcattttcatgcttccatgtgaatggagatggataacaggataaacaatctatcattatcttttagttgctatttctgttgtcgattttaggcagggtgactgttgcgatttcgcctaggaagaagaagagaggggaaactcgaagaagaaagatgagccagcatgcacaaaaccaaacgttttctttttctttgatgtgttcaccttcatagttcatatcacagcaatggccacaaaaataggatccacttatgatcatacatgtcaacacgtgcatacataattaattgtttgatataaaattatactgtagtcagctccctccgtctcacaatataagtattttgagtttttccttgtaacatttgaccactcgtcttattcaatttttttttgcaaatataaaaaatgaaaagttgtgcttaaaatactgtagataataaagtaagtcacaaataaaataaataataattttaaaatttttttaataagacgagtggtcaaacgttgcaaacagaaactcaaaatcccttatattatgggagggagtacaaaatatggttagagccggcagtcggcggcactattgaccttgctcacgtaatcctgcccatataaagagctcacgtggccacacatagttcgtcgatcgatcggctcccttcccgccatggagggttcgtctcgatctccttgcgtttgcatgctgctgctgctgcttcacgtcgtcctgctcgctccggtgctccaagcacggctgctcggactcggacatggacgtcgtctgctggtggcgccgccgctaataatgctgccggtctcgattctattgccgaagcggagacggcaggcgtaacaaaaaaaaaaaaaaacgcaatgcacttgtcgtgtccgaccttttttttttcggaaaaagtatacttcgactccttcaactatgacccgagtatgattcatgacctccaatcacaaaaccttgactcctccaactatcaaaaccaatacaaactatatccctcggtggttttggaagcggttttcgctgacgtggcacttacgtggcagtgttgacccggtcttcgtcccacgtgtcgcttatgtggcattagagtaaaaaaatattgtgggaccaacatgtcattcaaaaaaaaaagtaggacccaccgacatatgggccccacataattatcctcagctctccccctctttctttcatcttttctactcccctcaccttcctccatcactagagacggggcggcggcgacggtgacagtgacggcgcacgggggaggagctcgccggccgtccacgcgagggggaggagcccgctagccatcccgcgagctcgccgcccatccgcgcacagagggaggaggtcgccggccgtccgcgcgctggggaggaggtcgccggcgtccgcgcgggaggaggtctccggccgtccgcgcacagagggaggaggtcgccggccgtccgtgcgcgggcgaggaggtcgccggcgtccgcgcgccggggaggaggtcgccggcgtccgcgcgccggggaggaggtcgccagccgtccacgcgcgggggaggaggtcgccggccgtccgcgcgcgggggacgaggtcgccggcgtccgcgcacgggggaggagctcgccgccggccgtccgcgcgctggggacgaggtcgccggaatccgcgcacgggggaggagctcgcggaccatccgtgtgccaccgcgacgccatcgtcacctctccccggccggccattgtcacctctcctcttcgtgcttcgttgcttcggccagccgcctctagtgatggaaggtgagaggcgtggaaaagatgaaagagagagggggagagatgacgatgacatgtggggcccacgtgtcggtgggtcccacatttttttttgaatgacatgtcggtcccacaatttttttaactctaatgccacgtaagcgacacgtcgacgacacgtgggacgaagagcgggtcaacactgccacgtaggcgccacatcagccaaaaccgcttccaaaaccaccaaaggatatagtttgcatcggttttgatagttggaggagtctatatacctggttttgtggttcgaggatatgaatcatactagttgagggagtcaaagtataatttttcctttttttttcccaccgggccacggcgcccatgggccaggcccaggcgaggcatcctattccgtgacgtggataaatttctttttcgtctcccctgatcgcttctttccccatcgagagttcgccagaaggaagaaacctaaccctaagattgcgattcggcggcagcgacgaggcgcgggcggagatgaggaggcccaccatagaagagaaactggcgacctactccatgttccaggttcgtcagggatccaccgtcccgatcaccgcgcgggagtggctggactctgtgatggctggagttggctcgatctctctggcggtgcggggtgctggctcgatctcggcggcggcaggagcgggagatggggcttgctcgagctcagtggcggtggcggggactggctcgatctcggcggcgcgagcgggagatgggcctttctcgagctcagtggcgggggcgggggctggctccatctcggcgacggcgggagcgggacatggagctgggtcgagctcagttgcggcggcggggtcaggcgaagccccggcgaggaggaagaggacgcctgggagatggaggaggatccctcgcacgctacctcatccttgcctgagaaagaggcccatgacatgggaggagcttctcgcggacagcttggacatgagcgatgaggttcactgcttcagagaggaggataagcccgctttccgcaagtccaaggcgcagatggccaggttctatcagaggatgatcgacatcgagaataacaagatcaaacaaatcttccgaccccgcgtcccatccgatacacagtatgttaaaccccttcttctttctttcttttttttttctcatgggtatgtcaactacaccactaagaaaacatcatacaaatagaactttcctttcgtagatcctaacacacgtgaaatagcacacccattatattcctcattacaaagttcatgtgaaaaactatcattgtttttatcacttataaaacagtagtgaccgcaaacaagacatcgataattcagcttagaatagatctcctaaggacacaaggaagaggtggagacagaaaagccaaagttacttaatttggagacgaattctgtacaatcctttaaatgggtaaactgacattacaacttgcaaccattttaattaataagaaatgtggattttttaagctgcatttccattcttggtcactgaaacagttaaattataaaacttcagttgattcatttagctagtggtaagagatagaacatattaacaattgaactcttgtatatgcaacggatgtaatagttgaagtacgctatcgtcatagtattttaactcatcagatgcatcatgttcctgtgcaaacataggtggccatcttttatacagtctagcaactctttggtacttggccaaccttcacaaaaggtgcttgcatttataaattgaacaatcaaaggtcagatatgcgacagcaacagtgaatctgaaagaatgtcaggtactaacttctagagttagtttgaccatctcagcatcccaggatcaaataaaaattttcaggatggtttaagaatgtgcagtccaacttaggagttgccattagtcaattctctgagtttgaaaacaacactaaaatctgagctaattttaaaggaatgatccatcctgtgtgctgcactaatattcaataattatgttccaatctggatggcagacacaatctggatgggcttgaccaaggtttcatgcatgttgggtaatgaatattcccggggacaaaattaagcttgggtatgggtattcactattgatgcccgccatgcccaattgtcatccctatctatattcctgacaaaattaagtgaatacctaaaattggttttgtccaacacactgttgaatctattactcttttgaatatattgcagcgagcaacatttgaccgcagaagagatggaggcagagttcgctggcaagaaagtttcttcccaagcttgtcactttgccaatttagcaattaaccactacaacaatattgaggagaacattgtaatagcccttttccttgtttgctttccatgacatcatgagtctcaatgttgtaaactaataaacctttctatttttgtctgttcaggttaagattgagctttgtactgttcttttatcaaattgttttcatgagatctgtgggtccacatacgcccatgtcaactttactgccagggctgaggatgatgatcaggctaagaagagactatactttgcagagctcaagttgaatccggatcttctggcaaagaggagggaacgctttgtagagttgagccttgatccaaatattgttggatgtgctgatgatatcgagcccatgtgtgtcgtctctatacacaatcttcagggttcttgttttggtatgtttattactatcgacttatttactgtattctcaatttactgtgttctgattaatatgcttgcttatttgtaattactgtaaggtctctatttatgtttgtaagtgtgatagtaggacctcagcgatttattcgatatgttgatgttgcttttgtaggtggatgccatgagatcaacaggagaattgattatgtaatgatcaggaatcaggactacgagcgttgtcacgcatgtagcgatcgtatcaagcatccatacgggacagaatttattgcagggcatgatagttccaagattccgtattacactgcaggctgatgtaataataatatgattagagctatgacttggagtattgttagaatttagactctttatttatgctttgacatctatgtgcgcgagtgatctcttctaatgcgcaaatattacctgatgaagtagccaggatctttaatgaagcctctatggtatgtctactgtaaccaggatcattaatgctctattcagttgctccctctgggctagtattattagtggatgaagaaaattgtcgtttgaacgttctttttagttatgggacgagatataaatcataactacatgctttaaatcatctataaatcatctatagtgaattcaatactctctccatcccaaaaatataagggcatgtacaaaggtaaagtctaatatggtctcttagttagtacataatattatttagagactatactactgccatagttgagacaccaatcactctttaataattaatgcaccaaaatattattttactactacctttcattccttttctccactctcataacaaaatttcttttaataaatgtttagagtcaactctgagctgttatatgcatagcaatcatacttttcttttctctcctctctcttccacatttttcttctctcctctctctttcacatcatcaaatttacttgtatggcaataaagagagactgctattatacacggttgtacatgctctaaggcacaaccactcctgacacaaagagcaagaaagaatttaatcacctccttaattgaatcacatccgtacatgcaagtaatgtgattgggagacttaatggtacatgaattaaaataaaccaaatttaaagaaccaagagatgataattaatgtatgcatgcacgccttatattatgagacataataaaaaagtggttgtgtcttatattttaggatggagggagtagctaatacatacaatagttacctataaacatatactacactattgatacatggtcccacttgccctacacatattgcatcttgcagtccgtgctacggctggctataaatctgtagcccgctgcttgtttctctccccgatatgtgtttatagctgacttatagtctggtatcactggtggagaagtagtttttactcccggttcgtaaccccctttagtctcggttttccaaccgggactacgaatccgggactaaagatcgctatctttagtcccgggtgaaataaccgggagtaaaaatctatctttagtcctggttggtgttaccaatcgggactaaagatggagcatgccaaccgggactaaagatagagccaggctgatccctggctgctcctttattatattcttttcttcattgtttttaatatattgatttcactccatccccatccccaaaatcccaaatcaattatcacctccaaatccttaaatcgatcatctccaaatacatcacaaaatctttaaaaaaaaattacatcacaacttctacaaaattcatcacaaatacatcacatattcatatcacacacaaatcaaatacatctcaaatccggatcataaattctcaaaaaaaaaaaacaaaacaagccgccatcttccacctgccgcccagccgccaccttccgccttctgccagccagtgccgcgcgccggccgctgcttgttaatggctgcaataatggctgcaatctaggaaactaaataatggctgcaatgcagcatgcaagacactcatctatagatagccaaaaggcctgaggcccgacgcttggcccacggcacagcattttggcccggcccaagcacggcacgacccaaacggggtcgggcccgtgccggtccggcccaatcaccgggcgtgcctggcccctccaccggcacgttgggccggggcggcacggcacgatgggccgcaggccaggcccgacacataaacaacagggagtaaaaatagacattatatgccacggtcgaagaatagggacgtcaaatagacttatttaactatatatatgtcagcccaacgaggagggagggacaatagatttattttagctatatatatgtcacaacccaaagagaagggagggaaaatagacttattttaaaaaaggcacggtgggccacccgtgccttcgggctagcccggcatggcccgactactagtgggccgtgcctgggccagaggtgcagcccataggccggcacagcccgactactagcaagtgccgaccaggtcgtgcctgtgccgaaccgtgccgggcaggccttttggccatctatacagtcatgccgtgcagggcttgcgagcgtgacatcatgtatgacgaggagtctttgaccagcgactccctggatgaggccaacgagagagtgcatgtggtcctggactccatggacgctgccggcgatgaagtgctcgtggtcgtcgactccatggacgatagagccggcgaggaagtgtttgtgaacaacgagggtgatggttgaccaccgactccatggacaacacggccggcgaggaattgcacgtacgtgatcgccgactccatggacgatggctggctagtgactccatcaaaagtgcaatctccatttgcatcaaattttgaacaagtaagcacttaagaacattttagggatgctatcactggtggagaagtgctttttactcccggttcgtaaccccctgtagtcacggttttccaaccggaaaaccgggactacgaatccgggactaaagatcgctatctttagtcccggttcaaataaccgggattaaagatgaatccgggattaaatatccctatttttagtcctagttagtgttaccaaccgggagtaaagagagaatagtggtagtcccagttagtccccttttcttttttttttattttctcccaaatcaagtgggaagcatatccccaaatcaaagtaacatcctaaatccacatcataaataaagtaacatcacaaatcttaaagttacatatacacacaaatcaaatacatcacaaatcctaaaaagttacacacaaatcaaatatatcacaggtcatctcagatccatccaataaatcacaaaattatacatgtgaatcacaaattaaaaaaacagaaaacaacgccgttgccgctgtccgccacggccgccggcccgccgccgcctgccacggtcgccggcccgccaccgggcacggccccgccggccgccgcctgccggatgggaaggggaggatgggcaggaaaggggagaggagaaggtataggaaggggaggggatgaggaaggggaagaggtggaggggaagggaggatgggcaggaagggaggggagaggggaggggatcggatgaggaaggggaggaggtggaggggatgaggttgtaggaaacggaggaagaagggaaagaaggggagagattcgatctgtggaggagaggataagggatagggattatattgggaacaccaaccggatccggttggtgacaccaaccgggactaaagatcctcggccccctgacatcaatctgacaggggatgaaccgggactaaagatgatttttagttcggttggtaagaatgcctctgtggttttcaaccgggactaaagattatttttagtcccggttctttttggaaccaggattattgtggttttgggtcgatccagcaaagattatttctccaccagtgtattcttgcttctaacacgtacgtgtaggttctccttcatttgcacgcaaagaatatttctcagatttcctagtaaatagaaccaattttcatcaacaaaaacaacatcaaacatgcaggcccttaaaccctggatcaagcatggatacgcaccattgcaaccttgctttcttgtttgcatctatcaagtgtgactttatagcattcgaatgacatctactgagaccttctcgtattattctttgcaccttgtacttactcaaatgtaatgtaatggagcacaaagatctcaaagcgttgtttgttccttgaaaggaatgccatccagggttttatattttggaaagcaagaaaatttcggtgggcaccgaaatttcgaaaaaaaaatttgggatatttgcgaacgaatgttttgaaatttaaatatatttttactgaatttgaacaaattataaccaaattcataaatatttgaaaaaattcaaaaatttcactcgaaatatttgcttgccggtgggaaggcgaaattcccgaaatttccatccctgatgccatctagcacaaataaatctacttgaactcgcttgcggccaaagttgcatattctattattaacattaacatcaaccgtaatgcattgatcaaaataacttttaccttgcttctaaatacgttgaactgatcgaatgcgaacgttgaataactctgcaacttccctcgtcacatggcgctccagttttccatttgtgcttcttaatgcattagatatttgttttcgtgttgtacttggcacatctttcgtgcctgcgagaaaaaaaggctttttgacatttcgtttatgagtgcattattccttattccaggagtcaagatacaaggtggccaaacgggccgggccaaacaggcggcccggggcacggccgaacctgtagcaggcacggcccggcacggcctgctacagtaacgggccgtgccggcacggcacgagtagccgtgccgtgcttgggccgctggccgagcccgcgggccggcacggcacggcacggctactgtagcggcacggcacggcacggcccgtttcgccggcggcccgtcaggcgcggacagggcgggcggcggtcgaatgggaaggcgccacgtggcactaacggctatttgaccgttcaaatttgaaaataaccgttgggaggctaaaaaattcataaaaatttcgaaaaaattccaaaaaatctcaaatttcgccctataaatagggcatgaaccccagccatttctcctcatcccacactcctcatcttgtgctctcaagtgttttaagtgctctctttgttctcaagtgtgcattttttttgattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcagaatggatccgaactttccataccagtcgccgtcgttcaccttgggtgatttcgaccccaactacatgtcggggtttgacggtacctccggatcggctccaactccaccatctgtggaggaggtaccggttcatacggctgtcgttgaggaggtaccggttcaggcggcgacagcttcggaaggattttccggaaccgcgagcggaagtgtttcgacacacaccggctcgaagagatcgagaacctccgttgtgtggcaaaacttcgacgagataaaggaaacatgccccgacggaagggaggtatcgaaagcccgttgtagaatatgtaggcaaattttatctgctcgttcttctggtggtacaggtcacctcaagcgccatgcggagtcgtgtgccaagaagcaaggaatacaactccggcagcagcaacttatggtaaacccagacggtacggtacgcagttgggagtacgatcccatggttgctcgggaatctcttgtccggttaatcgccaggcaagatttacccctgaactttggggagtcccctgcttttgaacattacattcagcaatctcataaccctaggtttaaagctgtgagtaggcaaacatcaactagagatttagagaatgtttatcacaaggaagcaactgcacttaaggaactgtttagtacatgtactttctctgttagtgttacttcagatatatggagtagtagagctagagaggattatcttagcgtagttgttcattttgttgatgatgattggcaattacaaaagagagttttagggcttaggttaatagatgtctcacatacaggagaaaacatagctgaaagaattagggaagtaattaatgaatttaatcttgctgataaaatatttgctgtcaccctagataatgcatctgctaattctagggctattgaaatattgcaacctttattttgtgtgtatgctcaatcttttctactccatcagcgttgtgcatgtcatataattaatttgattgttaagactggcatgaagagggtaggtgaccacatcgatgctgttcgtcaagcaatcgcgtggttaactgcttctaacccgcggattgctgtatggaagaggttttgcaatgcggccggtgtgaaagctcgtaagtttgccaccgatgcagagcatcgcgtggaatgcaacgtatttaatgttaaaagttgttttaccttatagtagtttactttctgattttgttcagtcacgtggtggcccaagaaacagtgacgggtcttcagtactgaacgagcatgtttgggcaattgtccaaaaatttcaccaatttctagaaactttttatgattgtactctaactttgtcacaagtttattatccaactgctaatataattttgcacaaccttcttgaaattgctactttatttaaagaatacgaaaatgatgacgttctaactgaacctgtctttcacatgaaacaaaaatatttgaaatattggaaaaatatacctatgttatatgcttttgcttttgttttagatcctaggtgtaaattaaggggattgtctgctattttatcacttgttggagatactataggtgtagattatagttctttttatactgaggttagacgtaaattatatgaggtttttggaagatatgaagtaaagtttcaggaagttcgccagcagagaccccctcctatccccactacaggtaagaagaagatacagtggggtaggatttggggtggatcgtcttcaatccaaggtggtggcagttcgtcggctacaagtggagacgcctcttcgcatgttgtggccgaagagttgtccggttatttggacaacgacgccatccaccacgaagcacaagatttcaacgtcctcgggtggtggaatgaccacaagataacatatcatgtgctttcaaaactagcacgggatgtgttgacggtgcccgtgtcgacggtgtcctccgaatcggccttcagtctatgcggccgaatcatcgaagaccggaggatgactctgcgcagcgaccacgtcgaaatgctactaagcgttaaagactgggagcttgctcgacaacatgcccaatacactgcggacaaccaagaattggccgcccagttcgagcaactctacctggatccagaccaaccccagtagaattttgttagaaatagttctgacctttgagctgtactcttttctttgtcatggttttctcattttccactatgagtttttacatgacaaagtttttaacgaggcagcatgtatcattgtatcctgtaatgatataaacatcaataaaggtcattactatttttaacaaattcttttgcaatattttcgcaagtgtggatttatctttaaattatttcaaaataatgaatcacaatctatatttttaaatttttcaacacaacaaaaaataccattttttcttttttttaacattagcaaatcattacttttttaaaaaacttttatttccattttttaaataccattttttcattttttaacattagtaaatcattactttttttaaacattttggatccatttttaattttttttttccttatacatttcctttgcttttttttttaaaaaaaaacactgtgcactggcggcctggcggcctggcggccagtgcagctcagctgccggcctgccttcacgggccgccgtgccccgaacggcccgtgggccgcaggcgtgccgtgccggcacgggcacggcccggccatccacgggccgtgcttgggccggcggctcggcacgtgggccggcacggcacggcccgtttcatcagccgtgcctaacgggccgtgccgaaacgggccgtgccggacccgtgcccgtgccgggccgggccgtgccgcccgtttggacacctatacagatacacttaacatagtggataattaaataacatagtttagtaatatgcccatgctaaacgctacggtgaaattctatgtctttaattaaactttaaaatggattcggatgccgtgaatagaaaagttatatagagtacaagaaaatatattttccgcatgtcacgaatacagatgttccattccattttttgttatgtgtgctttttgaacaaaattaatacaccctgttcaattcacaaatggtaatcatcatcgatcaataacacccctaaccgtacgaattttctcgttttttttggaattttttcggctcctcaaaaaggttaagcgtggttggctatttttgcaaaaagctcctcgtgtttgtagaaaatatcgcacagatgcttaaatcgactaacaacccaccatattttatccggaaaaccccttatcttctagtgaaatacaatgtgaagaagagaaaattccgctgtaaacatggtaaggggtatttatgcaaaacatccatcccctacggcctacccccaatccccaaaccatcccccgatccggaaccagatccctctacgttagagggacgtcctcgcacgatcgccgttcatcccgcatccaacgctggcatcggctctgcggccgtccgtcgtcctcccgctgccgccgccgcgcgcgtcggagccgacgccatcgccggcgctacccgccacccccccggccccgccggccgtgagcgacgcgggcgtcgtagccggtgcctgcgctggcgctccctccccccttgttctcctcccactccgcccgccggcaacggggcttgaggtgccggcgaatccgaccgcgcacgggcaccccgccaccgccgcccgtcagatccagcggggagaggctggccgtgccccccgcgcctccacgaggggatctgcgttgagggggaggacgaggaggctgcggagaaggaagacgaggacgaggaaggccccagcgctcgtcgtcgtgcctgccttcttcgctcgttgtcgctcttctgccccatctccggctaccgccgtcgccgtcgccccccgggtccccggcatcgtcgccgctgtcgtggcctccttgagcccttgacgaggaggggcccttcacctgaggccgcgacgagaacaaggacgaggacgatacgccgcttcggctgatgggtcgtggcggagccagatccaaacgccttcgactcctccacccttgccgtcggcttccaggcggcgggcagcagcaggcatcggaggtgacccgggcaccgagcaggagttgttcttagcgtgcctcctacaacgcgccgtcgcccgcgacgtgctggtcccgtcatcagcgcggcggcgacgccgaggtatgggagccgcgcgctggtggtggccagatccgtgcgtcacctgcgcgcacaggcgcacaggcggcgcaacagctgacgcagcacgggaacatcgggtatgtgcttcgcacactcatctccatggataagaagcctgcgaggaatctcaccgcctgccttgccgccattgctggcgctgtcgtgaataacagcaatggcggaaagttgcctggtctgtcacggaagctgttccagaaggcgccgtcggaacacaagaagaacgcactgacggaggtcaagagcggtggcaacacgcgggcgctcgccatggtgctgcgcggcgagtgggtggacgagatcgctgcactccgcctccagttcgagcagaaggacattgaggtacacacacagacatatccacctcttccccactcctctgtgccctctgtggatgccaacgtgaccttactgcgattgcggcgttcaggttgagcgcctcaaggacctgtgcctgtggcagcgggaggagatctggacgctcaagggcgccgtgttcttcccggctacacaaccggaccacaacctcacgggacagatccaataccttgctgaaaagatcgcggtggcacgttttcttttcttttcttttcttttctttaacgtttttcaatgcagacacttcactaactctattgattacccacctaatcacctaatcttccgtctgcaatcgtttcactatgtacaggttaaaaccaagaaacatatgccaagatcatgcatgttttgatgacgaatactgctgttccccaagtactgtacgctggtgcttaatgagaatgctttctcactggtaattttcacatgctccaccattcgtctgctacaagtacgattttcaaaatccagatggaccatttgactgctactgtcaactgcttatatgtgctccttcataaattgccttcaaatcaatctttttaaatccaaagttcgtgctaccaagtttgcagtatgcattttcttctcaaacttgatagtctgctatgcaaaggtagttcagtggttcatttcttaataccagttttgaaagtctctttctcctgttgttgtttgtccttacagttgttctcccatggcgatgaaccacttagctatgattctcaccgtaaatttcttgcaaactattgatcaattaattagatggtttgatatttagttaaatattgatcagtcgcttaattttcttaatagttacatgatctatattccaatcagttacttagttttactataaatttcttatttcttgatcgataacttagttttggtacatgatctgcaatatgtaatcgatcttgacaccttgtaatcaacgttgctagctcccaagtctctcgatctttcgattctccccaatatctctttatcgttttgccatgcacactttgatgtggtaaagataaattacctacttaattaaccttccattaaatctttagattagtacctggtccacttttgaagtgccttctaatatttgtgttttaaatcgttagatcgaatggaatcaactgatctcgtttttccaaccataacataaaaatctccttttgtgcaatcacaaagtggaggtataagtagccattttacgtcttctgtgcacatcaaatgttagatgtgccttgtaaattctttaagttatttttcaggtagatgcttttccattttttgctgggccatcagtatcttagtctttgttcctgacaggcactatcgatcggctagatgttcttgaactcttgaatgcctgatgcttgatcagtgtgtcctaccaggcatgatatctccagagttcagatttgcttcttgtgaatactggctaagtaaaactggtaactattggcaattcggcatacatactactgaaaggacggtccttccaggcgtgacatctccatgttccagaatttttttgtgtgttttcactaacaaaggcggttattctttagacatttggtgctttcccattcaccaccgcatggatcttttgatatactatgcaggtaactaacagcacaggcaattatattctgctctttcaagattttagaatgatcatgtcctttagtttgtattttttgcatgtaccatacgattgatcaggctaaaaaagcatacccctttgtaattgagaacatattctgtaatagttcttttaggattgcgaacttcatttgtgttatattctctgttaaggaatgtgctaatcagcagaagaatgacaatagagatttttgttcccttcaatgaaccaccaccacatttgcagtccagcagaaattgaaaatagttgttctccagttgatggtgtaacaaacaagaagcttgtaaggttccccaacctatacaatatattctcaaccgcatacggcagcagtcaaattgtcctccgatatcaatatctggcgttctaatacccgaattttttttatccaagcacaagcaacacagtattttcaaatgtgagcacgccaaacccacatttttatttataggcaagatgcaacagtgattctattcaatcgaatgtcaacaagctaattggattagggatggcaattgtgcccgtttacccgtgggtaaaaaccctattaggattgggtttgttctccattttatatctatgggtatcttattgggttaaaagctacccatgcccgctttgcccgtttacccgtgaaatctaacttatatgtaggctaggagcaaaatccattagaatacataagccatgttctttgttttctacggtttctcttttatttcccttattatttctctccctttactctatcgccgccagaggagagacacgataccgaggcggagaatatttgatgttttaagttcgattcgaacttagaaacttgtagattttttgttccactgctcttgttgtggcgggaaaacaggcacgcccgcgggtataaggcgcccgcgggcaatgggcatgggcaaccatccttacccgttatgtagtaatgggtatacccacgggcacaaataatctcacgggtataggtatgggtaggtactacccgtgcccgtcgcgcccaattgccatccctaaattggatgctgaattgagttgagtacgtgcgcttatagaccaacagcccacctcctattagccagttagtgtttgatttagatattggaacaacatagtaggtgtaacatttttctactgttcaaatctaattcatccacgaggatcatcatcaaaaacgtaatttgtgctaataatcttcatttgttttgcaaagcagttttacatatcagttgttacaaataattgtagcatgcatataaattttttagtgtaatctgaataaagctaagtaaggtaccaacacgatagtcacgaagaagagagttatcgaggctgctgatttctagatgtttttgctagtaacaaggcagaaaaggcctattcatctatcgtggacatttactcaaactattctgttcatcataagattactcagattgacttgattacatgggcatgttgtttagaaatagaaattcaaatatcgtgtgctcacatttgtaattaacaggttgcatgtgcttatataccaaaaaaatggaatacccgaattttttttattcccagccgattatgataggtctgatcgttgctacgatggttaatacatgggcatgctcaagaacttattgtttttcttgcttattgaatgtatttttgtgtgctgatttttcccacaaattagttgtttcctcaagtataattctcaacgtttacaggttctctgtaaaaactaaatccttacgttgtttaaataaatgttgaaataatatttttattataaaattagcaattaagtttcaaaaattaatcatggagaatttaataaaaaataaatataaccatgttgttttatttttacacttaccttacctgtaaattaatttaattataaaaaatatccaagtatttcaagaaatttatattttaattagttacatataatgtaaatatttgttcactttttcttaattttctcatattttcttcccgttgcaacgcacgggcactttttctagttaggttctaaggaagtatagaggctggtctttggtgatgtggcgctgacgtggcacctaaagttagaaaaaagaaataaaatatggcgggaccgacaaaaaaaaacaggtctcacccaccgagtttcctaattagcgcagacgcgctagatatcaatctgacgcgtgtttccggcccatttctgttttgtccatgtattccggcccacttctgttttttcggtgtaaagaaacgtcgggaaagacggcgtgtcgtgcgccggcgttagatttggagaaaaaacaggattagttccgtaattagtttccgataattatgttttcaattaatcttgcctttttttcacaaggttgttttctttttttaactaaagattttaaaattttatacgtgaaatttaaaactttctatagaagaaaattgaaagtcacaatcataatttaaaacaactcaaaatttcaactttcaattcaaattttgaaaactttcaactcaaaatttaaactttcaagtcaattttgaaaactttcatcccaaattttaaaaactttcaactcgaattggaaaactttcaacccagatttgaaaactttcaagtcgaatttaaaaactttcaactcaaattgaaaaactttcaacttaaattttaaaaactttcaactcaaatttgaaaacttttaaggtaagatttaaaaactttcaattctacgtttgtaaagaggtataggaaaaattgaaaaaaaatcgggaaaaaaagagcgaaaaaaggaagaaaaacccgcctgtagacaccgaaatcgggaaaaaaaataataacagaaaaaaaaggtggggcaggggggctaggcttgctggtgcgtacgcgcgcattagccgcccccctcacccacgcctacgatcgcgtacctccggtcggtcacccacgccgcgtccgcgctcacccgctttgagatcggcgagccgctcccaatgttcgaccacggcccgcccgccgggattgtccaccgcccggcctgtcgtcgcaccctccatcgagcaacagcaacggcgcgcgcaggaggaggaaggcgctgttgtggatgatcatcttgttggcgacgtggctggggcgccgtcgatcggtcacgcgagaggaacgcggcggcggcggcggtgaggagatgaggatggtggtgaggaacagtagcctcgcggaggtcgcggcggggttggaggaatacttcctcaaggccagcgtcggctgcgtcgccggcgacgccatgtcgagccacctcgagtcgagcatgggttgcagaatagaagctttcatgccactgatcaccaccacatgaattgattttgttcatggtggaccgaacaacatcttggacgcgctttgctgcgtgtcagcgccatcagtggcgcacgaccacgtcgacagcatcaatggcgagcagaggcatacccccaccatgtagcagcagctagcctgggagaagaagctgtattgggaagtgaaggtgataacaacttaccaaaacaaagcctcaaactagccgtcgtaccgtattaccgtgcgtgttctatggccagtcgagtgatgcgatgttgcaatgcaggcgagagagcggctgcaggtccagaacgataagaagctggcggagctgagtgaccaggagtacagcaggaagattgacgtggatgtgttgaaggcttgaagctgaagaagaccgcgtggacctcgccaggggcagcatcgcgatgcgcgttggcgaggatccccgagctgccatcgggcgctgtgcccatcctcttgtagccggcctcgtctcccgcctcgccgaggagaggatggaactcctctgcgcacaccgcggacgctgctcctctccctgtctatagccggcccacgtgccctggaggctgggaagagaaggaagggaagagaggaatatgaagctgacacgtggggcttaggcactaaaaaacggtcgtgtttggaatcagccgttcccagattacatagctcacggaaaacgaaacggtccattaacgcgtgattaattaagtattagctaatatatttttttaaaaaagatcaatataattttttaagcaactttcgtatagaatttttttttttttgcaaaagaacacaccgtttagcggtttgaaaagcgtgtgcacggaatacgataaaatttcttgcgcggaatactgctctaggaccttatatgtactctggttttgtaagttgagggatgtgttatgtctgttattatggttgaaggatgtgatctaaactcgacgacaagatgagggacttgaagtgaacttattctggaagggagagaagagcggggacatggtgggccgaccgagcccagggagaggagggatgcaaatttgacttctgcagaaaaattgaattagagagaatttggatttgaattcaaattacatattcaaactcaagggatcaaggaggagtcaaggaaggaattcaaggtggtaattcgatgtttttggaactggaacaagtattagacaaggattaatcaaagggagagatttaacttcgaaatttgatttttgggggacttgattcagaatatggaatttcggggtgttgatttttgatgtcgaggagggggaacaagggaggatttaaattgatatccacaacatgacttggctgagtttgtttctaaaggttcccaacccatctccttagttttccacgcccacacttttcaaactgctaaacggtgcgttttttacaaaaagtttttatgcaaagttgttttaaaaaaatcatatcgatccatttcttaaaaaaatagttaatacttaattaatcacgcgctaatggattgctccgtttttcgtgcgggagggtagcgtttctaaccatgatgaacgaacacaggcttagaccctcactctataaagacagcaatgttcgatttttaaaggtgttgcatgggacagcaaagagaaatgagcgacgataggcaagcgagcttattatagatttactttatacctaatgtgtatatagggttacctccaatacaataaatgatagatatagcagcaagcgagtcaattatttacttgttttgaaaaaaaaatataaccatgtaaagaaaatgtacatagatatatcgctgctaagcgcgtaatcacgtgggccaccctagtagtacgtagttatgggaaattcgctattgaaaaagatcgttattatcggtgtcttttcctccaactagtgaattagctgctgattattgaagctgctttatgctaagagagagacgagcatgttttacttaatctgacgtgtatattgctatagcgtgtacatgtgcatcagtgcatgcctgcttagctcatgtcatattatcatcatgtcacatgtatagctcgccgccactactccagtattactggtggcaggtttggcgacaagctaactgcagcatactagtagcctaaccaatcagctctagtctctcgtccaaagtgaacaagatatacgcgcgcaaggacatgaatcgataaatcgaccgttttttatgcgagaactcagagctgtgtagcagtagtccacagtggccactggccagtgtatgcatgtgtgcatgatatatggtgatctgtgccaatctctgatgtgcagttgggcatgatactcgcaaggaaaaagaaagaagaacgcatgcatgatacatatatatcgatcagagaaattgagaagcgggtgcatgcctatatatgttaacagctagtagtagctagtggtatgtatacagtcagtacatgtgatacatcgtgtacgtggttcttcgtgtagacggccggtccggtcaatcgaggaaagatacgtcgtcatcgatctgatcagtcaagcatacgaggctggctacgactacgatacgagtggtacgcttctcttgctagccgcttgctttaatttggagcaatcgctccgcctgtctgaactaaagcaaccacattcacatacgtccaaaacttctttttttcaaaaagctatagctctttctatgctatgcaactgggacacctgtccacaccgatcgcttgatatacatatacacactgtcctgtgggtcaaaagaatctcgagcaaataaagcacacacacactgcgtcttgcgctgctctctcttctctatctacattaattggtggcttccgatcctgcgagggagagagaaggcagctgtgccctgtgatgtatatcaaggcaaaaaccctagaccaagcacacgtccgtctcatttctccccctttctgcttccaccatcaaacacaccgcagccgccgccgcctcctcctcctgctgctgctgtgagcctttgtgacacgcacacatctacattaatttacacatgtattattactacttgatcgaattcaatttgacagtaagctaggtggtggttctgcagagccaaccggatccaagatggaggcgtttgaaccagatcgatcctagctacgaccttcctgccctggaggatctgcacttcttcccagttctcacgaccaccgtagaccacagccaaggtaaaatatatagcatatctctgttattaccccccaccccacccaaacctaaaccctcttttatcgacgcttgcgagtgatcgatgttcttcactcatcttcctacttgtgcatttattttttatctgctcgatcggttgctcaaggggcacttcttgtctaccttaactaagatctcttttttttgttgccattattactcgatcggctgcctgcattggtggggaaatttaaagttcaaaaacctttcttttgattcggaccgctagttcgatcgattctttcatcctctcctgcagaggttaattggatccatgtcattgcaaaagtacatatttaaataaataccgttataattcgtctatttctaaccgtgtcattaaaattttacaaaattagaatcgtgccattgccgtcaagtttctatccatctccatcttttttttttccgtttcttctttttttttccctcccatcttctttgctttgcttggcggctgtgtatgatgtccggccgcgcgatcgcgggggttcagggcaccaacgccgccgtggccagcgcgttgatttctcctcctgccatgcgtggttggtggccagcgcacggcggcgtggcggcgggcgcagcaggcggggcaaggccgcactgcggccggcagcccggcacaaggcggcgctgcgggcgacggcgggcgcagggtggtgcggtggccggcgcaagcacggcgggcggctccctggcgaaagcgcggcggcctcgacgcggcttcggcgcaggctcggtgggcggcggccggggcacggcgcgagcaacggcgacgcacgcagtagctcgaccacactgtgctgatcgtcctgccaatctgccatccgttgtggtgttccttcaatccttctccttgccttgctcggatggtatctatggtggagcaacaagatgagccagaatggcaagaaaaagaagagcaagagctccaccatgaaagtgtacttgggccgtcagaagtcgccgtccagggacaggcggacgctgacaacgacggcggagatgacgacgacatcatcataccagcaggcatgccgacgaggtttagcttccaggagattacaacgatgacctccaatttcgcgacaaaggtgagaacaggcgggttcggcacagtgtacaaaggggagcttccaatggcgcggcgaggggctcatcgccgtgaaaaagctcgaggctatcgagctgaagggaagaagacgggagaaaacggaaaaacagagggatggatagaaacttatgatagtggcatgatcctaattttgtaaaatattaatggcatggttacgaatagataaataataatgacatttatctaaatatacacatttgcaaaggcatggatccaattattaataattgattgattgatcactcaattggtgggtttgtctctctctctctctcaacttgggcatgttaattggtggcctccgatcctgctattctttttaaaacatgggaaaattttaaaatccaccccataagtcacgtgacatactagggtgcatttgcaacaaaattacttatggttgctgttcgcaataacggaattaatggaaggcaaaattttaagttaaatatttgatatttgaatgcatgttcgttgaatttaaaaaatcttcatatatatatatagatgttcacaactccacgagattctttgtcacggcgttacgctgaagctgttagaaggatgacatggaaaaaaaaaatgggggtgaatgggatttgcaaggttgccccagttgtcaaaacacaagagggtggtaagaatttctcttgcttgtttaatctgacattaacatcaatgtgctatggtcttttggactaacaagaagtacatgcttttaatcgtatatcagggacctgtatttacaatgctatctgcagtactatggagtcccacctgaggcttaatggctactgcgtcaggctctccgtggaagacttgatcgagaaggagcaagcgctggtttgtgcagaagaagacaggacgctgcgctgcatcgaagtggctaagactctcggagtttgctcacaccgagattatcaggaggtgcgtgcgtacacatacgttatagttagacatttaggccgagttgagtttctaatttttttttcaaactttcaacttttccaccacgttaaaattttcctacagagacaaacttctaacttttctgttacatcgtttcaattttaaccaaacatccaattttaacatgaactaaacacatacttaattatctgttaatgctaattgtctgtttcttaattagagcaagcgcaagggcaccggccggaatgggagcacattcaagatcctctcgatcagggcctttctcaagctgaatgccgatgcttttgcggatgccattgaaagctgggggactaatggaccacttctagctgagatcgatgtggacgaaacattcatgcagtatataattaagttcgagcaagcgggtatcctgtcatatgaagcttacaatgagatcaacatgagagtccatgcagcgtgtgttctcgcgctgggcgtggagaatgtggtaccgttctgggagttcatcaattcgtacggcaagcttgggaagactaagggctacggcagagtggtaccccataacgtgagacgcctatttgagatcgtcgttgaggttccgaagaagagggtgaggggcatattcgagaatacgccgagcgactccatcgacacccaagacttgcggccttccaaggggagacctcctgtgactgatacgggagatgtcgttgttcctgttctcatgggcgcagccgctgccgctgggaatccattccccacacataccatggactgggctttctctgaccctccagatggttatggttcatctgccaagccggagcgcctccatatgatggatatagattaattagcggctttttctgaccctctagttctagttcctctgtaatgcgcttcttatgtgatcaacaactttatgttctgttctgagtatcagatgctgtgcaccgtgagaaacttaaaatactagtactccacaacaagcaagcgagaatctacttatccaaatccaacttgtcacggtttccatgttaatagtaattaataaagggagccacgcaacccaaccgtaccacaaaactgctccaacgacacattgcaacacttcttttaataagttttgagagtagcgggactgaccgatcatatgtgactgaccgatcggcctactaataaacaatggaataacgactgcctcataggggagtaattgcagatgcaggtgtgacaacaacaacaaaagaacaaccgtaacagcattccagaatgaacaagtagtcaacaacataaagaagacgctagctagctaatcttccaatcgtcgtggagcattccaagccatgcattcagttgacacttgatacttgatagattcttcccccacatacagcagcgtcacctctcctccagtcgtcagcaattctcgtctttcaagtctctctcttctttccggacctataaaaagcacactgcccaagtcaacgtgaaattgcacgaataattccagttggatcaccaacaaccttgtcctaaaggcaaatgatcactcccagacacacaattatacccaatttccttgggaagtgcacagaaaacaaaagggaccacagaagaaataaattttaaacacattctatagtccttattatgtaatgtggtcaacattacttgtcaatgccttcggagagactgggaactgagctatattattgtcatctttgtgtcaggtaaggttgttactctgcacagcgcatcgctagacctacttgggaaaacactgagctttgaacagaaacctaagttttggacctatgaaacagtgactatgtggttcctacatatgcaaggatagccagtgtgtcttgtcgatgcattgtgaaattcactgctgcactattagatctaatttgatttacacgaactaatggaatgatcccgtgaaatttcaaaagttctaatccagcattaaggcctattaataaattgtcaatttttttatcctaagaatgaaaaagctacaactccgtaatgatcgacgtacctcaagcatcagcatgttagcgtgattaatggtcagcccctcaggcaatgctcctacgtagccaacaaatccaccgtcctttggatgcctgattccaccccagcaatgggcacagatatcaacggaacctggaggtgacaacccttaattcattgattgtttcagagaaaaaaccatgaacttcagcacaaggttcaatatattgtttgaggcatttgtatcaggggggactgaaacgacagaaatttccgaaaattcggtccgaaattatttgattttttgaacaaaatttggtcaaatttaaacaaatattgccaaattcacagaaatatgaaataatatggtattaggggggggggtccaatagaaacaaaatttcgttccagaattttgaaccctgcttcagcacatgcatgtcaaaatgaatattcagcggcataacatttatcgattactccaatgataatttacaatgagggaagggaggaaacatggagtccaagtgcttaccattgtatttatcgacaatcttgcacattgtgacctcatttggtttttcttccccccttaattcagcaaaaaagggtgttgaacagccagcaacagtggctctaaagtacacgtgccagaaacattgtttgtcagcaagcctcaagataaacatgtggctatccttggctactcccttggttgctttattggctggctgaaaatgagaggaagggaacaatacaaggaaaaaaagaacagaaaatataatgaattaaaaaggtaactgactcaatcttaacaaactgattacaaatatatgaagtaagcagaatacttcagaatactaatcagatgatctccaaaagctaccttatatctaatacacacattaccatctgaggtaaaatataataacaaagataaatcacataaggtaaggtccaagataacatcagtacacacattttccaagttgtagtagtgcattgctagacgggtgcaaacacgtgtctggtgacattgacttgtatttttatgttcttgccaattcaatggtcccggcagcttgctgcggtcccttgaaattgcatccggctgtagcatgcggtgatgaaaaaattcttcagcagcactttcatattgccaaagaacaaaatgaagattagaaatgtgatgcacatctagcaaagcaaagtaactttatgtatgtgttccagatgttatttacgtaagtgcagatgctttggattgcttgccatgatttgctataaaatataccatttctaatgtacagatagctgtatgtagcagtcactgttgctaccagttgaaaaataatcttacatgtataaatatttaatttatatgcacatcatgtatggcctaaaagaaattagtatacataatcaagccttgtgcattaatggaagttacttcctacccatttcacccaaattattattatgttttggagaaacatataaaacacatgagaaaaagaaacatactcagggggacctttcttttcgggcttttgggacgccattcttgatagctcaaaaggagatgcccttaaagttttcctgcatatgtgaaagttaacattgaacttgatgcaggtgcttaacaaacacagattaccgaatagctaaagtaatacaaggataagcatctattgaatgagagctgcaatattcaacataaatataatggtatgttacaataacaaattatttaattcatctagcaaaaactatcatagacatcctattactatctttaatacactaaaaatacaatagaatctaattgggtgcacaactaattgggtccactcatactgaggtagtttaaccatgatgcatttcacctggtccaccactagggtgtgcactacattttcttccccataaaaggttgctttccccccttcgttttctcaaatgagctgaaggagagctatgcaattgatttttttttaaagagagcactgtgcaattgaggcttgtcaagtatcaacattttccaatctggctgattgcagttagatctagtttgcaaaatcttaagtcctaagtactaactaaatctagttaaatccaaatcaatttccacaaaatttgttaactgtaaatcaaatttacccaaaatttgttaactgaaaaacctgaagagacttcagtgactggaaaaaaaaaacctaaagagactttaggcatagataatccgaagtatgagggacaagaagatgagcatcaagcaaaactgctccttaactagtaaagacaaagaccgaacgaaaacacatgccatttaacagaaaaatatggcacgaatactttttaggtaagaaccgaaccacgaaaatatttgggaagcccgggattcagactatgagataaagaaagcggagaaacattaccagatgtatagggtggcgggcgagaatgattgagccgacggcgcgtgggaatggggtacgggacgacacgggaaagggtttagccggcggcgaagaaacgcaaaggcgtggccgcgtgagtgaggaagagagccgaggcttgagctgagagcctgagagtggtggtgccgtggtggagactggaaaaccctagtgggcgaatgctcgcgaacgcaggctttcttccgtttctggcccaggcggccgcgccttttccttttccttttcctgtgtggaataagttcactttagatccctccatttgtcattgagtcttaaattccccaacttacaaaactgtgcaaacgagatccctcggtagtattatctccggttttgactgacatagcgcctatgtggctcctttgactaggtcttcatcccacgtggcattgacatggacttacaaggcaattcgattcggaaaaataataaaacccatggacccacatgtcagtttcacacacaaaataataaaaaatagtggggctatatggtcccacatgtcatcctcactgctcccctcttctctctatcctctctctagtagtaagttgtttcatctcatagatgctctaatggcttcacttagtgacggtggagcgggatgggcgttggtcggagcggcggcgaccggagcatgccagtggtgcagagcggaccgtcattgtcaaccgctgtcacaccgccacagctgtcgtgctcaccagcaactgcttgagctcctcctccggccacctccgccgttgttgccccctccaccgcccgaccactccatcccacccgtcgcccgcttcggcagccgcctaccccgctccgctggttggagagagagggggatagagagaagaggggagagagaggggggatagagagtaggggatagtgaggatgacatgtggggccccatgggcccaccatttttttttgtgtgtaattgatatgtgggcctcacgtgttttattattttttccggatcgaattgccatgtaagtacaacgttaatgccacgtgagacgaagacctagttaaagcctcaaaggagccaagtatgcaccatgtcatccaaatccaggacagtactgctgagggatctcgtttgcactgattttgtaagttgagagatgtgttgtgcctcgacggatgaatttcgaactcagtgacaaaggagggacctaaagtgaacttattcctttctgtgtgaggccttgcggcttttcttgacgtggtgtgttatgcgcgtacactaacgtgatttggagtaatacgaagtagtgaagtagggttagaggggtgggacagtttggtctttggtgtgttattctcacgctgcacgcagtaggggacacagaggaagacgacagcgtcttttaaagtataaataagtagactttgttaaattcattttaaatttatatgtataaagtttctttactcaaagtttctattagagatagtttccatgcataaatttgtgctttaactcgtataaagtttgtacatttttaattttctttcaaattcatatgcataaaatttctgcggaatgtttctaaaaaaaaatctacgtatatagtttgcatgtagcaagtttggactttaattgtatacgttttgtatatatactgtattcgtttaaaaaatgagctttgtatattgcctcggaatactagatatcttaaacgtcctagattcgccgcgagctcagccgatccacgccattgaattttgcagaaaacccctcgttgtttcggtatttcggattaggttcagctgatcagagccgttctttctcacgcgtgtacgaaatctagccgttcattccctacgtacggccttgcctggtcgtggaatcggtggccggtcctctccccacgccgcctcctctctccccccctctctggctctctcccccgtctccccgatcccctttctctctcccttctccggcgccgctttcctcgccgccgtccctcttccccttcgggtgcgccgctccccctcccctacatcccgacctccgcctccaccgccctgccgtctctgccaccgccaccgccgtggcgactcgctcccgcccgcctaagcccactgccgccgctcccgagagtggaggcgggcggatccgcgtgctgccggcgctcccgttcctgccaggccgctcccaaggacgacggccgctggattcgtgcgtcaccgtcgctaccgaggacgggggacgacgaatccgcatcggtttcttcctgccccgcctcctcacggcgtgggtctgtcggtgggatggaggttcttgcgcggcggcgcgggccggggagcgaaaggtgaggactttgtgtgtgttctcttggtgcgtttcttgctgtgatttcttgggggagctgttcgtggtttctccacctgcggccgtggacgagattctccatctctgcttcgggggatttcttgtgggtttcttcccttcctcttcctctctctcctgtggcaaggtgtgggaggacggccatggtctggaactctggatcttctctcttactgattttcctccagcacagacgagcaccacgcggaacctgcggctcgccgtcgacggcgccggcaccaacaaccaaactcgaacgtggaggggcttttggaaagttaagaatggggattttcattttttgttttgttttgaagctttcgctaatttattggtgctgaccatctagagtgagttgatgccttgcaattggctactgagctcagcatttgctttacttgatagtgctcagtttggcaattggaatatacccatcacatgatgcaaataattctagattactagcactgctttgttctatttgattatttttttactcatcagattatgtcagtgcatgtcaaaaagaccagtcagatgatgccaagtgatcaaaagatataaatactgtcgaatgatactaacctttgtactcattttattacaacatgaacaaacccttctttcttcaaccaaattctaccatcaaagcatgggatagctagggccatctcagtgccggtgagctggggacgtggtaatttcccggagttttcaatttattactattcagtttcttgatgtatgagtgcaacaagttagtaaaacaagctacaatttataatcgggtagtcctgtccatgtataacatggttatctttgtttatttcttatcttatatgctaagatatttcttctcatttttgcagggtggaagatctttcgatttgtgaagttacaccaatttactaactttgtgatattgcactaaatttaggctgtatgtatcagttatttcttccagattgttttactcacagaatagatatgtttttcatgttatcaatgcacatccttttagctagaaatatagccttggtgtttgcatgtcaactggagaagcatgtcgactgaaattggttctatttgttccaggacaatcatgtgttcttcagttcctgggttagcattgcttaacaccagcataagcaaatcttggagcgatgaggaacttgtgcgattcttggcagagaggaaagcagcagactctttgccggagaatgtagtggtggggatgaacttttctctcattgatccatggaattcaggttagtgtccaatctatacagaaatttattatgacgtattcctggtggtataaccagtcttgcattctgaattaatggtattctccaacaagactatgtcatgtaatatctgtggtctgcttttcataattcagtcgttatagaccatgaaggcttctttgttttgtcctttttgagttgttatatatatttactttactacagtttattatacgattcggtagtatagcagcattttaattcttaaatgataactaaagaaagggaatcctacatagaattgataactatttagggttaaaaggcatggaccattatgcaaaaccagaaagaaatatcttgggctctgatgaaagtccagagttaagtgcacgaacgcatacttcagccccattgattatggcaaaaattgcctgcatgaagtgctcataaactaaagtgggatgttatatgagaaatactttggcacttcacattaccctgagcatttctttttcatttttctttgtagcctgtgcaccagttgcttgcatgttttcactagaaaattctgaattacgctatttgacgattaaattatgttcaatgtgttgctcggctaggatcctttaactttcacatcctcaccagagtttgctattatgagaggtcattgtttgccagttaaactttaagttttggagatgtcataatgcactatatgccattggttattatcaacttttgtttttagatactgtacaagcagatcatgtgctaagattttggggcttcagttcacttttagcattaaaatgtgcacataagaggagcggtagcagcagcaggaggataggagatgtaatgaggcaagagtgaacttgtgagctttcttaaaaactgtttattgcccagcaacggcgatgcgatgtacacagtcatgacagagcagatgaggtgggacttaaattttattaatcagagtatatgataatgttgtcatctgaatgtttgtaatattcaagaccttaattgctttgttttgatctaatttttttaatctttgaaagaattaacgtcgctataaatagaatgattctgaattttacatggagaaaatggtattcgtacccataactgctgcgatataacattatcttctgttaaaatgagttatcgcattaatagttttcttccattagggctgccaatgttctgaacttttgattaaatttgggtccagttgtttaaatgatgacaaaagtaacagttgctcacgagctctcattctctcctacaagtgtgttctattcatctatctatttttactgttttctagcatgccactgctttgtcgtccataactccaagcaaaaagcaaaatgttcggcttaagattgaaacaaaagcaaaatgttcggcttaagattgaaacaagctttgcagaacaagctttgcagaattgtcggacacaagttacttgggagggttctcaccatacaggtgcagacttgcgcccttttctggagtttgtaggttattagctttacaagagatttgtgctgcttttaatgaaattattatatagtccaacttacgaaaccatttgtaccgtggtgcttgcattgtgttgtggcttaaaacaaaattaataaggcatggatttgcaacaatgaattagtttttgtgtgtccacgggctctgtatgtcaaaaaaaaaaaaacttgtttgcccttgccttcttgctatgaaatattgtactgtcatgtaactaatgaatcgtcatttacatgtaaaagaattgcttctctaatcttacattcttctgtttcccgtaatttagtggccgcgccgcatagcgcgcgaaacctttctagtaaattcaatgtgggctgcctgataagctaggccatacgagaattcatgtctacatttgagtcgacacatacgttggccgcattcacgtggccccgtccgagcaagccttcgcgcaacaacaaccgcaagcaagctaagctttgtgtgcatccttgaataaaaggtccactttccagtcctcaaagcaagggtgcagatggtgtcaaaaggaaaaaaaaagtaagggataatttgatccgtgctattgtaaatgtgtcaattcaaataaatgatattacaattcatttattcatagtcatgccatccaaattttataaaatttaaaattataaccatgccatcgccgttatgttttgggtcccacatcctaggagatgaaaaaacataacggcgatcaggggcggtcacggggcatagacatgggggtacagttgtaccccccaaaatttttttgcaaaaagaacagtatacatagggtatattacatacatgcaccaaaagtggattaaaatgaatattgtcgacgtttgatatcgcgattccggtatttgcatagtatggggatcattggtactaggatatatgcgagactgaggtaaaagagacggggacgaggatttttatatagattcaggcctctgaattgtcaggtaatagccctacatcctattggccgaagccggtcgttgctcttattcaccataatcacaccagtacaatatttgaggtagcctatctaattgttgtcgacatggcggtctgaagttctgactcgtagtcgacaacagggttgacttcctcctcgaatccgtgcccggcgagatcagagatagcgctttcgtctctcctgacagtatccggagacactgtagggaactagccgttcttatccctgaagtcgatatccggcgtcttgtcttggcgtatgttagcttgtatgttgtggcttctgttgttccgtatattgtggtgggtgtatcggcggtgagattcgatgccccaggcccttcccggggggtcttgtatttatacccataagtgcccccttgtccaagtagaactagggaaaccaatatggatacaatgtgagtagtccttgtcgtttccatgtagaactctggttgtctttccttatctagaactccgtccatatccaatgtcaatttccgtataagacatggtatgtggtgggtcctgccgagatgtagtcgactactattaggtatgtggtattcataatcctgacagtagcccccgacttcaatgtaaatgaacgaattcatattcttgaccgctgaccatggagtaactgttatcgagctcaagtgaccgttctcggtgagttcagagataacgttagacttcctttatcagcctcgtgcgggcacctatagggtttgtctgagtcaatctccgatgtcaaccaagaaagtacatagcatacaactaggtctcccgtcttgctgtaatcgagaatttggattgaagtcaagaaattttatctaggcgggtacaccatctcttcattttgtattccttgtcgagatccaccaaccgttctcgagcgatcgagaaggcgtagaatctgcgacgaagccttgtcaacatttgtcgtactcgccttagtcgatcttggtgtagaaccatagagacgtgaagtcttcgacaatgtcaaatagaattttcctgaaatcaatacttagaaaacaatattagatagaaatagcccccgagcgagcgatcaaagggtgacatgttataatatgtatgaaaaactgaaaataaattaaatttacaaaccaatgttttgtatatgagtgtcttctcttttaccgacttcgatcagtcagtttgttgagtcatacactctccctagcccccaagccttgtcgtcggagaatcgttctcagaggataaggctcttggacccttgacctgcctcggttgaaaaaagcactgaccctagcccccagccgtgaagttgaaaaactcaatttccgattacacggcttggttaatacgcacggcgagaactcttacatgaccagatcttacatggtattttgtctctacaggatccgacaaggccttatcggctccgggcgtccccagccgaagtttccttaggttcctcggaggccttgtcaagacgacgtaaagggacagtaggataggtttcaacgctaggtgtcgtcgtggtaagggatctctgggtaaaacacttggcaatattgtgtaccttataccaattttgctggagtagaggtagtgggagaatcgctacacctctggtcaaaaaccagttgtagccccactcgaccacttgaagtaaaggtagtgg

SEQ ID NO: 82647 - DNA, 14177 bp, Oryza sativa
  unsure (1)..(14177): unsure at all n locations
caacgtccgtctgcgaaaataatcttcgcaggcggacggccgccccgcctgcgaagacccttttcgaccgcttgcgataatgcttttcctagtagtggaacacattattcggatacaccaaaaaataatttgagtatatatatatatatatatatatacgggtttatgattattgaggcataggtggaattgtatgttgtgttttctttctgaaactttaattttatacattatgatggagagcgagaatggctatagattctgttgaagcaaatgtcggggtttatccattatctaaagagaaaatgaagagatcgaggggatgccatgttaatattcacatggatattttcattattgacatggatatcttaaatatattttttatctaagtattagaacgttgagtgataagcaataacttttggactaagcgacaatcttcttcagactgtctatccatttgtcaggtgatttctaaccaaaaatcacccaaattttttctactcctagatttacatccaacggactacaaaagaatataacaaatacatatttacttaacatttttttatcaaaattacggtgcacttacatgtcttatcaactgaatttacaaatgtaattttagttatataggactgtaattttatattttaaagaaaattacaaatatatatttacttacacattattttttttcaaaattacagggcacttacatgtcatatcaactgatttacaaatataattttaattttagttatataggactgtaattttatattttaaagaaaataacaatatatatttacttacacattatttttatcaaaattacagtgcacttacatgccatatcaactgaatttacaaatgtaattttagttatatatgactgtaattttatattttaaagaaaacaacaaatatatatttacttacacattatttttatcaaaattacaaggcatttacatgatatatcaactgaatttacaaatgtaattttagttatataggattgtaactttgtatttcacggtgacgacgacgacgagagtggccgtactgccggcggccagctcaatcagaggccaccttggcaccgtgcttctccatcatcacgcgcgcacgcggtagctaggtaacacaggccgacgtgcctgccggccggcgagctgcatggaacgtcgaccttgcaaattgccgctcgcatcgcaagctgcatggaggccaaaaaaaagtgtcaaatgccagcaaaaaaatcacacgggagatggatagcaaaatcaaaaaaacaatcttcttttcagataggaagacacgtctgtcatgggcatttaatgggccaggtaaagacctattgaacgggccctgatgtaaatcaccactgcgtggccaggcccaaccccaatttggaaacctgactagttatgggataagttcatctgaggtcccttaactttacaccgaatccgattttcgtccctcgatcagaaaaccagacacagcgggtccctcaattattaaaaccggtgcagattaggtccctcggctgttttgagagcggttttggctgacgtgacacctatgtggctaatttgactcggtctttgtccgacgtggcgcttacgtggcaattcgacccgtgggacccacatgtcagtctcacatagaaaataataaaaaatcgtgggacccacgtgggtcccacatgtcagtccaactcacccctcttcttcctcctctctccccatctccctctcttcatctccctatctctgctctctccaggcgccacggaagacaacggcgcgtggcggcgcgcggccggcggcaggagaggagggagcaacgcgcaaagaccggcgaggtgggcagggagggaggacgcaaggaggccggcgatggccaagcgccgtgggcgggggcttgatggcgacggacagagggagaggtgcgcagccgacggcggccagcgggagagggagcggcgaccgccctccgccgcaacctacctccaccaccaagctcgtcagcgactgcccaccggagtgagcaggacgacagccggcgacgggtgaagaggatgaaggcggcggtatggagcagaggtcggaggagggcccccagccgctaggatggcgctcgatccgtcgcgtttcaccaccaccgagctcgtcagctgcagcccaccggagcgaggagcgaggagcttccgcttccccttcctcccattgacgccgcagccgcagcaactgaggcgccgctccccatgccgccgcttctgtggctgttaacagtaaaatttggtaagcccggagtagtcattggcttagagtcaatatcggtttggaagtcctgagattagccgatgagagttgtcaagtcgtcagttgtcggattcttgctatattcggttaaggaaattgatctactaaaggaagcttattcagaagagaccaagttcaaagagaatgcggcatagcaagttatctattaattaggaatagtttgttagtttccttttatctctaggaaagtgtgtttagtgtcctataaggactttatcattttcttttatctttaggaaagtttctttcttgtccgacaaggacttgtatcaacccatgggtataaatatgtacacccggggtctatgtaatctatctccacgatcaatacaattcggtgcatcgccaccttttaccttttctactttattttatcatccggcgggacttggcacttgacgcggggctgcatcggtgttcgatctccggctaaggggtaagtccaatgttccgccggcccagggaattgtatcgtttacgtcggcgtcgttcaaggctgcatcagtacattcgacctcttggattgctctggtttggatgatatatttgcctacctatttatcatatgtatctgttaatctagtcttagcatatcaatttagctctatcggctacttctcgttttagggtttctgccggtatcggctaaatcgtgttgctagattagattagcttagacatctaccaccctgaaaactcagtcaatggcttgattgtctagatattatgtttcttttcatacttagtgctgcatcagttaagtttgtctactaagtcgtgcttagaaccataatctctagcctgcttcttgattgccaataagggtatcatcggggtttcagccagtgagttatctggacgttgcatcggctcataaggattgcatatacatataagttggatttagccgatgacaataaaggtttcactatttaatctaatcttgtggatttcatgacatcggacctccagccaatgtgtgctttaaacctcggatcgatgcttatttatcatatcattgctagccgattggtttctaccggattatattgcaatattatactatcatcagccgattgcttttatatcatcatctacattggacatatagccgatttatcaaaatcctatcgctatcggctggtattggcatcggctattatcgatatcggctgagattgctccatcggcttgtcagccaatcgactgttttgatctactatttgcatatcttgtcagtttcaggatcaaactgactggcacgcccgcatctcatcaatctttggacctgcacaggagctaagcagatctcccaggccagtatgttcgattttttcgtcaacagtggcgcacgccggatgcggacggggacgccatggccgtggccgcggacgacgtcgacgtcgacctcggcatcctcggcaactcccaggggccccgcgccgccaccactaccgggaggaatagcgcacggcggacgtcctcctcctccggctgccaccgccacgcctccccgcatggctgcatctcctcctcctccttcggcggccatcgctgcacgccgccccttctccccgccggccaccgcccttctcccggccgccactgccggatctcgattgccggcgctgctctggggggagctgtgttaacaaccaaatttggtaatatcagcatcggaaaggaagatcagatcgaagcggaatcgaagatgaggattatcgctgaaacagagtaagaattggctggagtccagatcggctatgattggatcggctgagcccgagtcagacttggttaagtgatgtagccgattccgacaatatgacctaatgtacaacgtcgggttgaattgatatgcttcaagatgattgccacgcatggatagagtcctgataaggcaattgtatctattaattaggatattttgtgtaatttccatagagatatgtttggacaaaagtctgccgcaaagatttatggtatcttagagtttgttagagataagagtcgtgtctgatatggacatagtttgtaattttcgggtataaatagaccccgaaccccatgtaatcaattaacacacacgttcaatacactttcggtgcatcgccaccctttttgctttagtttatttcgacgagttcttactttcgggttgagctgcatcggtttcgatcttcaacaagaggtaaaacttgttatgacggcttgcgttctcgggattggtgcttccatctttatgatactctaatattgtttatgtaattcgtcgagttatcatatattttacataatctctggcaatatcgcaatttaacctattatcggctaaacatctgtcggtagaaggcagccgattaggttaaatatcgatgttgactttgattatataggatatctaccactctatgaaacctccagtgacttgattgtctagatattgttcttcttttcatacttaatgctgcatcagttgagtttgatctattaagtcgtgcttagaatatcaatctctagcctgccttctggttgccgattagggtagtatcggggttgcagtcgatcttatcttatttaactatatttactctatatgcttcattgatatgttaaatctgccctttatattaagatcttgttgcatttaagtatattagacttttgtttgatatatcctacttgtcttaatatcttagtataaaatggtatcggagtattagccgatacatgctaaatctgtttgatcggctatgctatgaacatatataatcctattattaatatatatttcgatctaagtgatttatactgtctcggcatagcgaccgatctatctcaatcacttgatttaagtatatatcgatataaggattatatattgttaatatctacaaccgatcgaatagatttagttccttcatatttaataatgactgccgatcgatgtatatatgacatcggctcaaagataaatgatatgtcatcggcacttagccgatcggctatcgtttatggatttaaccacggtttctttgtttttgtttcttgttgattgcaggatcaaatcaactggcacgctagcataacccgcagcgagttttggacctgcactggagttaagcagatctcccaggcctcgtgttttacatcaacaacctgccgccgcccgggtcgatctgttccgcccaccgccatcgccgattcccttttatcgccccagcttcctcctccagctcggtgctctcgctggtgggcgtcggtctcgccgccccctctagctcgccgctctcgccggaagaggagaggagaggggagagtgatgaagagagggagatggggagagaggatgaagaagaggaagggtgagtttgactgacatgtggggcccacgatttttttattattttctatgtgagactaacatgtgggtcccatggattttattatttttccggatcgaattgccacataagcgccacgtcaatgccacgtcggacgaagaccgagtcaaattagccatgtaggcgtcatgtcagccaaaaccgccatcaaaaccgccgagagacctaatctgcactggttttgatagttgagggacccgttgtgtcttattttccgattgagggatgaaaatcggatttggtgtaaagttaagggacctcagatgaacttattccactagttattagtgtactttttcctattaggaaaggcctgttacaagcctaaatttaaccctcctctcaaaacaagaaaggtcaaagctttaggttgatcgtccttaaattcttctgtaggacgtttttttttctttttaaaaaaatcagtattaattctgaccgttgatttcttgtgagttgtattcttagtttcaacttaacagccaccaacatcatttagacggaattgctacatcacatttaacaaaaaaaagtggaggccggctagctataatcttgtagttttcttacattagggaatgcttcacgattcgtgcgagagctcattctcctctagcttcagtgcatccaatgaactacagcaaccgacagcgactcaacaattaaggttcagtgttcaaggtagggtcaagggtggacgctcacaatttcttctttaaaaaaatatttggactttggagggatgtcttttcctccaaatctctttttttttaatattagtcaatcccttatttgaaatcactttgaaatatagatccgtatatataaattcaaattaaccaactggaaaaggttcaaccattaagcaaagtctggttagaacgcgctaatactctctttagttataaatatttgacgcatagggaaagattttgtcaaccttttaaactttgatgcgagcatctccaacagattatccaaatcggactctccaaacacccatatagccaactctccatctaatttggctagtcaaactagttacttactccaacagactctccattatgtatctatgacagcgggacccatatgtcagcctcaaataccccttcttcttcctcctcttttctccccttttccccgagccctccctcaccgacccctctaccacgtcgtctccaatctcactagtgtcgccgctccattcatgctgccgccgctcatcccttcttctctctctccggtgctcgagagcagacggcgagtgggaggccttcgcggcggtcgaaatcggcactaggcgctggcggcagcgagcgggaggctgcagcgatgctcgccgtcatgctacctgctgccgcggccgcgggcggatcttgtgctaattgtctcgccaccgcccaagtctccaccactgcgcagccgactaggcgggaaggcgagaagcgaggcgagatgggtggagcagatgacggggaggaggaaagggtggggcgacggaggcctggggcggagatgttgacggcaatggcgaggctgggtgacgactgtgctgccgcgtcggatggggagatggcggcggtggctgctcgaggcgaggggatttgcgcgacgcttgacgcttctactcgcgggcgatgtgatggtggcgacgccgtgacgatggggagaggtggatgggaggtggtggtggcggcgaggtagctgctcggaactcaggaggcgttgtcactggcatttctcagggcagtgttgcttgatgatgtctttggccagccaaaccagctggctagatttggctagcccacctgatcatttggccagcgagatggcttagccatccaaatggagagtttgttgcacctcattttcttgctatgtttgctattttttaacttggagagtgggatggctgaccggttggagatgctcttagatgcctaaaatctttttaaagaaatgttgagatttggcttggaaagttatataataaatttattggaatttacaaatttattctaatataaaattaaagatcaatgtttcacaagtttaataaaactttatcctaaacattaaatatctatgaccaaagagcatatatactccctttaaatgaactaaacaacatcatacacaaattaaatgtaaagagggagcagtatttttcatggatgcatatgagcatatccaaaacggtcgttgtatatatccggcccttatttaggatagaacatgtgtgctaggtagcacacggtaatcgaattttaatttgtcgttctcataacgtcagctggtagcagcaatactcgttcgtccgttcttggttgtacaaaactaattgcgctactccctccgttttgtaataggtaacaacgttaatgttttatcatatatttaacgatcgtcttattaaaaacattatctaattataatttattttttaagttattttgtccttaaaagtattatgagcatgattgatatcttatacattcacataaaaattttaaataagacgaatgataaaatatatgtttaaaagtcaacaacgttatctattaaaaaatgaagggagtaaactttgccttgtacaagggaccaagaaagagacgacgccgttgacacgctagctagctcactgcattaatcacacacacaaaacaacaaatcaaatgggactaggaggagaccaaaccaatcagtaacatggctatatatatagagagagagagagacacacacacacccatcctgatccagctcgatctaaccgatcgattcatcatcaacaattcacaagaactccatcacttacagtgcaaatcaagctgatttcatcagacaaatttcactaataactagcttagctgccgtagagccgtgtgcgatcaagatcgtatcatccatggcgttctacaagtacggcttcgccttcttggccggcaccggcttcggcgccgcgctcaccagcctccgccgcgacggcgacagctgctgccccatgcgccgccgccgccgccgctgtcgccgccaccaccacgacgacgacgaccagctggtcgacggcgacggcgacggcgaggctgcaggggaagagcgagacatgaaggagagcaagagggcgacgacgacgacgaatccgaaggccaagaaaggcagcaacaaggagaagaaggcagctgctagtgttgctagggaggaggaggatgacgatgatgaataggattaatttgagttgattattaattaagttcagtttgagttcagctattatatatttttaggtgcttgattccgttgctgtgccagtttaattgtgcttgtttagctctgtactcgttatcctgttgtgtgtattgacaaaaataagagaatatacatatatacctctctgttgttaaaaaataagtacctttgtttgacggtttttattttttgcgttgtgaacgggagtcgtcagccatctcgatcttgaggaactcacaactaagataataataaaactagctagtagaataaatttaggctaactcgggataaactcccattttgtgaccggaatggaaaattttctggataaatctacaaacgaattacgcttagcaaaacgataaagattgaacaaactaaggcaagatagagatatataatatgaaaagatgacacaattagctaattgtgtgttggattgttggttgttgtcaataaaacctaccatatttgttataaagatatcggtcttataatatgagagtttctccatgtctgttatagagatcaattaatacttgataaatctcaacacaagcaacaaaatatgagaaatatctcaactaggctcggaatcagagtttactggtcaaactggccatcatggcctggttggactgctagatttcagttagaccggcccatataatggttagatcggcctcttctatataggtattgggctttttaaatataatttggtcttgctataactgcccaactacaaaatttggttgtcaacatacaattccttttcttctttttttttttacaaatcaggaattaaaaagcacctacacatcggtattaagggcaataaaccattatcaaccataaaaaaacccttgtgagcatctcaaaaaaccggatatcttactgtagaaaaataattaaccgtaaataagaagactcggatcgtactaaacaggtaaaaaaactaattaactgagctaagcccacctcactatatttcaacacaattaattaactgcgcaagtctcctagattgctagcgagagaggcacaagaaaaataaaaaggccacaatttaatcgaccagacaaggacaagccttgctcggtgggtggttgggggtattacaaaaggtataaattcctgaagttcagctgttgtagtctgacccttggagaagaagttgatcatgaatcttttatccaccaaaaccgtgtgatagtggccaccccttgcaacgtcagatcatttcaactattatactactagtagttagcaatatcaattactacctccgtttcaacgttggacctattcgtgttatttgaaaaattagtgtaaatatgaaaaagaataagtcatgcttaaagcacttttgataataaagcaattcacaaacaaaataaataataattttatattttttaaaaaataagacgaatgattaaaagttaccaatctatacctaattaaaaaataagtaaggcttccggttaatctttttgtccgtcattaagagtgggcccacacgataattcgtcgctaatccacgatccgaaagcgtggccacgatctcttacgcctgcaaataaaggagaaaagaaaaataaaaagagaaaaccttgtttgtggagcagcccatccaaagcagcctggattggattagtgacgaggcagcccatccaaagcagctgcagaccggcccagatagcagccgcagcccaccagcgagcccacagagcggaggagaagcagcccaccagcccagcacagtactgcgcaacactgtagcaaccgaacacgaataaagtttggactcacgccaagcaggaaaaagaagagatcttattacttaaaacatgtagtcaccaataaaatgaattatttaccgacaaaataaattcttttttaaaaataaaaataatcacatgtgtctttctttttttttagaaagagtaatcaccaacaaattgaatcatgtttacatttggatttttttcgctcatcaattgcttattcgccacaggacacctaatcacatcactttttttttcattcattgtataatttcttctattatttagagtgaaagttattctgcgatataccacatttttttctttccttctgattatttaagtgagtggttatgcaattggagtgcagtgaggttgatctgatagctagcaaaaaatatttcttatattatggctactctttacaatatgaaaaaaaagtgcttatcaatatcgagtaccaaaaaaaaaacaaagtactgcaattgactcataataatacatgacaaaaaagtaaatattttttgtggtttcaaagtttagtatccatgtcagtggatttagagcaacaaataattatatcatgttagcgtcttatttgcactacaaagattcgattcgactataaagacctcaatgaacctggtggttttatgctcccacacactaattactattttttcttcccccaatgcaacgcatgggcattttgctagtaaagactcaaagcgataagtattttaagatggaggtagtattcaactcttgcatagaacatggccatcaataggttattaatctgttgtatactctgcactattattcctagatctttacatttccttagctttgctcccttcaattcctttcttgaacccttgtccaagaaacacatattcatccgattgatggacacactgatgctagcttcttcaatccagctaattaattacacacacataacacatataaatagcagcacagatacacgaattgttctcatccattaacaccacttctcatctgcagttcagacacacacacacacactgacacaaacatatatacttacatataaatacagatatatatatataggtggttagctacctgtatagtttatacattagctagtgtatgtgttgttgttgatcatcgatcgccggcgacgacagggagagatcgatccacgatgggttgcctgctgcggcggctgttcccgttcctggtcggcacggcggtgggcgtgtacgcggcgcagaattacaaggtccccaacctccggggcctcgccgaccgcggcgtcgacgccgccaagcactacgaggaggcctaccgcaagaagccctccgccggcggcggcggcggcgggagcaggaagaagatgaacaagaccgtcgagatcgacgacgacgaggagtaaattagttgatactgctagtgctagctcactagttattacattttctatgaaaacgagcagctagtgtgtatgatatgtaaattattggaatgttcttatgtgtacacgtaaaacttatacgtaaaccttatttgtactgtttctaaattaaaaaattaaaaagaacggatatattaataaaaataaaggacgaaaaattgatcaaatggcgaagtagtggccactttcactattgcaatcagccgaacgtgtaggtgaatcgaccattttgactcccatagaatcagattcgtaatctactactggagaaactatcgacgtttgatgtcgcgattccggtatttgtatagtatggggatcgttggtactaggatatatgtgagacttaggtaaaagagacggagaacacaccagcctatctaactgttgtcgacttggcggtctgtagtactgactcgtagtcgacaacagggtagccttcctcctcgaatccgcatccggcgagatcagagacagcgctatatctctcctgacagtatccgtaggcaccgtaggggactagccatgcctatctctgaaatcgatatccgacgtcttgtcttggcgtatgttggcttgtatgttgatcttgtgtcttgatctattgttccgtgtatgttgattgtgtcctctctcctcctaaggggcctaatatttatgggtaatttggaaccatgccattataacttttgtaaagtttgagatatgccatcggtatctcaatgacatgcaggacccacatgagtcaatgacatgtgggtcaggatggcatatttcaaattnngcaaaatnanaanggcanggttccaaatttccctatatttatacccataggtgttcccttgtccaagtagaactagggaaaccaatatggatacaatccgagtagtccttgtcgtttccatgtagaactctaatcatccttccttatgcggaactcctcctatatccgaaggttgtttcggatacaatgcacagcctcctgtaccgataggagcaagccggccaagcataatgttctcagtgacacctctcaggtagtcagattcagcatatacagcagcatcaagcaagatatccaccgtctcttcaaaggaacatctcataagaggccctgtgtcattacggttgataccatgccttgtaatagccatcagatgccctctgtatgtcattgtatcacaaagaatggccagatgtctgtaattgacataagaaccatcgaaagatatgaccacccgcagctcatccaagagagctcgacgaacagcctcgattccaagaacctcaattacttcgatcaaatggttacttgttgtcctagtagcatcaacatcttcatggcacatgacagccaagagattaacaccttccgtatcaagcatccactcattatctgctttgaagccaacattgtcctcaaatttattgaccttcccatatttgataaaaactttgttaatatctggaattccacgaagtgccatctctgtcaatatcctcagcagactcatgttactttcaatcttcttgaggaagacatcatcctcagcagactcatcttgtatttctccctttggagcttcatcatttgtgatgcggacacgaaggatcagtttatctgcattatcatcattaaatatgcatgacaagtcatcatcaaattcatgattgatcttctctgcaatatcagccatgctcaacttcttatcaaccatcatctcacgattcagctcgatacgcagcagccacggtgaaattttatctgggtcaatatcctcatcaggcatttcataataggaccggacaaattcaacatcttcttcaataatggttcccagtggatcaggatcataccatatctctgtagcatgtgtcacactgcgcagagtaggggctgcaggaattc

SEQ ID NO: 82648 - DNA, 1453 bp, Oryza sativa
ttagtttcagttgaccagatgtctctagaacttctgcatcaacaccaagatcgatctttaatctaaattttttacaacctgttttcaccaggctcatactattgggacaagccttggccttgctggggggcgatgcgaagcctttctcgaggctctggagagcctacccacagatgccagcttcagcgctgccctgatcttgacccacttgcgtggggacaatggcaccgcaactctttcgttgctagaaaactgagaaatgaaattctgtatgagctgatcacatgagctggagtcaaagctgtttgttcttgatggctggaatggagcggcaatttgctgtgaggtttggtcattgcttgataggttgagcaggttactgaaattctcgcctgcagatgccatccttagtaattagcatcaagatgaatgaatcagatgtagccaaaaaaaaatcagcatagagtaattactgttgcttggaggcactaagtgaggttgcatcaaagccacaacttcatctgtatggaggaaattatctggagaaaagccctgtcaacacaaatacaaaatggattagttctgttgaatgaaaagcacaagtaatgtcaaatttttactcttcgatttctatctagacaaaatacatagatttttacataaaaaaaggttcttaccttgtatgattcttcaggtgaatgagatcgctcattatgtgcatactggccaattcgtgtggcagcatgatcagcctggatgctgctatgagcgtttggattaaaatatgttttttcggtattaggtatacacagaggagtgattcttggtctgggtatgaatgttccttgatttgaatgatgtgggataaaattgcccatgcccaactgttggctaaactgcacgttggaggtttgaccctgcacaaatcttgacatatccactgaagcctgctagaaaattgatgaaactatcttagactaacatgcatatgtattttattatgtactgtattttgtatatttcaaaatatcttccttacattagaggcttcttggaatgaagaaaagttctccgttgattcaaatggttgaccagccagggctgaattgtattgacctgtaaacaattggaatagatgaccaaaaatccccaaaaaagtaattatcgctagtgattgaaattctcagaacaagatattaccacaagttgggatctgctgtttaggaataaagtcagtcaacatagaagttcccccacaatggaacctatgaagcggtacaggatagttgttgaccatcttatggtcatactgaataccacttatattcgcataagccaattgcttcattgtttcaactgcactctgtgaacaaaaaacaccaaattattaggaaaatagtgaaaaatctcctgttgaaggaagtgaggaaacagtacctgctctatttcgtcg

SEQ ID NO: 82649 - DNA, 820 bp, Oryza sativa
taattattagcgtatgattaagaaaattagtcattcaccaatgattaattattattaattatttaaaattaaaaaataaattaatatagttttctaaaggaacttctctaaagaaaattttttttaaaagaaacatatcgtttagcagttcgagaaacatgtgcgcggaaaacaaggaagttttcttccctttctcggaacgaacacagtctgtgttcggcataagctggtcgagaggaaaggtaccccagtttttgcatacttcccgaatggtttaattgtgtgtttttaaaaaaaattatatatgaaagtttctttaaaaatcatattactctattttttaaatttaaaataattaatactcaattaatcgtatgctaatggttcaccttattttgtgtatcttctcaatcagcttctctcaaacatttgcttaagaaagtggggaatgacaactcgcagttgcctcaaatatgacaccgctctagtacatcaatgaactctcgaagttatatataaataacattttcaatatacgatgagttgtatgtgaatggattagaaaactggggtggttcaaagtgacacaaaagataaaagatatgtttacctagtccaaagtgaaaaatgttaggtaaaggatggttcaaacggaaaaattttctgtttataaatataaatgtgtgtgtttttatttggtgcagagtctaaaacgttgtacttcaatcgttaaaataaaagataaatgagtcgtaccgtgaagccattgctgtaaccctacgccaactagtcaaccctagtggtctttagggggaaaaaa

SEQ ID NO: 82650 - DNA, 645 bp, Oryza sativa
atctgcgtaagggtgaggaaccaattttaagtctgttttcacgcaccggatttttcggaatatttccaaaacaaaacaaatccgaattttctcggatttttcagaatatttccaaaataaaacaaatccgaatttcacacagcaaaacataactgcaaaagcaggctgcatctattcgatgcgtacgtcgcgcgccgcctgcccggcccggcaagcgagcaagcgcgtgtgttccccctcttctctccatctcacatacttcaagtggctaggagggcatcctccctaaggagatccctctctcctagaataagtaaggtggtactaaactcgctatgcatgccatcgcatgtggtggacttttctgatttttcaaagaattaaacttcgagtgggctaaggcccatctattaattccaacaatatgttccttacaacctacataatgtttgagcttgggactggtattgaaaactttggcttgagccaatatggatattgatttgtatttatataaaaaatgacatttatctcattagattttgttctcactttttgccaatattaataaaattttcattcataccctggtgttctcaccccgaagcaaagtctccactgggtcaagggatagcgagttcgata

SEQ ID NO: 82651 - DNA, 1123 bp, Oryza sativa
tttgtaatatttatttacgctttttaattcgtagtttattttgaaatatttagttttgaattattaagagtcccatcgattgacctaataagctaaaataaaagccaaaatttatatttctggatttgattctaaagttgattttaaaagtaatttatttttagcattggcttttaagccactatgaacaaatatataaaagttttacctataaattaaattttattcttttattcctaaataaaccgttttgacttattaggtaatatgagcaaccgatgaggctctaaattatttttttaagttacttataagcaatgtgaatatgataggtaaaccttttatatatatttttaagttacttataaaccaaatgatatggctgatcagccagccgctgtcagcattccaaacgtgtctgtgttcttatcacagttttcccaactcctctctctcgttatccacgcgcacgcttttcaaactactaaatggtgtattttttagaaaaattttctatacaaaagttgttttaaaaaaatcatattgatttatttttttttaaaaaaatagctaatacttaattaatcacgactgcttcgtttttcgtaccagagagggagagttcccaaccagaaggtgcgaacacacccaaatcagtgccacgagatacacataatttttataaagataccgagaggataaaagcgtagtcacgagtataaaccaacgttttgacttgataaccatacgcacgcaatagtgcacgtatgatgatccaacgccatcaacctttttctattttttcccccctttctttccagataccgttacactacaccctggttgatgatactatattctactagttgtgtcatatgtcaccacatagctagtactattaatactgtgttggtaggctctatatttttattgtttgcaatcctggtacgctttgaagtgtattttagatattgtttttgaaagacttgaaagacattataaaaagaaataaatttggtgtcaaatcgttgagcaagagtaaacttatgagcatagaatagattatctctcaaataaaaataaaatcttgggtgtacggagtatatcgataccttccaaacta

SEQ ID NO: 82652 - DNA, 10131 bp, Oryza sativa
tactcatgtttatcaaatattatatgcttgggcaattacctttgggaaggtaattgagatgcggcatgtggagacatgagcgccatattgccatgataatgatgacatgatttgtgaaagtaggaaagaaattaaacaacttgttttagactggggcggacggtggatttgggtggtatctgggaaaggctagtaccgtccccggtcaattaaggaccgagccatgaagttaagcatgaaacgaccccgtacaaccacacttctcgtatggggatagacctagcggagtaaatagctgagcggaggcagtatccatgcatagtggtttcttgatgtgtaaggcaggggctctacggtggggcaaccattggtaggaccgcgaggcgggtgtctacagtggtgtcaccatcggtaggactgccatgtgagaatctaaaacataattataacttaatgcatgtgtgagtcttcccttcccaggtgcgccagaactcctctcactgctagaaaccgtgtacgcctagagtgcatgaggatgtaacgttcatggagcgggtactgccaatgcgaggttatcgaaaagctttaccgtgacgcgtctcatgtgttgagacaaggctcatgtgttgggcagtcgcggagtgtgggtaaagtgtacatccactgcagtgtgagtaaaccaaatctattcgaatagccgtgctcgcggttattgagcaccgggacatgtattacacttggttttatgttcaatcccttgaagtatttatggacaattatgatcggcatgacaattatgttcaatggacaattttgaacataaaacacgtgctttaatcccttgaagtatcatgccattggctcgctccacctgtccattgctcatggggtgcgccacggaggcatagcaaatcttgattccaaagtcctcacaaaagtctttaaaaactccgccagtgaattgtgtgccattatcagtgatgatccgattgggcactccaaatctatgtacaatgttgatgaagaagtctcgagcattatctgctgtgattgtgacaaccggtttagcttcaatccacttggagaacttatcaatggccacgaagagatgcgtgtaaccgccgactgcctttttaaacgggccaaccatgtcgagcccccaaaccgcaaacggccaagacagcgggatagtttgcaactcttgagctggtagatgaatttgtctagcgaaaaattggcaaccttcgcacgtgcgcacaatcttgtcggcgtcggacacagcagtaggccagaaaaaaccctgccggtaagctttgccgacaatggtgcgtgcagcggcatggtttccgcatatcccagaatgtatgtctttcagcaattgtctcccttcctctaaagatacgcagcgttgcagaactcctgaagggcttttcttgtatagctcagattcatgcataacatagagtttgctccgccttgaaatccgctcggcttcatctttattttgagggagctcttgagaagttaagaatcgtatgaagggctctcgccagtcggcttcaaccatagctatgtcatgagtgtccgcatcttgagtagtatctttatgaggtacggtcggtgtataaaggtgttcgacgaaaacatctgagggcgccgtctcgcgcttggatccaagattggcaagtctgtcggcggcttcattgttgtgtcgaagaacgtgactgagctcgagtccatcgaacttgtcttccaatttgcgcacctcttgtcgatatgccatcatattgtcgtcaatgcaggaccactctttcatgacttggttgacgaccagctgtgaatcgcctcgaacaatcagacgctttatccctagggaaattgcaatccgtagtccatgaaggagggcctcatactcggcaacgttgtgggacgccgaaaaatgtatccaaagcacatagctcaatctttctccagtcggggaaatcaaaaccactcctgctccagtgcccgaaagtctttttgacccgtcaaaatgcatggtccagtgctccatgttctccgcaggggtatcctcctggcactcggtccattcggcgacaaaatcagctagcgcttgggacttgattgaaattcggggcttgaatgatatgtccaaagacatcaactccaaagcccacttagcaatacgtccgtttgcctcgcggttgtgcagtatatcaccgagtggaaatgatgtgaccaccgttaccgagtgaccttgaaagtagtgagatagcttcctggtagtaattagaataccatataacagcttctgaacctgagggtacctcgttttggagtcggctaggacctcgctgacaaaataaatcggtcgctggactttttggacatggccttcttcctcgcgctcaacgaccaagactgtgctcacaacctgggaggtggctgatacatacagcaacaacggctcctgcgggtgtggcgaggctaagactggtggctcggtgaggagtttcttgaaatcttcgaaggcctcctgtgcttcgggtccccactggaaattatctgttttcttcagcagcttaaagaagggcatcccccgctcgccaagtcttgaaacaaatcggctgagcgccgccatgcatccagtcagcttctgaacatctttctgggtacttggcggtttcatgttgaggatggcagtaactttctccgggttggcttggatgcccctatgagacaccataaagccaagcagcttccctgacggtactccgaaggtgcacttttcagggttcaatttcatcctgaaagcacggatgctcgcaaaggtttcttctagatccgagatcaaatcatccttttgcttggtcttaacgactacatcatccacataggcttcaacgttgcggccgatctgcgttgagaagcatctttggatcatacgttgataagttgctcctgcgttttttagtccgaacggcatggtgacgtagcagtatgccccaaaaggcgtgatgaatgaagtcttcaagcagtcggattccttcagtcggatctgatgataccccgagtagcaatccaaaaaactgagaagctcacagccggcggtcgagtcgactacctggtcaatgcgaggcaacccaaaaggatctttgggacaagacttgttgaggtcggtataatcgacacacatgcgccattgccctgttttcttccgaactagaaccgggtttgccagccagtcgggatgaaggacttctttgatgaagcctgctgctaacagcttggttaattcctccttgatcgcgtccttcctgtcttgtgcgaatcggcggagtcgttgtttgatgggctttgcatcttctttgacatgtaaggagtgctcaatcacctctctaggaataccgggcatatccgatggtttccacgcaaagatatctttattattctgaagaaaggtgatgagcgcgctttcctatttacaatctaactcggcgcctattacagcagttttagtaggatcagagggatctaggggaatcttcttagtcttggcttcgctttctccactttttgaagtcttggtagcaggtatttctccttcgcttgccgtggctgcagccagtcggatatcctctcgggcagacgccatctcgcgggtttgagccatgtcgcaactctccttgtcgcatgtgacggcttgcttgatgtcactccgtagggatagcactcctcggggaccaggcatcttcatcatcatgtaagtgtagtgcgggacggccatgaacttggctaacgccgggcgtccgagtatggcatggtaagctgtctcgaaatcggcgacttcgaagctgatattctctgtgcgaaagttttcccgagtgccgaaagtgaccgggagggtgatctggccgagtggagttgcggataatcctggaatcactccgtgaaaaggcgcattgcttggttttagctcggagcgaggaatctgcatatcatccaaggtcttggcgaagaggatattgagtgcgctgccaccgtcaatgagggttctgcgaagcttgacattgcggaccactgggtctagtaccagggggtaccgccccgggtggaccactcggtcaggatgatccgagcggtcaaacttgattgcaatctctgaccatcgaagatactggggcatgtcgggctgaacagcattgatctcccgttcagtcaacttctgcttccgtttagactcataagccagggggccgccgaagatatggttgagctccttgcggtgatcttgaaaacctgccggggtgtcgccgtcgtccttcttcctcgacgtgctttgttcttcgtcggaattcttccgtgcagtcttggtgtattgatccgcgaattgcttgtagacgaagcaatctttggccacatggttggagttaggatggtgcgggcattgggagttcatgatcttgtcgaacgtgttgacgcgcgaacgctgtcgagaagagtggctggcggttgcaacaagttccgcaggcttacgcttgcggtccttatgattgttacttccacctcctcccgtagccggcgtatccttttttggcttccaactgggacccgactgctttgatgcggtgacggcgtcttcagctttggcgtactcgttggctttttcaaacatgagcttgactgtcctgggaggcttgcgcccaaacttgccgactagttcttcgtggcgaatccctttggtgaacgcggcgatgatgacgtcgtcggtgatgtcggagatcttgttacgttgttcagaaaaccgccggatgtaatctcgaagggattctccggacttctgaatgacgttgtagagatcatattgtgtgccgggacgctcgaaggtgccttggaagttggcgatgaagtggtcgcgtagttcggcccaagatccaattgtgccacggggcaatccatggagccaagatcgggcggaatccgctaaagccactggtaaatagttcgccatggccttgttgtctcctcctgctgcgcggattgcgagaccgtagacggtgagccacgattcggggttagtggtgccgtcatacttctctattccagtcggtttgaagccggctggccaatccactcgacgcaggtcgtctgtgaaggctgctactccgtcaaggtcgtcgtcgtggcggtccggcgagtgatggtagcctcgagccgctcggcgctgtatgattgtgtcgcgaagatcgatggggcggcgacgaggtggtgagcgaggccgttccactcggtgctccctatgaaggtcgggaggtgagtgaacagaccgctcgtcgtgacccctgctcctgcggttggatcctgcgccggtgatgctgaggcttggatgacggtagtcatgagatcggaagtggggaactcggctgccagtcggcgtgtggacactttcggagttaactgggaccgaggccgcaatcatggtcttcgtctggttcaagatgttgacgacgtggtcggatcgattgagctcgttttggttgaggagggtgtcgagaagggtgatcgcggcaaccgcattctgttgaggggtacggaaaaccggtgtcccttcgacgtcttgttggccgatgagatcacgcgctcggcgccctgcttccaaagctcgctgacgtcgatcctcagcctccttcgcggtccgctcacggtcctgctgctcacgccgtagccgttcttgttcttgtgcttgatgctcctcctccagtcggcgacgttcttcggtctcccgggcttggcgttgctcctccgtctcattattggccatgaaaacgccaaagtagagaggggtgtagttgtcatctaggcttccgtcgaagtcgtcgaagtcgttgaagtcgttgtagcgagaactaaattcgtcgtactccacgatgtcagtaggacgtgagtcggcggtgggagagctgttgtagtcatccagctgatccgtcgaaaccgtgccgagtggttggaggatgacgccaacttccctgaagctaggcgaaatcggtgttgaagccgacttctgcctaggcctacgggatgaagacgctgtcgtggtggagacggccgctaagtcgtcggggagcttcatcaggactggtgggtaagtcccatcatcttggtctggtgtcgttggagaagatgcgatctcggccgagtggtttgaagccgactcggttgagatggtcttgaagtagctttcagccgcgttcgggaatccaaacccgaccgaaatccggttctctcccgactggtctgattccgagtcgaggagagaaatcttgccaaagttgttggtgatgaagtcgaggctgccgaaccgaaacgtctgcccgggagggaagacgaggtcgtcgatgccggagacggaacccattgcgctgatcggcgaaaagcttgacgctacccctacctggcgcgccaactgtcgaaactagatttcggcaataataaaagggggtggctatcaagctagaaaagtgtatgggtttggagacaaaagatttatacaggttcaggccttcttataaaagaagtaataccctactcctgtccggggatgaatccgccgagtgtattattgattgtatgattttagagaaaattaacctccgcccctagaggcgcccggaccccccttatatatgggaaggagtccgggttacaaaagataatctatatccctaacggaatacaaatacagtcgtgaccgactaaatctcaaggtgtttccttgttgtacaagttaagaaacaaacccgagatacaaataagatattctatacatattcggtatcctatatccagcccaaatagtatcgccgtgtagatatgggatatccataatctccacagctagtctctaaattcttaacttgtgtgggatgggttgttgcatgatgaatttttatgctgatggagccacttcctgagaagggggaaagtgagcgtcctcagaaaaccataacgattcaatggtgggaagctatccttgggatcacaatggatggtggacagaaccgtcgttgtttaaatataaacactggtactaaaatttgatcagtcaatgctaggtcttaggtttgtgaaaagaattacaaaacttgctttgcgcaaaagaaccatagccatcctttgaaataccccctttcatatgcattgttgctgtggtggcttgctgagtacggttggtactcacccttgcaaatataaacttaatcagaagcgggagataaagctccggaggatccctatgcctactaccaggaggaagatgaagacgatggcgctcagtaggtcttagtacggtcgttgcctgtggcaatggcatgccgctgcctaaattccgctgccttatctaattctgcttttggttgtattccggaccgcttggtctaatgatttaagacagtgcctgagggcttatgatgtaataattagcactagactctcgtgtatgtgcatttggtatttcagctatgaactcgtgtgtccagactacttgatccagggaaatggtacggtttacaccaatgattcctgttataaaaacgggggtccacacaacttcggtcagaccgcgttccgtcgatttcgagggtaacttttatttccgctaaaagttttcggtttttgggtataccaaccattcaccccccctctggttggcttagttccctcaaaactcaaaagtgcaagagtcttgtgaatgtatctttctcgaaaaagggtatatataagtcttgtgaatgtatctttctagaaaagagtgaatatataggaagggaaccaatttacctacaagaacaatttagtttgtagcatagattatctgtggggtaacacacaattggaatcccttaaaggttaattttatgacaaagaatttaagtatactttttttttcataatattagtgctcgctgcaacaataaattttgaatttgatactcaaaacttgttttgtggcactggcaaaacttcaggtttggatccagaatctgttttcttcacacttgcgataaaacactcataaaagttcaatcacattccaataaggtcaattggttcactagtgcctttttttttctcaattcgacctagatttatatataattctaataagtacataacatagactatatccaaaatattctttcatcttgtagggttccctcctagagaactgtgcatgctgatccacttccagttaataaattcatgtgccaaataaattaaaagccaataagaaaaaacgaatcagccacattaacaattcagatggtacaatttccacctttgttcctcaatcatatttctaatttaaatggatacaaaacaatgttataagtacgtactgaatatgtcggtgagatttgaaaccaatttattgccaccggatattttaatactaacaagataaataattaatagagatatttgtgtttttttcgtgtaactcaaaaggatttggcataaagtgattttaatatgtagcccgcaatcccatattttggtgtgatctaagttacactacaaatatttggtgccctcttcctgggaatattttgtggttatagttgtcataactccataggtttacatgcaaagattggttacctcacccaccataccttttgacaaaatcatatataacatcaaaaccatattacgcttgcacgagtggagctaggaatctaagatatcaaaacggaataaaccatgtgagatgattacattggtttttttttattacagtggatcaaatggaagaaaaaaaacaagcgcgcctctttagccaattcatgattttaacaagatttctcattttaaactgtacttttcttcgaccgacaagattatttgaaaatacaaatcgtattaaccgaatacaaaatatgttatcagtggcacacattgaatgaagaaaagggaagaaaatgaaggggggaagagaattgaagtaaattgatgctcctattgggaagtcatccagcctatcaaatattgcagctgatcaacttgataatgatcatagccaggttattgctaggggaggcagaaatgccccccataaaagggcaactaaaatatggaattaattcaaagcatcatttgtattctttatctcactatctggcccacacaaaaaaacacctataataactaataagccagagctgagcaagaagagaaaaaacaacacaaataattgacaataattaagattagttattttaatctgatgtgattcttgataggctaagatgccgccggcgaggtcgacgcgtgccgccaccaccaccggccgccgccggccggccagcgacggttgcgtctccgatcagctcagcactgcagcagcatctgcatctatatctgaaccttatctctgaatttctcctccagctacaacagcatcagagcgaggaagaagaagacgtggagagctctcggagcgccacgtcggcggtgaccgtgctgacttgtcaccggctgattggccggcgaccggtgacctgtccggccggtagcccattgaggattcgatgcccattgaggaggaggctgtcagtgatcgtgttgtcatttttttcatttctctaatcttgtttccttttttttactttcgttcttttttctgaataaattctctgctcttcgcgtggtaaattaaactgcacgtgtagctttttttttcttttttggttcttgttttgatagaactgcacgtgtaggtgtagcttgtatttttcttttccgaatatattcatgtgtaacgttagtaagaagtggtactactagagaaatcgatattaataacggttgtgggtttatatgtgtgcatctactttctagcttagcaaagtcgacggtgcacaagcactgttgctgccaagggcaaatcctcttttgctatatgagttatataacccattagatgcaattactattacaaacaacatcatcaagtaaacaagctaatcacttctttctataaagttaaggccaaacgctcaaatctcgtgctttcacgtcatcatcaaattgtgaaccgttagatgaatgtattagattgcttctcagacgttg

SEQ ID NO: 82653 - DNA, 884 bp, Oryza sativa
cccagttcatccaagggatccgtgaatatccctgaagatgtatgctttgaggttgaagttgtaccaagaacatcaaatgggtcacttgccatgctagctggcttagacgttgacatggacacattcttatctttagttccaacagtctccctatgattcaaaaaaaaaaaggatgagggaatttatggtaacaaatctgtatatgattgacatattttagattaaaaagatccaaatcattctttaaacaaagcaatttcagaacctcgtagatattcttcttgcataactcactacatattccatcactataaagcgttatatttgaacctaaggtaatttgcaatcaaagttgtgcagcctatgaacctaccacatccggtcattaatgcatgctgaacattctctatgaactatgtgcaatttaaataaaccataataaacctagcatacactgtattatccacataacgcaatatagaggccaaagcaagtttgcctgagaaagtgcactggtatctttaggaaagtagggaatgcttataaaaagcatagcatatgttcctaggcgtttctaatagtaaaatcgaagtagagcccataaaattcacaagatgcccataagtttatccacaagatgccattgatattcaatggtcaacacagatcatacctaatggaaaatagcctataaattcaattaccaaatagatttgaagatataagccatcaatgaatttcctacctcaactggtataagttaccaattcaaacaatcgcacgtgcacattaacaagctaaaatctaagcaaatgcaacataaattagatatgggagtccataatttgtccaactcaactgaattatcacatggtttctcgttg

SEQ ID NO: 82654 - DNA, 1975 bp, Oryza sativa
  unsure (1)..(1975): unsure at all n locations
aggtccggaatacatccaaaagcagaaatagataaggcagcagaattcaggcagcggcatgccattgccacaggcaacgaccatactaagacctactggacgccttcgtcttcatctccctcntgatagtaggcatagggatcctccgaggcttcatctcccgcttctgataaattttatatttgcaaggatgagtaccaaccgtactcagcaagccaccacagcaacaatgcatatgaaagggggagttcaaaggatggccatagttcttttgcgcaaagcaagttttgtaattcttttcacaagcctaagacctagcattgactgatcaaattttagtaccagagtttgtatttaaacaacgacggttctgtccaccatccattgtgatcccaaggatagcttcccgccattgattcgtcatggttttctgaggacgtccaccttcccgcctctcaggaagtggctccaacagcataaaattcatcatgcaatatcccatcccacacaagttaagaatttagagtctagccaagtgtaatacatgtcccggtgctcaataaccgtgagcacggctattcgaatagatttggtttactcacactgcagtggatgtacactttacccgtactccgcaacttgcccaacacatgagcctacgtcccaacgaatgagacttgccacggcaaagcctttcaataacctcactttggcagtatccgctccatgaacttaggccctcatgcactctaggcgtacacagtttctagcagtgagaggagttttggcgctcccaagggggaaaactcacgcaagcctaacatcgcattctgtagttgaacccaatccacgctgtccccttttgggtatctccttgtagtcttgtagtcttgccaagtcagtctctagccatccgtatcgggtatccgccatttggccatccgtatcgggtatccgccagcagactgcttgttcgtccacacacctaagtgaaaccactatgcagggatactgcctccgctcggctatctactccgctaggtctatacccattcgagaagtacggctgtactgaggtcgtttcatgtttaacttcatggctcagtccttaactgaccagggacggcactagcctttaccggacaccacccaagtcctccagccgccccagtcgaaaacatttgtttaattttatttctcctttcacaaatcatgtcatcaacatcatggcaatgtggtgctcatgtctccacatgccgcatctcaattaccttcccaaaggtaattgcccaagcatatagcatttgataaatatgagtatgcatgattctagaatagcatttctaagcaattgtcataattgactagggactcatacgtagacatggttacaaagatttaagggtaaacaataatcaaggcatggcataatcccaagtaggatattcatcattgcatgcaattttatttataaacaaaataatttcgcaattggggatcaacatgttcaaggaatagggatgacttgccttgctcgaggtcttgcgggtcttggccttcacctggatccgcggctccctcggtctctatagttacgtgcgaaaattgatttgaattcggttagaattcaaataaaaatccaagtaaatccaaatggaagtcaaatgcgaaagtcaattcctttttattaattttactatccgcgaactatggcaaaccccaattttggtttaaattattttgcggttacaatattttgttgtcgtatgttttaatttaatctaccctagcattatatccatatattaggttagaaatttcttatcgcgagctaaatgtcggacggaatcctaaaattatcttataatattatacgactcaatttagtctatgattaaatataatacacggctaacaccctagtaattaaatccgaatcgctaccgttgatcgattatttatagagatttcccag

SEQ ID NO: 82655 - DNA, 527 bp, Oryza sativa
agatttagaaattatagaatcaaatttatatgggaaacaaactaaaatcgggataaataggaaaatacactgttcattatggcgtaggtgttcgatgcggtccctagccttccccctcctctcccacctctgcccctagccgcgcgccgagccccgcgccgcgccgcgccgtcccgtcgccgcgtcaccgtcccatcgccgctgctgcgccgtcgccatcgtcgctgccgcgccgcgcgccgtcgcgtcgcctcgagccccgccccgcgccgcgccgctgccgcctgccgggccgcgcgccgcgcgccgtcgcctcgccgcgcgcccgtcccatctcccctgctgcgcgcgcctcgcgccccgagccaccgcgcgccgtcacttcgccgctgccgcgccgcgccacgccgccatcccgtcgccccgcgcgcccacgcgccccgtcaccgcccgtcgcgtcgcccgcccatcgcttcgccgccccgagccgagcgccgtcgtgtcgcccgtcccgtcgccgcgcgccc

SEQ ID NO: 82656 - DNA, 17886 bp, Oryza sativa
  unsure (1)..(17886): unsure at all n locations
attatgaactgctaattatagctttggtatgcatgattaagtgattaacagttagcagtctcctgtctttaagctatggttagaatccacttattgttgcaaatctacaatgagctgtctgatttgaatgtggggcccacagccagtctcctcctctcctatataaaggcacacactctcctctaacccctctcacaaatttctcttcaaatttcaaagcacacaaatttttctttctcttgcagtattattattactaccatggcatccaggatcttgtacgcagccgccgtcgtcgcggccgtcgccgtgtcgtccctcgccggcgtcgcctacgccgccgacgccccggcgccgagcccgacctccggcgcggccgccgtctcgtcgtcgctcgtcgccgccgtcctctgccccgccgtcgcgctcctcctcggcaacctccgccaatgagcttgaagatcatagttgaatcgaatgctgctgtcaaacatgcgtaatgtgctacgcatcgcgtgatatcttcttcttcttgttcttcttctgtttgagattgctcgttttctgacctgtgtggcatgtatttttatcgattcagttaagccaattcttccaccagcattcatccattttaatccagaatttattggtttcagcactaagagcttgactgatcatttgttttgatggtgatacatgttgcttttggagtgatgtttctttcatgagaaaatttttggcgtacccagagatgtaaaaaataaaataaaataatattttaagttaccaaaattttcactagagaatgttatacctactgataaaaaacgtaaaatcactttctttcatagttaatcagtagtggcgtattatttcaaagaaaaaaaagagagaaaaaactgtagtgtcgtagtctgctttgctctttctgtttggacaaagcacatatcacttccttttctttctttttttttggtattttctcatacaatttacatcccattcctagagagaaaaggtgaagctttagttgggatagaaaggggttaacaaatgggataaagcgtaaaagcagatcagtaaagcagccatctcatggctgtaaagcagcaggcgtacacgtacatgttggaattcctttcgaattgtttaacatatatgctggcaaaaggaaatgtatataccatagttgcagatttgcaagtgacatgcgttgcaattctgacatgaatcggatgtcggatttttcatcggatctccagtttcctacgttgcaaatgtacaggatttagcagttcagaagtactccagtacattttagggcctgtttagatttcctggtaaaatttgtcaccctatcacatcaaatgtttggacacatgcatagagtattaaatataaacgaaaaaaataattaattatacagattgcatgtaaattgcgaaacgaatcttttaagcctaattgctccatgattcgacaatgtgatgctacagtaaacatttgctaataatggattaattaggcttaataaattcgtctcgcagtttataggcgaaatctctaatttgttttgttattagtctatatttatatccgatgtgatacgccaaaactttacacccatagataaacacccccttactgtgaaagcgagcgatgaaattgcaatgacacgaatgcgacatgaagaattagctcgacgtagagctgtcagtcggtttcagaccacaatggaatacaatggccattcaaatcgaaacgttcgacagttttgtctgctctgaattacaacagaagatttacgcctggcattatctcactctctgaatttacagcaccaggtgataaaaatattgaagactatcagattcgtgttaactgctattgtcatgcacagggcaagctacacatcgatcaaactggactggcctgagcagtgtgcttcacattttaggtagcaagacgtatacatgagaaacttggaaaacattcagagccgcgttgctggtaggcagacagcagacagtgttcagagcaaacatatttcctgcagcctctgtgttcttctgtgcagcttccaaattacgacagtccagtcatcttgatctcctcaaattaagcgcgagaagcggcgagcccgtgattgttccatcagaaagctgaaaaatcttcagctaaatgggtatgcgcaattatctcctttctaatgttcagctgcttcgtgttcagtgatcctattattcagagtcgctgtccatgttgtgcattgctttcaaccccctggggcgctgtgaaaccagaaaacaatcaaggaggctcatttaatcgaggatgtcatctagggagttgcaagactgaaattgattttagcatgttactaatccaatccaactcacctttttagaaaccttcttctctcggacttcgtatctttccagtgtcaagtcgcaaagccatgttccagggcatacaagctgccaaagatgaacagaacttagggaagaataatatggtgacggggttatatgcaacctcaagagaatcatatcgacaaaacaatagatatcaatggttgtctgactcataacttaagcctgcgtaggacacaactaactaatcattgatctgccatatattagaaatggaactcaactgaaacagcacagcacttcctggcaaattgcctgccagatcagctcattgatacagaaactgtaatgtagtcacaagatgaaaagtatggcaattcgtttggctgcttcaatgaaggaaggtaaggatcacactcaatggtagggaccgtacagatcaagcattgaggtggcaatcaaatggaaatcacaatcagcttttaatctgtcttatgtttgcttcagacagaagcataccgaattatggacacctctaggcaaacaaatttaataaatgaagcatccactgcatatcagtattatatttgcacgtcttgtttggttaaggagcaaggcaagcagcgtgcgcagaggtggccctatgttccatgtgatctcatgtcatctatttaaaatttttaaaaaaatgcatagccagtatgtcatggcaaattcttgtgttactgaactatagcacagtaagttaggagctgacaactacaggctaatagcatgttgcaataatgagtttagaatctctgtgcaacaagcaaggaacatatacacaattatttaccatatcatatgcaccaagggcctgtttagttcacgaaaaggaaactttntggtgtcacattggacgtttgaccgaatgttagaagaggtttttagacacgaataaaaaagctaatttcataactcgcatggaaaccgcgagacgaatcttttgagcctaattaatctgtcattagtacatgtgagttactgtagcacttatggctaatcatggactaattaggctcaaaagattcatctcacgatttcccctataactgtgcaattagtttttttaaaaatcaatatattaatgctccatgcatgtatccaaatattcgatgtgatgttttgggaactaaacatgccccaagataagaatcctatgcgcattgatgtgaactggaatgcattgaatttaatgagatataaagctaagatgaaaggtgcatacattcactgtcctctggatgactttggctctcttcttgggcctctgaggaagcttggatcctttgaacacccagaagtcctcttctttctctttgttcgtcagggcgactgcaaatttgggccagatcgacccctcgctccctgacgacgaacccttcttgtcatctggggaggtcggcggacctccattgttgttgatgatgttgctgccccttgcagggcgttctctttcaggtgaggcgactgcccggatcccgttcatctgatgctgctgcgctgaagatctcattgctccagactcctctgaattcctaccaatccagaacaccggctattataagtgatgcagaaaaaatggcaacgtgctaatgttatcttttgattttggtttggttgtggttgcaagcaaccaatgttagattctgaagcttgtctggccgaaaaggagaacatagagccaaaaatgattattttttttagaggaaaaacttggctggagctctgcctattcatccgaggagtagtagaattagacaaaccgaacactttgacaaaattgtgcatttaattctcttcataaaaaggttgtgtacatctaacctccattaagcacagtaactgtatgtttaatcttcagtaggcagtcctgtgtttttcttattagtcaagcaaaataaggtgacagataatctattgctagaaacaaaatgaacattcaacaacagtgactgatttcgcggtgaaaactggataaatagatttttatctctaaatcttcttacagcaaatcattcttagattctcacatagggagaaatggagcaccaaaaatgcatgattcatcacattttgggggaagggacaagtaagcaggcaataaatttcagcaattacctatgtcatgtttcatcatctccagataagaaacaaagtattacaggaagaaagagaacgtcacaatgaatgaacaagttgtcaccatccaccttacgagtggttgtgactgacttgagataaatatggtgttcccccctcaagccaaaattagtcgacagaaaattagctgagactagcatccaaaggcagaccgaatgtaattatgataagctattagcgtcaacctcatacacagttgtttcgcaaagaacatcgttgtagcaaagccgcatacactggatgaggcaaccgaaacggaagcagccttcacaattggcagttccgtttcagaaaagaactcttaataattcacatatggccctgacctagatagagatcgacagccaaaccaagtcagctaagttggaaccttggagatagattgaccaaaaaattcagcaagtaccatcttgcttgttattgaaagaacatatccctcaaattgtccaatattttagcctttcaaagacccaatttgagcataaaaagtaacacaatcacccataaaaagtaaaaccagtatctagcacaccagaatcaaacaaagaaaattagtgtcaagaccacaaaaacatcatggtcttcatttcacatcccgtagacaaacccaacgattttggacaccataatcatctcccgttacaaaccaaaaccatcaattcattgcttataatgtgtgcctacatcaatatataaaccactatttgtgcttagtaacctctgcatcatacagtcacaacggcaatgacacccaaagtgaaaccgaatcagatcaagaacactaacgctgctcgatgtcacgtgcccggggcagccaatcacgtgacggccagttgttctttcaacgcaacagttactccaaatcttatcgcattagtttaactgacgcttaacaacaaagcagtcagagagcacacgcaacgggcacggcaacatcgcaaataccaaaaatgatttttaaacaaaaaaaaaagaaataaaaagagagagaaaatggctacctgacagcgcggtggtgggcgtggccggcggttgtgtggtggcggtggtggtgagccgccgcggcggcggccgcacggcgctggctagccgcggccttctcggcggccacggtggcggcggcgtcgacgtcgcggcggtgcaccttgacgcagcgcagccgcttccggttgccccactgcaggagcaggtcgcgctccgccgccgttccgccgccgccgccgccgccgcgggtggagccccgcgtgtggtagtgattcctcgcctccttctccattgccggaccagagctcgccctgcacgtgtcacagcaacaaaaaaaaaaagaaaagaaaaaaaaaacacagaaattcagcagcagaagggaaggaagaaagattcatggtgggaagggaaattgctagaatttcaatcagattggaatagtgaagaattgcagaggaaattgctttgaggacagatcagctattcagctcagaccaattggtctaaaaataatctcaagattttattacaaatcttccgctttaattctccgtacgaactaggagaagggcaagttcaacaaactttagctcaatttcaccctccacccaaaagtaaaaaaaaaaaaaatcttctcagctgcccgatcaaatgaccggaacaagatgagacaccactaaaatgcaactcaattttaaggggccgaggaaatcagccagataaagttgcaaacttttgggagttttgcgaccactttgctttcaaaaattcagactgaaaccttaaaaaaaattcagactgaacgaactcaaaatcgggcaagaatcagacaaattaacagatcgaatttaagatgaaggtagatattcagttcaatttaactcatctattctggaaagaaaaagcaacctagataaaggggagaaaaaacagaacgatacaattttcggtaatcctacagtagagaaccaatattgaaaattcaacacagaaatggacagtgaaaaagttagaaagaggggacaacaaatcggacaaaatttgagacgagaacaagaaaacggcgagcagacgaacaagccaatttgggagcagaaaaaacaagagtaaaatgtgctaacttggtgaggtatacaaaatcatcaacacgagagaagcaaaacacaggggatgacccaaatcattaccagcatcctacctaaggaaaatcagctccctctttccaatcgacctactacaaggaaaaccaaattaaaactgacaagatttgtgacgaaatcaagtcgatcccaatcagaacccccaaccgcgcaaatcccaagttaggcagctcagatatgaagcacacttgatgcaactaatgcgtcttggcgaaattggattcaaattacccagtctgaatcatccctcactccattcccaatcgcagacagaggcgcagacaacggcagaagaattccagcacaggaaaaagcagccgcaaaaaggaatttaatcccgggggaataaagagggaactgaatcttccagatcaaacaaccaattagcaagaaccgaagaatccagaattcgaacaaaccacaagccagaactcacaacaattcagaagggaaaatttatccatcactgtgaaagtaaaacttttccaactccaatccccaccaaaaattttaccaaacaaaacaccacagagacaaccaaaaacgcagcgaatcaaactgttaagggcagtacctgcgaacacctcgctccaattcacctgacaaagccaaagattcctcactcctctcctcctcctcctcaagaacaccgacagatcaagagaagaaccgacaaaatggattcctcaggctgcggtgagaagagtacggaacccagagagagaaaatcgggacgcctttgtggccggccgtgttcttcctgttcctcccccccaccaccagaagccagagccagaggaagaagaagaagatgaagcccattttatatgccatctcctcccctctctctctctcccccacttctcgacccgtctcgggatgagcacaccaaatccggatcctatcagcgcctcgctggcccgtcctcagccgttgatctacagatcgacggtccagatcgccccaccgcgctcctctccgcggtaaaacgtgcaattgcctcgctcccactaatgggctgggccgctacatggcccgtagaatgtgggccgtggaccatgggccgtatgacgtgggccgagtaccgtgggcctgccgtgatccaattcccggccgtttccgatgcgattcggccactcgatttcatgattccgatcggaatcggaatcgcgcctctgcggaatccatatatattcgccggctcgccgccgctctctccaccgaccaccatggctaggatgaagaagaagggcgcgctctctcgcctccggacggcgacgtcgcgcgcggccaccgtggctaggcggaagggtgtcgtcgtcgtcggtcgcgccggggactgcggcggcggcggcgaggaccgcatcagcgacctcccggacgacctgctgcgcctcgtcctgcgccggctcgacacccgcacggcgctcgccacgggggcgctctccaggcgctgggcctccctctgtcgcggtctcgacgccctcgacttcctcgtcagcgacgtgctcccgccgcgctaccaccggtgccgcgaccacctcctcctccaccacccccacgccactaaaggcatcgacgccgacgatgccaaggttgtcgccggcaggtacgagcgcctctccatgcggaaaatggtggcctccatcgacagcttcctcgacgcggcgccggacgacgacgaccccgatcgacggaggaggatcactaggctgaggctggagttcatcatcaatcaccactccgacagcatcaaccgcttgatcgccacggccattgatgcttggggggtcaaggatctcgagattcttgctgggacgcccgcgcatcagctacggccgctggaccgcctccacatcttccctcaccaaggtatctgctctgatccccgcagctccactctgacaagcctgacgctggctaactgcacgatcccgccattgcaagggttccaagctctgaggatcctcgtcttgcagcatctgccaagctccacgcgtccagcagactacgaatcggtgttcacttcttgcacacagctgcgagtgctgcacctcaaatcctgcatgttcgatggcgttctacgggtaaacgctccgtgttcatcgatcgagcagcttgtgttcgaccactgcggcggtggcctgatcattctctacgctcttccaaagctcgaggagatggccgtggtgcagacctgcgtatggttccagcgtggctccatgccatgcctcaaacgcctgaacctcatctttcgatacaagcatgatcatcactccacctccatgccttggggcatgaacctgatgcagattgctgagtacaccccagaaataacagagctgttcctggagttcaccggacgcggggcggcgacgatggatgcgccgccatcatcgccattgccgtcgctgccaaacctccgaaagctcgtggtcgtcgtgccatcgtcgtgggacgtctcatggccgcgcctcctcttggaggtggcgccatgccttgagatcctccacgtccatgtcgccgcctgcgaggacgagccccgcggcgagatctcgtggcggcgatgcgagtcgcgacacaggaagctgaaggagttggggatgagtggcttcgaggggacgggaaggcaggtttactttgttaactttgtgatggaggtatcattagctctgaagtctgtgagtctgtgcaaatatgcaggtgtttactgggactacgacattgttcgtgaagatcgtcgttggagcagtgacgacagagctgatgtactgaagcagatcggtgagagagtttcttgcacagatattccggttcagttagtccgggagtgatttctcatgttgactagctagtaagtttaatagtgtagtcaactaatagctctaaatcatctattgctaatctaatagtctattcatataataattgtctgtaaatatatatattatattattaatatctggtcatatctctcatacacattaaaaaaacatctctcacatacacacaacgtattaaatttgtagtccgtttttattctctctcctatgttatctcctccacatatatgtttatagttagcttatagtatgctattatacttgtgctaacaagattgaattatgtttcttattaagttcttaggtataactttttataggctttgcacccatcaatgttaattttattatatgtgaaatagatttgtaagtttcaaacaattaatgtaagatgtaagttttggtacttgcattactgaaattaatagtgaagagatgtatgcgattaggacccgtattgaaccctaagttgcatacatgtggtgaattaattccttagccttgcaaaataatagatacatatgttcttgtttagtcttccgaattttccttcccaatatgcatggttaacaaaatgacacttctcaatcactgtatgaaatgccagtaaccacaacttcgcaatgtacattttttttccaacattgtttatcagaaccaaataattatttgacactcaagcggtaacaaaaaaatagaataaataacaatacagttctcgtgagttctcacatcacatgtaagaaatgcagtaccatgtgacacaaactcttttctccatttctcttgttattttcaggagtccggttatctttccgagttagtccactgtgccctcccttttccctgtaaccccccaaagatcatagttgtaaaatcttttttttccttgctaatatatcgatgcgtaagatttttgcgcattcacagaagaaatgcagtatcatggattataagaagatgtgcagtctgccaggcaattcagtaatagacagttaaagcaaccaaaaaaataaatagacgggaaatggtcattatgtgattaaaaaccatcggaacaaccagaattgaacaggaaggcatagtgattccactcaggtttgtacatagtagttttttttttcgaacacgtaaaaactttgcatgtcatttgtattagaagctataaaaaaatcaatttacaaccaagcactgggggtgggaaagggagagaatacatacgccagctagcgactaagtaaagacgcggcccctgaaaaaagagggaaaacaaaggaggttgaggaaaagatcagaggggtggatctactcgcaaaagaccttagaatcttgtcagttcaagagctttcatgattgatgccatccacatcccgtggaaatttgtctcatactctcaccaggtaagaacatatttctgcaagcatctaaatatatgtaggaatccatcctctcagtagaatattattaaaaatatataagaacagaggaaggtattactttatcagttcattgaacaaattgtttcacatagcatggtttatgctattgcagcgggactctccatcttacctttgaaagaattgcttcagcagaagtttggacagaggatggcaaccaaaacaaaacaataatgctactaaaaccatggactcatttcagtcgcaacatttcaatttattaaaggcaaaactatatccacatcatgcatgtaatatacagtcgcttttcgacatctttcacatgtaactaacaaagtatagatgagaaggctttcccaaaactacttgaattagagtaattgagcactaaattctatcagaaatctggtattgctgcatcagtagtcatctcccaggctctatgaaccatgtatacatgctcactttttaacaaagcaacaagctacagtaccatcgatacttctactacaaaattaacaaactaaaacagtctttctgttccctcagatcctactatcatcaactctattagctgagcatgccaacttcaagggggcaatatggattcaagagactctctaggcatccatggtaaaaagacacagcagcggtcaaaagcctcctgaggttactaggtctgataacttaagctttggatacaaaacatgagagatcactcaagaaatacttgaactggagttgctgagcaagaaattttatcagcaagctgatccagtatttttgctctctcctcatcacaccaacggtgttgttgcctcacaatgttccagtcccagtaacctatttcctgaacacggccatactcaaggaaacaagctccagtaccattgacacttcaatgacaaagttaacaaagtaaatctgtctctctgttccttcaaaaccaatgatcaccaactcctttagccgtttgtgctgcaacttggatggctgccacaaaatatcattgcaagtctctccttcccaaggggtaatatggatatgaaggctctccagacatggcgctgcttctaggaggagtcggggccaagagatatcccatgatgaaggcacatcggcaatcagaagcctggtaagctttggtaacagcaacgaagggcacgaaggccgaaaccatctttcatatccggtgaatcgtataacctggtcagttatgtctggagtgaatccaagatgcggcttgagatccaagttcgcaggcaagcaaaagttaagtttatgcctgagaccatcgcgtttgaggttcaggcgcacgaggcgcgggaaggatccaagcttgtaccgtacccaggtctgcatgacaactatactctcaagcattggcagagcgtgcagctcaaacccagggacgccacaacactccagaacaagctgcctgatcattgacctgggggcatcaacgaaaacactactgccgcgcttgcaggggcaggacttgaggtgcacctcttgcaactgtaggcatgagctgaacacactgcttcgtaggctgccgcgggtgtggagtcccgcaagtcttgcaggaccagcttggtgagagcttggaacccctgcaatgggggaatcacacagtccaccagcttcaggcttcgcaaacgggatctgtgcgggtcattgcagagaccatggcgacggaagatgtgggcatcctgaaaatgatgccgccaatacgttgtcctaccaagaacctctagatcctcaactccccaagtatcaacagccttggcgaccaagcggttgatgcagtcgtggtagtgtgtggcgatgaactccacccgcagcctactgatcctcctccgtggagctccgccgccgccgtcgccatgggcaaaaccatcatcggcgtcgaggaagttgttgatggaggcgaccatgtttcgcatggcgaggcgctcgtgccgcctgatgctagcaacgatggttctgagctcgtcggcgccatcgaacacaccactggcggactcgtggagctggatgcaccggtggtagcgcggcgggaggatgtcgccgaccatgaaatcgagagcctcgaggcccgcgcgcgcgaggccggaccagcgcctggagagcgccgcggtggcgagcgcggagcgggtgtcgagcctccgcaggatgatcagcagcagatcgtccgtcaggtcgtcgatgcggttgtcgccgcaagccgcgggcgcccgccggcggcggcggcggcggcggcgataggacgaacctttcctcctcctagccatggcggagtcgcgcggcggcgtggggtttggcgcgcgcatctgatgccctgagatcgcaatggcgtccccgcggccgcgactagatagcatccgccgcgggccgcagctggaatccgaaccggaatcgcaccgaggccgcagctgctcatactattcggactcgattcgacgggtggctttggggatcgggggggaggggcgatgaggcggtgacgccgccggaatccagtggagccatgggaggaggaagataggaagcgaggccgccgaggctctggcgccggtggtttggcggatccagcggccggctccggcgccggtggcgagcggcgacggcgaggcggtagggaagaaggattaggcctaaaaaaataaataatagaaaatgtggaaggcccatgggtgaaacctggcaagatttcattgatgggcctaatagtgcgatatccagcccatctcacagtagatgggcctgatattgtgggctacccccaactcctccccctctccaagagcgagaagcccaagctctgtcatctatctgtaagatacaaataattagagcactgtgatttcatcttggttttccagtaacttctaactgagtttaaagaatcacagttaaaagcattgtttgtaagggattttgatagaatgaaccaatgggaaatttgcttagaacaagctcgttgttttttaatcactagtgtagtaggctgctagtgtgggcatacaaaatgttttatgcttccttcaaggagtatacgagtagcttgattcttatcagaaaattcgagtcacatgtgtaggggcgataatcggtcaagatatatggtttctttcacaaccctacctacctagtacttatataattttagtttaaattgctactttactttatctccatatatagacattcttccttaagatgtttttattctttatagagtatttcatgtcttaaaaataacaacttctagaatttaaatttcattctaaattttattaataaactgcatgtactaactatgggtatgttcggctgctctttgttgccacatgctgcacgtataaaatatcgtcgtataagctgcaacacagtgtaaataagggcagtcgaacaaaccctatagctttattatcatcctaaccaattccgggtctgctcccacccacacacccaccctgagagcaggtacaacagtgggctaatagcctgcttacataggatgatttttgtatatgtggctgagaaagaaaaattgtagagagaaaagcgagcgactatttagtcgccggctcttcgcgcgagcctatgcattttacctaccatgggcccacctgctctcacaacaaccaatggaaaaatgaatatggacgtgaaatactggctggttccttcggagtagacactagcttgattaaaaaaaataaagaagtgttgcctgttgttgtatacattgtagattagctgtctattgttggacgtggcactcggttgcagccagcagtcgccggtactattaaccttgctatgagaatgcaaacaagtccttctaacctcctccatgatatatacaagtgtcactatctaaaaattgctatatatgtttcgatacggatagtgtagattatattcttcatgaaccacgatgtgcacctagaagagcagcatatccagagtcctcataaacaggctctacatatataaagcatataaaaattggtacggatattataattaaatctactgtgacctttgcacagtgtacttgaaataaagtcttagccaacaatctaaaatagtgtattcaacagtacaaaacgtgaacagcttgctgtatatatacatcaagctagcttttgttaaaaaaaaatagcagtgtatatatatatcaggccatcagctatgtaacttagcatgtctgacaagaatatagtcgtactgatactctaagatactctgtatatttaaacgtaaccataacaaacacctacacagaacaaacagtatcaattaatatgctgtggagtttcatatatatatataaaaaaaattaacagttgtttaattttatcactctgatccaggtctgaatcagcagtgcgttttctccaacggacagaaataaataagtaaccaaaacaacgtaagccgatctgttcctgaaatttatagcaaagccgtttacaagcatcatcaaactgcccagccagccagccagccacacagctgcatctcccgtcacaagaatacatatacacacactcatgaacagctagccacgcccaaaattcagctctctgaattctgattcgatcgttccagtcaaaacagcccccttcaatttcttcgccggcctttaatttcgccatgacgccacgagtttgttacgcacagaaaaacgcggtgccggcagtgcatgatgcatgcgagtgatcaaaccatggaaacttgcatcgaactctcacctcatgtcaccacaaaaactgcaggtgaaagttcagacttcttcttcttcagagatagatagagagaagcatgaacaataatactcctcatacatttcaaagttcagacttcaaagtgcacctatacacggttgtagagatgttggtgatcggtcacacatagcgatggttggtttggtgtcgattcttttctcaagctgacgtatagaagacatcagttcgtggtgttgtgtttttttttcttttatgatttagcctattaggattataattttatattttttctactatagcaatatataaaacctcgtatttgtctcgtttggtgcggttggtttaaaagaaagaaaaggttcagacttcttcagagacaaagagatggaggggcatactgccattagcacacaggaatagaattgaagaatgctgctgcagcagcagctttggtcagtgcacagtggtggtgttctcaaggtagcaagctttggcagcaaacgaggtgtagtactccagaatggagagaggggacaggggtacactgccacacatgggggtcaggcccaaagggaatgtcttttggcattgggcagcccaaagcgtggtggtaccgatacaccaacaccaacatatgcattccgtttctcatcttgttattcccctagctaagctcaattagctaacccacacacacaaaaaaaagcgagctaaaggcgtgcaaatgcaagatgctacagtgccctgcagccggcaaaagatcaaagatttcgattccaattccaatggcacattggcacatttcaagcccagatgcatggtcgacagcaacaacacccaggaagagatgatcatgtcaaaagggacacaaagcatggatatgtacatgtcccaattgtgtctgatcaattcctgtccaattttctcacatcatatgtggcgtgattccaattcagagatgtgtaggggtggtagctatagtaatcaatcatcagaactatcatgattccaattttactttgtgttttctttgcttgcttgcgttgcatgcatgcattgcaaaaaaaggctgttaaattttagcaacaaaaggagcaggtctttctgatggttttttgcatcgtccaacatggaaaaagttcggcgatgtcaggcagacagaaagtgcatacacctttttctctctctcatttttacccttggaattgaagtacttgggcaaaaaagagatcactgattaatttactcatgtcaatgtcatgtactatacgttattactgcatcgatccatgcaaaacaaaatagcgtttagtacataattaattaaatattagctaacattaattagaaaaatatattaatatgattttttaaagtaactttcatatataatttttttttaaaaaaacacaccatttaataatttaaaaagcgtgcgtgtaaaatacgagggagatgagtcggaaaagtaaaataagaactcagccctagttacacactgttaatcatataaaatcctctcaatcgatcaaaaggtaaaaatgaagcattaatttttatcagcttgaacagcaagagatttgtctcatgcatgtataaaatatatatatgtcactcacacgaatacacaccttgcatgcatgcatgaatcatgcatggtacacagtactacaattgcaaattcctattggatttcacaaagccagcaagtccatctcgcccaaatgcaagtacagtgctattgctagaaccagtagcagcagtagcagtagcatttcttgatccagtgtagtagccatggtgcaacaggttgccgttgccattgccattccctagggtttccagcgcctcgagctgcgacttgaggaacttgaggtagctggcggcctcgtcgagcatggtggccgtgtccatcttgctgccgccggggaccagccgctgcagcacgcgcaggcgctcgctcacccgctcccgccgcagccgcgccgccaccgtctgcgggtcgctggagatgcgcacgttcttgcgccgcggccgctggggcggcggcggcgccgccgatgacgggtcggaggcggaggcggcgccgccgagggtgaccgggcgcatcgccgccgcgcggtagatcatctccttcacctgcg

SEQ ID NO: 82657 - DNA, 694 bp, Oryza sativa
aattcctgcagcccagtcttggatgcctttttgagggaggagaaccaatctttatcaccggtcatgtgccgcgaacaaccggaatccacgatccacacgttctccttccttgccatcaaagcctacacacaagcagatgtcgaagcctcagtactggggttagatgataataaaaatttaggaatccagtactgagacacacgaccagaagatccaataggcatatatccacgagcaaaatcaattttagaattttcagaaaaattcctccgaggccgatctgaccgaggtacagtggccggtctgaccgggggccggtctgaccgcctctgtaccgccggtctgaccgaggctgttcagccagtctgaccggtcgccggtctgaccgcgggacccactgcggtctgaccggtttcctcgagggaaaaccagatttttgccactttgattttgcaaaagcaatctctatctcctttttctgtttatgagctaatctgaaacaaaaatcaacaatatgtccatctttgccaaaaaagaacaagtatatttctcacgttgtttagacactttgttagaactagaagttttagcaatacaagcagaaacaagaggttttgcatgcacaacattggattgtaggatcgtaaagggcctttcccaccccaaaagctagtcattgaggtgaggggctccc

SEQ ID NO: 82658 - DNA, 588 bp, Oryza sativa
gcatcgccgtcctcctctctcgcttttttcccatttcgccgatctctcccgagctccccatcgcctccgcgccgtgcaaccacccgccgccgccgcttttgctactccgaccgccgctagccgccgctaggctcgtcgccgtctcgcgccgtcgccgccgttagcttcgcggggtcgagatctacctcggccgccccttccccgtcgaggttcgccgccggagacccatccccgtcgtgtgccggcaagtggcgccatggccgccgccttcggccggcgctctcgccctcccacgctctttcctctctctctaatccctctccttttgttcgttaggaggttccggagctcgtcccgccgtcgtcgtcgtcctccgtcggccgccgtcgtcgaccgttgtcggtgaggcttccccctcccctttctccttttccccgtaccgtgtagccgcgtgcgcgccgcttatccgcgtagccgccgctcctcctctagccgccggtccccgccgccggtcggtcgccttcgggcgccgccttgcgccgctgccgcatgcgcgccgccgccgtgtgggcgccgcgccgccggcgc

SEQ ID NO: 82659 - DNA, 2138 bp, Oryza sativa
  unsure (1)..(2138): unsure at all n locations
agtgctaaaggtacgatcttttacataaaaagttcatgcgatatanaaagtttatattatgcaattatttgtatttaaaacatattacttttataaatattgttggtcaaagtagtatatcgaaactacgttgaagtctaaaaatacttatattttgggatggagggagtagtgccaacctaaaaaattataccgatcgatctaagaagggctgtcagagattcatccatatcaccaagagtaaacgttttattctcagtaaaatttttacttattgttgaatttgggagtaaaatttttaccattgatgacatggataaatatcaagcattcattttttttaatctaacgatagtttccactacatatgtgatttctactaaataatttttccgactataggagcctccactgaaccctcttgaaaccatacatccatggcaaaaggggctagagctttatctagtttgtccagtctcccatgatatttctttttgtattcgccaacgcaaccacttagggcgataaatataagtgtgtccatgtacaagagggcagagaattatagaatgtacaaattacaaaaatcaagttaatgttttcagccaacaatcagagctctcaaatctactcccttaatatttgtccatctccatttcacacaaaaaaaaatctggcctgttaaaatgactactcaaattgtggtatcaattcatgaaatggtcctgaaaaaatgttcctaaagaagtgaattcgtcatgaaaaagttcctttcttgcttggattcaaaggttgccaaattccctgttgcattcaactcatgaagaacattatcgatcatcaacttggagaaagatactaataatgtttgggtacgtgcatcacatcctcatagattttccgtatttttccgctacatattcctagtttgaacttatatatttgcggctatggttttaacatgaatggtgtcattttctccatagctgttggatttagattcgaactaatctcatcttcatgcattgggaactagtgtttgtgcctaaattgtgaagaaagtgagacagttctgaccctctctaggaattcaacgaaggaacattatatatcttgtgatctcccttttggtttaggttaggaccaccatgaatggatgcaagggagttgtgcatagctaatgaggctggaataacaagttagctagagtttgatcctggcacacaaatcaagtgttgcttctctccaagcaacaataagcagacatattcctttttcttcctccatagggttccatgattgtaattgtaccctacctcatctgtgagagtgataccaaaatctctctctcttccttgttttgtctacccattaatctcctgatcttgaagcttttaagggtttttttttaactcaggtaatagatattaggtttttccaccacggaccgttatgcattgcttgcaatgagggaatccacatatttctgcagcacttgaatggtttcaattaaattcttacaaaattgcatccaaattagcaaggttcaaacaatttggagatactctctccgtatttagatatatgatattgttggtttgtattacgtggaacttttgaaactttaataagtaataatcattcatagctctcaaaaatatttagtttgaaaacataaaaatcatatgggtacatttttcaatactataatattattttttttgtgagataatatcattatattctaacagtaaatagtggtcaaagttgcacacaagaccaaataaaattaacagtatcgtatatttaaataaagagaagtgcgtacagtgtctgtatatttaaatacggaggtagtacataccaattgatagattgttctccatctacttgagctacatagacagggacaagcaaagatagtactgtttgtgtttggtttaaaactctggtggtactgtttgtacatgtgttctctttcattcttgcctttagattctctgtgatgctactttaatttgataattcgtacgtttcatattataagactttctaccattgcccatattcatatatatggtaatgaatttagacatatatgcgtacctagatttattaacatacagggctgcaggaat

SEQ ID NO: 82660 - DNA, 1985 bp, Oryza sativa
atttgagttattcttcagtaacatcacataccaccagtaaatgtgtaataatgcaatcaagagaagtgctattgacaatgaggatgttactttaagttttactattagattgttactgtgtacagtgatgatgcaatcaagagaaatatccaaacttacaaaaataatgactaaatgtcaaacatgccaaaagataagtatggaagtaaaaagaaccaaaccaatgcatgcgtttgtcagtgagaggatcattgaatgcacggaaaagactgagtggtgaagggcctcgaagacgaagatgtggaatatcatagagtgcatcagtctgcacagaatggtcactactaagccttggaaaatcatcaacagtaaatgggcggtgcatccctatacaaaaaaatcataggaaaatcaatcaactgaaacaatttccatggctctgtagtttgatctaccaccatctatcatatgtatgcaagctaaaattagacgcttgacagaaaacatagcgatggaagttgattaagtcaaaaagtctgtaattatgtatactgaatatagaataaaaggttgcattttttttcctttttgcattttatattattgccaaagttcattacaagtaggattaggtaggaactaattcaagcaagatattcttagtgatgttccttccaatgtcacccaatcaaagagcaagaactgaatcctaaatcctaatccaagttgtcaatcacaagctaaaagtattaaggaaactgatgagcaccttttttttttcaattgtatttcagtctgaatcaaagaggggaatgggaacttataaaaagcaaggaggcactagattaactgaatggtggactgccactgcactgcattgaacattatattgcggcatgtagcattgaatcgctaacattctcaaagtgtgtaactgtaactctgtagagaaaaggaacacactctgcactgcactgcaacttgattgccgccttgatagttcgatacaagtacatattagtaactgcaagttgttattgccaggttttttctcagccatgtacctaatgaagtaaatgatcctcttctgtttctgcaacttgtacagtatggaatgaggcaatatgtggaacaacatttcagttattcagcagtagcagacttgcattatgctatcccccctcccctctctttagcatggtttatcaatttatcataagacaatcaaattcctgaaattactttaaaccagaaatatatgttgcctatcatcaagaagagcaagaactctgtggctagcgcactaactaaataggaaggggaacatttaaaaccgagaattgaacaaggtaatttcagataagcgatttagaactcatcatgtaccttcttggtcctcttcgtcttcctcttcctcttcctcctcctcgtcgctgacagcccagctgtcgtcggagtcctccccatcgtcgctcggcgtcggaggagtcgagggggaaggcggcctcttcttcccgcggccggggtcaggggtcgccgccgacgactcgtctccgcctccgtcgacctccatttctcctcaactccgccgcggccactgccgccgccgctctcacccacaaaccctagcgagaggagaaatcgaggaagcaaagcaaagggcggcaataaaccacgcgcgggccgcagtggggaccacatcgctgccgtgtggggcccgcggcatggcgttttgtgtcactgacgggtgggtccactgatttttggagggggaaaggggatccacgtgtcgactttgcagggcactaacgctaatcctactgtacataagcttttgtatagcttcctactccaggtgggagagaatttagatgaattttcgtgcaaattgaacaaactgcagagttatttgtgcgagtgagcaaaatgtccgggaacttccgatgcaatgcgtcacaaaaattacatacatgcgcctccttgag

SEQ ID NO: 82661 - DNA, 2012 bp, Oryza sativa
aaacttctcacgagcctaacgaggtgtgcaactttttccttttatatatgataagtgctactccccctgggctgataatatttgtcgttttaaagaagtgtgaggtcaaactttagaatctttgattataaatcatttttaaaatatttatctttcaaatatggtgactacatatatagattagtcttaaaaagtactttaataaaatcatatatctgttaatacttttatacatattataataaaaaataatggtcaaaattgttttttggaaaccgtgcccttgtccaaaacgataagtattatcaacccggaggaagtatctcaataattctatttatatgaaaaattagtgtattgtggcatcatatattaatattaacttctcataatctttttcttcaatattgttaattaaaattattgtttttttacaaaattttatcatcaaaatatacactatcctatactcgatcgagcttctcgagccgagcctgtttaaaacctcgaaggatgactaggctcgattcaagctcggctcgagcttgtgtcgagcttaagcctaggcaggcaagattggctcgttgacagccctactccgatcctaagggtacctactccgatcctaacgtaccctagctacagccattaattgaattaaatgtttctcaacggctgcacagtcatcaaggtctccatgctgatctcgatcccatgtcgatgccagtatatatatagttctttttttattttcggggagtatatatatatatagtatgcgagtattgattatttgcgtgtatatgcacggctttgaattgaccttccaacctctcgtatgacaatccatttggatcattgtagcacttgacagtactgtgtatgctgaccataagcatgcatggaacttgttatgtactctaccttagaatttattagtaagatcaggctgatttgctcccgatgtagggaccaaaaatattatagtcacacttccaatttgatatatagtagattttttggtcttccaaaattcatcatctaactggtgtttactcgtttattagtgcaaaaataaatggcatcatagtatatcagttcgtttatatgtgcaggagtaaaatgtttgttgcatatctgctctcttatctatgtaggagtaaatgacatcgtcgcatatctaatcatcttgatcgatgaggtttaatctcagaataaatgatgttttttttgttttggtcttaatgctattttcaaatatgatgactaaattgggatggagagagtaacaaatttttattaaacttgctctgttcctataagtataatgttttgaacgtcgatacagtctatgacacatatgtttcatcattattttttaaaactatatatatgtatttattaaaaagatactatatgaacgagattttcttgataaatctagcgatatgattcttacattctaaatcatgctaattttggcacctattaattaatgattttaaattttaattattgcacatgttttaagaatcaattattttaagaatggatattattaataaaaaagaacgggtcaagttctactaatttaatttaacaattatatctaatcttatataaccttatactaccattttgcaaggtttggactatgagcattgtctttagggtttgttgaaaccatgccaccctatatttgtaaaatttgagatatatcacccgtatctcaatgacatgtaggatccacatgagtcaatgacatgtgggtcagtgaccaggttcttgttccaatttcaacaacatatatgtgcttaatagtatcttcgttttttaatatatgacacgttgatttttaacacatatttgattattctggtcttatttaaaaaaatcacgcaattattatttattttattgtgagttgttttatcacttacaaatattttaagtatgatttatatcttatacatttaaatttttttttaaataagataaatgattaaacgtgt

SEQ ID NO: 82662 - DNA, 3029 bp, Oryza sativa
ttcctgcagcccgtatgttgtacctatgatcactcacatattctgttcttcatctatttgttttagaacttttattaagcatcggaagtaaacaaccagagataatatgtcatcattgacatatttaactccgaagtgccattatgatatgtaagtgtgcttggaataaaggcccgtaggcctagttgaatgtcctatacccaagtgacatgccatgacaacacgatggaggcggctgccacaaggccaggtgaaacagtgggaagctaatgacttgtttgtttctattaaaagagacgcaaccccatccttataaagatgggatgactcgacccctaagaaatcttatctaaaattaaggaaataggctaaaactcaacctaagttatctctaaaacaaaaaaaaaacaaaaaaaaaaacacccaaccgactacttcagtacttgtgggtactgttcatgtgcatttgcatgtgacgtggtaataccacctaaggtttaggttgtaatgcgttgtacgttgtgcatctaagatgcacatgtttgcatttgtatgatgttttcttctttgagcagggcatcaagtgtttatagcatacttctgctactactccgtgactcaaacaattacaagataaggatgcatgcagctgttgccttagcagttccagtctcacggcttggttggttccttgattgcttttgtttcccacctttggtcaactgttgtccttccacattctacaaataccacaccatatcacactgaagtaatagagctttgttctgttggagtattatctattgagtaaatttagattttattttcccatatcacatgcttttttttccattgttgtatgtgtagtctagacacatctactcattccaaaatttaatttgtgatgctgctcagttgctgcatagttcgtcgtggcgatatttatgtagtggctatgcactcgttctgtcatgatgctgctttatttctttctctaatctgcgaattgatttttctaatagaataaaatgtattccaatttcttatattttccctcttctgtatagattatggtagctcatttccagatgttgttcgaggaatcgagcatgttcttgagtcattgagttccaacagtttatcatcaccttcaaatttcaaacataaaggcaaccttgagaaacaggttagtgtttctgtagtgcttatatagacttttctttttgcatcaaagcagctttatttttgtaccagctcagagcatctatatttggcagcactgttgaagcttttgcccctttattttacaggttacatttactgctcttcatttgtttagttttgtttcaccaaaagatgatcaaagcctgagagattttcttatcaaggtaaggaactattttagcctatggaaatggcctatgtatttagtggttacttatatggtagttccgtagttggcatctgtaaaaatgttgtccaatgaaaaatattacgcccatcagtttgttattgtacgaaaatgtggatgcttagttggctatatcatatatagaacatcgaatttgcaagccctttgtggtcaaattttgagtttatttttcagtcctgcaaaagaaatcatatccctctttgctaattttatttcagtacttactaaatgtaaatggttattattctgcatttatatttggtttggtgattgttagttcacactattcagtggacttggggattattgtcagctaatgtttgttacgttctgtgattgtaccgtctatttttgcttggtaacattgcttgtactggtgcatgtatctgatgtagtccgtttggtgttaacataccaatgcactaagagaaaaatcctaaaccgtatgcagaaaatgaaaagaaattacttaaaatgctgcttggccctgggtgtgctggcaatcttctttttgattcttctgtctctatgtttaattgcttttctagctaatttgtgtgttattttgagcagaaagcatcctttctagaagactggctgaagtcattgttctcattgttcaataatgttgaggaccagcctttggcaaatgaggccataaatgacgaggatggtttcagcccaaacgtggcacaaaaagctatgttgtcttctgctgtgaagtccttgctcgacatatatacaagtgaaaatcagcacactgttgctcagagatttgagcaattggcaagaagcctagaattatagtgtgaatgacaaacaagatggtggtctcgatccccattaacaagcagcatgacagtggccgtcttcctcccggaaaagccaactcatcatctattcattttcaatctccttcataaagagaggcaacatgccctattgcaagtattccatgaactcaatgaagcttctgaatttcgatgataccagacgttggacattatgttcatgaacaagctcctggcagcttctaatgggaagggggggggggattcaaaactgcatctgcgtatcttatttatattgtaaaatagctttacctgttttttccaggtgtggccatgttctgcaccttatgtgtaaattttgagctttgtacaaagatttgcatgatcatatcattgtgagtgtaccatatatgtctcagcattttagtgaggaaatcttccacaaattttgtatgtacatttctggtagaccagatagcttcatgctacttaagatttgtcctgggcttgaatgcctggttagcttgattagaccactagcttgatgattgttcctcactatctattactcctatctgttagtactgaaaaactgatcagttgtcaatgtcttaatgcaacagaaaatgaatgccagccatttcagttggcgctgtcgtttgctttggtgtcacactctagaagtgttcatctaacaaccgccataaatggctgtgcactgttccattgctccaatgtttgaactcatggcattgctgagcagggatgatccaatcaagtgctacattcaactttttcccagcttt

SEQ ID NO: 82663 - DNA, 944 bp, Oryza sativa
tttggaagtaaactcggccgtccatctccgatctataatactccttccgtccctaaatatttaacgtcgttgacttttttaaacatatttgaccgttcgtcttattaaaaacttttgtaaaatatgtaaaactttatatatacataaaagtatatttaacaatgaatcaaatgataggaaaaaaattaataattacttaatttttttgaataaaatgaatagtcaaatatgtttaaaaatatgtttaaaaagataaacggcgtaggtacggagggagtgccttcctttccaaggagccgaagccgacatcccgcctgccgccagtggctgcccgcttacacgtacgtttgtaggtgccctgtataggctgcaacctgcaatactgttaatggctttggatcacgttaatttagattgccagcagcccatggagtgatttggactgtacatgtatgaagttggttcagatgctgacgaacaagtaataatcacactttttctttgacgacctatgtcgacgggtgatacccgtagaccggatatagagggtattagggtacgttggtacaagcatctacgtagtacgacatcaagcaaacaaaaaataagaattatactggttcagaccccttgataggtaataaccctaatccagttgatgtgggattatatggtagaaaatacaggttacaaagggaacaagggaacttgtcggatccggcgagattatagtcgagttgtttcgactagctctcgatgacttggctcctcgtaggctctggcttcgtaggctgtataggttgtgttggctctgagatttgatcccttaaaccctccccggggggtcccttttatatcgcagatctggaggtctccacgtagaactcggagatacagaccctatacgatacgtcaacgacccaattctgcccgagtaggattct

SEQ ID NO: 82664 - DNA, 2505 bp, Oryza sativa
ccaacctttgagcaccgcatcaatcgcttttgttattccagcgagtttttgggttctttgtgtgatttggatggaaggtgatcggaacctctatctctctctctctctcatcttgtttgttttgtgggcgactgttcttgccttcttggttggggatgatcagacattcagaccatcagatgaatcgatttctttgtagagcagttcttgatttatttatttattttgcgctaggtagtagatcggaggggttcatatgattcttggatcttttggttgatttgatttgatctttgttcttcacatggatgaagcgagttttgtgtgtgtttgagcctttgccctttgcttctctgtctgcggaagaaaatactcgtcttttccccttcacttgttcaattttttctcagttttggtggttagaaagaaaatctttgtttgcaaacttgattttctttttggaatgctcatctgcaacgagttgcggatttttttgttttcttgctgctctctgaagagcaagtgcggatcttgcattctcggtcggatctctgcgtttctttgcaaccatcgattccactgctttgcttcttgtaggtttctttggttcgatggaactcgctttatgcatgttctttcacttctgttcttgtgaatccttcgatgtgactcctgcggtttttttcaactatattattttgttttatgtgctgttgatttcccttccagtttactaattcctactgcattgtttaatctttacaggtgggcttcaggactggtggtgataactggctgttggtaaggtgagggttttactttttaatgtcatctgcaacaatttcatgttgctcaccaattttgttggactgtgtgtgggctgtttcttggtgcttatggttgtgggattgagtctcctgggtttgcttccacttagacactagcagtataatgcacataaagttgggcaaataagtttaatcatgcacataagttgaatttgatgcacatttttcattactttgatgcacataagttgggcaaaattcaagtgactgtcaagtcatattctgttgcctattgaacctgcaggaaacatggcagagaccagaggcgtgggtgggcgccttgcggcattggcttctaaggtggactcgaagatatattatctcaaggatgtgttggttgagtacatggacatgaaaaatgtggttgctgaaatagcagaggagagggagaggttccagcttgaacagcgtggttcgtggccttctcacgaataatgttgtgcttcgtcgattccaatgttgaactattatttagtaaaggtgtcatatgtaacttgaaatggttatggcaggaaatgacgcacttctggaagcaatgaaggaggagcttgtggcagcaaacaacgagctcgaagcagcaaaagaggaaatctctcgaaagaacaatgagctagagtctgtaaagaaacagcttcaagagagtgaagcgagaaatattcaggctgagcagcagagcggcattgtggttgagcttatgcaaccaagaggggtaataatctatagttcctgcccccaaattattcataatttcttcatggcattgactaaccacattatgttttcaacttattttaattcttcctatttagccatgtaacttaacacctcacaaatgtctatatttttcacatcatgccttagcatactttttgtactaataaagtaataactagcattttttttttgcttggagcaggtgcaaacaagatcgatgcaaaaacgcaaaaggccattgcaaggaccttcgggctgtgaggctgatgaccaagagtatacgagtcaaatcaatgtccaatctccacgttgcttggaatcgatgagaactcctgatgtatggaacattttgtttagaatatggattctcaattcttgatattttcattatgtgcctaccaaatctataagctaattatttgtcattgcagtcagtttatgttcattgtttttttcttgctgggctactatattgcttatagaagtatcgatatgaaagcaggtcaagaaaagatcggtgcagaaacaaaaacatttatctcaaggacttccaggtgatcctggtgagcttcagttaatggaagggcatctgagtgacccgaatgctggggaagcctcaggtgctctggtgagcaaagatgatgacctggaggcagttagagaagagttgatcaaggttgattcatactcctagaatttctctgatgatacttatagatactgcctaaattcttgtatggtcaaattaaagtgtggcattagaggtgatgctatatgcatgttggtgtttcagggattccttgacattgataacggtggacggaaacttgggataaaggaaatgggacagttgaatgagaaggtgttccagattgcatgtcttgctaagctacctccagaaccagttggtgaggcatcgtatgaactatactcatcgtggcgg

SEQ ID NO: 82665 - DNA, 3674 bp, Oryza sativa
  unsure (1)..(3674): unsure at all n locations
atgatgtgacaaatggttttgaatttgaacccattagaagtaaacatattttttcactggagtgtgaaactttaattatgcattcaagtcacatcatagtgaaatactaagcaccgttctttcgttgtcgtaaccaaattttagtgacaagaagcagctttgttttcatctaacactactgaagcccacctgcaagtttaataacctaaattggcaaagccattttttcactaaagatactctttggaatgggatcctactttagtactttacatattccaatttccttccaaattctagttaaataaagtctacagcttccttgtataaatatgatgttttgccatgtgtctattgaagtttatgttggaataaattattagacctacaagatcaaggtatctggagtaataatagtcaaaggctacaaaatcgtagtccactttctgaggtgacacgtccgcgaagttatcatgtatgattacaatacaaccttgttctccatggcatagtttcgtgcttaaaaatattgtttttatgaaaccttgttgtaaatcttatgctgggtgtttgatcgcagaacttcacttgctgttgtttaatattttttaattgttttgatttggtgctgctacatgcaccatctgaatctgctcttcacatactttcttactgccatgtatcaaactttgtattccttcctactggtaatatggatgcaggtttgaggcaggaatgttcaacaataattgtcacaaattcttattttctttctgtgaaagtaaacaattttttgtttttcctagtttatcagatcccccccccccccaatgacaatattgtcaagtctaatgtctccattgcgttgctctgtcaggttgattgtgttctttgagcagaacgttccacataaaagagatttggctttaagaaatctccaacaaagctacaagtgctaaaaaatgtatattgatgcaaacttaactgcttgagtttgagtgtccatactattttctattgggagtaggcgccaattgttatcttaccagacatacatattacacaaacaaaatttatattgaaaatatgcattttgttaatgggcaaactgtgagatgcatcaatttgttgtaatctgcaaccactgtttggtggttgtcagctgtacataaactctgccaatacaattttgttctccactgttagatctaaaggtacatgacggttttttgttagttgcgtaactgaaggattatgaagtggaagacattactccctctattccataatataaggcataaccacgttttttagaagttccataatatgaggcatgcatgcatgcaagcaattaactatgacctcttctccattaaattattacttttttaaatcctctactcttatgttctctaattctattggatgcattcattatactccctccatctacttttgattgttatatttcatcttggcacacagatcaaggataagtaattctacttatcatctatttaaatatgctactagtcattcttcgtaaacaagcgattcattaatatttacatttctcgatgcccatatgaccaatgttgtgtggaagaatgaagagtcacgcattaaatccaagaaagccattaagatgataatctattggattgaaatatgcctatcaaaaataaatttttcagatttggaaatatgactatcaaaagtagatggagggagtatttattaggatgatccaaactacaagataataataattatttcttggtctttgggttagaggtggttatgccttatattttggaatggaaggagtaatttactgccatgattaccatttggtaactttggtttgtgtagtggtggtatatatgcaacaagtcatacataccctacctagaatttttacattttaaccctttttaaaccttattttacaaataaataccacaaaattctcccaccttccaaaataccacaatgaaaccctattccttccagaaaaaagcacaaatcttaacaaaatgacgcgagggagacaacgctactttccaaagaccaagttgcccctcagcccttttgttcaacctgtcgtatcttccccctttcttctcatacttcaccaattttctcttcgagccttaagtccacatctatggcaatgacgcagggaaaagcaggcacaaatccacctagaggcctcaattttttctcccaaactctagagcttgagctgcataaaaagaaaaaaaaaacagnggctctccctcttcttactcctgtgcagnggttcttgttctttcggtgactcctaaactagtttcttctgcaaggtgatgcttggggatgggtttctagcgccgccatggatgcttcagtcaatttttagggcttggggatggatttatggtgccgccatgtatacttgatcgattgttacggttagggaacaactggtgagcgaggatgcatgatgagaggttgaagaaggagatgcaggggcaactttgtctcggtaagtcacaaaatctattccgatcgatggtacctaatgtttgtggtatttttgaaaggtggaagggtcttaaggtatttattggtactgataaaatgtaaaatatttatgctatagatgaaactttcccatttagagatgatctcgatgggcaaatagactagggtatttcctcaaaaaaatggactagggtattaattcagttcacatcccttagtaaattatctctcttcctcctcaatggaaaacttatgttttttgatcatcttctcacatcttttatttttggagctaaaagtcaaaataacttcttcgaggaattctcttggggaatttacctcattgtctttatactcaggaatctgattcaccatgagccatgaagcatacgccgaagatgttctttcccttgtcattgtcttcaccactctcaagatctgcactacttgattcaataccttcttgagcttgcttggacttccttccattgaacattccttttagcttattgtccttgaactttgtctccattgtcttttttcttggctctcccaagcttggggcagtgcaaacggatgtgatcaagctctccacactcaaagcaaagaactcgacctcctattttcttgaacttgacatcattcatagttcgagacaacttgtttatagtcaaagccaactcctcctcgaattgctcgagttgatcatcggacatgacgttaatagtagaaagagcagtaggagttgactaagaagcaccaatatccaaagaagtcgaaggagaaaccaatgcactagatttagaatcaactttacgagaaagaatatttatctcataagttttgagtctagtgtaaagtgaatctaaagtcaaagtgggcatgtcaacagattcctgaacacacgtaattttcatctcacaaacagacataccaagaccattcaaaaagtgacaatcttagattgtgagtagaagtatcataagatgtatcaacaaatctaagattactcaaaactttgtcaaagcatgcaaggtaatcatccaaagcctctccatgtttcttctcaaattttatgtaatcctttttgaaaacatctttgcgtagttccttgatatttgaagttccttgatgagggctgcaggaat

SEQ ID NO: 82666 - DNA, 707 bp, Oryza sativa
tgaattgctccttcatctccggccccgactgtgtcgacagtggccatacacgaattgccaatatccaagccctggtatgccacctaaagctagacccagagataaaaaacagacgcaccttgtccacaaatcgccccctcacagcaaaaacagcctacgacttaagcttcttagggttataggatgaccttttcgctaagcccatttgggacaaccacgctcaagtcaaatgcaagatcttcctttgtactacacacaagaggcgcatcttcaccaatgagagacaagctcgatgtggattagtagcatccgcacgttgtcctttttgctcctctgttaaagatgtggagcacctcttcctacgctgcaccggagtggcaacaatatggcacacctttggcctggacgaacaacagatcgcctccctgccgcagcttgaaggtgtctgggacatccctccacccagacaacccgccactccacgagtctggcgctctatcctccttgccgtcatgtggaatatttggaaacgacacaacaacaaggtcttcaattctcttgatgaacctgctaagttagttctccggcgttgtgctagcgacattgacatttggtcccatcgatgtaaaaatgttaagagcaaacaatagctccgcaagtgggccttatacctctttgtaattaattcttaatttaattctccccct

SEQ ID NO: 82667 - DNA, 1010 bp, Oryza sativa
ccagattaggtttattcaaatgtagcattgtatgtattttgataatatgttgtcatgtgttgaaaacattgctatatttttctacaaacttggtcatacttaaagcaagtttaactaggaaaaaataaacctacttcatatataaagtcacaagaccttttatccaaaaattgaaactttcaactaaaagttcaaaaaaattatactcttggctcaaactttcaatataaaatccaaaaactgaaacttcccaaaaaaaaatcaaaaactttgtgctcttggctctcaatctttcgatacgaagttacagaatttgagaaaactttcaactgaaactcctcacgagggtgtcaagtagggatgaaaacggtcggaaacaatcggaaaaaaggctcaaccattaccataaccatatttttctcagaaacaaaaacgatatcggaaatatcgaaaaaccagaaagggcagctacgctggatgggctctccaatttattttaatttaataattccctcaataagaagaaaaattatcctcagtcaatttcttgaccattgttctacaatcttacttataaccaaattttacttataaccaaatatgacttatgactttatagtaataaaatcccgtaggctgcagcaacgtgttggatatcacccaacaaacataaaaaaaaaacatgccatgttctagtgagcatcttgatcgtggtaggatagctagctaaataaagggtcggatgcgatatggatgctagcgaatagagcttttctgaatcgtcattaatacaaggaaagagggaggaggaaccagaaggagaggagcaatagtttgggggatgatcccctccattaatttctcattctggatctttgctagggatggataaataatcttatcccaaacagaaaaggctagagtacgggtatgtgcttcacgtgaaatgggaaataatatactatcaatgacgactaatttggcagcatacatgcgtgcatgggccagtt

SEQ ID NO: 82668 - DNA, 9625 bp, Oryza sativa
catggttttgctggtcgcacccatggcagttaaggaccggttcgcgggatgccctggaagaacttatcgtacttaccacaagccagcgtgggcaacggctgggcttgtagcgtagctttcctctagccgacgcatccaggcaagggtgggcgtgatggagtttggatgggccctgcgacggcctatgcggcttccggattcacctaggcacgagaggggactgcccgctgcattgcgaggagtgggggtgaaacctgaggtgtggtgtgcttggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtttcaccctagtgtaatcttttgaatttgtaagtttaggtggatggttgggcctgttgcaacgtgggatagcgttggacagtggatagttaatattaattaattattacaactgtttaaatctttcaacttctgtttataaatgctcgctttatgcaaatgaaccactctagctcttctgtgataattccctgcatcatacccctattccggtatgacttgctgagtacagtgggtagtactcagtcttgctctatttttcccaaccccagagtacgagtatgtgtcagatggaggtgtctctgaggagtaggcttcgtccgtgccgtcaaggatgcctgtggagtggtgttcccgctgcagttctagttaaggcttagctcctgttgcctttcttttcttctgctgcatttatgtaagacttttatgatgtttataagacgtggatctgaatgtcaacattgtcgtttgtgtaccccggccggtcctggacggggattttgatgcacattctgcttggaattctattcgggaatttctgggcgtgacaacagcattaaaagacacttagttgctcaaagctattttgtaagcacgatcctagagctatacgaggttattaatcaaggccgtgaacccacacgaacctgccttaacccaaggcctacgataattcagaccgaactggcaacccgaccctgggtcccagctcgtcccaagccaacccagaccaaccattctacattttagttgttaagcaggtattaagaattaaaacactaacttgggtacattgctcggcttgcccataaccgagggcgcggctattcgaataggttatactctgatcagaggtgtacatctttacccacaagacacatctttctcacgtgtaaccacgtgccacataccaccacggtatacggatggaagacgtgacatagtttccaacccatcctagccataaacaagagtaccgacccaaccccacctacggccggaacccccgggacaggtaggcaggactgagcccctagcagcaggacaccagccctgtaccatgacatctcgactaccgagccgcagctcgtgtagccttcatttgccctagagatgtccatcgacccccaacttcgtccatctccatccgtgtacttttgtttataaccagactgagccacaaactaagccttacccactagacatgtggaagtacggtagtgctttgcaacagaggcccgaagaccggtccttatatggccgaagtgctactatcaaaaccatgcaccccgagcccagcctaaaaccattttgagggttttgaatagagggggaggtgtgaatccaattccacaataattcaaccattccataatgtccaggtgatgagaatattcccaaagtctagagttgtaaaaccacctaatgttgcctaattaaccagcgaagcatctacctaaattcatactagtggtaccataaattgagtacccactagttggggttttgtttattctagggtgaacaaggtaataataacaataacaacaataataaggtcatacaaaggtaaatgggcatagctaaacaaaacagtgataacgcgggaatttaagtaaaacggtaatgtaataattttaaatcaaaataattttataaactgggattcaatatgttcaaggatgatgtgacttgccttgctcgctttcccaaacgtcggcttcaacctccacgaagagcggatctttcgaagctgcagcgtctacacgactaacagaaaaaaaaaagtcttttactctaataaactccatataacaagtaggaacaaagcacaaaaaagggtttttgacttcttaaggaaaaattagagacttgaacggtctaattccgagttcaaatggccaagttatggccatttgaagtttatatgctctttaaatgaatatttgcgaatttcttcatttaaattttaatttaaaaagggtttattgcgtcagccgagggggaggggcgcgcggaccgggtccatgggagtggggctcacgcggcagcctcacggtccacggtggaccgggcgcacccgggctcgcaccggccggcgccgcgggccccacgcgtcagccgcacccgagggcgcgggcggctcacggccgggccccacgcggcagccactcggcgggcccgaaggcggccatgccggcgcggccggcgggaggcggcgcccgcgcccctatggtcgtcggcggcggccataggcacggcggagcggcggccgagagaggggagggagagggggaaacgaggcggcggtccatggctcaccccgaggcgacggcggcgacggaggaggcgcccggagtggaggaaggcggcggcgcggctcgggtcgacggggacggcggcgctccggcggtcggcgagctcgatgagggggtggacggggacggcgacggtgcggcgaagccgaaggaggcggcgccgaggcgggaggcggtccggggcgacgacggcggcggaccggagctcggcggcggcggcggagagagagagcgacggcgtgagctcgattccggcgaggagaaggcgcggcaaatggtggaaacgggcgaaggaagtgcggggagggtttaaatagggttggaagggggagagagcggccggggaggaaggaaaccggcgcgggaggtccggccgccatcaatggcgccggcgagatttgcgggggcaaatccgcccgtttgaacacgagagagagagggaaaaatggggggaaagggagaggggatcacggggagtatttctccccactttattgcacgcggggacggcgggatgctgcagatttggcggcggcggcagcgcttggcgcgggcggggcggcgggaggacggggatgacaggtgggccccacccgtcagcgagggtggcaggcgggcccgcccgtcagcggcgcgcgcgcggggagggaggccgaatgggccgccggggagaggagagagagagagagggggaagagggagatgggccgagccggcccaagggagggaagggggactttttagggtttttctttttataaaacctttttaactttgtttatttcttaataattattatttgtgctctgaaaattccactaaaatttatttacacattttaggcttttaggaaatatacaaaaatcctctaagccttgattgacttttaactttgcacattttaatttttgaaggctttcacaaggattttaattattctaggcataatttaaaggatatattttagagtcgttttgggacgtgacatccgcgctggcatgatgagaggggaggggaagcgcgcccggagatcggacggcgcacggcagccgacgagttccggcgagcagcggcgaatcggagggggatgcgggcactggaggccagagggggtcgaggcggttccatccaccggctcggaagatggggaggcagcgcgacggcggccagcgaagacagtcatgcggcggcgggatgggtggcacggcgcgggcacgtgagggaaggccggcagccaaggcggcggttcggggagggccacgggagctccaagagggcagaggcgagaggaatcgacggggaatggccgacaacggcgcgcggttgtgcgcggcggcggtggaagcagagcggcggcgacggaaggggatgggaggccggcggctagaggaaagaggcggggcggccaaaggagggggggttgaaggggtctccgggagaccgacagtggggaaaacgtcaagaggaaccgtcggcgacgcatggccgagcggcggcgcagttcgcacggcggctcgcgcagtagcgccaagcggcggtggcgggagcgacatggcgcgagaaaaagaggggcgctgaaggggagggaggagccggggagctcaccggcagccatgaaggcatcagcggcggtggcgaggatgggaacgcccgcgggacggcgcggcaccgagtgagcacggccggggaagaagagagagggaggcgtggcgcccggagctcctcgtcacacgtccacgcacgcaacggcccctccggtgctcggcgacggcgagagcggggcgaccagcaacaatggcgcagcaacgtggagagtgaagcgggagggattgaggggaggggttcggctttataggcggccaggaagtcggttagggagagggaaccgttggcggtcaagggagctcagctggtgttcacgggcggcagcggcggtttcgggggcagtgcgaaagcggtgtggatgcgttggtcggcaaaggcggtggattggacggtgaaaaattgggtcacgagcgcgggaggagcagcgcggcatggtcaaagtgtgggtggcaagctggcgactggcgtcagcggctctgcctccggagcgcaagggcatggataggagagagagagatcgagtccgagagggaaaaagggggaaaaatggaggaataggggaggcttatccatgccgttctgggaggaggagagagaggggaacgcgagcacggtctcccaggtttggacgcatgcggcgtggagcagtagagctggcgtgggaaagagagagcgaggaagaagaagagagcgagcactctctcccgagcgcggcgcacgcgcgacgcacgtgcgaggggaggagaaagagcggctgagggagagaggtgggctgagggagagaagtgggccgaggggaggaaatccggcccacaaggatccgagggaggcaaaatagactttttgccgaggagatcgattccgaagggattgagatttggaatttgaatttcgaacttgatatttggactcataggaatatggtggagtcaaggaagggagatcaaagtgaaaactcaatattttcgaattggttttgtatctggagacccgaagaattatttggggaggtttccgaagaaagaggaaaaaggaggaatcttggaggttgaagctcaaggctgggatatgtttggatttacatccttggagttgggacaggaattcaaaggttgttagatagacagacgaaccgatggataaacatgtagatagatagatagatggatggataggtagatagatagatagatagatagatagatagatagatagatagatagatagatgaacaggtagatagatcgatagacagggagggattcaaggtagggatttgatattctcggaatcgagagaaatattggcaaggaatttcaaggacgggattgaatatcgatgtttgactttgaaagatgaatcgggattgacattttagaggtgggggattttgatggcgacgggagggaacaacgatggatttaaactgagatccacggcacgacttagactcgctcacaaggaacggaatttttgaaattaggatttttctgaattagtttttaacgcctcacgaaaagcggagcgttacaagacccctacatagcaaatgtttgtagttaacaaagttattgatgatgtaaatttatatgcaaaataagttaggcagaaaagaatacatttctgcctccattgcagctatatcttctgggttgccattcttacatgtgtaccggtgatggcctaacagatggcagattgggcactcatgtttttttgatgatttcttctggctgctgcttcctccctcaagtgctgacttcatcctattcttatgcctacctccagctgtggacttaagcaagggagggtgcatgaagaagtcatgagtagctttgggccacatgctcttgtctggtatgctagggatggaaccctcatatgcggctctaaatctattgacagagaagtagtcatccacatggtcttctagcttttcaccagcaatggatgtaatgaaagctatggcatgcttgcatgggatgcctgagccctgccaaactctacaagaacaggttctatcttttaggctgaccacatacctaaacctagagccattgctgccttttgcacacagttctgccacaccttctggagaggctatgatcacttcaatatccaggttgtagctctcttccttaagcctttgcaagatgtgaggtagaatttttccattgaacttcttggctaccttctttctttggttccattttatcaaaattttctgccttatagtgtccaacaagtcatccaagtgctttcccttctttagcttgatccagttattgaatgattcagccagattgttagtcacataatccacctttgatgcagtcctgtattggctcctggtccacaacttcttgtgagtttcctgcaaatacttcattgcttctggtttagctgcagccattgcttgatagtgcttctcaaacatgtatgggctccatgaataagaagaagcccataaatgatcattaaataccttcccactgtacctcttcttaaaattctaaactaagtggtacatacattctctatgttcagcacgtggaaaaacatcactaacccccttcatgattgcctgcccacaatctgtgctaaatgttaggccatctggggtacctattacttccttcaatctctccataaaccagatccaattctcatttgtctctgactcaatcactccaacagctactggatacatccagttgtgcccatctactgcacaagctatgcacaactgtcccctaaacctgcctgtcaagaaagtgctatctactgcaagatatggtctacagcctctaagaaaaccatcaacacatgctctcagtgcaaagaatagtctacaaaatctgattttcttgtttatggtgtgatggtcaataacaagaaaggatccaggactagattcttctaactgagccttaagcctatacaggttattgaaactcttgtccagggcccataaatcttatccatggcaagatatttacctttgtacactctcttgtagggcaccacaattttatggtgctccttcaacctcctctgcagttctgttgggccaatatttccatcttccttcagccaatcaatgacctgactgcacacccagaattgagtgaccccaacacatattccttgcctcctagtgctctgacatttgtgaggtaaggggacttttttcacctgcaaactagagaagcaacacatcaatgtcatagttcaatgaaaattgtgagcaatcaaagaaaacaatgcactacatcaccttcacagtgtttccattctttccagttgaggcatgaagtctccacttgcagccatcactcctttgtgcgcatttcaccctatatctccctgtatcactcttctcaatgtcatagttgaactcatgtttgatagcatggctagctaaagcaatcttaaaagcatccatatcagaataaacagttcctactgtcataggagggtcattcttatcataaaaagcatcaggcatattttctggctccttgtctttaatttcatcatctatgtctttgtagacccccgatttttggaaatcggaaatcttctgtgtttattcgtaccaatccctggatcagtagttggtacacacatacatagttggatcacaacatatcacgaatgaatctaggctaaaagagttaaatacttacattagggccaggtaggccaacaactatcagagaacaacagcggaagacaaaataatataagggcccggttaacatgccacaggcagtcgactggggaacgagacctagaaccagaccgcactccgatcatcttgtgggatacgcaagcgtaccgacaagggcttctcttcaacactctcctaaaagatatataaatagcaagggtgagtaccaaccgtactcagcaagccaccacaacaacaatgcgtatgatagaaggtatttcaaggaaaggcttcaggttcttttgcataaagctaattttgcaattcttttcataagcctaagacctagcatagactgatcaaattttagtaccagtgttcactttaaacaacgacggttctgtccaccatccattgtgatcccaaggatagcttcccgccgttgaatcgtcatggttttctaaggatgtccaccttccctcctctcgggatgtggctccatcagcataaaattcatcatgcaatatcccattccccacaagttaagaatttagagtctagccaagtgtaatacatgtcccggtgctcaataaccgcgagcacggctattcgaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttaaatcctcatgcactctaggcgtccatgtttctagcagtgagaggagttctggcgctcccgggaaagagaagtctcacacgcatattaaattatggttcaagttaagttctctctctcacacactcatggcagtcctaccaatggcgacaccgatgtagggcacgcctctcggccctacctcaacggttatcccattgtagcgcacctgcctcactcaggggtgaaccatctatgcagggatactgcctccgctcggctatctaatccgctaggtctatacccattcgagaagtacggttgtacgggggtcgtttcatgcttaacttcatggctcggtccttaattgaccggggacggtactagccttttccagataccacccaaatcctccgtccgccccagtcgaaaacagttgtttaattttatttctcctttcacaaatcatgtcatcaacatcatggcaatgtggcgctcatgtctccacatgccgcatctcaattaccttcccaaaggtaattgcccaagcatatagcatttgataaatatgagtatgcatgattctagaatagcatttctaagcaattgtcataattgactagggactcatacgtaatcatggttacaaggattttaagggtaaacaatcatcaaggcatggcataatcacaagtaggatgttcatcattgcatgcaattttatttgtaaacaaaacaatttcgccattaggatcaacatgttcaaggaatagtgatgacttgccttgctcaggataatccttattattgatatattcttgatcaacct

SEQ ID NO: 82669 - DNA, 12977 bp, Oryza sativa
aaggcagggtttttcaaactttcccttgatttaagtagtttgcctaagagcccgtgcattgcaatgaaaaacaaattaagtttctagcttattgaatcaatcaataaacacttatttagtctaagtaatactatgatttttcttattgaacaagtagataattttgaaatttggggggagccaatagtgaaatgggggaggatttgttgaaaggtggtgcaatagtatagattgtggggcccaattttagtggtaggggtggtgtgggaatagacaccaccactaccaacattttaactagtatagatatagaaaactttaatcagaaccagttaatatgagtatatgattgaaacaaaaagtttattaaactgttagttgctctttagctaataacattgtttgtttgcagcgtgctaatagagatgttgatagaccctttgttcctgatactgttgggtttgcaggtaatttggaaaaatacattttggtttgctttcttcttgcctcttcaatcttatcagggactacttatacttttttttgtttcatgttacctcaggtgagagagcaggcaagcgggaccacaagcggaaggtttgttctttctcatcctctctgtgatgatgttcttaatatagtttcatctttaatgtgtgtctgtgggacatcctgctgaccttctaaatatctagtttgaggggagacaaaattgaattgagacatagttcaactgctctgattttctgaaatctatccatttgtactttaccatcctgataggacatgcagacaggaactatatgttgattttacttatgtgtggcaataccatttaaaacatcaaacaagatgcttcagtgtgttggatcatccagtatcaaaatgaagtgcaatctctattgttaatggccattttggttgaagttgacagtcatattcttgctgtcctaaaatgtttgcattctggaatgctccatattttagaattcaatcagggacttgttttcttctataaaactatatgattacttttacttggttttatcatttacatctgtaacattttcgccagaccactggaagatttatagatgcacctccctcaccaccccagtccaagaggcctcggaagttgaaagcatctgattgatgagtttcagattgagctgcatagaatttcaacaagccaaaacccctggtatgccttactggcttgaattgaacttgcacttgaatacttgatcatttgttgctcgcttcatggttgacaactggaccttgtgtttcagatagtgctatggatcaactccattcttgcttggaagcttcccggcgtgcactttcaccaagagtttgctcccgtcggtagaagccgttcttggcttttgtctgtacagtgcatctgccctgagaaggttttcttcgtactcctcgttggaagatgagacgaatcaggtggaagcagctgctggcgtcactgagaagtgatcgccttgagcccttgacgtctccccctactcaacgaagagtgtaactgtttcttttgtttgtttgagctgtagctaccgtttgtaaaatgagttatctgacaataccgtgtttgttcaagtagaactgtaacacaactgtttacacccaatcaatcctgtaatcttggacaatttaacgaggaaccgcgatcccaatgcaaacctgagcctggtttccatgtgtggttggcgttatagcttatcaacagccttgtgcagttcaacacaaggtactccatctgtctcataaagaaccaacttagtactagatgtgatacattctactactataaatctggatgtatatctgtctagatttatcatactagaaatatgtcatatccaattctaaattcgttttttatggaacggagagagtactcttcgagtcttgataactcagccaacacagttgacggtgaacacacctggagaggagaaagcagaggtgtgcactgtatctgtgtatcaatcaggccgagaccgacgctttgtcctctcatatagacactgatcgacgtctcgagattgactctcgactttgccccgacatgcagtagagcgttgggcagtgacgtggcttaatctctggccgtccgtgtaccgatcgatggccacggatcggatagaatatgccggaacacatgtcgtcaggttggttggcatggatagaagatagattgtgtcacgtcgcggtaggcaaaattttcgcttctcgagtggtccagtggacgttgccacctgcgtgtgtggcacgcggctgagtggacggtttgtacaaggcgatttctacagttctactggctatggggcctatggccaattgaccatgagcagctggttggtgcccagttcaccggagccgccaatccaaacggcttgatgcgtcgcaactgtggagctttgcatgggtggagtcagatgtggagggtggttgttgaattcgttactactactactggtgcatgacaagttaaatcgggagagaaaaagaccttacaaaagaaattgtgagaaaaggtgagagacgtagccaaatacctgatgaactgtgacgtctgaatatatccgagtattctgcccgtttgacgtgtcataaatcttatataattattagtatatcccagtattctgttcacttgatagaatgatagcttacaaagacacaagtatttactatttgtgctgactagtcactcagtatgcaaaaatctgcaggtttggtagagacaacacatttaactttggacagcaactaatcctagcatcagattaatgctgagaatgagagctcagtttcatccatcttgggagtcatggcctcatgggtcacctgcatgggccaccgtgcccaagatcctaaacttgctcccaaatttatgagtagtttttttttccgaggtcagagaggcataatcacaattcacaaagatctcaatcccaaacgaaagagacgcccgacccacctctcctgttaacatcactgctcacttatctcatctcacctcttgatttgaagcagacaatgcatgatcctcagtcacaagataattctgttaaggcaaaaatcttgcaactatttcacagtttaattcattaacaccacatatataagaaatctcttgattgatttagcattgctaagtagtataattaacagggagcttagtgagcttgctgtgaaattgcaaggctcttgttgttcttggcgagtgtggctagctactgcttgctgctgccgcggttgagcatctccttgtagttgagcagcgagttgagcctctgaagctgcagttgctgcctgaatttgttgatgaagtcgtcggctctggcgtccacgccgccgtcgtcggcgtcctccgccgccgtgtccttcctcgcctccgagctcgacttggtcatcgtcttcgcctccgacgccgcctgcttcttcgccttcttgtcctgctcccgcgccggctccgaccgggtcctaccgtagtgcgcttgtgcgggcgttgccgccgccgctgcgtcggcggggatgtcgtcggtggcgaggtcgccggagcggaagctgtagagggtgaacgagcggaggcggtccaggacggacgacgtgcgcgcgagcggcgccggcgccggcgccgggggaggaacgtattcttgctggagcggcagatctcgctgctgcttcggtgtgaaatcgtcttcggccgtcgcgtccacggcggccgcggcctcctccgggaacgcctcgaccaccctcgccggagccctcacgacctctgccctcctcacctcggagctcgagttcctcagcctcgacgccgccttcctctcctcctgcgccggcgccgccgccggctccgaccggctcctcgcgtagtgcccttgcagcttcacctcatccaccggagacgaagacaccacctcctccgtgcgctggtggtggagttggctcgtcgccgccgccgcagcagtagcgtactcgggagggaagtcaccggagcggaagcggtagagtccgaacgagcggagccggtcaagaacggacgacgtccgcgcgagcggcgccggcgccggcggcggagcatacagcgtctcctgcatcatcatctgctggtgctcaccgccgccgtagtattgctgatgcagcagcggcggcggcggttgcaactggtcgtggtggagtatctccccgtcgtggtgatactggtacacctgccgccggcggcgctggtgcgtgcgggaggtgagcgcgatggtgccgatgacgatgttcacgacgaggaacagcgtcgccggcgtgaagtacccgcggatcgccgcccacgcgcccacccccggcgacgccgcctccgccacgtccatctatcacgcggaggctagcaggggaaagcgcggaaacggacgacgcgggcgagagctcggtgagcggctgtggtgtacaggtggggattagcgtttttggggcggtgtacgggggtttgtgtgggttggctagcacgagggcgtcgcggaggcgagcggttaaaatggcgggcgaggcgaggcgggcgggggcgacacgcggcgaggcggggtgggagatggctgacttggtgggtggaaaacgtgggaatccaagctgccgcccaagcaggcaagcagcagcagcgcggggagccgacccgccgggattgcagctgctgcatctgcatggcatcttccgccaaaaaaaagacggcctacgacgcgtacgctgacactgtagtatgtggtggactggagtacaagtcactgttgctactcggctactccagccgtcctatggcacgtgcatatacagtggtatgtacagttgacatttttccatggagcacacgacagaataatgatactacgagtacatgcgtacatgagatgctacaatatactcccttcgtttcaaaatgtttgacaccgttgacattttagcacatgtttgaccgttcgtcttattaaaaaaaatttatgaaatatgtaaaactatatgcgtacttgaaagtatatttaagaatgaatcaaacacgtactaaaaagtcaacggtgtcaaatattttgaaacggaggaagtatattgtacgataaagaaatgttaggtacacatggatatggagtatatcatgagtatatcatcgagcttggcacagaggatcttgtaagagttaagcgttgtcgttgctggtgcacattgacgcacagatgccctcacgtgttgctcgatcgattgatcagtccacgccctgctgcaagtcaacctgctcgcgtcgtggcgcggcgcccgtcagtccttgattagtgcattaaaccgacgttggggataaccgataacctgtccctaaatctccatgcttttcttcttcgatggtcgctttcagcggcagatatgataacgtatcaactccaaatgttccaatcacatctttgcttccaacgcaaccaaccatcatccaggcaggctccaccagatgacctttttaatttaccttcaccgtttaggtagtatgcaactttggaacgatctcttcagattagccatcttgagcttgtacgttatagaaaaaaccgtttttctgatggtgatttggtgacgcagatattctcgtggagtgacgagaggatgggactcactgatggagcagcgcagatcaggggttcagagtgacacacttgcacacacatttacatttttcctagagatggcaattgtgctacagaagttttcgtgtacagcgtttttatggattcagagtgacacgctggtggagcacacgacttggtgatttgagtccgattacagtcggcctggaacggcactgtgatgttaccttcagcccattctagttgggccagaaaggaagtacttaaatgtggccccattatacttgggcctgggagggaatacgagtagggatggcaatgggggggctacacctacaaggctacacccgtcggattttgctatcctgtcccgtccccgtagtagaaaaaaaatcccgtccccattcccatccccgcacgcgggggagtgttttcccctcccccgttcccgcccccgtgcgggtatggggcaccgtcgggtgcccacacccgacaatatctcaatagatttggtagcagcaaagcaagacaagaaatagccaaacaccagtgaataagcaccaaatcttaccgtaatccaagtatccaggctatcaacaacaacaattagcatgattgcataaggaccaaaggcatcatattaggtattcacgttcacatgcgtgtacatcaccacaacacaactacacatgcagtgaatatgcacgctattacagatcgatcggagtaggctgtggcggcagcggcgccgaagcgaggctgcttgctagttgctcccttggaggcggcggcgcgaagcgtctcgcacggcaaggacgacgagagctcaacgccgccttctcgcctggaggtgtggatgcggcgacgcatcagggaggccgagctcgtggcggcgcgcagggagggagtttgagctcgaaaacgaaaacaattttaacatataattaagtctttaattattactttctccgtcccataatataacgtacgagacactcctgcggtccagattcattatgccatgaagtgtctcatccaatactaggttgctatattattggacggagggagtacaaacttaacaaattaacatatttaatatgttaaaacaatttctatatagaaagttttcgtacgtaacaccgtttagtagttaaaaaaaactatgcaaataaaaaacgatgtaaaatccgaatcttaattagaaaataacaggattgaccagagtcgccaccacactcttagcccttggaggcttggagggtactccctccgtcccaaaaaaagacaaaccatggtttccgtgtccaacgtttgaccgtccgtcttatttaaaaaaattataaaaaaaaattaaaaagacaagtcacgtataaaatattaatcatgttttatcatctaacaacaatgaaaatacaaattataaaaaaatttcatataagacggacagtcaaagttggacacggaaatctagaggtggaacccaacgtaataatcttcaagctcctgaagggcgggaacatatatgtccggtccttgcagtcacactgtcgagtcaagttcgggtagtttcgttatatgttttaccatcagccatggtaggctatgctctctccattttaaaaaaaatcaatctaatatcggatgtgacacatcctaacactacgaatctggatatatatatatcgagatttatagtattagaatgtgtcacatctgattttaaatttgttttttatgcgttggagggagtagtggtcgtcgaagcccgagtccgctcagccgggagccgtgtccaactgcctcaggctcgacgagttttgattgaaaaactccattctggctagctcgtgtcgcctactcgccctctcgatcgtccgtgccacggtctcccatgcgatgcgatcccaccgtgtcgtgtccgccccgtcgtcggcaacgcgtactacaggagggaaagccgtcgtagtggacgcacagttcgtccactctccaggatccagatcgtgccgacgcacagttcgtcgtagtggacactggacacaaccaccacgccaccccacctctatctgcatgacatatgggcccacgatgtcgcggaccccacgcgccagcctctcctaacacgtcccccgagaaagccgtcgcctcctccccccttctccaagcccgagacgtccgagaaaaccacatcacacggccccacttgtcagcgacgccaaggtgggtcccacctttgccacttgtggcttcttctcgccgttcaaattttgaatccccacgcggccaccgctaattgaacggaacggaacggtttgctgcggagttcgcgtcgtcgtggacgaaaaagacaacggctaactccccctacccccaccacttctcctcctacttccattttgtctctcgccttggcttcttcttcttcctcctcgcgctgcccccacaggaggagtttgtgagctctctcagcgtcgatgggggcgtcggggaagtggatcaagtcgctggtgagcctcaaggcggcgccggaggggacgacgaaggggcggaggtggacccggctgtggcggagcagctcgtcggcgtcggcgtcggcgtcgaccgcgggggacgcgtcggagtcggcgtcgtcggaggccgacgcgttcagctcggtcgtcgccgccgtcgtccgcgcgccgcccagggacttccgcgtcatccgccaggagtgggccgccgtccgcgtccaggcggccttccgcgccttcttggtaagacacagatttttctgatgctgctcttgatgtggcgcggtggtggtgatgctgtgctttgcgtggtgtgtcaatggcgtgtggagttaggcgcggcgggcgttgaaggcgctgagaggcatcgtgcggctgcaggcgctggtgcgggggcggctggtgcggcggcagctcgccgtgacgctcaagtgcatgaacgcgctgctgcgggtgcaggagcgcgcgcgggagcggcgggcgcgctgctcggcggatggccgggactcgcaggacgcggtcggcgagcgcgacggccgcgccgacccgatcaaacaagcagaggtacatgggaacacagcctgacccgcgtgcttctcttacgattgatacgtgcagtgctatatccttcttgcgttaatttctgaatgcaaaaaattgcattggtggcgcttcctctgtgcagtggattaaagaatcgaaatacttgtgtagtggagtatatataaatggtaatctgcatgccatttctgcaaattcgatggcattgctccatttcttgggactttgggagtggaatttggtagagtcagattgaagtgtgccttccattttcctatatcggtatgtaagatgggcctctagctcaacactggtacgtctatggcccatgggctgtgtgagtgtgtggttgaattcactcccatgtaggctttaatattgcaactactccctccgtttcacaatgtaagtcattctaacatttctcacattcatattgatgtaacatcaatctagattcattaacatcaatatgaatgtgggaaatgctagaatgacttatattgtgaaaaaggaagtatttagaacaagatagagcttgcaccaatccaaatcaaagttataaagtaagattttgaattcagtcctcaaaatagttgtcttactgacatacaaaaatgatgtatttatttggagatcatttgaaggcttgaaaattgaaaattgttctttttagttaagttatactactaggtgttataatttgagaggtttgtactggtgccttaatttgattccttaagaagaaagtgatgtatgacttaatatggtgggggtacttttacctgaaaatgacttttcggactgataaggacaattaaggttccttttttagtaatgattgagtccattaagattgttgttttctctctcgtaatgacaacacatgtttgaatcgatcttggaagtgatcctgttaggtaagaagaggcaatgctgacaagaccgataacgccttttgcaattagttattgccaggcaaagttctaagctggaactgtgctggttcttttaaaaagtcctgaggccacacaggaatatattttttggtgttttaattagagagaaaaaaagcgaattttgctttaaaatgagatgtatatcgtattaacatgtcaaagattgtggcattgcaggaacaatggtgtgacagtcaaggatcggtttctgaagtaagatcgaaaatacacatgaggcatgatgctgtggctaagagggaaagggcaattgcttatgcgctttctcaccaggtatacttttgtatcattaagaggaactcttgcgctggacgacgcaagttgatataacatgctgctcacatccattttcctttcagcctaggagttcaaaacaaagtgcaaggccaagctctcctgctagatctctgaggaaccatgagtctaataggtgcaatcacgactggagctatattgaaggatggatggcaacaaagccttgggagagcaggctcatggagcaaagccatgctgaattgaagtgttccaagaacagtggcgaactgaacttagctggcgcccaactttcaaatgcaagctcagttaagatgagagggaacagggtggcagcaaagcctccttctgtactctcagcttcttcttcagacttcccgtgtgatgtgagctctgcatcgacatcgtcagcaactccagcaagatccgacggtggacatggtgaaggtccgagttacatgagcttgacgaagtctgcaaaagcaaggcagagctgcaacagtccattccagattcagagacagcgatctggaggcatgtcatcttacaaaagggttgcactctctccattagatgttcagagcaacgcctgttcagaattttcagtcacctccaggaagttaaacagtctgtctctgaaaggccgtagcatgacaaggagcttggacaaggagaatgacaatctgttctagcttgctgttctatggacaaattagctaatttgcatcttacatatatattatctgatccgttgttagcatttatacatccaagccaagctcaatgcctcattgcctctatcatgttttttgtatgcacaactgagattagtcattagttaaatgtctgaacctctttttatccctaaatgctgtgtagtagtattataaagagctgcagttctaattggagatggtgacagtttcttatgtttgaatatatatcaattatgaatgctagcttggggacaatgagaatgatgcaacgtttatcatcttccgtaaagatcacatgacatgccattgccgatcgtctgattgctcaaacaattgccataactctcgccgattggtcgctctcatcacaatcaccgggtaaacattttaggtttggtgcagcgatcgtccttgattggcttctttatttagtgtccttttgactaacgacgtgatcaattacaataatcctctcctcatttgcttttcaaaaaaaccctacgatttggtcatttgtaccagcatcagcgaccaatacgtggcgtcctgaaattaaaaggacgagagaaaaggattaaagaaaagaattcgaacacgacgagattgtgcagagcagcagcagctgcaactgtaccactccctggttggtcactgcacaagagagtgagagggacgtggtgaaagctatgccgaaaccgaccaccacattaaaccgcacatctaccaaaatccacgttttacatcagtgagagcactattttctgatgtcaaaaccagtctatgttggtttacagaaagccatcgaaagcagcccgtaaaaccaacgactttcggttaattcagtaagaagaagaatagctaaaaccgtttggtttttcataaactgcttctagcggttttatgaaaaccaagtgctttacaatcggtattaaaaaatatcatcaagtataaaaatgtttaatcgatgtcttaaacaaactatcttcggtttataagcgtaaattttgtccccttccgctacttcgatcacatgtctatggcttataatcgtacaactgccttttaagcagcaaatttaactatttgcctttgtcaaaaatattttttaaaactatttgcctctcttgttacaaagtgatatttgttgccactcaccctttcgaaatggcaaaagaaaaaaaagaagttaattacctccattcaagcaggctctctcggtctatctctacatatgctgaagcatgtttgtttagagaaaaaaaggggttaattatctccttttaagcatgcactctcggtttctctctaaatatgttgaagcatgtttttgtttcttaccgcagctggggttgttagtgtcactcacctgatagtaacttggccacccctcactttgtcgctaggaggaggaggaggcaattaattctggttgcgcaagcgacaccggcgcagacgtgccatcgtttcagcgacccaggagcggatggtccagggggggttagtgtggtacagtgccacgcatgccgttatccggagagaagaggaaagtgaattcttttattttcagaactttttttaactcttaatacttactacttgtctgctttgagttttttgtttaaaaaatttaatcattcgtcttattaaaaaaataaaattattatttattttatttatgacttactttattatttaagtattacttatcctttttatatttgtacacatttttcaaataaaacgaatgatcaaacgttgtaaggaaaaaatcaaaacgataactactataagacggaggtagtattttctagatttgtatctttttactaaaacaacgcgatcacatcggtttaaatggcgtgacaacgttattgacatcactctacaagccacgtcattttagctggtgtggcagaataaaatcgccacgtcctttgcgagtggcgtgatagtattattttgccacgtcaaatgttcagattttggaaatttttattttagatatttgttttcaaaatgaaaggtttcaaaaaaataataaaagaaacgaaaaatggagggagggttcagtggaccggagggaggagaggggcagaagaggcaggcgagattctcggagacagaccggtgagggggacaattcagagttacgggctttgaggacggggaggcgggggccccgcccccaccggcgtgtgcagcgccggtgattggcgtggcgtggcgtggcgtggcgcggtgtggtcaccgcgaaaatgacagcggcgacgagggggggggaggaggtggtggtggtggtgg

SEQ ID NO: 82670 - DNA, 40602 bp, Oryza sativa
ggcatggcatattcacaagtaggatgttcatcattgcatgcaattttatttgtaaacaaaacaatttcgcaattcgatcaacatgttcaaggaatagtgatgacttgccttgctcaggataatccttattattgatataatcttgatcaaccttcacctcctggaagttgcagacgttgcctcacgactaaccgatacacaaggtctataatacgcgagaaaaaccaatattcaaacaacaatcaaatatgcacaaacaaaatatatttgctgaggtcgaacctagggttgctcatattattcgcgcttgctaatggactctaatcaagctaagagctaaggtttcttagtctttctgttgtcatggtggttcagtctagctaatggctaaggaaggattatggttacacatgcatctatctaaatagaacggttatacactagaggttctgttgccggatggattttggatcggtcaaataattactgtgaatcatttgtattattattttattaatggaggctttattttaattatgtacatatttcacttgtcaaaataaattataaaaggttaacaattacccatgctttgtatgttggaattgtttaggttaatcatattatggttacggattatcccatcacctaattttacaatgaataatccaagtttacagttgatctgtaattatacgaggacaggatgtataactagtatttatctaatattcatgtttgtcatatactccctctaaattaatatatgcaacaagcaaattaatacgataccatatatctataacgggatgtacaatatatgcgtgcataatatcttaatatattgaatcatttatttgaatagtttctatttactgcttggttaactaagggttgctcaccttgcctactatatgctattttatgggatatgtcgttgattaatttcatataggtgatttaatcacactagctctgttattatttgccataaacaagcttatgaccgatctatgtgtatctatattttacttacctaacaattataaggctaactctatttaaataactaataagtcgtgggttttaattatatttggacatagattagtaaatggcactaatattttcctgtacacccattaatttgaaggattgattataactaatttatttagttgctacagtgacaagacatgttaaagataattatgccactgtacaatatccattttcgatttatacatcctaaactattttgcgggtataaatattttgttagcataagtttttaatttaatctacccgagcattatatccatataatagggtagaaattttctatcgcgagctaagtatcggacgaaatcctggaaatattgtacgaattaatttagtctatgactaaatgattaaatataatacaagggaaaaatccgaatttctaccgtgaattgattatttatagggattacccaaaaataatctataataatctataataattcatcttatttgtttagtaattaactacatctaaattattaccgcgaattgatttcttatagaaattgccaagaataatccataatttatattaaattttgcaattctacgactataattaatccataattaaattctaattattttaaatcttctaaacttccctaatcttcctctaatttctatttatttttttttccttctttttctctcctcttttctttcttttcttttctttttctctctttttctctcttttctctcctttctttttcctttctttctctcctctctctctttttccctttcttctctttctttcctccctcccggcttcttcctcccttcctctctctctctcggctcaggctacccggggcggcgacagcggcggaacgagggaaggggcggcggcttaccgacgacggcggcggcgacggcggcgcaaggcgaggcgacgctcggcacggcacacagcgcggtgtggcggcaccgagggcggcagcgcggcggcacgagggcggcagcgcagtggcacgagagcggcggtgcggtggagagggaagaggggaggaggagggaaatggagtgggggaaagtggagagggggtggggtatttatagggaagagggggagaaggagaggggaaagggcggcggcttaatggcgacgcgacagcggcgcacggggctcgggacgacggcgacgcgcgggcggcgacgcgatggccgcgcgggacggcgcgcggcagcacggggctcggggcttcgaaggcgcggcagcgcgaggggcgacggctcgcggcgcacggcgatggcgacgcgacggcgacggcgtgcggcgcggcacgatggcgacggcgatggcggctcggggctcaaggtgatggaatggcgatggcgcgacgagacggcgacagcgcggcagcggcggcacggggcgcaaggtgacgcgacgggcggcagtggcgacgcgacagcgggcggcgcggcgcggggtgcgatgacgcgacaacaacggtgatggcgacgcggcagcgacggcgatggcgcggcgtggcacggggctcggcgcgcggcgatggcgacagggcgacgcagggctcgagatgacggcgacatgacggacgcaacgcgcggcgtggggcgcatggcagcggcggcgcgcggcgcgaggcagagacggcgacggcaggcggcagagagagggggaaagaggagggctgggttaggggaccacgtcgagcacctagagtgcaatgaacagtgccattttctatttaacccgattttagtttatttcccatataaatttaattctataatttctaaatcttgcataaatgaagtttactcaatatttgtgttattctaaccaatggattcaccctagattaatattactcatattttatttttatataatttatttgagttttaattagggttaattcttattccatcgtacttaaatttaattgatccaaatatggtcgcgataatattttatttatttctatccacacctaatctttattttaatttgtatttactcctaagcatttgggtgaccatattaagtgttcaaatgtgaatttgcccaaaatttaatattgtccaatatttaaggtttattaaagattctataattttctaatgagaccgttattaacacaatagcacattagctcaatttatttatatgttagtttattttatatggagaggtttaatatatcaaatttcaatccctaaatgcaattagtaacttggtgcaatatcgatctacatatcgaattaaatactcccgtaattctattatatatacagagagctcagtttatttgaatgatcatcatttcatgtgtacacctattatggcacccacctacattatttaaatattttaatatttgataaaataggttaataataactttttcttttatttgattttaatatcttgtgcataattatttgtaggattaaatatattcccgtaaatcatatctattgcttaaatgtagttcttttctttattttcttggtgatcatttacggtttggcaagcaatagcaatcataacaaccagcatgatgcaaaagtttaaaaagttcgaaattttcgtgattttcattgtcttgaattttcaggatgttacagtcttcctcagatgattcataatcagagtcagtctcattgcaatcatcatcaccagaactttcaccttccctttcttcagtcccaccttggttctgaggattagtaggaggagggggctggtttggacccatatcaatgtacaaaccttcatcatcaacacccacatgctcatacattggatttgggttacaaaggtattcagtttcatcacaatagggttcagtagattggtgttcagcaaattgattgagtgtgccacttgttgcttcaactaagcttggacatgcaatagaaggggtgaatgggggttgagcagggttcacagtgctttgcttagaacaatcccaatcgggaatcacagaaggctcactacttgggctatgatacgcaacagtcaacaaacatgttcttatagccctatgttttgcaaacatttcaaccaaatcttggtcattgcaaactaggatgtgagatttagtctcagtgcagaaaaagaacaaactgactttgtcaccgtatttatgaggatacttctcgaccaaatcagcaagcaggtccctgaattgagtgcggtctgcatccaccacttggttcaacgaaaaccaccgcgcacgacaatttcgagcaacaatccggatttctaagttgaagctactgtctgggtccatcctacagatgaacaagtagcacgcaatcattaaaccctaacacggatcggaagcgcttggcactaagcatcaatgcatcatgggaggcaattggggcgaaatcagcgaaatcaaaggggaaagcaaagggggaagtaaagagggaagcaaagaactcactcgtctaggaaccaatccgagcggtcgtcggcgccgttccacaccatggctgctcctcccccttcctctggacgcattgtcttcccccttcctctcgatgcacggtcaaatccacgctcccatgcttctccaagcccccggatctgccgccgctagggtttccccgccacggagagaggggaattgagtgggaggaagagagagagagagcggacttcaccgcatcggtcaacggtaacccttatgccagcgactgaaagggcaagatggacaattttcctacccgggcccatatgtcggagctgtcaaacggctcaaccctaacagaatagcgacggaagggtgtgtagggcgcgataaagttcgacgatggcattctgggaggctcaaactttttagtggcacagatgcaggggccatcttttttaatggcacacaggtaaaaacctctgtttgaatgggcctaactctcaagaaagaaataaaaagaaataaaaacgcccgtagtggggaggggaaagcaaacaagccctagttccgccgatggagaggagcgccggcgaggaggttggccgtggcgtcgcttgcgattagggtggaggcgccggacagcaggagggtggaggcgccggacagcaggagggtggcgttccgatgggtacaatctgttgtctccgatgccggccaggagggcggcgttccgatgggtgggaggaggggcggtggtgaactggtgacgccggcgtcggccagaagggtggcgttccaacagaagatatcctagctgttccaggaagctcgcgagcactgcttctctcgcttctctctgatttcgagaagtatatgtcactcatctctacttctagttatctctatcgacatctgtacatcttctagttaccgaaatctgcacagattcaacaattttactctagacaatatatagagtaagaatggggaaatggtgtacctatctctatctgcactggttcatctcattaactaggatatatagaataagaatggggcgatgatgtttttacccaacttaatttggtgctcaatcatgattatgtcctcctttttcttactttgtgattttgtccctgtttttttttttttgcgaactgaagctaccttttgcccctagttcagacttatgataattacaaagtatatgcaatggttatttcagcgaaagacaatctttactaccatctctggtgccactgggcgacgttccgatgggtatgaggaggggcagtggtggcgctggcgctgaccaggagggcggcgttccgatgggtgggagtaggggcagtggcgatgccggcactaacaaggagcacggcgttccgatgggtgggaggaggggcagtggtggtgccggcgctgaccaggagggcggcattccgatgggtgggaggagtggcggtagtggtgccggcttcggcttggattgggtgtgggactggcgtaatcccaacaggtagaaaattcttccatcaacactgaaatgattattgttggtaccagtgaccaagcctgaaatgatatgattgattgcgcaggtctgtgccgccaccaccaacagaagatatcccagctgtcccaggaagctcaggagtactacctctctctaatctccagaggtatatatgtcactcatttctacttctagttatctctatcgacatatgtacatcttctagttaccactatctacgcagattcatctaatcaacaattttactctaacaatatatagagtaagaatggggcgatgttgtacctatctctatttgcacaggttcatctaatgaactaggttatatagaataagaatggggcgatgatgtttttacccaacataatttggtgctcaatcatgattatgtcctcctttttcttactttgtgattttgtccctgttttttttcaaatcgaagctaccttttgcccctagttcagacttatgttaattacgaagtactatatgaaatgtttattatcggtaccaacgacctgacctgaaatgattgattgcagcaaaagacaatatttagtatcatctctgatgctgctatcatctctgcctctctctgatctccagaggtatatatgtcactcatctctacttctagttatctctatcaacatctgtacatcttctagttaccactatctgcacagattcatctaataaactatcgtcctaacactatcgtagggtaagaacactaacaccctaacaagaataggagtccaatttcttttttttctttttgtaatttacactccctcgttgtatggtgtttagacaacaaatacatgcaatgcgcaccaagttatcaagttttaaaaataaggaaaaggattagttaattaattatgtgtatagttatttttcttttgtgcacacctatagtttcattggtgtgtatacttatagctttgcatttggttagtctaacattttaaaattctgttcaaattaggcattctgagaaattatctgatacacatggatcagataaggaagatgaagtggtggattcttcagacgatgattgtgatccatattttaactatttggttgatagctttatgactgcaactaaagctcaaccaaaacagttgtatggcaatattgatcttgttgcagctgcacaacgtcagtctaatgagtatgcaagtagtgctttggattactataacaaggatgaaaacaataaggtaaaattttgttccccttgattgatttgagatgatggttcgcgtacgtggatgcttaaattaaatctctgtctaattaaaattatatgtttacactatattaatacttggtccttagattatacactaatgtgatattgtaaccttatagtgattttaaatggtggtgtcacatatacggatgcttaattagatgagtggttttaaacttctagctaactaagatgctatattgcactatatcatcctcggacctcaatatatactctaggttataatagcattgtattgatactaggttgttgatgtgtgagagagaaaaagagattttctcgataaaaaaggttttaagaggagattttgatatatttgtttaatatatatgtcatgtagctaaaatcatcctatttatatgcaaaattataccagtttgcccaccttaggagaccatatcctaaagttagatgtctggtttcaaattttgtggtgctagatggacttccactttaggtgggtatattgactgtttccctttttaacatttgtactaaaatgtcttgctcgtttcacaagtatttgattcattttttgttatttgcaatgtgttagattcaatacagcttaatcaaagccttaaaaagcagtacaattagagagaagggtgagaaatatggacatgtcaacttcatagcatctttagattcaaaggaagagctatttttcgccgaagtttgttgggatcccaagaactatgatatggtgccgacctgcattgtatctcttgaggagaaaaggagaattggttagtatggaatcactggttaaagttctttgaaccatgtaattattatgttcctaatcctaattctgttaataacagggggacgctcctttattaatgacgagtatgtggtgtgtctggatctccaaaatccgcctatagatggcaagcactgctatggatgtagcgaagagattaagcacccagaagatggatctacgtttaaggccgggcatgtagccgccaccggtttttatgattctttcatgtagctgccatcagttactattctttcttccgagtttgtataaaagctcaactaatctacccttaacagctgtttttactgttctatttattttgcatcttgtctacactagcagacttattttgtggctatgaatggatgaatatgctgcgttatgtatacagagttgaggtgaaagctttgaatggattacgatattataaatcatacaatatcatattactaaaaaaagatccatcccgttcattatgaaagaaacaaaaattttccatgggacatggactatggtgaaaatctgacaaaaaatcacgtgataatgttgggtttagttcacactaaaattgaaaatttgattgaaattggaacgatgtgatggaaaagttgaaagtttatgtgtgtagaaaagttttgatgggatgaaaaagttagaaatttaaagaaaaactttggaactaaacacggccatcatcatggtttcatgcgtttgatttctggaagtctgaactcattaagaacgcggttatttatattaggataaagcaccagagatttgttagccctgtcgctcgagttcatccgcgtatgcttagccgcgtgctgtcgcgtgtcgccatcgctgcgccatcggagaaggaaacaaacactgattaaattaaattaaacactgagaaaattcctccccaacttcttctcgcaaaccacctcttttatatacctcccaattcacaactctgaacatcacaaattcatttcacaagttcagagctccctgaacctgaaatctgttcgaaacagaggccctctcaaaattctcaatctgccaccgcatcaacgaggtggggcccagcctccgtgacgtcacgacactgacttggtgggcccacctatcaggcctgtccacgttgaccacatcgcgtcacaccgtccacgacttttttttttcccctgattccctcgcagccagggcaccactccttctagaggaaaaggatcgattttttttcttccccaatttcttcctggtgctcacctcctcctcccccgggatcttccagaagcttccagaactgaccttggtaaagaatctttctctctctggctttcttggtggaggcttggtttctctgttggtttctcctggtgtgattggaggttggcgtttgcaggtgcgggcgagatccaaggaggagggtttcctgccatggtgaaggataccgcgtactacgacaccctgggggtcagcgtggacgcctcccccgccgagatcaagaaggcctattacctcaaggtgaattcctttttgcgcctttgatttcttcatctttttttttcttgattgattgatttcgtgtgtcgtcatcaatgtagaattgcagatagctattggcctattgagctaatcttcgtgtgccaaattgatttttttttaatctctcttccaggcgaagcaggtgcatccggacaagaatcctgggaaccccgatgcggcgcagaaatttcaggtagttttttttttctttttctcccgtgccttctgttgatatctgtgattctgtgctagtaatttgatttgttggatttgattgtggaatgaaaagtaagactacgtgttcacaaaaacatgttttttctttatgaattggaatagtttactgcaagtgtcaaagctatgctatagctagaagaatgtgaataggctggagtttgcttgatttttaccaagtgatatcagatttttgcaatgcagcgcctgtgttacttgttaagaggcatagttttatcgtcggagatgccatgattttcagtatgagcatcttctgggtgttaagaggcagagttttatcgacagagatgccagtatgttttttgagcggaatgtttggttgtttggtgtatatacattgaagctattgtgttgattgtctattcggcatcaaatgcctgcttaaattatttccctctatgaattattgaattaaatagcttgatgttaacaggaactcggagaggcataccaagttttaagcgatccttcaaaaagggaggcttatgataagcatggaaaggaggggcttcctcagtaagtcacgaattttttttatgtctggtaaacaatgggtgttcttctcaaaagataaaagggtggcaactaaaaaactgtttaatctttaatctgaacaagtgtgctgagaatatagagcgggccaatttggtaaattaattgcacagtgcaacaagaaaattggagtgtattcaaatgacctgtcaatttctatgggttgatacttggtagatcactatttccttagctataaaagcacatctgtttaaaggaaaaggagacttctctaggcacgttatgaaattcaaacagtcagttatggaacacaatattttcagttaagatgatatttatagttcaatagaaactaaagaaattatgcgttgtgctgtaccctttaagttggcgtcttacacattttacacggcatttcagggataacatggtggatcctgctgctgtctttgggatgctttttggaagtgactattttgaagattatgttggacagcttgcactggcatccatagcatcagtggaagtcgaggaaaacttaaacagtcaagaagcaagagggaaggttcaagagaaaattaaagtatgttactctcgaagttccctactgttttgcttaaatagtttcattaaagttagcattccacttaggctctaggatgctgagacacaaattaaaactaaagcttcctgtgtgacaggagttacaaaaagaaagagaacagaagcttattcagagcctaaaagatcgacttcaaccatttgtggatgagagaaaggatgaatttgttaactgggcaaatggggaagctcagcggttatcccatgcaggtacatcatgtgattgtgtactactttgtttttatttgagagggctatatgctttctgcagtcacttttactttgtttgataaatcagttgctttcaccagcagattggcaaattggatatgattacatccacatagacatagattttgtggggtcttaattttaaaacaaattgtatagaactcatcgttgcacgttccctaattcactttattcatacgagtattttaccattggcttatcaaatgaatatttttcagcttttggcgaggctatgctcaccactattggctatatttatgtgcgacaagcagcgagagaacttggaaagagtaagttgtatatgggtgtaccattcatagctgagtgggtcagagacaagggccactgcattaaatcacaggttaatgccgcctcaggtacaccccgagacactgttttgtttctggtgcaatatacgattcaagtactccttgataattagctcctgttgcaggcgctatcgctctgatgcagctacaagaagggatgaaaaagatggaggaaagtgacaataaggaggaccagattatgaagagtttcgaggagaaaaaagatgccatgcttagttacctatggaaaattaatgtggttgatattgagtcaacacttacacatgtttgccaagcagtaagtttttgcgtatccttgttagtggaagaaggcttgcatagtaacaattatgcactgtgcacgtcaaagaagaaagaactaaaaacatatgagttacttttgtgtaatcttctaccttacaggttttgaaagacgccagtgtcccaaaagatgttctgaagttacgagcaagagcattgaaaaagcttgggacgatattccaggtaagcttatgttaacgccttctgcctgtttcaaccaagtactcatggaaaaaccacatcagatctgcaaatgtcctttgtcttatactcttatgcatggccatggatggacgattggccaatatgcttactctctatgtaaccgtgcatcaaaccaaacagccaaaaacgaaccattgttgattcactgtttcaatattattgatcatcagttgaagttttgcgcatgaaccatcatagatgatcagttatgcataaaagacctctaatcaactagttccaatatataagttatgcatatgtgagtcttacctcatatatatcgtactaaaacaatagaagcagtggattaatccagatttcatacttgtagtgtctttcctgttgcagtatctttgcgtgcagctcatgtgttcttgttttgtagcatcttatctcgagtgagtttgatagcagtgcataggtgacagagcacacgatgattatattcacatgggttgtttttcaatgtaaaaatcagggtgcgaagtctctgtaccatcgtgaaaacagcctacaggtggaaaccagcccacggcagggagcagcaacatcgaactgaagactgcaaaagtacaaaaaggaaaaaaaaaagtacacctgacagacgcaatttctggttttttggaggtgtcgtctctcgtgtccgtttattcatttttgtaagattttagacgacgcgtatcgttctggataaaatttgctgtttgatttggtctccgttttctttgtaaaaatggtgatgctgtcgtgagctctgaacacgaagattttgttggtgctctgcaacctgcatattactagcttgggctatctcgttgtaagatttgcacccttttgttttgtctttcaagctggatgatctcgtgtgtgatgatgccgccatggcacctggcagtgtcatccatctggccacgagaccacgtgtggcatcgtgaataagctaaacaccatatttaaatttttatatacatgtttctagtgatctaaaaacaaaagctgaaaaataaattttgaagaaaacactaaaatcaacttcaagttcaaggctgaaaatttaaattttacttagctgataaatataagtataagtaaaaagacggggcctcacgacggagcatgagctgacctcacggtgccaagctcatgctctcgcggtgccaagttgtcgcgcactttagtgcttgccagtaagctaaacctcacctccgtacccaaagtatatatccaccaccattttcttgtggctcctgatcacaaagacaaaccataataaccatatataatcacaaaacacaaatagtgtagtcgtattaattagacagcacatgagcggagcccctcccctggctggctttgatcatactaaatattaatcagctgcctttccgctcacttggctggcttaattgctcacatgttgcccgcaaaagtaggcccgatcggcgcggcttaactccaccgctcgctcgctcgctcgcgttcgcagtcgcacgcacgctcgcctcgcctcctctcgcgttgtgtttgtgtgtcgcgcgcgacgctcgctcggttcgtttcgcctcgacacgcgatttgatgcgcgcgcggtaggattcgccggcttttcatccgcgtgcacaccgttcacgttggtttttttctcgcgcggagatcgactgcactcaacgcagcaacactgtggcgggcgcccggggggggggggggtggcgtgatttccgtgtactttgatcccttcgtttcaaaactggagtatgatgaaactagacatgtcttacgtgctgattcttaatccaaggatgagtccaatcttattctggagtattttagaatggttacgtactggtacctctttattcaacgtttggccatccatcttatttaaaatagattagtaaaaaaattagtacatataaatcattattcatattttatcatctaataacaataaaaataataatcatatttttttaaataagacggacgatcaaaagttggacataaaaaataaaaaagtgtcgtctttctaatacggagggactagttttgtcaccatcatcgtcttcgatactgtgtcctggtatgtacgcgttggcccgtctgccgaaagagacctatattttgcaaagaggattccacgagaagccaatgccgcaatggagcccttcatcataaatgaggccatgaacggtcacggacgcatggatgtaattaattaattaattaattaattaattaattaattttagttgcacgctaccataattgggtcctgtttggttccatgggctaatgtttagccctcaccttttagcctcaaattagcccttaagaatccaaacatgtggactaattttgagctaatatgaattagcctctctcaaaacattagcccctccaaggggtgctaatggggctaattttgtatggggaccatcaacaagtagctctctctcctctctttctactctctctctaccttttagccttgaattagcccatggatccaaacataccactctaggctaatgtttagcctactaattcatgactaaacattagctctcaaaattagccctgggctaatctttcaaacagggccctggtagtttcacaaggaaacgctaaattgcaagattagcctagctagcattagcatggcattgcattggcaatttggcatggacagttttaatcttcctttctttagctgggccacacgtagtactactatttttcaagatggtataagcaaatatatatatgctatgctagcttcctctctccgttttcgtgaaacacaaatcaagggaaaaaaggctaaaagcgtgacagcaacctgtgctgcgagctaaggttttgatgatgtagtaattgattagttcatcacacggcggaggaggacaaaaaatcaacaaaaaagtacatgtgctttctcagtgacgtgcagaaattagtagcacaaagcatgatggaggagacgactatttttctctcaaaaaaaataatattattattatagtgcacaatgttctcgtgtgtatagtagtaatgtctcttattctaaccaaccagaaaaacagtatacattttctcaaaaaaaaaaagaaaaaagaaacagtgtgagtagagtccgggctagagaaaattaacatgtagtagtagtaataataataataacaatcctaatcttccaatggttctttatcctgtacgtgtagaatatactgtagtgtggtaaaaaaaaggagtggtaaaaattaattgatcagaagtattccaagttgaagtcgaattgagccaagctctgctcatggcatggtagcgagaacttgtgctccagcgtggcgtcgtcttccacctgatactcgccgccatagccactgtgctgctgctccatgtcggcgaagggctctgccttggcggcggcgtcggcgccggccgaggcggcccagttgagcacctcgctgtcgagcacattgctcacctcggcgcaggtccagttgctgctgttgctggagctctcgccgtagcccaggttctccgacacgtcgagcacgctgctgtagtcggcgacgaacccggcgccgtcgtcggggtgggagccgtacagcgccgccgccatgttcgccgcgccgaggtcgaagccggcgccgaagtcggtcaccgggaacgggtcgaacaccgactgcttggcgttcgcggcgaggccgtcggcggcggcggcggcggcggcggcgccgtggggcttgtgatcctcatccacctgggtgaccgccgactccgaggacgtcgccgccgcggcggcggcggcgatgggcttgtgcgtggccgggtcgaggccgcgttgccggagcttcttcttgaggcagctgttccagaagttcttgatctcgttgtccgtcctccccggcaagtgcgacgcgatctgcgaccacctgcaccacaccattattccccctcaaatcctttatccctccgaccaacctccatggctgccgccattgcaagaaagcaagcaagctccgaaacggcaatgcagaatccaagacatgaaaccgacctgttcccgaggatctcgtgcagcgcgacgatgaggtcctcctcctgctgcgagaagctcccgcgcttcaggtctggcctgaggtagttgatccaccgcagcctgcagctcttgccgcatcgctgcaaccctgcacgacccaaaaaaccaaaattagcccaatcaagctcgccaaatcggcaatggcgatcgatcgatcgatcgaacagttggtgtctcatttgaattgcgtgcgttcttgcttgcctgcgagcttggggacggagctccagcagccgacgccatgtcggatgatgtgattgtacagcttatcgtcttcctcgggagaccaaagccccttcctcagcttcgcctgcacgccgccgcacgacgacagccgtcccattcctccccctccctgcctctacctctagatcgatgtccacaacctacgtagctaccaccaccaccacctcgccgccgccgacgacgacaacgaacactagccgctcgccacgacgtcgatcgatggtcgatcagcctctataacccttctcctcactggctatatcgatcaaccgttgcccggtggtggtcgggtatatatggggaagcttgccaagaactcctgcaacttcagttagagagagacacagagacagcgagctagagagagagaataggtgtttgtgtggtgtggtgaggtgaggcagcgatcaagtggtttctaagcaagctgccactcccctctcgagctcgctggattagagctcaagatacctccatctcgctggataaaaatactgctagttcgcgccaaagagcctcacttaatttctctctctaattacagtgttagttagagatcagagagagagacagagagatttagtttccattttctttttctttttttttttgcctaagattgatttctgctttggacagcaatataatatactaatccagctagtacagttaagagagagactaaacactggttaatggcaagtgtaactgtaagccatcaatgagctcgatcggggacctgtgcagagaatcgcgatgtggtacggagaaaaatcgcgtcagatcatcgcgttttacttgtccaacttgatcaccccctgaaaacgcccgtcgtgacatgatcgaactgactgggaatcactgtgtttactactactgatgacagtaatcagctcacggccactcgctgatcttgagagagataattaatttaattaattgattaatcaaattaaagtcactaatctcactgatcgtttgatggatgtggcggagcgcaggtgctgtattagttgatggaagaaaagcggacacacggtaacgatcggattacagtggcgaagaatgaaaaatggagggaaaattggaattttagacgattttgctttttatgtttctctagcatttcattttttgtttaaatcagtgttctaattatgttttttttcctagcatgatccctttgatttaggcgttgggttacgtgagcatgacaactctataacaagctttgtgatcatgttcatctttttggtacggtcttaagtaatcaaggcggatgccctcttatatatacgtacctttatatctccagcttgccacaaatagttttttttagaaacaaaatagttatatattttaaaaaatatataaatacggagtatactggcatctgataaaaataaatctaaactctatctacaaagtaagaggcagagaaggcaaataccgtagtaaatagttcatgtaacaatctgtagattttttttatctgaatgtgtaggcttaatttaaacttcagaatttttttaggaaatttaagccttgaatcttagtagatagaacatatacttcctccgtttcacaatgtaagtcattctaacatttcccacattcatattgatgctaatggatctagataaatatatatgtctagattcattagcatcaatatgaatgtggaaaatgctataatgacttacattgtgaaacggagggagtatatgatactggcatcatcgcttttcatactattttattttttaaaggagggcaaaaacctttttttttgtgacttttacatagggtaaacttttttatatcttatttacttaaaaacatatcgggagtaatcgtattctctaatgttaaacttgatacccgagatatcaaatctatgaccgtaaaatttctcttatacatatggtttaagaaaacgaggaaaatatcctcttaacacgtgaaaacactctccccatctctacttaaaacagaaatatcaaatatggtacaaccacaaaagtagcccgacctatgtagtgtatcaccgatcacctcaagcaacataagtttacacatccctgttgaaattttcttttaacataaaatttagtaccgttgatttccgtggccgtgccttgccctgccgaccttggtgtgcccatcgggctgtctcgtccgcgcgtcaatacaaatacgccacatttttccatcctcggacgcggtcaagtagcaattaaccccgctgatcgctgtctcgccgcgtcaccccccctcctttcccgccgacaggtggagccaccctgccatgccaagccatattttataacgtttgcgttaaatatgtgtaaaatgtattataaattaaaacttaaagatgataatagatatagtgtgtctggtatttacgatccttaatccagccagctgatcgagtatcgtaaatacacagacgcactataattacgctaaatcaaaagtaagcttttcgtaatcggtatctcaggatgtagatctcggctaaacctgcctaacctataacgtgtctcttatggtgttctttcgtgtttagttaccgtcggttttataacaactttcgagaaggacgagcgctcacttgctcgtgtgcgcgcacgcgcgcttagattagatagtacgtcgcgcgcctggacactgctccaggctgcgtaggcgatcgttttctgtttgcgtcgtggaggcacgcggcgacgacggcgacggatttaacgtcttgcctgctcacaccacagctgatcaaatctccagtagtaatcagcagtggaaatgatcgatatgacgcgcgatttgggagatcgaccagaaaccaatgggcgatcgagctgtgtctgaattctgatcagctgttcattctctgagcattacccttgctgtcttttataatctgtcgtaccgacagagaaaaaatatccctggcttattgccgtgttcagagaaggaattaattcaaacacatgtcgatggaattgtatgtaaattcaggctttggcgcacgtcctcgcgattgtccaggagtatgttccaaaatatattacttttaatcttaggtagattgaagtattaaaaaagttgatagaaataattggaaaaatactatcattgattgagaaaaagaaatgggtgagttaattaaatggagaatggttgttgagaggaagggatagatagaatagtttcagtcggggacaagctaaatgtgttagaaatagttatattttagaacgtaaaaagtactactgtaacaaatgatgagaaagtaaaatgaagaaaaagatgtgatgagaaagcaacgtgcgtacctgctgtcctgctgtaaattgcaatcatttttgggggatcagaaaaaggaaaacatcgatcgtcgacagcagcgtgtccacagatacggcgttcagttttttcaacccccttttgatttttcaaaggcccagttgttcgttttgttcttgttcgtcggtagcttatgtggcacagcaccaaattctgaccttaccacgatgatgccgtgtaaatcgtgttactcttgttccctttttttttaacaaaaaggtaaaccgtgttaaaaaaaacaaataaggggggtgtttagatcgaggggtgtaaagttttggcgtgtcacatcagatattatatagggtgttgcattgggtgttcgggcattaataaaaaaactaattatagaatccgtcagtaaaccacgagatgaatttattaagactaattaatttatcattagcgaatgtttactatagcaccacattgtcaaatcgtgaagcaattaggcttaaaagattcgtctcacaaattagtctcaattaatctatgcaattagttattttttagccatatttaatacttcatgcagatgttcaaccgttcgatgtgacatggtgtacaatttttgggtgggatccaaacaccctctaatattactcgatcgtagtatagtatatatagcatcgtttgatttttgtcgtgtaacctgctgtcacaaggttgtctgcagacgaaatcaagaaacaaaagcgatagaagcctgagagttactgaagaaaaagggtgagaattacacaatgtttactttggattcagagcaaaagggatgggaggacagaaggacagcaaattgggcagagagggaccagagatagtagcagggaagaataaagaacaaaggcaccatgatccttgtacttgaagggaaaaggagattttgtatacagatgttgcacgaggctgtgatcatcatcagataactcgacaagaggagtagatggatagaacaaaagaaagcaaacagacaagaaggaaaaaaaaaaaggtacaaggagtcgcctgtacggcatggtatatgtgtctgtagcttcaaatgtgatcgattctccaatcatccagcttctgatcgacggcgccaccagaaagtgttctgcacaaatcaaagtccaaaacatcacgttttgatgaagcattttcaactaggaatctcgaaatgcaattcatttgtttctttctttatttttatttttatttttcattcaggggaaagagcagagtaacacgccattgctgctttgcaatgcccacatgttgatcgagatctgcaattatcagcagccgtaccacacgctgtctccccacaatttctctctctcagcaaccgtttcaacacagggtcaaccgcgcaataatcagaacctgtgttcatcttttgaatttcgagtaaattgatgcacgagttgcacggccctgataatgcatctaggtgtagctagagctatgatgacttgaattgcaatgttgcattgttacagttggatttctgttgttagctccgatccacggccggctggttggtgagatgaggaggacggacactgtcactctgtcagtctgttacagtgatcatcatcagatgtaccacttaccttctacctctactagagagtgtcgacaggaagtaggagtactaattaagaacacgttctaaagagttaattgagcttaagtacttatttttcattagcattcttttttaattgctaaattgtatgtttcgtacgaaatctttttatatagaaagtacatttaaaaatgcaaataagtctatttttaaaagaaagttaataattaatagtaattaatcatatgctaaacatgtttctcaattagcgtgtacctattcagtcaaaactatactccgaaaagaaagtgccctaattaagggtctgtttgtcacagctcaaactccaactccaccttttcagcactagtgcacaatcaaacaattttagctccacgttaaaaaaattagtgtagcgaaataaagtgctctcacaaaataagtacttgtttggtttgctactatgtcaaaatattgcaataccaaaccataggcaaattttggtactaccaaatattttgacaacttatgcgtcatcttattggcatattttgatagcaaatcaaacactagtcaaactactattcaaaatacatggtagggcacattttggcatcaaaccaaaatggctctaaactagtagaaggatgaagttggatttaggttactttataactctatttcagaactaacttaaattcacgaattaggatactcccaaattggccatatttgtacgtatgtacgtagcttgcgggataacggcaaatgatagcgtctactcgctagcactacaccgagagcgagtgagagatcgatcgagtaggtgatggatgacttgcaaatgctacaaccacaagccaaggttggaagagagaggaaaacggaagccgtgcggctagctagcgtgagttggggaaagctagctaaaccaatttctagcctggctcgcccgcgtactcgcgcccgcgcgcgcgcgttcggtggcgtgtcgccgtcgcgcccgcgcgcgcgctgcatgcggacgatgcgtccatccatccatccatgcaaccggcgcgcgcgcgcggcgacggcgctggcatcatgccgccatcggcgagggtcgccgtcgtcgcttcgatcgaggctggtccaagaatcgatcgatcgaacggcagaagagaatgcaggagtagctagctagctaagctgatgacaactgtagctgctgcatgagctacgcggatgtgagtgatcagctttgttcgttgcctctacttcccagcttgcctctcgtttttcgcgcgcacgtttttcaatctgctaaatattgtattttttataaaaagcttatatacgaaagttgcttaaaaaattatattgatatattttttaaaaaaaactaatactttctctgtttcataatgtaagtcattctagcattttttacatccatattgatattaatgaatctagatagatatatatgtctaaattcattagcatcaatatgaatgtgaaaaatgctaaaataacttatattgtgaaacgaaggaagtacttaattaattatgcgctaatggaccgcttcgttttcgtgtgcgggacatgggttccaacccaggctgccgagtccagtgtagctggatggtgaggcggcaggctacgtaggcgtacgcgcaccgccggttcggtggcctggccgcgcaagccgcggcgagccttgcgtttacgcgatcgtcgatcgtcgtgtacaatgtacctagatcgagctagccctgcgtatgttcgtgcgagcatgagactgacagtcatgtgatcgatcgatctcaatcctcaggggaaatgatcaggggttcgatcgattcgtgttaaatttcggactcgtcaggcgacgctgataggatcagttggtactattggtgactagctacctggtcctctctcttttttctaagaaaaaatgattttattgtttgagaagataattaatgagagagatcgcgatttgtggtgttaattatggtacatatatattgagcattctaacatcaccaagggaaaaacattaaaaaaattgtcggataaacactgtaacactaaggtaataagaatgtaatagaaatatattgagtttcagactcatcagacgctgataggattagtttggtcttattggtgactagctacttggtcctctcctctctttttttttttacaaaaaaaagtgattttatgattcttacatattgagagatataatttctggtgttaattatggtacaccttgagcattgaagcatctacagaaaaagcattgtaacactaataaaaaataatagaaaaatcggtactatccctcctgtcaataatatttgatgttaggatagggagtatctttcagtgcgactgtaaaaaatatattaaaaaaatatctcctgtatttttcgttttgtccttcttttaaggaaagtcgtttcggccctttgacagtgcagtttgctcaatctcagacactgcagcaagcaacaaaattcaggataatcgacaactcgcgatatgcatccatgagtgaagtgaacagaggcattaacaaacacctctcagctgcaagcattttgttgtcaaataaggacagagagccagttacccatcacacatacgtactatcagggacaaaattaagctcgtaggttgtagggttgtatcttgtcctgttcttttggcaaagtttcaagctacttcaccaaggtaggagcgatttcattttccaatcaaagcttcaaattcagagcggttacaaaaacaaaaacagtggccattttcaaaccaaccaaaaaggcacgaggagactgggactggtgctgcagaaaaggtatcgtaaactaatcatctcgtccgaattcataagttgtcggttactgatcgattggtgcttctactcattcacaaaatgcatcactcctcacacatgcatctcgagtgtgctcgacctaattttcagatgtagactgaacatgatttcagaattcagtgctctagcttagctccaatactcccaacagtaataccagtaggagttaagtagtactcacatgttgggtttttcaatcagttcataaacccatcaaattaagatgtcatggaaaaaaatttcagacgtacgtcagtcgttaatttctagtcccatcacaataccagtataatctgttgactaataaggctgtgtgtgtatatgtaccttttgttctctccatttctttaagaaaactccatgcagtttggtactggctaccacagtgtggtacattcagtattgcagacaacaagtggacgaagaacacgagaccagggtatattataagcttataattaccagtgtgactaatacaaggtcgtaggtcgtgtatatgcagagaattatattgcagattccataacacgtagagtggccaatcgattagcttctacaagtgcatgtccctattgatggacaaaaagatccagccaagaatcttacatgagacctgatcttgacttgcctcctctagaaaggaaagggaaagtgaaaagcagctaagagagaaagaaaagaaaagaaagcacaggaaagaagcatgcatcatgctggctcctctttgaagttatgcaaacccaaagctagctagctaaactaaacacaaaaggaaattttatataaaaaaaacattagcatgtagtagtgttaattattacatatcggattcagaatcatataaaactataaattggagtagccacatgttgattgtttagtcattgcgacgtcgccagaggagaggaggttggtgtgtgcagtgctatgccgttaccatcacaacagatagcgtgatgtgcacttgccttgcatgagtaacctgcatgattaagctgttcggtacaatggccggagagctagtagacagtggtgtttattgatttaattatattcaagccatgcatgcaaaccaaactgtgcactaattaagcaccccctcacctaatttaggctgctcttttttcttagtagggctaccactgtttcctctgtcatcaatcctttctcttgcttgtttatttacagcaaactgattagaaaattgattggactggttaaggtaggtaatcatagtagctagtgaattatctgatgtcacaagaaagtttgggaacaaaatgaacactgtagttaacattgtgcctagctagctttgcttgttttcttctgcttttaggcatgcatattgtgttttgggtgctgatcataaagctttctcttgccctgttagcaagatcagtttttttattcaacaaccattgagtaatctagaaagggaatcaattagtgtgtgatgagcttaccgactaataattcagttgattgattttccaacagctgaatacaggtgctgactgaagtttcacagaatcttcttattacccatcttgattcctgtactcaaaatgattttgtgaaactgaacattcagaatatttgtactattgtactgtactgaatttgacattgagcctctagttcattacaagtacagcttaggtgtaagatggtaccataatgtgaatcgcaagcaaccactattggaggatcctgcatatctttatctgctggttaagcaacgatatatattggttgaactgagctcaacatcagcagtataagaaatcaatcagcaaacgaagtttttattaaaaaaaagaataatagcaaaaaggttctgaacattgtggcttctgacaacctttgctactctgctccatcatcttcatgtgttgaagcttttttttcttgtttgttttaaaactactagaagctttacatttcttgcattgcatatatagggcatatatactcacttgtttccttcaaaaaaagtccatacactttgtgagttgtccctctctcttggtcactgatctttaatttctcaagtgatatttttgttggtgatcagaagatgccacctctaatccaagtttccatcatgcatgtcacaaagtaaaggcacaatggcaattaagccatcgcaaccaccttagataatcttatcaaataatcaatcctatctcgtccacacacatagccaagtaatattctagcactgtaaggtgcaaggaaatcttgcatgacatagttgcttcccatgaaatctttctctgacattgaccttaaacattttcttatcattcatggcaacctctgtgcatgcatgactactctgtcaaattaattccccttatcaaagccgttgctgtcctctgcttagtactcctactacaactgacaaccagcaaggtctgtactagatgactcagctacactgaattaagtgccaaaaacatcactgcgtagcagttgcatgttacatcagatacatgagtagggatgatagattgacgaactgatcaacacagcaaatcaagcccttgtttcaagcagccaagcatgcataccaaatgataatgatattatctccatggaagatgaaactgcaaccgcatatatatatatatatatatatatgcagattactatcatgcaaattggcatgcttgcagaataatctgcagcaagatatactagcaaattgtgcatggacagggatagatgttccctgcttgcaattgcaaagtcgctggcggcagcacacaagaaagctaaagagagaagaaaatgttcagagagaaaatattcggaataacgaccacgactgccaccaccaccatgcgtcgttttctctgcatgggatcgatggacgacgtcaatggcgggaagcttcttcccgcccttttgacatacgtggcaccggtccatgggccccacgtggcattttcgggaggtttgaccagcgaattcaagtgtcggcaccaacaacgagcgtcgtctgcattagctgcagagagcctgcaacctcgtgagtgaaaaggcagtgcaaaacgcatagaaattatgtgtgctgctttgctttgctttgctttgcttttgcatgcgatcgatcgtgctcgtcagctgtaacgctaatcgacaattgcacagtgacgcattgttcatggatataatcccatgtctgcatgtgaaaaatcccatgaatatatcacatgtaagattgttcataagggacaaggtgtcggattcggagcatgtacgcactaaacagcacgggaattaagatcgatcagttcgatgaatcaaactgtttctgccggaataatccagcggccggagaacagcaaagtgaatgggaagtttggacttattttttttaccgggggcttgtgcattgtgattgatctctatccgtcttaaattgggtggtgttcttggtgatcaagaatgcatgcatgcgttcctgtgctagctgctccgatcgatcgatcaatcaatcaaatctggatggacgtggtgaggaaaatgatgaacaccgtaccgaactgatcccaaccagtggtaaacggtagtaacgcagcggcattggttgcaaatcgtggtcggggccgtgcatccaattgacttaagggggcacgtaattgtatgattagctttgctgattcgtgacctctgaaaaagattactccttcctatacgtgaggtaatttcgacgcctgaatctgtgtaggatacattcacagagagagagagagatcgatcgatgagcaggataaattttgcggtgttgttcactgcagactgacttggtcccgtgtctacgcaccattgaaatatgggggctagatattcacaacatggagctcacgatgatcgcgctccgtgctagatggctctgggctcagcgggcctcccaatccttgtcctggtaggagccagtggcggatctaggatttatgtgatgggtattcggaattctaaaatagcagatatatcgataccgattgacgcattgactgtacgatacatcattttgatgcataatctttactacgaactatgcacatatataataaaatatatagaaacatttacaatttcctataatcagcatcaaacaattttctattgatctaagtatgagtgaagagtaccaaagaattcggaatttttggagattgtatagcataggtggacagctttatgtagcaaagatattctgatttattgctaatgaaggaaaacactcataaaaccacgaagaaactagtagctagcaaagaaatataacttatttccgtaggacaattgatatcaattagacaacaacatgtagagaaaaacaactgagtgggcaatatatagatgtatatacaatttgcaaagataactattccctctgtttcataatgtaagactttctagcattgtccacattcatatagatgttaacgaatctagacataaagtcttacattatgaaacggaggaagtgggcattaaagtaattgcttattaattgccacaaccaaaatgtaaacaagaaaatcaaattagcatgaatatattacaaaagaaagggagggactaggaagactattgatcttgttgggctgaggagagctagaaaagggtggaattgaattgttagggtataaatatcacaaatctagatagactatggtggtacatatatattatggtcaatatatattaggtttgtgtccaaaattcatgggtattcaactgaatacccatgaattacgtgggatccgcccctggtaggagcttcaaatcccatgttctaggcaatagcgcgagtttgttgccgcttccatgacttgtgttcttggtgatagcaaatatattctcttctaggaggagagatggctacagggttcgagtcttcgctcttgggcacccaaactctatagtcgcaacccgacgcgtgtccaccggaagctctcggtcgctgatgcgttggtcaacaaccaatggatccgtgaccttcgtggctccttgggcatccattcaatactgtaatacctgcagatttggtcgatattgcggtcaacaattctttccgagggccaacctgattcattcatctagaggtgggagtgggacagcttggggtcgtactccacccgctcggcctaccttgccctcttcttgagaagtatttcgttccagcacctacctatctggcgctctttcaccccacctcggttgctctatttcctgtggttggtcacttattggcgctattggacggttgaccgcttggagaagcgtggcctgccgcacccaacctgttttgtcttctgtgaccaaaaggatgaaacaatagatcacattctaattgggtgacccgagtccctacatttgtggtagaccgtcctcccaagtctcggcctccctcattgcttctcctctaacgttgtttccttccatgagtggcactgctcctgccgactcaaagttcagagggagcgtcgccgtaggtttgacatggtcatgacccttggcacgtgaggaaccactgcgtgtccaacaagtgttcccggccttggtccgatgtggttgtaggcatggagcaagagaccgccctttggcgtcttgcccatcccttgacgccaacgctctcttcttagcgtgccaggtcgtttggtcgttcaattgtaaacatgagaataggcttaagtccctttgtttgtttataatcaatgatttatctttgtgcatgtgtgtgacgaagactgcagtggagtagagaaaagatgcgtgcgtttgtatcgatcgctttcgtttttgggtcgccgtcgttttctcgccggtccggctagctcgacgtcgatgacttgaattgcaggagaagaggaggacaccggcgatgcatatgtcatgtctacctccctttcgatcggggggtctacacgtacgtacggggtggcggacgggcacctgtacagccgccacggcacagttgtgtgtgcccgactacctgccgcgacgtgcaccggtgctcgccggggaaggggggcagctaggccggccgcgcacgaggatttgacggcggcgcgtcgtgcgggaccggggggtggcccggcaaaatgtgttgggcctttctgatctgcgcagcgtgaacggcctatgggtatggggtcgtagtaactgaagagtccaggagaaaccgtggccatgggccggggctgtacaggtgaaggcgtgtagcaggagtgggaaaaggtgcacttgaggtccctcacttcgtcgtcaagtttcaaaatcgcccttgaaccaaaatagtactaaaaatcttaaacctccagcttgtaaaacaggaataaatttggtgctcctgctcctgcagtataggttgtcgtggtcatgggcagggtttacgatttcgacgaaatcgaaatttcgacgtttcgatgagactcgaaagtagaaaccgtctgagatttcaagaagtttcatccaaattcaaatttaaattgataaaaaagaaaaaaatcaaataaaatattataaatactatgatattcatagaatctattgggatataaatttttgaaaaaaatgatgtattatgtgtatttactgaaacttacattagaaaagaaaagaataaagaattaaaaaaggaaaacacttacatgggccaaaaccgaccgaaattaaaaaaggaaaacacttaatgattgaaattttgatgatttcaatcagaatttcaccaaaaccaaccggctttcgagaacttgtcggtaaacttatggaatttgtatttaaattttgatttatgaaatttgttcaaaaattaccggttttccaccggatttcgcgaaatcttgaattccgtcggtgcctgaaacggaaggggctgtcggaatcgtaaaccctggtcatggctcccatggcccctgcgcttggccagcacaagcgtggtgactgccggaagcaaaggcgtagccatcttccgtccccatgaggaagacggactggaggtgcacagttgcgagctccggggcatagttgacaacgccctgcagatccttcacctacacgatgcagcttcatcagctgcgggaagggctatgccgtcatcggtggtgtcgatggtgtggtgccaagccacagctggacgggtgcggttccctgcgtcggtgatggggcctgaagcaactatgttgctctgacggcggcggtacgtgaaagggaagatgattcgacgtggcgcgcatctcattttataactcattagacgatgattctagcctacttcacgcggtggccatcttttgccaccaccaccatcgatctcacggcagacgctcttgcgcgccgctcggtgcgaccgtccatgcggagaagaatgcagctagcaccgtcggtgtatcgatcggctgcatcttaacgtctgtgcagacgtatcaaccgatcgagattgggtaacgtacctcgcgcctaccgtgttgcagcaatcgctggccttcgatggctacggtcatggtctcgatcgacgacgggatctagggaaagataagagatgatggaaagtagagggccacttacatgtgggacccacttattttttttaattttcttttttctaactaggatgccatgtcagcaaaaccacctatccatatacctcatcagtcaaaactgggagcaaaattgccttgggaccgaatgtgacccgattttgtaagattagggatgcgttatatttggtatttcagcctaggaacgattttgaaattcaacgacaacatgaagggcccaagtgaacttttttccgcaggagtaaggctactaggccaacaaggcctagttttatgagagaacacacagagagtttggaaaaaagttcactttaggcccctcattgtcgtcaagttttaaaatcatccagaataccaaatataacgcattcctaatcttaaaaaatatcacattaggcagccacgtcaaaacagaaccataattaatatgggtcccacgctaactcacaaccacgtcagccaaaaacaggagtaatattgtcttggtacttaatgtgatctagttttataagattataccttgtatttcggtttagagacgattttaaatctcgacgataagataagggacctcaagcgaactttttctctagagggttacaggcttacatccagttttcaacgacgtggtgcacaatcaggtaaattttgaattttgatgatttggcactatattcgttgtcaaattgatttcattgacatttgtagagatgatacgcgggactatgagtcaataaaagtgagccatgaattaaataatcgaacccacttttatagagggttaaatgaccaaatctctctcgcaaatcaacagtattcaagttgcgtgccgcaggtaaaaaactgtggtgcttatgacgacagaaaagttttatgctgcacgcgcaatagcgtgatggaagaagacacgtcaaaattgtgcgttgcaatttggctgcgttctatgccccaggttggagagattttcagcgcacctaatacgaaataacttattaacatatgaataattaaatattactccctccatcctaaaatcaaaatataagtatttttattgttcagattcataactaaaaatacttatattttagctaaaaatatttatattttagcttgtaatagctaaaagttattacattttagaacggatgtagtaatatttataaattaaaaaatgtacttatttgattttttaaagaaaaattatatagaaaattttgtaaaagacatataatttaacagttcgaaaaagtgctaacaaacaaacgaggaagaactgaaagtaactctacgaaaaacatgagtaaattaaacagtacaaatgtggcacattgacagctggaataaacaacggagcacattgattcatcgccacacgtatctaaaaaaacttgtaaaacctccagtgcctcacctactctgcagtctgcactaatgatacccagccgcctgatagtgcgtcatcaggttttggcactggacggccatgaacgtctttagctatgacctcattcattcctcaatcaaacattttccgtccactctctttcacctaaaactgtacaagtcatgggtcctctttaaatgaatttttacaagttgcagcatttcttaaaatttctaactccatcgaacactatagcttctcacccaatttctaataatatacttacatcccaccgaaatcctttatatggatatttttatctatgtaattatatggatgaaatcctatatattctcagacggaggtattaatctagaaaatatgatattgatttttgataagttttattggtttttatataaacataagcatatttattcatattatttttaatccatatgattttaaataatatagatcgggactgacatgcttaaaccatcaactcccatcttaacaaaaaaaaaagaaagaggcatcactaaggcctggtttagttcccaacttttttcttaaaactttcaacttttccattacatcaaaactttcctacacacacaaacttcgaacttttccgtcacatcgtttcaatttcaaacaaacttctagttttagcgtgaactaggccctgtttagttcaaaagttttttttccaaacttccaactttccatcacatcaaacctttcatacacacataacttttctatcacatcgtaccaatttcaaccaaactttcaaacttcagtgtgaacaaaacacaaacacacccttgagaatgggctggcatctgggatgatagtactgtgcaggaggccaacacccagcagttgaggagtaggccatgaccatgaggaccacgagactgacagctacagtacccatcaacgtgacggaaactataaaaatttccgtttgatactgaattttgtagcaaaaaaacgcagatctggatccatacgaatactaatggcatcgtcgttttggctcgtctcctcccccgcgactataaaaacgggagctttgctgctgcgccggccgccccaccacctccggtccatctcggccgccgccgctgtcgctgtcgcgatcgcgatccccgcctagatagacttccccaagaacccgccgccgccgctgcaggggtggcgtggcatcgcgggagaccagctcgagccttcagcctcttttgcgccgccgccgccgccgccggtcgatccgtgttcttggctcaggcggcgtcaatggcggcggcgaatgggagcgcctgcggcggaggcggcgtggacaaggagaaggaggagttcaagcagatctacggggtgctcaaggaggagctgctcagggaccccgccttcgagttcaccgactcgtcgcggcagtggatcgatcgcgtaatgcttttctccccctctcctttttcatcttgtgttgctgaccgcatgtgtttctcctcccggatcgtttcttccggattttcagtagggtttagatcgggtaaatgattggtggaactgcaattaatttagtcgcagcacgtgtaggggttcgcttgtaaattctggatcctcagttattagcattgagtgattaggcctttttgggaggtttaatcttggttaaataactagtagtgttatgttggagtgaatcagcaagtgcagtaaaggttggctcaaaattcccttttgttaaatgagctgctccaattctgtctccatgtcaaaaggagaaaaaataataatgctcacatttggaaggcaaaaatgtgatattttgggttaagtgaattcttggggtgataaagcgtatgattattaaaccttggcctactgcttaaccatagatggatcatggatggtcggcttagtcgcctactgctttctccatttgctactttttttattatatataatgtaaagcttcacaatagattgggtgtacgacagatgatcttatcagttaaattgtcactgttgggaactgctcaatttaacttgtttattttctttgaagcagatgttggactacaatgtacctggaggtgagatggatttgacttgattagtctataacatatgagtaaaaagtaaaaacacactaaatctccaacctattgtctttgatatggtagggaagtgcaatcgtggtctctctgtggtcgatagctataagctgttgaagggcaccaatgttctaagtcaggaagacatgtttctcgcgagcactcttggttggtgcgttgaatgggtaatgctttaacctcaactttccgaataatgggtgcaaatcaactaaaattgctcctctaagctttactgttgtctatgtagcttcaagcttactttctcgtgcttgatgatatcatggatgattctcacactcgacgtggtcagccttgttggtttcgggtgcctcaggttggtgaatctgaaattgtcctatctgaatggtgcattgcctaattatttactgaaacaaaacactcattttactttatagtacctttctttcacttgttacatatgaaactttatccctagtgccgccatttgttgcacaataggttggctccattgctatcaatgatggaattatccttcgcaaccatatcacgcgaatgcttcggctccactttagaggaaaactttactatgctgatctccttgatttattcaatgaggtaattttacattctgatctacatacacggttagtctgaactttcagatcattgtggtcttactgctactatcttgttttgctttcctaggtcgagttcaagacagcttcaggtcaattgctagaccttatcactactcacgagggagaaaaagatctaaacaaatataacataggagtgtaagtcaacgttgtaacaactttggaaataactattttgcatgctttatttaatctattcttagaaccataagcctaatgtttctgtcatatatggaatggattggttttatctattatatcttcaataattttgattttgagattgttgattcaaaacttcctgtatttttgcagtcaccgccgcattgttcaatataagacatcctactattcattttatctgccggtaaaatttatattccattgccatatcttcgtttatgcaatccttgttttgttaataaatactaattgcgagtggtactgatatgctgttatatcaaaggttgcttgtgcactgttgctatctggagaggacttgaccaaatatggtgctgtagaagacattcttgttaagatgggaatatactttcaagtccaagtaactcctatttctgccacataacaacaggaggaatttgactgccacgagtattattctactttcaattaatacgaatattttcttacaggacgattatctagattgttatggtgaccccaaatttattggcaaggttagtgcatttacctgttgtagcagcatagatgaacatcaatatctatattgatatttgtttagctcttgtagtttgatcattttttatgtcatattatagatcgggactgacattgaagattacaaatgctcttggctagttgtgcaagcccttgagcgtgctgatgagagtcaaaagagcgttctatttgtgagccatctccatagtcttttttgatgctgtgaaggttgttgtctaaacacttgttctgctcctacaggaaaattatggaaagaaagatccagcctgtgtggcaaaagtgaagagcctctacagagaactaaacctagaggtttgccttgactctatatgctttatatgtttcttcatggggtttaccttattgtcaaaagaatcttactctcttgtaaattatgatttctatagcggatgttcctgctttgtattatcatggcctacttgtttagttgctctacctagtctgaatttcgacatctccaaccattatattgagttcataaccaagtctgatatcttgtttattacttcattcttaggcggtctttctggactatgagaacgagagttacaagaagttgattgcggatatagaagcccagccaagcatagctgttcagaatgttctgaagtccttcttgcacaagatctacaagagacagaagtagggggggtttctgtgcaggaagctgtccattgttgcatgtttcttctctagcaactgatgttgtatgttgcaatttgctgatcttggataataatgttgcaaggtgttatttcgggtgtgatggaccgcttggtgtagacattagacaataatacatgagctgtttgtcttgttattagcatcatagccgcttgttttcttttttttttctttgcacgagttcaagcaagtcagttacagggtaatatgcaagttgctgtagtatttcttttttctcgaaaacgcaagaggcttgcgcttaatgaaatttcattaagtaattctgaaggactgatctgagtggtaactggtaaggcatatcgcgttatagaggttaaaaaaaacaatgcaaattcacgaatccaatcaacactcaaaaggagtacataattcaagggtcacttaacacagatggaactcatttccaactctgagaagaaaaaaaaaacaatttactgagctagttcctgttcagtcacaaggaagcatatggtaacaaggacaaactttttatccaactctatcagttcatctcaaaaaaaataaagggaaaaacccggactcccttgaagatgctgaagtccgcggcggtgggaaagcacacaataaagaataaagagaatattatgagatcttgagcccagaatattgtgagatcttgaacccaaaagctttagcaataagaggtttagcttataattttctaagcactagtgccactacctaattatgtggccatgttctatggatagttgcaagcttacaataagcaccaaaagatttggaccagctgtacgatttccatttctgatgatgcactgagagaagtgcaaaggaagattttgggtgactgatgcagaaaattttatgtgtattaacaatagccataagagaatacaatgggaaggtgtacatcatcattttttgccacagatggtaataaagagattgatacttcatacacgatacccatcttgtgcaggaaagaacaggatacaagtgtttgttgaatcagcatatcacacgttccatcctttttgctaggcacctaattcgaactggaattgttgggaatccagaaagttagggcagttgacgcagttgcaaacattgctcgacggggagcccacttcaaagcagtgataggaccgatgtgactgttccaacaagcaatctacaaaaggaaaaacacttaagaggcaaagaacagcatattaaaagcatgatttaagaaagagcacctcttgtattgtattgatgttccaagcatgcaaggtaccatcaccagatcctgcaaaatcaagcaaaaaggttttcaacaaaagctttggccacagcctgaaatattggtatcaaaaagttccaagttttgttaaatgttagagcatatataggccttcactttcagcagtagtggaactgtcaataggcaacagaaactatagcatatataagttatattggtacataaaaagcagtatgagcatatcatgccaacaaaatatttctattcggatggttaaaggcatgttgaaggcgaaatatatgctccaattatcattaggtctgttcttagtagaagcgacggtcgcacaaggtaagttaggagcacttttagtagaagttttacttacaggggaaccagttgggtaaattgttgtgtactactagttcatatcggaatatatatatgccaaatgatatggcatacaaatggaaaaacaagaatatcatacctgaaattacatattggccatctggagtaaaagcagcttcagttgctacattgggagatgactccagactaaagccacacctctgcaaaaggattttgagggtgtcaatgatttgatttgaggaaattatgcacttagttcaatttgaagcatttttttctgcaacagaagtaactgaccttatcccctccatatgcatccagaacatatatatggttgttggttgttgtcaaaagcatggacttgccatcattgctaaatttgatgtcagaaacttcagctgtatctccaccaaccaagaaagtgtcaaagggaccctgaaattgtatttggcacccaagataagaacttccgcaagccttataggaatttacagtttttgagattcaagctgaataccaactttgtcatatgaccgggaatcaaatagcttaatagcacctccttccattgccacggcaaaaacaagtccctgctgatcatatgcaacagaaggcctaccacgcaaacgtagtataccctaatgctaaacaagtaagcatggaaagccctgagatgacaaatggtactattaccctactaaatgcaatttgtgtatatatgattgatcacattaaacaaggaatggtgtccgaacctgacaagcatttacacgaagatcccatatcctgacactgtgatcaagtgatcctgacataaaactatcgttgacaggtgacatacatagtgaaacaaccctgaaatgaaatagtgcacctctcataatttatcctagacataatcgctagacaagaaagaaacaagaacatagccaacctgtctttgtgtcctttaaaatatcttaagcaacggttgtcatacagtgataaataacgaagtgactctgctgactctagattgtatcttgatgaacataagatagaactcggatggtgagtgaaacagacacggtcagcaccatgtttcctatgatatgtagtcttcaacaacctaaacaatagccccccatttataacatcagttcatcagaagaaagaaaatgtacacaacacattattgaatgctctcaacagtttggttaacatcaaacaaagcaaaattcgagcaattcagagcatactgcaggacaggttaaatctaatgaaaaaaaaaagcaacgattacattaatagagaaaagaagggcaaaacaaatgctgccagtatgactgcaatgcatatccctagcaatgttgttaatcagacagaaaacgatcgcaggtcataaaaagtgcatcagtatatatccatcaagcagaagcacagaactgacacacatgaagtatggattctagcagcaagatattgacatctcccgagttccgaaaagtagaacccaccacacataacatccccaacaca

SEQ ID NO: 82671 - DNA, 2131 bp, Oryza sativa
acccagatgaaaaagtacggccgcaagctctttatgggcggccaaaattgcaattagccccttgccgccctctgtacgggcggcaagggcctaatcgcaattttggccgacggcggcagacggcgcggtcgacccaccgtctgccacgtcagcttgccgcccaccattagggcggcaggggctatttctgcaatttttttggtcgatagattatttctgtaaatattaaaaaaaaatctaaaaacgaaaaaaattcttcctgttctcccttgtggcctggacttatggaccgtggagtaaagttgctgtaactagataggccaactttttttttagataatggaatataatatcccggcctttgctcaaaaagaactacagccaattattacaaagatccactccagaagagagtgtagttcaagacaagttgaacacaccaaacaagagaagagaggacccaaactgagaaaagcaaaataaaatgtggagctagaaggcctcgtcaaggcctaggactgaagttcgaagccaatgcatagaccaatgacaatatccttgcacgaagaggtttctccaaagcggtgcccccaaggaggatgcgacgtggatcgccgccaccactcgttcggaaccgaagcaaggttttcacccagagaatatggtagggaaaggaaaggggtatgctaaaacaacgcctccaaggaggggaacgacgccaaacggcgtcgccgttgtcagccagccaaatggctcggcaaggctttcgcccgcgattccctgtccaaacccacaccaccaatccgcacaagaaggatcgtcgtcggtcaacaacattgtcccttcagcgattcggccaaggccaccgcccacagttgttcccgccgtcgacagcgcgcccgctcccggactcctcctgccccgcctccacatatcgccgccgccgacgacgcaccgtcagccggatgatggccttcaaccatcgccgccataggtaccatcgtcgacagccgccatcgccactgccacagccaccaccatcgccagccgccaccgtcagccaccatcaccaccgccaccgccacggacacccctgtccaaccaccaccgtccagccgccaccgtcgctagccaacgctgccagacgccaaccgtccagatccggccggggtggcgcggatcggaggtgcagcgtgaagcacgggtcgccggcatcatggaggaaggcgtcacgggtacggcgttcacagccggagcattgacgagggcgccgcgccttcctcgtggcggcgaggttcttgatgagggccggcgtcgcggcacgcgccacagtccgccgccgtcgtcgccaacttcgtcgccgccacatccgccaccatcgccgccgctagccacccccctgccaggtccgcggagtggcgccagcgacgaccgagcccgtcgccggtcaccccggccaagcggggagaccagatctggcgacgccgtcgctggagccgcggagagccgacaccgtgaccgccgcgcccaactccgcgccgtcgccgcgccgtccctgtcgccacgaccttgccgtcccgccgccatcgtcgccacgcccgcgccggggcgaggtggagccgaggaggatggccccaccgccgccatcccaacgtgtcgcccggctttgccggcgacgagctccggcggcggcgaagcacggaggagggaggaggaggggcggcggcggcggctaggatttcgccctgaactccctgataggccaacttagaaggaataattccactttgactctcaaaaatattgatccaatctacccttgtttgcaacaccagatatcttggttctccaactatcaaaaccggcccaatttaacgctcaggcagtattaatagtggtatttgctgacgtgccatgtagcatcccaatcattaaaaaagtagagcccacatgtcatactcccctcaccctctctccttctctcccccatgatttctcgacagcagctggggggagcgcatgcaccgtacgtggtgggtggcggcagggcgacggaagcaagggagcagggacgaggagcgacagcgtggagcaatggcgacgaggaacgggcgcgggaggcgggaggatg

SEQ ID NO: 82672 - DNA, 6958 bp, Oryza sativa
taatgattttaaattttaattattgcacatgttttaagaatcaattattttaagaatggatattattaataaaaaagaacgggtcaagttctactaatttaatttaacaattatatctaatcttatataaccttatactaccattttgcaaggtttggactatgagcattgtctttagggtttgttgaaaccatgccaccctatatttgtaaaatttgagatatatcacccgtatctcaatgacatgtaggatccacatgagtcaatgacatgtgggtcagtgaccaggttcttgttccaatttcaacaacatatatgtgcttaatagtatcttcgttttttaatatatgacacgttgatttttaacacatatttgattattctggtcttatttaaaaaaatcacgcaattattatttattttattgtgagttgttttatcacttacaaatattttaagtatgatttatatcttatacatttaaatttttttttaaataagataaatgattaaacgtgtgttcaaaagtaaatgatgttatatattaaaatatagagagggtaaccactcctatgttgcactgtactctatatttttttccttggcacagttttcaactaacaataatacttcaactgtaccgtacaagccttccacagcaaatactagtcaagtactgatcactccaaacactatatgtctctgttgagagagaagtgaggaaatttagcgcagttaatgatactccctcaattctaaaatatactccatctgttctatattaattgacgttttgaacatagttgagattaaacttttataactttgactatcaataactttaaaaatatttagtttaaagaaactagaaaaacatatatagatttgtctttcaaaacactataataaaagtaaacatgtatttatttattgtatatattataatagaaaaataaggttaaaggtatatcttgtagagctagcgtatcattgtctaaagcgtcaattaaaacgaaaccggagggagtaaggcacaatcacccttaactagctattatataacaaagaaaattggttgtgccttatattatagaatgaatggagtaacatttaaaaattaaatagtttctggatactaatgtagtagttcattttctacattttataactattgagccttacaatctagagcgagaatataatatagtactagattatttgatgggggctagttggagattcttaaaagtggacacagttactagaaacttcttaagaagagcctatattatatttgaaaccttcaaccagtaatacgttgtgtatatagcatatgtttaaactagacgtacagtgagtttctccgtagcaaaagaaattctaccaagctaataactcaaaaatacaattagtataaagttttaattgttactacctccgtctcaaaataagtgcagccataagtttccgcgcttaactttgatcgtctgtcttatttaaattttttttataattaccatttttattgttataagatgataaaatatgaataggactttactcatgacttatgttttaattatttttaaaaaaattttcatataagaagaatggtcaaaattgaacgtggaaaactattgttaggaagtacagctagtagcttttagatcgaacaaacggtcatcgcaccggtcgagccagtgaactcatcacgttgacccggtcgccatgcacccgcaagctcatccacctagcccaagcccagcccagcccagcccaaaccatccatccccggcccaccccgccgctgacggctggctcccacttccggaatattccgtccatcgccgtcaccccacctcctccctctctatcctcttctcctccatttccctctcctctcccctctcttcgctggtcaatccccctccttcctcgaatcttcgcttccccccccccccacccttctcgccgcgccaccgcctctacaaatccactaaaccccctcctccgcctcgccgccgccatgggctcgtcggcggccgactcgttccccgcttgtggagatgatgcaatccgagacgtgtacggcatcggtggtggtggggaggaggacgatccgtccctcttcctctacctctccgacctcgcccccgtctccccctccgcctacctcgacctccccccctcgccgccgccgccgacgacgacggcgacgacgatggtgaaggagggggaggaggcgccggaggacctggtgctgccgttcatctcgaggatgctgatggaggaggacatcgacgacaagttcttctacgactaccccgacaacccggcgctgctccaggcgcagcagcccttcctcgagatcctctccgatccctcctccaactcccgctcctccaactccgacgacccccgcctctccccgacctcctcctccgacacctccgccgccatcaactcctacgacgccgccgccaccgccaccgccgttgccgccgccgcggtgcccgtgccgcagtacgagagcatcgagctcgatcccgccgcgttcttcgccgcggccaactccgacctcatgagctccgccttcctcaaggggatggaggaggcgaacaagttcctccccaccgagaacaagctcatcatcgacctcgaggcctcgtcggagaataattacctcaggggtctcgaggaggccaagaggttcctgcccagcgacgacaagcttcaggttggattcgctgcggcggcggcgcctgtggtgagcgtgaagaaggaggcggtggatgtggtggtggcaaccgcctcgggcggcggcggacgagggcggaaaaacccgtacgacgacgaggagctggagctggagggagggaggagcagcaagcagaccgcggttcagggggacgatgtcgcggcgcgcgccatgttcgacaaggtgatgatgccctcccatgagaattgcaccgagatgatggagaagctgaggattgccatgaaggaggaggcggccaagaacgaggccagcgccggcgggaagggtgggaacgggaaggtgaagggagggcggcggggcgggagggacgtggtggacctgcgcacgctgctcatccactgcgcgcaggccgtggccaccgacgaccgccggagcgccaccgagctgcttaagcagatcaagcagcacgcgaaaccgaccggcgacgcgacgcagcgccttgctcattgctttgctgagggcttgcaggcgcggatcgctggcacgggcagcctggtgcaccagtcgctcgtggctaagcgcacctcagccgtggacatcctccaagcgtaccagctgtacatggctgccatctgcttcaagaaggtgtccttcattttctccaatcaaaccatctacaatgcttccttgggtaagaagaagatacacatcgttgattacggtatacagtatgggttccagtggccgtgcttcctgcggcggatatcacaaagggagggtgggccaccggaggtaaggatgactggcattgacctcccccagcctggtttccggccaactgagcgtattgaggagacagggcaccggctcagtaaatacgcccaggagtttggggtgccattcaagtacaatgccattgcagcggttaagatggagtcagtccgcaaagaggatctgaacattgatcctgatgaggtgctcattgtgaattgccagtatcaatttaagaacttgatggatgagagtgttgtgatcgacagcccaagggatattgtgctcagcaacatccggaagatgcagcctcatgtgttcatccatgcaatagtgaatggctcattcagtgcaccattctttgtgacacggttccgggaggctttgttcttttactcggccttgttcgatgttctggatgcaactaccccaagggaaagcgaacagcggctgctgattgagcaaaacatctttggacgagctgctctgaatgtcattgcgtgtgagggcatagatcgggtggagcgccctgagacatacaagcaatggcaggtgcggaatcaacgggctggcttcaagcaactgccattgaatccagaaattgttcaggtagtgcggaacaaggtcaaggactgctaccacaaggacttcgtgatagatatagatcaccaatggctcttgcaaggatggaagggacgaatactctatgccatctcaacatggacgccaaatgatgctctctcttatttttagttgtttttttttttggcatcgcgacaaatataagatctaggtatttcaataagatggctagtggcagtatgtcatgtatgaagatcgatggtgttggtgttggtttgatggacccaatgacttgaggtatgcctatctagaatttggagtgcacttgtgattccaatgggttggttcttcttctgattcaaaccaattcatgcaatgcaggctatgagggagaattggtagcccaagttgttgaagccataagataaccaagcatgcatgtagatatccatgtttttatgtgatgttaattagttgcttctgttgtcatgttgcagcttagtgccacactaccacttagaaaatagacttaggtcctggtccggatgatgttcgctgcagcgtcaccggttcttgcgatcaatccagtcagttgatccggttgtaattgacaccagttactctgtttttactaggtgcttactgcactgtggcagacagtaacattgtaatatgctcaaaatgttgaactgggttttggctagtcttgtgctgttgtcaacctgagaactatcttttcggccaacttatttggtctattcatgatccatgttgcaacagagggtcaaacatttttgcccattgatgtgtgtgatattgtttttttaattattatttgcattgatgtgatattgtgattccatacattgacataccttggctgtgtttaaaccttagttctttttcatcacatcaacatgtcatcacatcaaacttattttgctgtggaggctagaaattcccacattaatcgaagaaaaagataaaatctacaccgctagatcgtgatagtcctaaattataacggttgatatttaataaggctacaaataagttttgggaactaacttaaatgcaataggaaactaaaaggctacattggactgatctgtctacatatactagaaacataaattgattaggagtaggattctgacgtataggtgttggtcctgttgaagcctgtaatcggattaggacttggcaatacatatttgaatgcatatggcgctagagcctgaagtctgtaattagagtcatttaaattcaccatatatatacggccatgcattgctaggagaataggaacaactaaacagtacatacatatagcataccatatgctgtatgcacaagcctagcagtaaaggccatatacatgtggctgcactggcttacgattaattaggcagtataaatgcaaaacgccagtggttaaaggcatgtgcgtaattcaatatatacttaattaataatttcataaaaaatgagttgtcgcaggaaaaaaaattttatgtcataagaccttcaccttcatagcagcttcatcagtcagaagtgcaatttgatatatgtgtgcacttttgggtaaaagaaaaaaataattgtaattcgataaaaagaatattaaaagaacagtctatctggaaaacaagacaagattaattaaaattcgaaaataataaaataaatttcaacattagaaaaatagtagtagtttatgtaggaatacaatttagaaatagctaaaattcataattaaaaataagaaatgttgcaagaagagaccatcttaaacgaaacatgagatcaattaattgaaatttggagtaaaaataaaataaattctgaaattataaaataaaattgagagtttagataggaatacaacttataaataaccaaaattttcgaacggaaattctcacattaatataagaaaaaaagaagagttagagttctagttatattattaaaacagccttgaaagaaggcaccacgttcgctgtggaggctggaaattcccacattaatcggagaaaaagaaaaaaaagaagagtccaagtagaaatacaatttaaaataactgaaattcgaaattaaaagtaagaaatattgaaagaaatttccatatagaaacccaatacgacattaatcaaaattcaaaataaaaataaaataaaatccgaaattaccaaaaaaaagagtctaagtagaaatacaatttaaaaatagctaaaattcggaattaaaaataagaaatatcgaaagaagagtccatatagtaacccaatacgagattaattaaaattcagaataaaaataaaataaaatctgaaattagcaaaaaaaagatgagtccaagtagaaatacaatttaaaaataaattaaattcggaattaaaaataaggaatattgaaagaagaatccatacaagaatccaatacgagattaattaaaattcggaataaaaaaaataaaaaatcaaaattagaaaaaagaaacgaaaagaagagttcaagtaggaatataatttaaaattaactaaaaatcggaattaaatataagcaatattgaaataagagtgcatataagaacccaatagtagattaactaaaattcgaaataaaaaaataaaatataatatgaaattaggcaaattaaaaagagagttaaaataggaatataattttaaaacaactgagttgaaaataaaaataaaaatatcaaaagaacacaatacgaaaaataaaataaattctgaaatgagaaaaagaaaaataagatatcaactaggaatacaatttataaataactaaaattggtgagaaaaaaataaagattactaaaagaaaaaaccatctgaaacacatgacttgattaat

SEQ ID NO: 82673 - DNA, 2904 bp, Oryza sativa
tactccctccgtttcaaaatgtttgacaccgttgactttttagtacgtgtttgaccatttgtcttattaaaaaatttaagtaattatttattcttttcatatcatttgattcattgttaaatatactttcatgcacacatatagttttacatatttcacgattttttttaataagacgaacggtcaaacatgtgctaaaaagtcaacggtgtcaaatattttgaaacggagggagtactatcgaggtgatttaccactgctcgtgtgactattatatggaaattgtatactgcatatgcttttgtgatcaaagttatgttttcttgaagtagtaaagacttaagcaaaactattcatagatattttggttggctaaagttattcatagacacagattgtgagttcctgttcatatttatagtaggattaatttgcactaaaccatagaaaggatatgacttaacaaagaagaaaaaaaaaacaaagatgagaatttgttatgaagggtaaattttccatttatcaacttgagatatgaagatttgcatgttctcattttggcattttaactgatatgcaacggttttgttattaataacattataatccattttttaaatatagtgcaaatgataacaaggtcccaaagattacaaggcttggagcttttggagaatggagtacaaaatcaagaattggtcccaaatgatcattatgttgaaaaacagaacataacaaacgcagattggcgcacaaattgctatgagtattgtaagatgtatttgtttattcgcttcaaaacttgtgcttacagactaacttttaaaattttacagatcctgatggccgcattaaaagatgtcgaggaccaactaaattggcaaatattgaaaatcttccagagggtgttaagattattgtcaaactggatcgtttcaatataccttgctcccaatctgctatagttcttggatcctatttaggaacacttgtcaggaagccacatctagctccactgaacattcttcaatggaatcataaactttataagagagcatatcatccaaaaatgatttctgaagtagaggtattgctctttaattttcacagctttttaaatcatattcttatggtgattccaatataattccattcactctttatttttcatatgcactagagaaagcttgcaattgatagaagagctaataattggattctccactagttagatggcaaatggaggcagtacaagtcaaaactgaaaaggggctattacaagcctaacttacctatggaacgagtattgcaaaccgtgcccaaaattgttgctaaatctcaatgggccaccctagtttcttactggtacttagaggactctaaggtaaatatatgttgggactttttagtgactgaatgaccatcattttgatttatatcagctcattgatgctatatgttgtatcattagaaaatcagtgacaaaacaacgagaatgcacagaatattaagcatccacacatattaggaagaaagagttttgcaataaagaggaaagagctggtaagattttaagcaattttcatatattaattcactattgcttcaattcctcatgcactaaagatgtataatctgcaggaagttaatggagtggaggtggactgagcaaccttctttgatgaatgccataagacgaaagatggcagatatgttaacgatgctactgaagaaaaaatggtatgccatattgcttttcttatataaactctttgtaaaacaaaatacactacattaagagtctacaatcttttccaacgtagaatgaagtatatatgaaattggctgagaaaagagtggattgccaagaactcagtgaagctgattttgaacaagctatgttagaagtgcttggaaaggatcataggggtagagttagaggcatgggtccaaccattactccaacaaactattatggtagaagatttttgaatatatcaggaagcaatgaagggaatggctccagtaatgtaaatggtttcattagttttatagtatcatatttgactgagaaatatccagaggataatttgatttctaggttgccaccatcagttgctagggtcattccaagacaagaggtatggccacaaaattactaattttaaatgttgtaacttatatagccataagcttccagaataacaaattcatgcatgtatcttcaggttgatcagaatgaaggaagtcagccaccaaatactgctacatcctctcttccatttgatcagaaccatgaaaatcagctaccaaatactactccatcctctagtgctagagcatcatctcagtcttgcagtgaagaagagtgatttacaatggcaattgtaccattccgtactacttgctgcattagaatataattattttttgtgttaatttgtttgaacctattgtttcattgttatatcagaaaagatgttgaagtattttcattgtgaacaatgtatagatattgcttttgattttaatgacaagctactggcgttaaaagtcttgttaatgtggtctgatggtaattcaatctgttggtattgttttgtttatgggttttctgaatgaaagatgtattgattgttggcatgtggccaatagcggggttataaataataagtgtagatacaggcacaaccgtgtctatagaagcagaaattgtctctaggaaagaaataagtaataaattcattatgaatagagacggttgtgaccgtttctagagaaaacgtagatgtatctactataagctagacatggaaacaaccgtggctaagatcatcaagtgtctctacatgatcaatccaaaaatttgtatttcaaatttgacacggtcataatttaaattag

SEQ ID NO: 82674 - DNA, 1312 bp, Oryza sativa
tttttatcatcaataagcaaaatgcccgcgcatcagcgcgggcttccttcctaattatcctacataaccaatattttgaccggaccgggtatattgcataaatttactatagaaacaggggtttcctttaaaagaaaactgacaactagcgttttgggattttgaattacatgtgccccaaaacctagaattttgtggtaattactcttgtctattttttggcccaaatatttggttcatcacagtaagctcaactatttaacgatattgtcgctagcttgacccttaccttaaaagtacaattgaaaaggtcagtagggcaagcttgtgtcatggtcaaaattaagcagcatccagcaatataatcaacatggacagcatatattaccttatagatgtagctatatatatatatatatatatatatatatatatatatatatatatatatatatatatatagcttaatcttgcagtgtgagtgatgtgaagccccacttaacaaaatccttgcttgcagattagggaatcaatgcatcaggctattagctgttcttctacagtgctctgcagtaccacattggcccctgcacttgcaactatctgctgtcaataaacagtggtgatgtacattgcaaattatatatgcatgtgtttgtgtgtgtgtgtgtgtttttgcaattaaataattttgttaatttacataatgcatggagccatctggaaagaggacacacacatgcatacaaaagcattgcacagggatagcatgcaagcacacctgcaggaccattggatgacggccatgaggtggtgagatgaaatcaggaccatccgtttaattgattgatcaaataattgaacagttgattgattggcagtgccctagctatgctacaggggaggtccctgaccctgagttaaggtgtgtactcaaagcaaatgcaagtggcttaattataacacatgttttagttatgtaaacaagcagctggtctgatacatgcgtgatgtggagactggataaaattacaatatcaaaataaatgtaatcctttatatttatatagttcatccccactaattaagtgtagttaatgctatttctcttttctctcattaagccacatcactccaattatttttagcctttggacgatagatttatggttcaaattgtgtctcctctttcttctctcataacaccatgtaatttcaattatttaggtctcaaaattcataaatatcaatttgttttagttctaataatcatattgcatcttatttttacatattatacaacttaattttc

SEQ ID NO: 82675 - DNA, 9267 bp, Oryza sativa
tatacctcgaactattaaaagtgcttccccatattgtctaacagtatttctttttttttcatatctctacatacaagtcatatatgtttgtttaactaccaatcttcgttgttaactttctcgatatttgtgccgtgcgctgttgtgccaatgccgtgaaccagtgactatggtttgtgtgcgttgtaccaacacctaattaaggctagctctgccgccccatctgtattttaaacccgcgtccgccactgataccatgagaatttggctttatattagtagcaatccaaatgctagctaaatactccctctatttctaaatgtttaacaccgttgactttttagcacatgtttaaccgttcgtcttattcaaaaacttttgtgaaataagtaaaactatatgtatacatataagtatatttaacaatgaatcaaataataggaaaataattaataattacttaaaatttttaaataagacgaacgattaaacatatttaaaaaagtcaatggcatcaaatatttagaaacggagtgagtaattattagggatgcaagtgggtagtcccgctacccgcataaaaacatacttggtagttcattttccacgtggtagtacaaaatttagaagaaaaaatgaactagaaatgagataggcagactaaaaaaacccacttgcatctctaataaccaaacaagcactaaatctagaactgaatgtgacacattctaatacaacgaatctagataaatatatatttatatgtctagattcattgtatttagaatgtgtcacatctagtactttatttttttataggacggaggaagtactccagttgagagagagagaggggggggggagagtactccctccgtcctaaaagacctaacctagaaggagatataacccctcctagctataacaataaatttgaacatcccgaaccattgtactgggagggtcttatcccattatagaaaatagatcttctgattttgagagactgacacaagaattttatatcttgggaatccacgtatattaacaacccatattagaagatactactagcagtactatgttagagaagtctacagcatctgctatacgaagattaagtaccgggacgcaatacggaaaagccactaatgtatgattaattgagttttgattatttcaattgagttttaaagcaccttttacatagtactcaaatttgaaagatgtgctaacagataaatttgagataagagctgtgtctaaatcaaaaaataacggacatggatcctctgcggaactgtatttgtagtagcagtagctgatagttggacccgatcctacatgtcagctgctgctactacaccggtactactgcaaacaatctccaatgaaaaaaaaaagaaaaactgatcatatgcagtggtcagtggagtggccctagagagagagagagagagagagagggagagacgagcagaggggtgatggaccgatggtgcggtggtcagtcgctcaccggtcagtcgcatcgcatcgcatcgcatgcatggacgtggagtaggctggcccgggcggcctgccacatcgtgccgccaaacacggagtacacaccgaccgcagcccgtaggcgtaggcaatggcagtgccagcgacgtcctcgatcggttgcgtgccatgccacgccacgccatgcagaaatgcagatgcagccatcggaccagtactctccctccccagtccccagttgcataaaaaaaacaaaaaagaaagttaacatgagatggaacgtagggtgtgtttagttcacactaaaattgaaaagttggaagtttgtgtatagaaaagtttcgatgtgatggaaaatttggaagtttgaagaaaaagtttggaactaaactcggccgtaatagaaatatattaaggggatatttagataagggttttggcgtgtcacataagatattatagatattatatagggtgttagggcactaataaaaaactaattacagaacccgtaaataaaccgtgagacaaatatattaatcctaattaatccgttactagcaaatgttcactgtagcaccacatgttaaatcatggagcaattaggcttaaaatattcgtctagtaaattagtcgcaatatgtaaaattagttatttttagcctatatttaatattttgcaggtgtttaaacgttcgatgtgataggatgcaaaattttagggtgggatataaacatgccctaaaatttaaattataactagaaaggtagtagtacgtttatttagaaatataagagtatatattctagtaattcaatcttattttaggtttggtttttctgagagaatgcgagtacgtgccactacggatcgagttggcctgctagcagcagcaaagcatgcaggccagccagtggccctgtgcgttgcgtacgtgtaggtcagtacggtgtgacccgcccgatactactactgcactgcacacactccctccgtccgtgtagtactcctacttgcttcctcctatggaaaaaaaattctaaccttgctacccgtcctaaaataagtgcagccgtggatatccatacccaacgtttgactgcccgttttatttaaaaaaattgtgaaaaatttaaaaatatttagtcacacataaagtaatattcatgttttatcatctaataacaataaaaatactaatcataaaaaattttcaaataagacgaacggtcaaacgttaaacgtgaatagtgcaaaactgtacttattttgggacggatggagtatatcataagtactataaatttaaacatgtagtagtaggagtaactgttcagattcgtagtattagaatatgacacatctgatattaggttgattgagaaatatctaggggttttccgactatctccacaagttgatgggctaggcaatataggttcgaagcttcactcctactaattatttaatattaggtcattctctaatatttgcgtctttgacaaggttcacaattccgacgaaaaccgatcgaattccgcgaaattttgaggtttcgacgaggctcgaaagtagaagccatctgaaatttcgatgagtttcattcaaattcaaatttaaattgataaaaaaggaaaaaaatatttaaaaaaatcttataaatagaatgatattcatataacctattgggatataaatttttgaagaaattgatgtattccgtgtatttgctgaaatttaccgtaggaaagaaaagaataaaaattaataaaaggaaaaaaatcatttgatcactttttctaataaccgattgaaatttcgataatttcgctcggaattttatcaaagccaatcggttttcgcgagcttatcggtaaactcagggaatttgtatttaaattttggtttataaaatttgttcagaatctatcagctttccaccaaattttataaataccgtcgttccaccaaaccctgaaatggaaggccatcttgaaatcgtaaaccctgatctttgatactcctactacgtggtactcactatactagtatatctctgacccaggtgggccccatccaacccctccctcagtccctccctctagagcctggaccctgtttatcttcttctctctagctaccactaatctctcttcagtttttgtttggtttggtctgttctggtcaccgtctgcatgcatatggctcattcgatcgatcgaccggcgcggcgccaaagattcacccacgacgctctacctaccctgtctgctactgtcccatatatgctccctccgttttataatgtaagactttctagcattgcccatatacatataaatgttaatgaatctaaatacatacatatgtctagatgaatatggacaatgctagacaggggcgtactagctaggtggcaccgtggtccatggaccacctaaaaatttgaaattatagtatatgtgctagttaatatagtaaaaattatatagtggaccacccttttaattgacatattacatatagatgaaacacttttactttaaatcctagttacgccactgatgttagaaagtcttatattgtgaaacagaggaagtacatactacgtgtatcaacaccatgatgcacaccatgtcgatctgaacctttgaccatgtcggtcgagatgacatgacaaaacaatcctgtcacgctggtttgaatagtgtggcaatgttatttggtactatcatcgcgcatgtgtgtgagtcatagtatcataatgtcaaattcatagttactaggaatatcctaatacctatgtcagatttattatattaggatgttaaatttatagtgctcctagaatatgtacttatcagatttataatgttgaattaacttggtgtgtatttagttctttgggtgtaaagttttaagtatatgaatgcacatttgaagtattaaacgtagactaataacaaaacaaattacatattccgcctgtaaactgcgagacgaatttattaagcctaattaatccgcaaatgtttaatgtagcatcatattgtcaaatcatagcgtaattaggctcaaaagatccgtctcgcaatttacatataaactgtgcaattggttttttctcacatttaaattaatgccctatacatgtgtccaaatatttgatgtgacgtttttgactaaaatttaggccttgattccgaaatggagttactatttgatgcgttggtcccaaatacgctaaaccatgtttcttttttttttcgactggccatgggcaacgagtttcgatgattggcgtttccgtttagaaataaacacttttttgtgcttgcttgcgagcattggaatggcttgaatgaaatgaatattaagataaataaaagaaagaaaataaaccattgagaaagttatttatttttatattagtttcctatacttgactgaacaacttccaattccgttatttcaactacaccaaatgatcttttgaattagtcaagactcatatttatggccccttttatatggttattgttttattgaatttgcttcaggcttgcgattcgactttgatcgtaatggattggtaccaaaccaagatcaaatcctaggcaagtggatctaattttaacagccggcacgataacaatgaaaattgctccttctttagtgagattaattatatgagaagattaattatatgagtgaccaacgaggatggattagctaggctaggcaagcagtaattgctacaggtgtaatgtgacccagcacatgacacgaccgctgtgtaaaggccgtcaaaagtcaaccatactgtactggatataccgcccggcccgttgtacgtactgtacgtacgtagacagacatggcgatgtcaaatcaaatcaaatcaagtccagtacaatactccctccgtctttaaaaaaaaagacaaatcctagattttcgtatccaacgtttaactatccgtcttatatgaatttttttataattattatttttattgttagatgataaatcatgattaatactttatgcgtgacttatccttttaatttttttataatttttttaaataagatgaacggtcaaacattgaacatagaaatccagagtttatttttttttgaacggagggagtaatccatatgcaatcaatctcacatacattatcgtaaaaggggacgcatcgactcctcctaagttgatttttttccgaagggagtaggtctctctagcataaataccctgtatatctagctcagctacagcctctgatcattcactccatctttattccgccttcatcaattcgatccctgcatttcgctaagctattgtggtgtttgtttctatcgaaaatagataaagtttagatgtgaaattaagacacggaagacaataagatcgttaacgcatggttaactaagttttaattacttattgagaacctttaaatgaatagatttaagcaacttctacataaaaagttttgtacaaattacatcgttcgatagtttgaaaagtgtgctaacggaaatcgaaataaaatatgtatcttagtcagaaaagaacagggtaacctcatcttcagccgaatccacctccacctcagcttcaatcgtgcccatagaacttacgctctctgcaaggtccaccatctcagcaccagaggtggcatcgagcaactagagctcgcactagtgaagtggctgctcgccaaggagaccgaaaccgagctccggccatgtcagctggctacatggcaggggtgccacgggaggagggggttagtgctaatgtctttggtgtcgatccattggaccttggcgccaatgatgcttgcgctgagctaaggttctattcctgaataatattttttataggcttatttgtaaaaacaagttttctataagggccaaatatacacattttaggcaaatcaaacctgaagtggatgctttctcaaatttcagaaattcattccccaaatttagcaaaatttactcaaaattagtcaaaatatgtttacaaattattttcttttgggccaaaatattctgaaatattagatctatcggccctctcaaatttgtttagctttcaccaatatagaatcctgctcactagctatgtgatgcgattctagctgacctggcccatgccctacccactccgtataaattagtgtacgtacgtacatacgtgcaccgttcatgcttgtaacctaaagtaaatacatgtacaccaccctctgtataaacgtataagagaccacaccctgcagcaatgcttgcccaattctagcaacacctctagcccgtgtcaccttcctttcatagctaaacaaaccaacaaaaaaaaagtactagtatactagtagtatacagctagacggtaaaagaaaacaagtttatacgtactccaatggaatactccagtaatttaaaatttactccgtattatagcatagtatcagttagtactagtatactccctcggtaaaaaaacgaatctaattagatgtgacacattttaatacaacgaatctgaatagagatatgtctagatttacggtactaagggggtgtttagatccaggggtataaagttttggcgtgtcacatcgggcattatataatgtgtcgtatagggtgtttggacagtaataaaaaaaactaattacagtatccgtaagtaaaccacgagacaaatttattaagtgatccaattaatccgtcattagtaaatgtttactgtagcaacacattgtcaaatcatggagcaattaggcttaaaagattcgtctcgcaaattagttgtaatctgtgcaattagttattttttagcttatatttaatacttcatacatgtgttcaaacgttcgatgtgacagggtgtaaaattttgagatgggatctaaacagacgggacaagatattaattgtatagtaagcgactattatataaattagctagtattaaattggctatagatattttaaagctagtagttggctatactattaaacttgatacgagagagggagctagtaattagctactccattaaacttgctctgagagtgaggtgtgaggaggggaaaaaataaaaaaaattggagagacaagacaatggatggagatatcacgtcacatcaccgacacgctgcactgtatacgtacgctgtacagtacagtacagtaggagaacgtactccctccgaaaaaacaaaccctagatttacgtgccaacatttgactgttcgttttatataaaaaaaatttataattagtattttcattgttgtcagatgataaaacatgattaatactttatgcgtgacttatttttttaatttttttcataattttttcaaataagatggacggtctggacacggaaatcaaggtttgtcttttttttataaggagtagctccctagggcgtattcgtacaggcctcaagcagcgcgcccagccaatgggaacccgccacgtttccgtctcccatcttcatttcttcctgatcctctgccactttgatggcggagtagtaaaatacgaagtctctagctttccgctgcgacgtctactcgagctctgggcaacttgtgatctcatctcctgaatgctgccatctttggttaattgatttctcttatctcttttgttcttcttcctctctctctctattcaatataaataccccgttcctaaaaaaaatcaattttgtgttcagattcaatactaggattgtactctctccgtaaaaaaaaacaaacattgggtttaaatctggacatgatgcatgtccagattcaaacccaaggtttatctttcttttgggctggagggagtattttttttgacggagtagtataatctaatatagagtctcattggttacctatattttctaatatataagtcaaaacggtatattagggaatacaaattaatttatataagtaaaagttttatatatttttatagcgatttaaaagctaacgcaaaaagaattacgttgaatatatcttaaaatcaactctaaatataggttctagaatttaaattttacatattgctttggcttattaggtcaactgataaggccacagatataacatattctacaactacatatatgttgcacttattttgagatggagggatataatctctagcaagctaaggtcccgttcttttctctaataagagtcggataaagattaaaattttcatggcacgcttttcaaacggttaaacaatacgtttcgtgcgaaaactttctatataaaaattgctctaaaatatcatattaatctatttttcaagtttgtaataattaaaactcaatcaataatacgttaataccatatcgttttgcataaaaaacttaatctccatctttaccttcagaagaaaagaacaccacctaagatttcgcgtttgagcaagggagagagattggagatctttttcgagcaaggctgtgtttagttcctgaaattggggagaagtttggggaaagtttgtgctttggaaaaaaagttaggactttatgtgagtaggaaagttttggatgtgatgtgatggaaagttgggagtttgggagaagttccgtgtgaactgaacagtgcgcaagagaaggatccgatcaaacaagaagaagcagcagcagcagaggttgtagaccagtgacggatgtagaatatacaatttttagagtgaacgcctccat

SEQ ID NO: 82676 - DNA, 14623 bp, Oryza sativa
ccagatgaaaaaagtacggccaaaagatttttctatgttatgttaataataaataaagaagtatttattggtaaaacttgttaatattgttataaaaatgtattgaagttggttgttgcgcaatttcatatgttaagtgaggtattattttgtaccttattcgacgtattagtactcggataatttatatatgcctatcgcagtctgggtcatagaaacattatatggacttaaacaaggagaattatgtaacatgaagaaatagtagtacaatttgaacatgatacaactatttgcattgcggttacatagatgatattagattcgaactatgtcacatcctgatttttgtttcaggatttataaattatttaataaattaataatataatttatattaaatgttctttaatttacaagtgaagttaaatgtgggaaataaaatttcctaaatataaagcatggatggatttaatttttattaaattctccatgattaagtcaactctctgaaattttctcggatttttcagagctcaattcctaaatgatacaaagaacagttcagtaattatttgatcattaatgatctaattataattgttaagagcttttcttgtttaaaaatccttaaattataaattattgtttaaaaggaattattagaaatgatcttaaaaacctaaaagagaagatctaattttaatttgttaaatctcaatataaaattgggctagataaaattttgttaaatactttgcttaattctataattcctagatttttctgggatttatttgagctaaggaagtatttttaataaatggaattgcatttcaagaataatttaaattgaaaaatgtttttaaatcctccttttggctttgggccgaaagtcggcccaaaacctctcttcttctctctccctccccggcccagtcggccaagtccgccgagccgccgctctcctctctctctcagccgctgacaggcgggacccacctgtcagtcttgtcttcctcctcgcgccgccgccgccgccagaaaccctagcgcaagccgccgcagtttccttccaaattcggtcgcgtctttccttctccggtgaaatctttagaggggaaataatctcctcgatctcctcttccttttctcttttggaatcatcgtctaaatcgctttggaagttcgtggattcgaggtcgattcggatcggtctctctctctctccgagcccgaactttccatcccgccgccggtcgccgtgggccttcgtcgccgctcgctagcccctttataaggatccccgagctctcctctacccgccgccaccctcgccttcgcctctcgtcgccggtagcgctctagcgccgtgtgacctagcgccaccgtcgtcgccgtcgcttcagccgtgtgccgccgccgttccggtcgtcgtcatcgctcgggaagaccgccatcgtggtcgccaagtcgccgccgtcctcgtccgccccttcgccgccgccgaagaccgccagagcaccgccgtcaccgtcgacccgatctccgccgccgtttcttcctcgtcgccggcgccgtccgttgcccttccgccgttgttttggtcaccggtgagttcgccgcgtcgccctctacccgttggtgtcctccatttgcgtcgtcgcgccgtcgttcgccggcgagcacgcgaggccgagccgccgccggtgctgacgtcatcgctgacatcatcgttgccgtttcccgtgagccggtcgtggaccgttcgatctcggccgtccgttttgggtggatcgatctcggccgttcgttcccgtgaaccgctgccgtgcacccggtccaccgcgaaatcctagccgctgacgcaataatcctccttttccttttcaaaaataattcattattgcgtcgtaattcaattaaaatccatataagtgttttaatccgatttaatctttaaaaattcataactaattcattataactcagtttaatgtggttcaagttgcaaaaattatataaaataaagatctacatattaaaattgtccataaattgaattaaatttatttaattctttttaaatgggctttaattagatttaatcttgtaaaattcataataaattatttgaagttagaatgaggccgttcaagtctcataattcatctaaaattatgatctacatgtttgtttactttttatgtatggtttatttggtttttattagtctttttctttgttttgcgtgttagcttgtcgtttccgtcgttgcgaaggttcgcgagtgcgccggaagtattcaagaagattaattgaataccgattattgcaaggcaagtcacacagatcctaaacacaatcctttgagcatgttgatcctatatttaaattctctatttatttcaactgtgcatttattttcgaatgtcactgggtggtgtgaatctattcctttgttatggcttgtttgcattgattactttattccttgataccttgggttattataacttgactaattgagctttatatattggttcagctagatattagatataattgcttagccatgcttagaaacattagcacactattgggataacttatgactcactattatttaatgatggtttaaagatagttcacgatggtcaatcgtgattggttaattaattacttgtcaactaaaacttgataatggtgggttgtgagcacatggttttgagagtcgtgctcatgacaattaagaaccggttcgcgagctactattgtgaaacattaatcgtgccaaccacaagccagcgtgggcaacggctttaccttttgtataacatgattcattacggagcaccagactgagaagtggcggagataagcccacgggggtcgctggggagtccatgccttgttttataagggggtgattatgatccaggaatggtgcactgtggtgagttgtgttatgcagagggtattgtcacagcctctattcgggtactttccagtatcgcgacgcatagtagacatgatgttgaggctgtgtcttgtgggtacagtggtacacctctggccagagtaaaactattcgaatagccgtgcctgcggttatgggcgggttgagcaatgtttttcgtgattagtctcacacctctcacaatagttatagatgttatacctggtaataatttgcttagctcctggtttggagattagatctgtacagccgggtatggttgttcaggatggttgggcctgtgcagcatgggtgtgctgttcagtgttgattaaaatttctgattaattactccactgttttacctctcttaaatgttttgctaaatgctgcttttgcaaatgagcctatattatgccatcctttggtatccttgtgcacgtgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttattttccgctgcagttttcttcatggtgaggactaagtgcctcttaagtaagtatttatcgttgtaattaatttgatgaatctgtatattaaattgtcagtttgtgtacctcggctgattcctggacgaggattttatgcacaaataagttcggaaattactagtgaatttccgggcgtgacaaactaggagggaggtagtgcaatagttgaacacaacgacgatgtagtaatgggacaaggaagcatgacagtagaaatttcaatatgccaagttgtccgataataggtaacccctacgtgaggatccctctcctctctcaaaccgcgctttagtaaccctgtattgctctggtagttcaagctgcacaacacggctaggtggagttagaacctttctggtgtctatccattctctgtattgacatctccttggtggttcctgggaggaaagaatagatgtaaagcaagcaaagttagtaaatgttgtgagaaaataaggattcatgtaatcaaaatattcttaccatgaaatcgtcgtcaagaatatttggacaaacaaagaaccttcgacccaatgttgtaggatttatggaacgaagaacctgacaacgatcaccacacctgcatcttggacgggcttcccatggagggagtgccgtagttagcacctgccagtcgctctgttgttcacgacattgtcgttcataagccgcgtttctctgtaagtattgctcagtactttcggatgcgaaataccagcgaccttcttgtaaacaagtggttaggtcgagaacgggattttctgtatcgacccactcgatgtatgcgcaagccgtagtgcgggtctgccgaatagagtagtgttacgaagaataaagcgattgcccatacggaatgaataagcatatgcagataataaaatacctcacggtcatagttagggcacctaaaaaagcgccttcctcgaatatcaggattcctcgaagccattagttggcatcgatcaccacataggcagagaggacgctggcaccaaggtggtagtaggtatacacaaggatcgctacgccagtttggatcctcaacacctcggcgtctagccattgacgaaagccggtcggatttgtaatgaagcaagtggggaagagagtactgaatgtgactgagttctgaaagattgtgaggcctcactcgttaaggcgacttatataggcgcaaaaaatcgagtgatacccctgacatgtgaacgtggtggggtatggtgggtacgcctgattggcgccgaaagatacatgcatgatcggcgccgaaagttacattggttgtatgcgccaaatggcggacaaatactcgtatcacacgcgaacaaaggaggctgcatcggtacggcagaaagtagtcgtgcatgcgccgaaaggtatcgtgcatgcgccgaaaggtatcgtgcacatataacaacaacgtagtcattacacaagcatacagtactggaaagtgaagcaagtaaacaaagagaagactgctctactggccccgccccgcgccgcgaccacgcttggtcctccgggcctgtgctcgcgcgtggtcctgggagtaggtgaaaagatccggtggcacagtacgggtagcacgagtgtcccgcggaggagtggcctgcgcctggtcctgcgtctgcaccggcagtgcgcctcccagctgtgaggggccgatgacgtcctctgtcgagcctgaagcgaagtcgaagtcagtgatgtcgaagaggaaggtggaaggcaacaagcagtccgacgaggtcccagcatggtccagtggtggaccctgactcgacgtgccggctgcctgtgacgaagtcccggtgtactgccagaactgcgctgagtgcgaggtcgacacagctgcctgagatgctgaccctgcagcctgggagaagtgggcggcctgcgttatagcgaactgggcgaaacctacacatcgacaacgggacccttgtaagctaagacataaaatgtatgtaaattgattgtcgaagtaatgttgtttttttaagtacctgtggggggcacaacagaaggcctagccgaggaaggtggggtgctgaacggtgcacgaaaccctgaagcaatcggcaagtgaaacggctcacttatatgtgcgaggcatgtacagaaatagtaataaaaatacctacctccgtgcggagggggagtcggcctaggaacgtgcgcagctggacggggaccagtcggtacgggtggccgctgtacagctgcgtctgcccgagcaacgtcgtctgcacgacaggtgagcactcggagaatcgagcgcatcgactccaccatccgcgtgtacgtcgtcagctgctcctctacgggtaccggaatccccgcgcctaaacgttggatcgtcgttgaaccatcaacgacgacccggttgatgtcgtcgacctgcatggttaatttgttcgtaaatattcgtaaaatttgacgaagagaaagacatgaaaacataaaggaatggtgcgatgcagggtactcacagcacgagcgaagtcctggtcacggtgcctggcatagaggtctctagtgctcgcaacgtggggctgctactccaagggagcgaaggtgaccctagtacgggtgcgtggctggtaccagcgtaggtaggcctggtacgactcctcagtgtgtggctctccctcgtggtccacgacctcctcggttgcgagcaaccagtcctcaacaaaagtcgccaacttggcgggccagtcgccagctaactgctgactcttgcgcgagtacctgcgaattaatgtgtaatattagtgtgaaacgacagatgttacaaaatattgtgaacatgcagattttaatgcaacaacggaaagcgtagtgcaagatcttaccggtgaacagcagctgggacggtggtcggaaacggtactgtaaagggctaacggaatccgaactaccgcatcacgcggaaaggggcgtgaggctcaacgcagatgtcgaagaccatcggaaccgtagtcatccagtacgcctggtccctggtgcagagtgtggacagacccaacggcgcacgagcctgggtagccgtggcactgtagggctcccacacgacgtcagtcggcagaaggcggtcgaactccataacaaactcaggatacgaccgcctaacctggacgtgagcccatcggcactacaatacgagacgatcgatgtgatgtacaatgaacttatcaattaacttaacaatacgataagatcgatgcaacgtacttgacgacggcaccacagagtacccatcgtagggtagtcgacctctggtcgctcctcgtacagtgactcctcgtacgcgtgctggtccacctcagggcggccgatcgcaatcctctcagctgcccagatagaaagaaagagagggcacccaccaaaggtcgcgctgggatccttcttcgtgcaagactcacaaagtgcacggtacagagccgccaacaacgcggaaccccagctccactgaggcacctcgcctaccgcggcgtcggcgatgctcctggcgtagtgcacgagtcccttgtcgaccgcgtgcccgtgaccgccacagaacatcacccagccaaaaagccagagcaagtacgcctccaaacatcggctgtaggagtactcgtcagcctccgcctgtagctgctcaacctgcaagccgtcgataaaatgttaggcaccttaactgcggactaaatatgtaatacgattgtcatttcggtacaaaaacactcacggtgaactgaagcagccacctcttcgtaggtccggtgttgcggtggtgtgccaacggctcgagcgggaggtgcggtgcgcgctgtactagtgcgaaacgtgccgtcagatcgtcctgccagtccacagccgtggttactggcccaacagcgtctcccgcgagcggtagccccaacaagtacgatacgtcctgtagggtaggggctacctcaccgtacggcaagtgaaaagtgtgcgtctctggcctccatcgatcgaccaaagctgctaggagggacctgtccacagtccatcgtctggccgggtccacgtcgccggccgcagcctccaccagccgacacatcggtaggaggccggcctcacgtagcctgcaataacaaattaatatgtcattataaaaaatattacagtgcaactaacttatagtaaaacactgttcgtacctctcgacaaaggagtcgtaaaccgtgagtagctcaccgcacgtccgtgcccggaacgtcccaagctgagccccctgcaccgcagtaaggtgagaccggtgtcggtgatctatcgccgggtccaacaactgaggtgtatcctgacgtgccatctctgaaaaatatagtgtttcgtgttagaacaattcaaaaaatagtactgtaaaacaaaagataacttgcaaaattataaaatagtaataaaataatgagattaattatgtacaacaagagtacaggctatttaaatatagcaaacgttactaatggtacataacgatgacgtgcaatttaacatatatgtagagttcaataatataacataacattacgtgtcgaagtccgacatacatcagcatacctaaagacgttaggcgccttagtctgacgttacatcacgagacctaaagacatgacatgccgaagtctgacattacacgacgaaacataaacacatcgataagttcgaaacgaattacaagaaaatccacatgccgacatagaacataagaactacaccacgtagccagacgtggcacgacgacgcctaggacgtggtcgagtggaggtagtgccttcacccgtaggtcgagctccatctgctgctgatcctgatagtcctgcctccgccgcacttggtttctccttgtctttaggacaatgcttgtaggtgtgcccatgttcatcgcatttgctgcaacgcttcaccctgccagcctccgactcgtccatatcgttgcggatgcgacgagtcctcctccttccagccttgcctcggagcttcgatgggtcaggaatattgagtacttcatcgttagtctctgtgaactccccagctatgccgaacccataaatctcgccgctccatgtatgatatattgcttgcttactgaagtactgtgacacatatactgcatctgatatgccacactccactgcggcagcaatgacatgggtgcatggcctgtggagcagcttcggctttgcacaagagcaatgacatgtgccgtcggctttgagaacacactcctgcttcactctcttgcggtagatacccctgcctgacttatcttgacatagtatctcaaacctgtgctgttgggtaccttgcactagagctcgatgtttcatggcctttttacgcaactcctctagctttttctgcatgaaagctccaaacaaaatgctgttgttcggcatagagggaagaactgcctggaaccgatccctaaaatacctgcatgtcccatgtaaaatgaactccactatgccaactagtggcagtccacggacaccgcgcatcacccagttgtaaacttctgccaaatttgttgtcattattccatatctagcaccacctgtgtcatacgccttggcccatttctcttttggttcatgcagaatccactgagaaaatttctgaatctccaatccagttcttctaaccaatgttggactatccgttgggagaggtccaagagcttgaggagggtcagcaacggcggtcgatggagccgctgcacgctgatcactgcatttggctgtcaactcatctaatctcttccaaagctcattgaattttttctcctggttctgattgcacagcctcttgaacatgttcatgagctccttgttcttgaattgcttgaagaaattagctcccatatgacgcatgcaccacctactctgtacatcttcccaaacaccggggtatcctcgttccatactcccaaactgcaactctcctatcgctcgcagaatgccagcgtgcctatcatgtatcaggcatacatttggcctcataccaacaacttttgttttaaccaatttcaggaaccagtaccagctgtcggtattctcactctcaacaaaagcaaatgccaagggcaatacctgattgttcccatctacccctattgttgttagtatctggccccgatactttcctatcaagaatgtcccatcaatgcagagaacaggacgacagttcacgaatgccatcttgcatgcatgtagagctaagaacgccctttgcagcacactcttgctaggatgttcaattgaggggaatttcttcacttcgtaagagctcccagggtttctttcctcgataacaccaagcaggtgtggcaaattgtcatacgaggcttcgtaagttccaaatctcatctctattattttctgtttggccctccaggccttggcatagctaatagtatacttgtatgtctcttcaatgtgtcggattattgaccttggttcatatgtgagattatcgatgacatgcgcatacatctcagatgcaacaaatgcacatgtaatgttcctgtggtatttctgaacactaggtagaaaacatgtatgcttggtaacaactgacactgtccaataatccttccatttccccttatacgcgtgcactctccagggacaaccatctttttccttaacacaccgaacttcatattgcgaccggttcgacttggcaacccaaaactctctatgaagtgacactgcaaaatgttttaccgcctccttcatatcttctgctctactataaatcgctccctgaataaccttattttctttgtactcccatctcacactatcctcttcagagacgatcagcccagaaaaatcctcactagcccattctgctggattaatatccgtctcatcatctgacgaatcaccttcctctacacgctcgttgtcagaatcctccctctccatttcatccacaatggcaccgacagtctccccctcgtcggccactccacctggttgaatgcccactggagctactacgcccccgtcctctcgtgcgttgacctcctccacagaagtctcgtttacttcagcacttggtccctcgccatcatccatgttcgtctgcacacctggatccttcgggtgaacaaacggaaccaaagctagaggccacccgcgttgcaatgcattttccaaataccatctccacactcaagagttttgaactggcattagttcccaataaaaaccctcagttgcccgacttactataacattgattgttatgtcacttgtctgtggatcaactctcaagcccctcattaaccatccttttatagaaggtacactcctctcagccggtctatcaatttccctttctgatacaataaaatctgacagatctaccccagttggcccgtaacggacgtttcctggtccatggtaaacttggaatatttgtttgttcgacatatctgtcaacgaaataactagatcatattactctttcatgcaataaacatctataacgtaatatcttcttgtgtaagccaatgccaatgcaacggtaatgtattgattccaaactagcagatctacgtagttaccgatatctacaatacgcacttctagattagtacaactaaaaccctaaaaatataatgcatttattcaaacaaatttttaaagaatacacactatttaactcaatagtcacatataggatctatgaatattacctgaaatcggcgtctgaatccggcagggtttcgccccttcttctcttctccttccctctcttctttttttttcactggaattgaggagagaagaatgagggctgggggctgggcagcaggccttctataggcagcgaggcctgccgcccggccagagggcggcaaggggccgcctgcaaaatagccggccccgactggcttttttgcattcgggccccttgccgccccaccagagggcggcaagggttttcctgcaaaaaaccctccctccgtcaccgcccgttcctcccccgtttgccacgtcagcttgccgccccagaggtgggcggcaggggctatttctgcaatttttttggtcgatagattatttctgtaaatattaaaaaaaaatctaaaaccgaaaaaaagtcagaacaggaaaagaaagcctatcttggcccataacttatttccttatttatgttgtcaccgttatgggccaagatgcatccgggttggcgagttcagctaacggtgctagagatgacaacggggaatacatcctatatatgaccataaggcctgaggcctaataacccagcccacggcacggccatttggctcagctcaagcatggcacgatacgattggtgtcaggctcgtgccggcccggccagacagttgggccgtgcctagccgatgccttggcatggtgggccgacccggcccggcaggattaaagaaaaaaagttgagggaccctatatagacttaactcagccatataagacacggcccaaagagaagaggaatacaaaatagactattccagccatataagacatagcccaaagagataaggaaggaaaaataggcttattctatggagaagcacggtggctattgtgtgtttggtccggcccaacacggtccgagtctgactcgagtcgtgcctaggccatgggtatagcccgtgggtaggcacggcccaacccagcaagtaggtcgggctgtgctgacccgactgacctcggcccaagtccagtcgtgcctggactgtgtcgggcctggcggcccatctggccatctataatacatcctcctcagtcctccctaccccccagtgagtcaaaactttccctgttttcgtccccgcgaaatacaacggaaaaaactttgttccatcccgctcttacacaggaaattaatcccgatgggtcttcatagccgcttaaaaccatatatagatatcaaattatatatacaatacaccacatatattcacactttatattaataatattgacaaactcacatgataacaaataagattatcatttatccaagatcacaagtaaagtaatcacataggatgtaaaaaaattgtaaatttggaccttatacaggtctccgcgggggacggataccccggaggccggtaattgaggattatctctgccgccgcaaaatctgacgtgtacataatttctctcatttaattttcaatggaaaaactaattctaaccatttttatctcctaataggagaattcaccgcagggaaatgggaaccgggccattgccatctataaacggtgcacatggaagtgaacggtgtgtgcatgtggtgagtgactgccgactcttgctgctgtaagcaatgacctcttcgacatgtgcatgcaaacgcggcgaatcggtgagaaaatctagataaaattttctattgatttgagaggatttgtgctagctagcctgctaggatcatctttgcttatgcaaacaaagctttatcagagtttaatcagaggttaatcatcctgtctgacagtcagagagcttgcttaagcttgttatatcagtcatggggtcacaatctgtctatataaactttttttttctctgctagaaaaaaatacatatatagtcttatgttgtcgtatttgtacatgtccatatcttaaaaaaattgtttcggcctaaaacggtcgtaggtctactcctggattgaaaataattgttgtgttcttgcagcacaagaagtctgtcaagagagaagcactagcatacaagaatactgcaccctgtcaaccattttaataagagataataaatatcataatgataaagatatttaagatgatttaggacagggtcagctcatcagatgcgtccaggttactctaatatcctgcgatttaatttcatattcgttttgattcccccaaatcagcagcaccagcatggcaaaatcacacaagatcgcctttcacctgaatacaaatatttttggatcacacgagattcgatccattttcagtggtttcttggcctgttgctcagctatgttcttgtggtcaaaccatttttctgaacctgtcatcctccaggatcagtgccaggttctctgaatgtctcatgttgctctcctgttttttcagtcttcctgatctccatttggcttatctctaggcatccaccggatcacagcatgtgatggaaaaatattcccctaatcttgtcgacatttttgcaggattgattcagttttaactttagattttcgccgtattttgcgaaagactccaaatccagatgctcctattatgcaactttcaagagcttctggtatgtgctgcatgtacatacatgatagttactaggaagattcattttgcatttacaggtaatgtaaagatgaggctgggatgcctaggtgcagttatagcatggatcgtcacagaatcagctaattgaggctaaaaggagcatatcttgatgaattattgggatggcaatgcaggaatagcatcaatcaatgtggggaaacaagaggttttaatcacctgcattcctggattgcaaacaacacatacatggcctgccttttgctgacgagatatttaacatattatagacacaaggacccacatgttataaacgtattagtaacaaattgttaaacgtcacatctaaaagcggtaaatagttaaatacttaactgcccagttgttgacagtaggccggaaacatgatctgtaatgaacagtcttgatttggccatatagcagatactagtagctactagtaacatccacattctttatacatcttttcatgaaacagatgtgcacatcaactctggcatataggtccagctggaaccattccaagaatctggtgccatatgagtaatacagaagggctgtgtctagttcagcgcaaagtttggattttggttaaaactagttgggtggcccgcgcaattgcgcggctagcacccatataaaattatatatttttaatataatttta

SEQ ID NO: 82677 - DNA, 1064 bp, Oryza sativa
tcaagataatagtcacacccaaaactgttttatttaaagggatccactttttgtcagatgatgaatgctagctatatggtagtgaataatggaagaacttctatcaaggaaaaataatgaacagtctccttactgtttttattgcaaccagtccccttcatgctcacttcctttttagctacaattcatttttaaacaaattactctgttagcgggtatctataagtgataccatgtgtatttagtgggcaaataataaagtattctgattttaattctttttctacaattaaatcatggaatacatactatttgtatgtggcagtgatggaagaaattaaaaatccagtacttctgacacatattacagtgtgattcatgcttttttttttgggtatggttctatcacttctctagaggtatatttatctacactgtttttgttccaaaatatcactatttcaatttgagaatctcaaatttcataaaacctgtaccagttcagctaaaacaagatggcagaaggcgtggtattcgctgctctatgcaaaattggatctgtcttggcatcatctgcaagcataacattaggtggacgtttagatgcaaacttgacaataataaatgagattgagagtcgaataaaacagatcgaagttgagctcaagttgatgcaagcattcctgcgccaagcgcaaaaacaagaaggctatagcgagcccactgaagtctacctgcaggaagtaagaaaagcagcttttgaaattgaggacatcatcgatgagtttctttacctgtctgttaagcacaagaacaggtttttcaatggggagttcatgagttacttccgtaaactcggtaaaacttcttggcacaaaattgctagagagctgaaggattcgcaatgtcaccttcagaatctccggaatttgtgggtgcagtatgagattcagcttccaaatggcaatagagtttcaaccgatgtggaggatcaccggcttccgcatcatctttcttacccagctgatgagatggtgggtgttgaacaagaaagaacaatgatg

SEQ ID NO: 82678 - DNA, 10248 bp, Oryza sativa
ccccccccccccccccccccaaccccgcatgccccattgaccgacgaaaacaccgaacaaaccgagcacaaaccgcagacgcggacgccgagcgaaatgctcgttcttttcgttggtggaatctgcaaaagcacactggaggctggtccggtacgggacaagacaaccacgcgagaggggataaaaaaaaggcgataaaggtaaagctagctaccgcgcgcatccaatgatcggatgcgatccggaggagaaggtcgccgaattccgtcttatccagagatggggaggtaaaaaggagggggatccacctaaccaaccaagttgcgtcgcgcctaaaaaaaatggccgcacgcgctccgccccggcagcaccggtcaattcctgctgcttcctcgagtcaactgctccagcgcagcgccccacccacgccttttacccgcgcgccagcggcggcggcggcggcggcggggtgaggaggtgaagtgggagaggcggcgtggacctgcgacgacctgcttgctgcccagcctgcgagggcaagccactggtaggtagtacgtgcttctctcttcagtcttcactgtctgtgtgtgtgtgaattggaatttggaagtgctggaggtaagcagtaagagaaggatcagatttggagaggctgaatctctgattctctctggtgtttaaagagtttgttcaattcgaattgtgggtttaattttggtgccgtctctcactgggagggatcactggatcacagttgtgctgcttctgggaacgttttggttaattctatcaggtctgtagttcttcatgatttttttttgaatggatgtagttcttcatgatagcttctagaatatctgagtcttgctaatattccttttttttttaatagcaagagaatttagtggtgctgacatactaaaaattagaaggtttatgtgctgtatgggcatgttcagatattttgatttgttaggcaaatttagatatttttaaccatggcgaccttttggtttgggggcataattgggagcttggttttgcttccttttttttgaacggaagttttgcttgtttcatgcgttctctttggaaataataattctagtacgttttgctgtgatgaattcaagcctctattttagtataccgatgaaacaattgtgcatttcaaggcaacttttgcttttcagcataactaacagcataacagtgaacagatagtataataataacagtaactacaaattctgctttgcctatcactcaatcttgtatgaacctcttttcttatccaataatattttgtctatcttataggtgccatactggactggcttgcttgttaactgggttagccagggactccggtattatactactatgatcagttcgtgtactttttttcgccgggcaagtttccccaaggaactcttttgatgctgtaattataactgaagagtcatggatctgctcagcgtcctcctaattatagcatctctgctcccattttcagcatctgaccgtcaaggtttatttacatgcctatcatttatgtagttattcaagctattttggagtgcttccacaatcatgagtttgcaaatacttttgggtaataaataaatttcttttatttccttaggtgatgcactatatgatatgaagctgaagctgaatgctactggtaaccagctttctgactggaaccaaaatcaagttaacccatgcacttggaattctgttatttgtgacaacaactacaatgttgtgcaagtgtaagtttattttgttgatgttttgcttcacttttattttctctccattttgagttaattctatatttacgtatctcttaaacttatatggcataatagttcttgatttatgttccacattcattaccagtgagctccagaagcatctgtttgagcacatgattatgatttttttgatgcacttgcacatgctatctgcacttctttgatgcacgagcacatttcataattgaactatatgaaaatggaaaaatcatacaacatgctgtttctttaaatcttcttcacaccatctgttatttctggcaaaacaacatctagatggttctgttgaccccgttatgcatgttccatatctaggttttttgtttgttccaagttggtgtgcctgatgacagatgccctcctgcagaacattggcatctatgggattcactggagttctatcaccacgaattggagagcttcagtttttgaatgttttgtaagtgtacttgtgttgattgttggaatttctctcagatatttggtggtagttgtgatgaaatagctactgtgatcctagaggaaaccagaagctggtattatgtgagaagtgccaactgttagctatttctgtgcttgctgcccaaagatttggttgtcttagttaccatgtactgtggtcttagactccagtttttgctaaccactgtagtgcatgtcattgcaggtccttgcctggtaataagattactggtggcatacctgagcagatcggcaacctatctagtttgacaagtttggatttggaagacaatttgttggttggaccaataccggcttctcttggccagctttcaaagctccaaattctgtatgtacttgaaccttagtcctttgttttatgaatgtataatgatttaacctgctcacctttttatctcttaaacaggatactaagtcaaaacaatctcaacggaactatacctgatactgtagcaagaatctcaagcttgacagacatgcaaggactcatacatgatttctgttgacaacagtccatgcctgaattatttgactaacatattttttttcttatgattgcagtaggttagcctacaataaactctctggttcaatacctggttcgctgtttcaagttgcacgttacaagtactgttggatcactgtgacttgtatactcatgttttttcaagtttgagctttgagttctgacaaatgttaattttctttacagcttttctggtaataacttgacttgtggagcaaactttctgcatccatgctcatcaagtatttcttatcaaggtaggaagcaattttttccctgttcaacattgcacatctgtcatacagcatccattggatgcctgtcagaattttcgctggaatatgctaattctatctgtttaataggttcatcccatggctcaaaggtaggcattgtactcggaacagttgtaggagcaatagggatacttataataggggctgtgtttattgtctgtaatggaaggaggaaaagccatctacgagaagtttttgtcgatgtatcaggtagtattttacttcatgattttctttctatccattcattcaactaaaccttttcctacagtcttgtttattattttattgaaacaaagatgtaaattatgccgcaaaattttatcatgcgacccccaaaacaaaaacagtgcaagcagagataactcacacatgttggtttatttctaaactatggtttccaggttgtgtatgtcaacacagctatttttactggcagtttcgcttactgctccatgtttaataaataatcttggtgaagtattttggtcaaaaaaatttatggcaaaataagaaaaaaaaagtagcatgcaatatgcaaagctgtcaagtgtttagcaccttcagtaattttctgataaaagatatggaaggttgtttctaaggtagcgtttcaatttacaaatttaggattaggatatgcataggctgcatttacatttagtcaagagtaattttagttaactaatctgtaacttatgtccccaggcgaggacgatcgaagaattgcatttggtcagttgaaaagatttgcctggcgagaattacaacttgcaaccgatagtttcagtgagaaaaatgtccttggacaggggggtttcggtaaagtgtataaaggagcacttccagatggcactaagattgctgtaaagcggttgacagattatgaaagccctggtggggaggctgcattcttgcgtgaagtagagcttatcagtgttgcagttcaccggaatcttttaagattgattggcttctgtacaacacaaacagaacgtctacttgtttatcctttcatgcagaatcttagtgtggcctatcgtttacgaggtactttctataactgatcaataatttgtttcgttcttccaattttatgcttctactactgtactataaagtttctcggatacttcactattgtgcctatggattatgcaactgatacttgtagtgcttttaatttacgcttgttgggtaatatggtgcatgtgcactattgatttcaacatcgcatatgctcactttcttatgtttagattcaatattggaagatttcaatatgtacctcattgtgtttaacgatgcagaattcaaacctggcgaaccaatattggattggtcagcaaggaaacgtgtggcaataggcacagcacgtggactggagtacctgcacgagcactgtaatcccaagatcatacatcgagatgtcaaggctgccaacgtcctgcttgatgaggattttgagccagttgttggtgactttggcctggcaaagttggttgatgtacagaagacatcagtgacaactcaagtccgtggaactatgggtcacattgcgcctgaatatctgtccacagggaagtcatcggagagaactgatgtttttggttatggcataatgcttcttgagctggtcactggacaacgcgccatcgacttctcacggttggaggaagaagacgatgtgctactgcttgaccatgtgagtctactcttgcgaagctggaacaaaattatcctagcctctgatagccatgtgttgacataattgaacgaattttttttgaaactaactgtgccagatagtgcgaaatttcatactgatatagcaagaaaaattataaaaatacagcatgagaggctataatcagcaggaaaagaaaaaaaacaaaataattgttgctctcattgaacatcatattcattctgaagcctgcaccgcttgaatcatcagtgtcatgatcatgcttgctggttgctgctgaaaatgtgcaggtgaagaagctgcagagggaagggcagctgggcgccatcgtggaccggaacctgagcagcaactacgacgggcaggaggtggagatgatgatacagatcgcgctgctgtgcacacaggcgtcgccggaggaccggccgtccatgtcggaggtggtgcggatgctggaaggggaaggactcgcggagcggtgggaggagtggcagcaggtggaggtgacgcggcggcaggactacgagcggatgcagcagcgcttcgactggggcgaggactccatcttcaaccaggaagccatcgagctctccgccggcagatgacgactgcgtacgtcctgatgcatgtcacttcccaatcccagtgttaatagatatacatgtatgtatatgtatggttggctcttagttaccatagggttggttatgtcactaaagaacccatgtcaagcctccatttgtgtagaggaaaacagctagagacgcatgtgttcagagttcagacttcagaagtcccaagtcgcatctgcttggcgaagccgagccacattttctaccatcatacgagaaaagaccaggaattaaccgagcgaagctgtgagaatctaccgtccgattccgagacaaggaggacggtgccaccgtggtgcgtcacagctggtcgctcgcgaggactcgagcacacggtgcacgacccgcggcccacgccggcatcattggctccgcgacgcacgcggcgctgcctgccgtacctgcctccctccgatccaatccgattggaaccaacctggcgaacccacccaccgaccaaaaagctcagaaaaagcgtcggggatggccgatggcggggatcacatcacgtgccgaaaccgggggccacagtacggtgaaaaacaccggaaaaaaaaaaacgtcaaaagactcaaaacccaaaacccgcgtgctgacaaaaactcgctggcttccaccgaccgcttcactcgcagcactcgttcactgagactcagagagtgaggtgacttgaggcggcggctgggagctttgggttgctggcttgctgctgcgatgggctgcgctccggcggcgcattacctcccggggggagggtggcggcggctgctggtggtggtcgtggcgctggtcgtgctcgaccgtgccggggcccgggtccgcgccgcggacgacgacacgggcgggctgagccgggccgcgttccccaaggggttcgtgttcgggacggcgacgtcggcattccaggtcgagggcatggcggcgtccggcggccgcgggccgtccatctgggaccccttcgtccacaccccaggtgacatgcaccgcgagtttacaagaaccgtgcttaactaatcctgctggtaaactagatcctgcgtgagctctcactgggttactgcgttacacgttctcgcgttctctgttcatgttccatttctcctttcaagattattaccggccatggtaatacttcgaggattaattctggtgagcgactcgtggaacaaagcgtgattttggacagttcagctgagtagtggagaatattcgaattttcagataccaatttggcttaacgagtttgagggaatgggggatagaatcagctcatctgattggatgatattaaattcgtggatcattatcttaaaaaaaatcgtgatgttgacattgtttttttccggatgaacagggaatattgcgggaaatgggaatgcagatgttactacagatgaatatcatcgctacaaggtaaatgagatcaattgagactatcttctgttctttttttcttgctcctgtttcacctacatatagtattgaaaggcagttagttttgtcagtcaattagtagatcgcaattttcctgtccatgaggatgctttgggactatctatacatttcctgacaatttttctcaaatataatataatagtaatgtaattacattataatttacatataactacaatgtaactggtatgcagtaactttcatataattttgaaaacgttagatttgctttaatattcatgcaagcggagaagaaaaaaatcacaacgcacacacaagtgaggggatcgcttcgtgaaaatagcatgttatcgtaagattttacttacatacaagttgtattgtagttacatgcagttacgatgtaattacaatacgattcgattacactatattacatttgtcaaatttttgggagaaaatttgtcagcaaatgtatagcaaaactggaatggttttgtttgtgtagttgatatccatatttgttttcaaccttaagcaagcacaaccttatagtgtatttatactttattgggctgtgagcaaggctcaagtttggccttgatctggcgaagcttagctcacagcgccatgctgctttggcaattatgttttcaggaaattagagaatacttactgtagaaaaatcttgagtcaagttaatcaataatgaatttcggcagcttgataattgcttactttttttttctgaaagaagataattacttacattgtcttcttgctagcacaggaagatgttgatctcttgaaaagcctgaatttcgatgcatatcggttttcaatctcgtggtcaaggattttccctggtaaataaaaatatggctctggctatagcatctacttgtactggttagctggatgaggatgaattccactgatgcattttggttatttagatggagagggaaaagttaacacggaaggtgtggcatattacaataatctaatagattatgtaattaagcaaggtataacttcagacatattgttcgacgtttgagttttgccaacataagtatattactgtctgaatatttctatcaaaactaacagggcttattccttacgtcaatctgaaccactacgatctcccacttgcacttcagaaaaagtatgaaggctggttaagcccaaaaattgtgtaagtcgtacatgccaattcttttttttaatgttttcactcacttatctattggtattgcctttccgttttaggctaattatatggtgataaaacatatgatcttgtcacaattctatatctgtataatcaggacttaatttttaataaatacaaggttttctgcaccagccattttttcacttatttttgttacagtgtgcaggagagctgagaggtgttttttataaggtgctatgaaagcagaaatggcttaacagttgatttcttcagaatgatcaaatttacatttgtgaagaaaatgaaattcgaaactatgacaaaatatcaagtttgcattttgcaatataggtgcatataacatatttacttgtcacagtctgtgcaaggagcacgtataatttttcttcatttttttgcagtggtgtattttcggactatgctgagttttgtttcaagacatatggcgatcgagtcaagaactggtttacgtttaatgagccaaggatagtagcagcacttggccatgatacagggacagacccacctaaccgatgcaccaagtgtgctgccggtgggaactcagcaacagagccatatattgttgctcataatatcatcttatctcatgctactgcagttgatagataccgtaacaagttccaggtattttctttctactaaagaataaagaaacagaaacagttagattgactctttcgttgttagtaacatggcaatttatatctcttcaacagttaaaccaacctgtttggattaatttagggtggtttataatgcatacctgctcaaaatgatagtctgtactcacgtctttaccatccgatgggcaacagttatcatcgaaattgatcccacatgctaattttcaacataaagcctttactatggtcaaaatgcatcatcttctttttcctcttcctttaataccgcagatgagtcatgagtgcattattgtactctttactccctccgtcccaaagtatagcaagtttgaacccttggcacggttattaagggaaggggtaaaaagacttgtttgccttctcagggtgggtggggtgtgggcctggactagttgagatgataatgaagctaaggggtagtgtggctagtttagtggtaaaaatcaccttttacaagtactaggttgcagcaatatttgggacaaaatttgaactctaaaagttagattttgggacggagtagtattctattaagctagcttattttaatgacattttgtatgggacatgcaaaatacaatggcagtattgataacaggtcacaaaagcgcaaacacatcttcttgcaaaatatattttccgcacagtctaatgatgttgtaatgatttgtctacaatatttctcactagtaattcaaaggggattgtttatggctgcaaattcagaatatttgtttgcctagtcttgtgaatcatgcatgccaatgaaattggtgaaagtagtttgctgtaataaatgtggccagaacagttgtgcccgaactatctgcattttgggacaatgcaatagcatatgtattttttaagcaaaagtaccacatgtatttcttagtgaaagtagttctaggagcatgccatatatgtcacatatattgcttgtcatgtaaggtcatattattcaatcataatagaatatatgtttaaacatttaggcaagtcagaaaggcaagatcggaatagttctcgattttaattggtatgaacctctaactaactcaactgaagaccaagcagcagctcaaagagccagagacttccatgttggttggtaagaccatagaagtaacatgtgacaaagttaaaggttttgtttgatacaatttccgatgctgataaaaatcaactacttcaattcaggtttcttgatccgttaataaatggacaatatccaaaaaatatgcgagatattgtgaaagaaagattacctactttcacgcctgaacaagctaagctagtcaagggctccgcagattattttgggatcaatcaatatactgctaactacatggagaccaaccagcacctcagcaagcagcaactagctagtcatctgattggcatgtttcatttatctgtaagttcccaacttataattaaggattatataatataa

SEQ ID NO: 82679 - DNA, 1384 bp, Oryza sativa
ttcctgcagccctgagtgagaacttcaaaaacatttgaagaagtggttcttttgaaaatgctgcttccaagcaattcaggacattaacctgttcatactcgtgtaaagtaaaaggaccatccgtttcctgaacatataaataaagtgttaaaaagctcaccagcaaagcatagtgctcattcttatttgagtgtctgtccaacaatctcctgcgcatatctgtgattacagttggcaacaactgcttcggcatgcgggcatacctgttcatttaacatatttacatagtaagtcaagaacagggaagagatacacataggagttcagggatctagatcatacggtgtaacagatatcaaaaggatgagaactttgaacaatgctgaaagcaaagtagtttgagtttcacgctgtatcaaatacaacattcctgccaatcagaaaacaaaatatgtcatataaaactttaaaaatactacccccgtccctaataagtgcatttatagcacttgaaggacgaaattactattgagagaaaatgacttagatgcccccaattaaatgaggggtggttggagctgggagggtggttggagacttgggggtaagatggatgaatgagcggtggttggacagaaaagtggtaatctagaagtgcgcttattttgggataaaatttgaaagctagaagtgcacttatttagggttggaggtaatatatctctttgctgatagcagaaggttctgaacatctagtgaaaggaagtgtccagatattggaaattgagaagtcaccgagcctcctacctgtatgcagctgcataagaatttgaccaagtgaagaagatagcgtagtgaaagatccccgtcttgatgactccttgtactcggcaacttgtgtcaaaactaatgcttgtccttccagcatggaagcaatggttgatgctgcctcaatacgcacctgcacatagacatccaggtaaatcaagagaattatcaaatataaacacactaatttgatagaagtatgggctataaagagtctgcacacattaaatacttttattttaacttttcaagtgtctacatcgactttttgcaaacatttaatatatgttcaactagcaacggtgtcaagacaattgaacaccctcagtcaacagctaaaacacaagctagcatgtaatggataagcacaatgttgtttgaaggtagaattaccagaaaatataaacactaaaaaaagattatataaatcccaattaggtcataggtagcctatagttgagaaacttcacactgaaacatgaaaataaatgtagatagataattacagacttgtacctttattataggatcgaaaatcaagcatgtcatcagagta

SEQ ID NO: 82680 - DNA, 563 bp, Oryza sativa
gcgcattttgtgcaccttttaggaggatttgttccttgggcataaccaagaagtgctactatccttggctcattaaatgtaaaccagtgcttgacacgattgccaaaggtcttgaaacagaagtccgcgtactccgtgaatagatccctacagaacaagtagtatgaagataatccagacttcagagtgttacttatacagctagtgatgccagagatacaggatgctgcatttagctagacaacaggtaccaataatcataatgcagtgcagctttcttttgacagaacaatagaactttcacgttcataataattgtcatttgtctagaattggagccaattttagtcaggaatttttgtgttaagaaactgataattttgtcccaagcattcatacttatcatgtgtgcttctatgtttaaaaccaagtctaaaatagtcaataaccaacaaatgacgagagttctaatagattaacagacaaaaagctaggataaattactaatttgacttacgccatttttgcattcaaccagcctccgtacttcttctcaagcgcaa

SEQ ID NO: 82681 - DNA, 9589 bp, Oryza sativa
aattagttgaaatatgctattatccagagtacttttgggggtttatggattgtttcctcctactcaagagaggtaaacaaagtaacttcttcagtacagattttccagagatgccatttcttcttcatcattcctcctttgattacttcatgattgtttttacctgcttctcagcccatatcccttggaacattcacttccatgaaaattaccacctaaggaaaaaaaaacaaaatggtcagtaattgagaacttgctatattagttacctgaaagatagtaacacccagcaacacagatccatgtttcagtatacttgtggtataggagtagtatagtatagtatacccccacactgctttcaatttgtcagtactactactgtggtagtaacatctagccaaggaggatacaacggtccaatccaatcagatcaacaaacaacaacacattgatttctttggcctactaccatgctttcaacattctttcattttgtttcttcttggttaatgcttgaatttctagatgaaatggatggcacaagaccactcttgaggaatcctaagtttcctataaatcccttttataaatacttttttttagaaacaactgttttgtctcaacttaaaaaaaataaaatcaaaagcatattgcttgcaagaattcagaagatgttctaggtgaaattcttgcagattttattgcatttctctctcatgagtccttcattacaattaggtgaaaactaaagaggtgccatattaaatagagtgaatttattgcaaattaaattggttttcgatttgtcaaatttgctcgagacacctaaccaactaacccttattgtccaaatcaaaattccatctcgtgcgcaattagccctggccatagctttaattcgtcattagtaggcaaccagtgggggctccaaatggtcctagaatcatcacttttactttggatttgcttctgcctcttgcacattcccttattttgtagccttcttgagggtattaggtaggtgttttggcagattatctccccattgatcagctcccaattaatgccagatggtgacactgctaaagatggaagacaagcttgcgagaaaacagtggtagccttattatttcctctcacaagaattgtgcccacaacttgtcctgacatctgtgaatttgtctgtatgttgatagtaatagctggatgaatcatgggtgcttaacaatgctcttacttaccaatagtgtttatggtcggttggcccttgcaacctccaaagaaccaattggagcaattcagccttctcttttttttttctctctctgtcattttctgtgctttaactgttatctgaacgagtagttaactgtataatgtcaaaggaataatcttgcacaaatttagtaccaatgttgttgtagaggagcatgtataagctttatctgtggtactgtggtagtaagtaggatgtgtagagtgtgcaggtcacagttatggatcactgaacaaataaattaactcccctgcttttgacaccccaaactgaaacatataaatgctgcaatgaataaagcaactaactttacactatcacagccctagcttctgttctggccagtttcttgctccctccagacggtaatcactttactctgtatcaacatttgcatttaaactggttgtggttgactggttgtttgactagattagcacaactagaaaccatgccaagccattcctgatctgcagtgtgtcgtttctttcttctgaactgaagatttgatcttttctgtttgcaaagttcatgcttacacacttactacacttgaaatctgtaagataagtgctctacattgaactaaaaatacgtaaattttttgtacatgatctgatttctcatgtgcttgttttcctcttagctaatgacttttatcttttctgttgtagaaattagaatccatgctcatttaccattgtaagatgaaatcctacattgagccaaaaatctaactttcttttctttttgtttgtacatgacctcgtcctctatttggatgaagatttcacctttgctactaatagacgagccttgcaaacaggctaaagaaatgatcttttttttttatttgagtaaatttcagaaatctacaactatttgggtcaaaactatcaatttgctacacgtcatactcatgcatacatgccaagttcacacgcacgcacaactggttacagttgcagaacttgcagtttaatgataaaatcgtttgatatagttacaacagttttgcgaaatgttcgccttaatcttatagaaaagcgatacctttgaccaaataactacagctttctgaaatttactcctttatatatattttgcatcacgagaaacaattttaatcacttaggtggatatctactcatttgttgcatgtgaacaaaatgaatatgaaaaaaaaaataaaaagaataattaatacacgtatattcacagatgaatttgttttttttgttataacttgtatatttcatattaatctatctcgttaatttttttatattatttatttgacatgcaataaatggacgaacatccacccgagcgattacaatcctctccaccaacatacaagtttaaattcaacttctataaattgtaacaaaaataacaaatttaactccaataagtatatgcatattcacaaatgaatttattaattttgttataacttgtagaagtcgaatttaaaattgcatgtttgtggggtgatatatttcatattaatctatcttatcaacttttctgaattttttttcaataaacgggcgaacatccaaccgagcgattacaatcctctctcttggtagctaactaaagaagtgatcttcttcttcttcttcttcatcttgcatgacttctcacgacaatggcggcgcgcgggtgcaggagagcagcatgagtactcgcaccaccgagctgggatggtcggcgatggcgaacaccgatgcagccgccgccgatgagggagaggcagcggtggcggcctgaggaagacgccatcctcctcgcctacgtccgccagtatgggccccgggagtggagcctcgtgtcccagcggatgaaccgccccctccaccgcgacgccaagtcctgcctcgagcgctggaagaactacctccgcccggggatcaagaaaggttcgctcaccgacgacgagcagcgcctcgtcatccgcctccaggccaagcacggcaacaagtggaagaagatcgccgccgaggtccccggccggacggcgaagcggctgggcaagtggtgggaggtgttcaaggagaagcagcagcgggagctccgggatcgggatcgccggcgactcccgccgccgctggacggcgacgagcgcggctgcgccggcgggcgatacgactggctcctcgaggacttcgccgacaagctcgtcaacgaccaccaccgccgaatgatggctgccccgatcctcccgccgtggatgtcgtcgtcgccgtcgtcttcttcctcgccgtcggtgacgcttagcctcgcgtcggcggcggtggcgccggcgcctgcggcgccgccgccgacgtggggtggtggtggaggaggggaggtggtggtggcggagttgatggagtgttgcaggtgcttgaaatcttttgctccctacgtttttaaatatttaatactctttgatttttctaaaaaaaaatatttaaccgctcattttattttttaaaaaattaattattaattttgttcctatcatttcattcatttacttatatttattaaatatacttatatgtatactacatatagttttacatatttcacaaaaatttttaataaaacaaatatttaaacatataattaaaaagttaacggcgttaaatgggggatttcttcatctcattcgtcttctttgacccactatcatcgattggatctcctcttttatgtgtcgtcgcttgactcgcatctattgttgcagggagatggaggaagggcagagggcgtgggcggcgcacaggaaggaggcggcgtggaggatgaagagggtggagatgcagctggagacggagagggcgtgccggcggcgggaggcgacggaggagttcgaggcgaagatgagggcgctgagggaggagcaggcagctgcggtggagcgggtggaggcggagtaccgggagaagatggccggcctccgccgcgacgcggaggccaaggagcagaagatggcggagcagtgggcggccaagcacgcccgcctcgccaagttcctcgaccaggtcgccgcctgccgccgctggccgcccgtagagatcaacggcggcggcggcggcggccccggcggcggccggtgagccgccggacggtggcgctgcatgcatgcgtagttggacacctcgctttcttgcttcttcttctcgtgtcctttttacaactgttggaattcacttctctctagaaatatgtaatcttttgagtctcttttgatcattccaagtttcctactagtagctctattgaataataaatggaccaccaaattgcaaaccaaaatggttacaaaagaatatcttgagcagcagtagattgcaatggaaataagtttttttactctgtggttttgtgttgggatagtgcatgggccaaatgagtcgcatcacgatgaaatggttctgtaggatctttgaaacaaaatttctcgcaacaacactatctgcaacgaattcgaataagattcagtggaattgaaccagacgattgtttttaaagcgcctttggaatacaggaattttttggcatagttgaattctcgtgaaattccagcaaactttcttcattccaacgacggtcttatgtttatttttttacatgcacaagcatatcagggagtaataagcaagagaaaataacaacataagttacaaaatccattttctagttttaatataggtcataataaaacgagttacctgctaggcagggaaataaagaatgggacaaaacatcataatctagtatataggagtataatagaacaacttgaacatggtaaggtggtacccatcatcacaaatggtacgatgttaaatgatatcgactgctcattcccaacttgcgtgtggtcatcgcaaaccgtttccttttcagtcaaacaaacacatttacgcgccaacatcactcatgcaattatgcatacatctttcatcagggggggacctaactaaactagaccctacctagatatgaattatactctataatagaattgtagtagaaccctatcaggatatatgacgctacatagaattgtaaatttgaactagcctgagctggctgactgatctccagagaacacacttccactggacagtgccgctgatcctgactgggaagggcccaacccgcggttcctctggatctgcctaagcctgaatatgtcccgcggcattgctcggctctgcactgttgtcgacgtatcatcctcctcttgtgctcgcccccctgcacacaagttgatgattatcaggtcctatagttgatccaattgtatcatatatctgtaggtagatcataaaagtttgtctaggatagcttgaagataagagacggtactttcagagttcttccgcttcgtgggttgcccgtctcttggaggtctatggatggatccattctggttcaatcctgatttgccaggacctgagaggtcactcgtggcaggaccaggaacttgcgaacctggtttgtctcccactggcaatgtactctgcatcagcacgcttagcacaatatccatatctggtgatggccctatcaagatgaaaaaaacattgaccttagcgatacttcagcaacttaaattcaagatatcaaacagcaacaaaaagatcaggtactcaaagattatcagtaaacatatatgcagctgttcatgtcatgcaaatggaatcccagaacagtaaataaaggactaacaatatgctaatatacatatgaaaaaaacttttctgaaagaactgctgcgacttctaagtcatgtagtattttcaatcagttatgctatgcctgatgttgaacattgcaatctttaaactgtcaaacattccagcaaatacactacaggaaaaaggtatgcaacaggatctcatttaagctttgctcctaatgattccgataccatctggcacacaactaggaggctacagatcagaggacagtgagtacttgggtcatcggagtgcaagttcttagtttggataaagtggggacatggagccattctagttcatttcggtttttaattacatataccacatgaactagcaattgcagaaagttgtatttttagtttggataaagtggctcaatcctgaggcataccttcaatagcaggcaaatttgtgatgaaagacatcatctgtggagaaagtcttttcaatatttcatcaatctcctttgtatacccactggctgtggttgagaagtctgggcctgacaaaaataaacaatgatattttatgtgtgagaaaagttgacaattgtgtctgaatggaatggctggaagcatttgcagcccaaactatgaaaaaaaaaagttgtcaatcccatcaagtaacattatgcaattggcagattagatgttcatggtagcaattaaatgagataaccaagtgataataattttttgaccaagcattaggcagtgtaggctggcagctatacctaaacacagattacgagttgactcatgattatctgaaattctgcatactgcattattaggtgtcaatatctgatcaagacaaatgatacaagagtgggtactactatttcatcaccaagggaatctaggacaaatgtggaatatggaaatatttagaacactgatttgtatacctttcatctgtctaggatcatagataaccattcgagaaatctcaggacgaacaacctttgaagattgtgggaacgactttttattggaaccaactcggatatcacctttatcttagccaaacaaccagcaaacataattagcaactccagtagtatttacattgacatgatggcagacagaacaaaaaaaccttacctaaagtagcaccgccagttagcacaactgatttgtcacccctattagcaatgttttttgcaagccactgtggtattgacatcaagaaagcgttacaagtgagatttttcaatggaaatcaaactgttacaatgtaaaaacctgcatcagaaacattaagtagcaaaaaataaagcattttcaagtagactgaaatattaaggactgactcaagagagatatctcaaaattgcaacatgaaatagattccgactttctatttatgaatgttctcacaatctcgcacaagaactgccaagggatacatgagcatatccttttagataattacttggtatggtttatattaagtcctaagtccaacagccagtggcatcagagcagagacaagggaaagcaagagtaacgctaagccttgtacgtagatgcattaaaattgagcttgactgtgagttccaaatatgagcttgttacatttgcttcggatgaaatatgcaaggtagttgtatatttgagatagtgcaaacctcatgtcttgatagataatccaattctttggttgagcatggccaaagatccatatagctgtatcgagaaacaacgtcataaagtgtgttttccaaggcagataaggcgtcttcggatgtcctagataaagcctccttccttctttgttccacctgagaaaacataatttagagcaaggaatgagggaaaaaatatttttctccaaagtcaaattaaataaggctaaatatatataaagcatgcacatcctaatccaattgtgcatgagctgttattaggaaagcaggaaatacacaaattccattgcaacaagcacaatataaagtcattaaaggatcacaatacaataaattgggtgagatcaatacaaaaacagtcagaagattaaaaaaaattgtatgcccacaatgtggtttcaagattttacaatgtgtaattattgttccaaaactgaccaaaccaagcagcagcttagtatttctaccatacttgacattgtcttgccccgatactatgtaaaaggtttttaataagtgctgtaagttatgtcacagatggcaacttggcaagtccaaggcacaaccatggagcacataaattttaacacaagtatgcctttgcaaaatggattattctatcctgcaatggtaacatatatataagttttgcctagattcatacaattatgagcctcatacctttaacatgcttgacaaatccccgtatgtttgctcaaattgagcaaatcgtttccacacctacaagataatagcaacgtgcattactcagacaacataaaaaaaagtgtttatattcctttgccatggaagctaattacacctaactaattttaactgaactgcagtattcccctttgtcatggaagctaactgtaactaatgcacaaaagttattgcattttgcatctctctaaaacaaaaatccaagtatataacttaaaaggaggaaaaaaagggtcatacataagtgcaaatttgctactgcttaaaaggctccgatgcaatacttaccattctcagaaaatgtattgcaactcatgagttgtgatttatatcaattttgagaacctttcgctagagaatgaaatagaaactctacctctatagattcttcaggaggaagtaagctcagagctcgctcaaacaaagcacgcacatttctgtcgtcatttaagcgacacaggaagtctgcatatctgtatcattgcaccagtcccaacaacacaaactttgattcatatctcttaagtaaagcaaaaaaagtgcaagaaacctttcccaactgttaatttatgaagatagcataccaaaatgtcatatcaatgagcctggaagtgagaacttactcaaggatatatcctggctcatgcataaatcgctttaaaccagcttcaaaaacactttgggctacctggaacagaattgtagcagatgaactaatgcaaaaataaaaacagataaataacctaaaaaccatgtttgcattttttatattaaaaaacatcaagataattcctttcacaacctttgcatccttgtcaaggcaaaatgccattgtagcgtaagcaacatagacatgataagtgcagcctggcaatttccgagcatccagaaagtacttacgagctgcttcaatgccttcagttctccttagaaatcgaataaactacaacagaaaaccagaatgctaaagctctcacatacattacagcaataatctaagtatgccaaaagtaataacaagttagcaactcacctgaatatgtgcaagtgaagtcatcccgcattctcagctataagagactcatatattgctttagcaggctgcaatgcaattgaaggagtatttgagaaaagtagaaaacaaaatcatttttagcgtagctgtagctatccaaaaagggctgcaggaat

SEQ ID NO: 82682 - DNA, 7770 bp, Oryza sativa
aaaaaaaaaagaagaaaaatctctacttctgactttacatggaaacacagaagcaaatgtaattttaagcttacaccaagtcattgttctgatcgttgatctgaagtatggtttgcataccatgttttattttgcaaatgcatgcaagaaattttgattgttcatgctatatctagtttcgattagagttcatcggcacgacaatgttgtagcctttgcacgctaacctgtgtaaacttgaatatctggttcattcaaatgttggagcaaaacaaatcatcgcaaagtaacttatcaattatcagataatggggaccacgcattactaacttctggacaccttgtttttttttttaccaagttaggctagtgtttggttcactgccacacttttctagctcatgtccctacacgtcatacttacaaacttttgccacacttgtggccgacaaatttggtgccacaaaaactatggcatgccataaaatgtttagcaaaatagagcatccaaccaagcatgccctttgtgactaaaattccttgtcagtaattccagggtgtgcatccaaaaatattttcgcagattgatcgttctgatgattaccagatgataattgacaatgcataaaataaatttgggccaaacatggggtgacattgaccaatgatccaattaaataggcacacatacctgtacagactgtagtcacagctaaagaatctcatgagaagagaacaggataggccacatgctaatgcacaacttcacatgtttggttctgacattgcaaatctcacaataactatactgggaaaattttgctacatgttacagtcctaagttcatctagtccacctgatggctgatgttcagaacaaaagaaaaaaaatacacaaaacatgagcagtttattcttgattacctcaacctgagaccatcagcaacctaatcatcagctgattacatgagtatgatctttgacagagacagtcaggactaggagctggtggccaagaaactaatgctttacaatggtagtaacaagccctgcttgaacatgggaaatgttcatagaatggagaatttttttccccggatccatatcaagctctggcagttgagtttgttggtgataggccagtcggtgagttgcatgtgtcaggatcccgtttgcccctggatctcttctttgctttgaacctggacttggccatcagcgtgtccactgtatttgcaaaattacctatcgccattgcgatcagtaggactccacagaccacaacctgtgagagcatgcataggttatgacacgggttaagtatgatagaatcttggttgtattaagagccaaaagttcttacctgccactcagggacgatgcctgtatgagcagtacgaagaagtaaaaatccaacgtaaccctcaaaaccctatacaagtatgtgcgaaatcagataattgacttgagtgtctacacatttatcagaagattataatttagtgttacataaagtcagcatgtgctaagtagatcgcattaccatttagataatagacctggatactacccttcataggaattttcagcacagcattgtgtatttaccaaaaaaaactagaagtatcacaggataaaaaaaaaagagaaccgatctgtccttgatgaggttaactaggtattggtatgctcaacacctgctatcattaaaaaaaaaagtacctgcaacagaaagaggacagggcatagtagcaacaattgaccttcaacaccagcagtctctccccacacaacgtccattcttctagcctaccaaaaaagaaaattcagttatgcaaaattacttggactaaaatgaaggaaatgacatgatctcacaggtaagtgcatatagccacatgatgcttgaaatgccataaaaaagcaaatagataccagaaagttctttggaacagcaggaacatagagtatcagtttgttttttgatcagaaaaatatgttacctttcctaaagcaatccgagtatatagtctttggcgttgatatctgttctgcaacatcatggcgaaaccttgcattatggcccagcacagaaacagctcgacgcctctctgtgaataagtatacaggttatgcacattcattatgtacagtatatagtggaaagaaaaaaaattgcatacctgttttcgagaacaatcaggttgtccctttatctcccatgttagactaataagagacatcagcatggcacaatagtgatggcacatccaccttaagaacaaaagcaatttccataagttccacatgtatcagagtatccagtggtattggtgcttacatgtatagacatatagtgactagaaaagagcagacaaaatcttaacaagcaaagaaaggctggccacctgcatgttataagtggatagacagtttttgaaatttgaacaacacaaaatatttagcatcatttacagtctatataagataacttaaggcttcagaacattgaaatgttcccttgaaataagaggtgaaaatattggtaactactgacatgcaaaaattagagaacaagaatggctacaccctcttcatttttgtatatgggcaattccaaattttgtttttttttccccttaccaaggacggatatcacttccattaactcgtaatatgttctctcgcagagctaaagttgtatacagaaacaacaaccaagcctgtaaaatataaggtatgctcactgtcagtttagtcttttggcatggcataaaacataagataggttaaactgtttgcaatgtccatgaataagcatcagtctacctggtatagctgaactggcaatactgggaagcatccattccataaccatgaccggagtaccaacagaatcattgggaaaccaagaaaaagcaatgcagtcctatcctggaagaaagggggaggtttatttatgaacaggacaaagagttattgctgtttatggttatctatcagtatactctaaggtgatcactcactgaatcgttcaaacaatattgtaggaaatattctcatttaaaattcttgtaacaatcttggcctcagtttgcacagaaaggctgctaattttggtgtcatcaccattgcaagcttgaaaaggcatttgaggcaagagttttttttttctacagggatagaacatcaacaagatggatgatagaaaagtttggaggtacaggatttctatgaaaaattaaaagttacactgctgaaatcgccaggtgtttcacttccactaggaagagtgaagaagtcatgggtgcaattccttgattgttatgtttgtcatttatgtaaatttagataagctatgatgttatagttacatagacaaataatagtagattagtttgacttgtttattaacttgaaattaattaattgatcacaatttgcacaagttaggcttatgtattgacttgacaaaacagtttcaaagaaaacataacgaattaaagtagtatgtgaattcaatcgatttgtatatgaattctctaacacctcagtacatctcaagctaacttaaaattatttgaggctcatggtaaaaaaaaacttgaacactaaaatgtgtgcagaattattattattttttttgtctagcagtgcagaatttacaattgtaaaagctttggacaacacaaagacactcttttcttctaaggtacttggatcaatgtgcaaattaaattcctgaactctttatcaaatggaagctcaaagacaccagaatgccacacccaaaattttcatttcaaaacacaacttgatggctatagattatcatcaatagtacaattgtaacataccctgtagctattatactcttccttcaccttgagctgcacctccttcctcggtgcccgcagatttactggtcccaggaacatcttcaggaaagtaccttccaagcccaaaaaccaaagcaaaaatatcagaatcccacatcgccaaaaaaaaaagcaaagcaaaatatcagaatcccacatcaaaaaaaaaaggaataaggacagaaaccaagaacaagttcaaacttttttttccataaaagggaacaattaccatgtgtcttgctcgggagcagcgccgcaatgtctccatcgcttatgaggcacgtcgctcgatccaagtcctcctcaacctgctctcaagcacacacccacccaattccacatccacagtcacatcagcaaccaccaaatgcatacgcacatgcacattgtcatgatcaatcagcagcagatacacatatagctgacagaatgatgattcagagaggcatgaattcccatgttcccacacatctccacactccacagccgcatctagaaactcacaaaaactcgagattgttttttttaaaaaaaaattacagcataccaaacaacccaaacagcacgcagatctctccccagtgatccggcgcccacgaagcatccgcccacgaagcccgaggcgcacccacccaccccggcgatccactccgccaccgacgcaccccacgcacccgcgcgcgagcgcgcgcgcgcaccaacgaggcgaagcagcagcagcggtagagagtaccttgtcgctgtcggcgtgggcggcggccttgcggagcctggcgagctcggcgccgagcgcggcggcgcggcggcggagcgcctcctcctccgccgacgacctcgacaggaggcccgccgccgcgtcctgcagctccctcgcctgctccgccaccctcgccgccgccgccgccgcctcctcctcccccatctcgccgcctctctctctctctctctacactgctcgcgcgcctcgctttctctctctctcctctatagagagagaggaggtggtggtggaggcgggggccagaggctgacaggtggggcccacgccgacgaagggaggaggagaggaagatagaagatggtttggtggtttgatttggaaggaatcaatccccctgatggaggttagtttaatggggtgtttgtgatgtgatttgggagcttaattgtttagtgtaaagggggagaagaaaaaaggagtgctgggcatgtttgtagatttggatgggatggatgattaggatttgatttgttgtttcttgcttttttttccttttctttttgacatgtttagttgttttttgctctcttttattaaggtgagtttgccttttttttttttagggatgagatttttttttcttttcttgtgggggtttatttgggggcacaaatggatagcatgacgcattgggtgtgattttcttttgttgatgtgggtatgtaccctagcacggtgttatatggctttatgtttttaaaggttggtgtgcttacgttggatattaggcatatgtcatccaaatttgtatatgcgtctgagttgtaaatgtgcatgaagcgatagctatggtggataagatggtcgtttttgtgctttttttagtcgtatacataacaaccttataaaagatggatagtatcgtgtgaaagaaagttttataacttgtctaatattacacagctttttacatgagtacgtaacaaattgctataatatggttagtgtcatgatgagaaaagtttcatggcttgagtacaccatttatcgtatttgcacacgacaacacgttaagatggtgcaaatggttggagtgatattaggacgagggagaaggtgaagcaattgaagatggcatttatcttgttttgcttggattgtcacattaattttgcgtagtggttatactaaataaccactacaaaatgaatgtacaaatttacatagagattgtcagtggagagcaataatttgaagcatgccaaccctggggacacactatggccaaagttatgacaaaaataagtttagaatgtatttgaataatccataataatttcagcaagttatctgaactttggaaagccactccaatattacattttttatcaactaaaaatatttgttagggatgacatgttcatcacgagctaataaaaatttatttccctagcaattttttttaaattttagtcaactgactatttgggagtactatagaagtacttggttaattgccctcctacaaatttacctgttcaaaacaagaactaggttggtcatattgatttgacacctaatcatctagatctacctaacaaactttcaaggactaatagtaaaaaaaaaggagagagactgacacatcacaaatcaatgctcactaaacaccataagatactagaatgaattatgtcatggctagggcacatatagatggcatatacacaacatcgactctttagaacaagcccataaagaatgacactcaaatagtcccaatgttcgtaccaaatgttcttttctcttgttttcctttgcagaagacgacatctcatctgttgatccatgtttggacggtgacagatgcaaaggaccgcagacaatgtgtttgttagctagctgttcaattatcagcatcaacagggtagtaggcgataaccatcagtggtacgatgatgattaattggcaggaaaattaaaaacaacgaaattaaaatggagaggataaggcagggtaaaatccacaggagtggaggcggattaatggagctgctaatctttcggccatgggttcatgtattaataatgtctgttgttgctatctactgcataatgtattttgtgtttcatgtattaatatttaataataaccgtaatgtatattatattttgctagctgatgcatgccttatccgttcgccgtttgctactggttgctactattttctcaagtacaaaagtagaaaaaaataataagaaagaactataaaatttatactaaatgctattttaattagatggtataagattaaatgtactggttataggacagaaccaaagttaatatccagaataattgacttaacttgttcctattgttctaggcgcacaagaataaagtggcatcaaatttggacttgagttagtgtcagtcaattggtcttaccctagtatatgaaaaataatccctggttttcttgaaaaggttactgacttggtaggttagatttattttttctattctaaaacagcaggtgattaacaggaacctggaggtaatggtcattggtcaacactccgtggagtgactttcactccatcagtatgaaaaaacacacaatttgtcccccaggttattgaatctaatagtgtttaattatttaattaacacaagagcactgcctactggcacactcctacaaaagaacttgaaaggaattgaatacctgttgtgttaatttcagaaacggcatcaatcacttgtttaccatgatgtcacctgcatgcatacatgtcaacctgtttaccaaaaagaagaaaaacaaggttgcctggaaagtacaaacagaccgttccaagacgcccatgctgaggcttatatgcttgatatgaatgaatttttcattggacaaactgatttggagagcttggagaagattttgatttggagagacatcaaatttaactatagagttatatctatagaagttgtagctagacggttaacaagtagtactctgtacagtaaaaaatatatttgtcatttagaataagattgataaaacatttaaaattggatcatcaataataatgttgctagtttaaaaacaaaggaaataatgtacgcagatttgtctcgaaaatactgccgtaatatcacaaatct

SEQ ID NO: 82683 - DNA, 714 bp, Oryza sativa
aatgtcttaacaaaggtaaataggcatggctaaataaaacagtgataacgcgggaatgtaaataaagcggtaatgcattaatttaaattaaaataattttataaactgggattcaatatgctcaaggatgatgtgacttgccttgctcagagagaacggccttccgaaccttcggcgacgaccacgaaccacgcttcgggaacctccggaacgatgaaagctacgcgaagcacacaagcaaagctacaagcctataaagaagtaataacaacacataaaaagaaagcacacagttctttaggttataacaaacattaagagacttgaacgggtcgattcggagctcgtatgaccaagatatgatcatctgaagtttaatgctgttatatggagatttgcggattattataattaagctttgtaattataaaacatgtgtaagcgctagcctggaaaagacaggagggctgcgccgttgacatgcggaccccacatgtcaacctaaaggaccgcggtagaccgagtacacagagacggtccacgggtcgacggaagcagatcccgtgtgtcaaccgaggcgagtgggcaacaaacggactccactagacaccacaccggctgcacccgtagaaaccacgctgctaccgagcgggcacattaacacggtcaccacacgcacaagcgaacgactaccgacaccggtacacgggtacc

SEQ ID NO: 82684 - DNA, 14470 bp, Oryza sativa
gaggtcgcggtgcatcgcctcgatcgccctcacccgcgcgtcgccggggcggtcgccgaagcacatgtgcaacaggaggcagagcatcgcgtaccggaagggctccatcacggtcaccggagcaccgccctcgccgcggacgtgggagacgagggcatcgagcacacagcgtcgcgcgccggagaacgcgcggaggcgggccggccggagggccgtccaggtggggccatacggacgccgggctgacggcgcgggggcgcgacgcgaacgccgccccgcgctgcaccagcgcgcggtacgccgcgccacgcgccgccacgaagatcgtcggccccagcggcgcgaacgtgaacaccgggccgtgctccgccgcgatccgccgcagcgtcggctcgacgtcgatgtccctccgcgcgaggaacagcagcgggcccagcaccggcaccgtcctcggccccggcggcagcggcgccgccgccgccgaggcgcgggcgcgcagcagcagcgagcacgcgaggcagagcagcgaggtgagggagtagaagagccagtcctccatggctaaacctctcggattatttttttccactcccgctgctcacagtggagggatatttatacgggagggggaaaaaagttcggcgggaaatctaaatcgagagagctatctcggttttgtgttattgcacgacgcgtctggtagccgtacgtcttcgtgctatcggagagacagacttgctttcactgcaatggcaacacaccaccgaccacatattatatttcactttcatttatatcatcatgttctactcaaaatatactatagacgagtccaatattgaatatatgcaaacacttaaagagtttacttaatttaaaagtaatttatttaaattgtagaaataatttagctttgcaatagaagtaactacctatagcatcggaaatagttatcctaaccaatcagttaataatgactgagatacgaacacatggatgttgtactgacaaagaaacatggaaacgagaccacttgtcagaaaaagaggacaacatgctaattgttagttgtcgtgtcgattcacgtgtatgctaccaaggctaacaacactaatatattttctttttttatagaacctttgatggtctatatttttttaagaccgtatgttatttttatgatctgtttgaaccatcatactatacttgaaacatgtgataaatgagtccaatattgaatatatttaatttttttttcttaattcctctataagtgtagttacttctaataatatgaaaagttacatccttatagcagtgtagttatttctaacgacgtgaagaactaattctctctagcagtacagttacttctaatatcttaaagagttattttaattttattttttatagttacttctctctagaagtgtgtttacttctaatattatgaagagttacttctattactttaaaagttgcttccctctaatagtgtagttagttttaatatcatgaagagttaccttctatatgacgcaagattttattttttaaataatatagtgattagtttaaataaagaatatatatatttacttgaaaatatcttctctacattgtgcttgtggatttactccacatagtttcttatttcaactcatcatgatgtaattacttctaatgctctaaatagttactcctattgcatagctaagttacttttgcaattttaatgaactacttttagatcaataaaatgtttgaatatattcaacattgaacttgttttatcacatattttaagcagagtacaatggtaaaaaaatatcttaaatataatataaggtttaaaagatacactagtgaccgatctatattagtggcaaagaagtatttatacatcacatgggataaagtggtcgatggtttaaccaaaccagcgaccgtgcactgggtagtcgtatctaaaaaagtctattccttttttataggcccaaaagaatatatttatccatgctgacattaccactaccagaaattggagtgtaaaatacaccaaaattctactactccatgatcaagtttagatacccaataatgtgtcaataattacttttaatgctaccttccatctcaaaatataagtaatttttagctataaatttagacacacttttatttagataaataattaaaaattattttattttatttgtatagctgtttttagttatggtaacaagaattcttcattgtgcatacctaataaagtgcattttctcttcttttattgtgatacaaagatatgttaatgtaaatgcaatttttccatgtctcatcacatatctattttcagtaattatatcggtggcatcagcaaatgtttaacattaactagatgaataccccgcggcgttgctgcgaaaaattaatttgcataatatgtacaaataaaaagtaatttgattattaaaactaaaacaaatttgaaacaattttgggcccaaaaataattgatattgcatgtttttatgagagaagaaagaagagacaattaagaccatagatctatcatctaaaggctagaaataattgaggtgatgtggcttaatgatagaagagaaaaataacattaactatatttagtgaggatgaactatatatacttatatagatacacccattatcttgtacccacgtctgaatatggacagctgtcaggttcaaaaaaaattttagtacacgtgaatcagaaaatacagaaatagaaaaaacatataaatagaatattatgcattgttgaatcctaaaaaaatattaagatgatccaaaatacaacaaaatataaagttatatggccgaaagtaaaaaaaaaataatcgataggtggtcaaagaaaaattttacaacaaaatatggcccaaagtgtaattcactaaaaacaatcatacagtatatacttcttccgttctaaaatataatcatctctaatattcgaaattcatctaagaacttctctactcattcaacttagtcaattataatcatctctcagttgcttctccagttaattgctcatctcagctaatcaaaaccatttttgatttaatttcaactatctccttattctctgtttctatgaaaaatacatatgctttgggaccgattaaaggagtagttagcaggtaaaacatataaatttcttgcatgactcgtgatgttgtttcttgccttgttaaacagtcaaataataagggtggttgccgggcaaaagcccagtcttggctcttttgaaaccctgacggacggcagcggcagttttcctgtcgcttctctccttggagacgttgtttaagcatccccttgccgaaacctctcgaacgattgatgcaagcacgctctaggatagagttgggctttgtgttggttgtaagggtgtttttttggcgatctcgtctatgttcctttgttgccctagcggtggtaggtcacacttagcggcggctggtccggtgctagccttctcccggacctgtgtattggcgctgtttgtgtgtgggtggtggtatttttttcctttttcctggttacgatcttccagggttgtaatcttgtaattttttttagctctatcaatagaacatcgttaaaaagaaagtcaaataatggaaaacagtagtgcaatatctgcaaatatctcttattgggtcggattttccaaagacattgtctattttttgcgaataaagtcaagtatttccccaatgcattcatgcgatagatagataactggtctgtggtcacaccactcaccacatcaaacgtgaccgtgatatacaaccgaagtatataaattacgcaaaattctcaggagggtccaatatttcccaggataatctcactgtcagaaaatcaaaacattggtgaattttatcttaatttttttttgcggggagaattttagcttaattttaaacaacaaatttcaaccatttttttaaaatataaattaatcctttttttgtccgtttccacaatttctcggtgggggcataaaaaaagatggcagatatcctcggaatcctaatgacaaacatatgacatatgacatgagaaaggttgtcgtaggctcgtcctccctccgtcgtgattgtgagtttttcaaagtttgactggccgttttattaaaagaaaaattgtcattagtatttgtattgttactaaatgataaaacataaatagtactttagtactttatatgtgacttatttttaaattgtttcataaacttttcaaataatacggacgatcaaacgttagacacgaaaacttactatcaaacttaaaacgcaacggagggagtagctttcttttctttcttcttttttcttttgacatgaatgttcatttgttgttaatttccctttcaacactgttgattccaacgtcaaatcaccatcatttttggagtcctctactctacccgtcatcaaacatgtcaccacattcattaatcataatcatcagtacaaatgctaattagctatgctcattattcattgagaggtgcagtacagtccatactgacaaacgcgttaactacgtaaggttgtggggtagtcagcctgggtacgaaacattaccctttttatttatttgatattagattattctctaatatttatgtttttttttcagtcagtccataaccataccatgcaagtgcaacaaatatttccccatgtattttttaattcgtgttttttttcagtcagtacataaccattttttagtcagtccataaccatactccttccatcccattttaaatgcagccatgaattttttttatccaacgttgatcatatgtcttatttgaaaactttttgaaaatattaaaaaaacataagtcacacaaaatattatttatcttttatcatctaataacaatataaatactaatcataaaaaaatttcaaataagacggacgatcaaagtttgacatggaaactcatgactgcacttaaaatcggacggagggagtcccatgcaaatgcaacaatattttctgcatgcattttttaatggttttttacggtgatatttacgaagacaacagctattccatccttcacgttcttattatcagcaccatggaattctttttggctcattgttcacaaattttaaaacttaatttagaattgatttaaggtattttgtcgtagtttatttttcagcattcgtagtttttagatagctaaaaaatttaccaataacttatttcgtgagttctataagccgtttttatggcctaccagatttacgtgaaacgatttaactaagaagctatgcactctttctattttcttttacattatatcggttcaatttttaactaaccagcaacagaaaaaaaaacagagaacccctcttctgtttttctccgggcatacttatgtgatgttgcggcattaatcgaatttgatttttcttgttctattttagagcattacttattatttttgaacaaaaatgctcagtacttattattgtgtcatctgatcacttattgcctttttttttctttcaccaatctggtgactttcttggcaggtgactaatacccaggtaattaaagttataataaaagtaaattatccggttaaaaaattaacagccacataatccaaccttacctacgtgttcatgactccaacactcactaccggccactagctacacaccaaaaaaaaaaaaatccccgtgaaattattcacccccaaaaatatcccagccacccacttcctaccagcatccaaacattctagccaggaacaaaatggataaacaaattattttcccaataaaaaaaggaataaaactttttttccctcccgtataaatatccctccactgtgagcagtgggaatgggaaaaaaatccgagaggtttagccatggaggattggctcttctactccctcacctcgctgctctgcctcgcgtgctcgctgctgctgcgcgcccgcgcctcggcggcgagccccaaggcggcggcggcggaggcggcgccgctgccgccggggccgaggacggtgcctgtgctgggcccgctgctgttcctcgcgcggagggacttcgacgtcgagccgacgctgcggcggatcgcggcggagcacgggccggtgttcacgttcgcgccgctggggccgtcgcggccgacgatcttcgtggcggcgcgcggcgcggcgcaccgcgcgctggtgcagcgcggggcggcgttcgcgtcgcgcccccgcggcggcggcggcccggcgtccgcgctgctctccagcggcggccggaacgtgagctcggcgccgtatggccccacgtggagggccctccggcgatgcatctcctccggcgtgctcaacccggcccgcctccgcgcgttctccgacgcgcggcgctgggtgctcgacgtgctcatctcccacgtccgcggcgagggcggtgcgccggtgaccgtgatggagccgttccagtacgcgatgttctgcctcctggtgtacatgtgcttcggcgaccgccccggcgacgcgcgggtgagggagatcgaggcgctgcagcgcgacctcctcggcaacttcctcagcttccaggtcttcgccttcctcccgccgatcaccaagctcgtgttccgggagcggtggaacaagctggtgtcgctgcggcggcggcaggaggagctcttcgtcccgctcatacgcgccaggagggaggccggcgccggcggcgactgctacgtggactccctcgtgaacctcaccatcccggaggacggcgggcgggggctcaccgacggcgagattgtcagcctctgctccgagttcatgagcgccggcaccgacaccacggccaccgcgttgcagtggatactggccaacctcgtcaagaacccggcgatgcaggacaggctcagggaggagatcgccgccgccgtgggcagcgacggcgaggtgcgggaggaggatctccaggcgatgccgtacctcaaggcggtggtgctggaaggtctccggcgacatccacccggccactacgtgctcccgcacgccgtggaagacgagacgacgctggacgggtaccgcgtgccggcgaacacgccgatgaacttcgcggtgggcgagatcgggctcgacggcgaggtgtgggcctcgccggaggtgttccggccggagcggttcctccccggcggcgagggcgaggacgtggacctcaccggcagcaaggagatcaagatgatgccgttcggcgccgggcggagggtgtgccccggcatggcgctggcgctgctccacctcgagtacttcgtcgccaacctcgtctgggagttcgactggcgcgaggtcgccggcgatgaggtcgacctcaccgagaagctcgagttcaccgtcgtcatgaagcggccgctcaaggcgaccgccgtgccgctgcgcggcgaccgatcggccgccgtcgagtgaacaaaggcctcaacgacggcgacggcggccggcgttttctctgaatgttgtagcatggcaattaggaagagaacaagagtaggtcatggcttctctttgctaatcatgctactaattacttcctccgttttacaatgtaagtcattctggcatttctcatattcatattgatgctaacgaatctagacatatatatctatctagattcattaacattaatatgaatatgggaaatgttagaatgacttacattgtgaaactggaggaagtagcaattaaaaatggtgattagatttaagttcctcttgttcttttggggtattagtagactgaactaatgctgtgctagtgcctatatgtacaaattactatggggagaacagtttggtacttctttctcataatcttgtactttgttgagcttaattacttaattgctaatagcaatctggttgtgttgttgagcttagttacttaattggtaatagcaatctggttgtgagatcccattcgccactattaacatgatgccgtcaagaaaatctaaaagaaacatcgtgcctttcatagcacagtctgcaaatgagtgaatagtgattagctattgcaggtttgtaattatcaggtaaataaatctgcaggaaccttcagacatgcagatttgttcatctgcagaaagatataaccaacctgcagtagttaatcacaaaattgatctggagggattggttgtagacgaacaccacatcaatgtgatgtgttctgaagattgctgcaaacaaaggttactgtccctgaacttgacaactattcatactcagatactggtactgcaaaattaaggatattcatttgctgatgccaccgacatgattaccgaaaatagatgtgaagagacatggaaaaaaaatgcatgatcaatagttcaggctattctacagtacattgatgatctctgtgccttggcaataaataaatcaacggcaaacagagtatggcaatttacagcgttccctaataggcagataaattatgtacctcatcatgattacaagctctgcttcataaacagttaccatctgaagttctggaagtgcatcaagtaagcatgtataggatacaacatggcatggtatgtgctctagcaaatgtactaggttgcaccagctagaaccacctcactctttattatcatcagcttcttcagactgtctaagccattcttgtagtttgagttcttgttcttccttgaacttgttataattctccaccgatttggagatatcagtcgaagagctctccttcatagtagctgtattgttatctaaaagctggcttgaaacaggaagatcatccttctctgtatctgagggtgtcgatgcaccatgtccaccagcttgtgatgattcaggagctgcagatgactctgactcctcagtggtgtcatcttttgttccgaaatcaggctgtggccatctgagagtggatgccttctgcttcgcagtgttgaacatggaagagaaataattacggctgcttcctccgtcggttgtgcccaaatcttcttcccatgttcctgagcttttccctgattggaacccccaagtggggttctggattaacctgagtgtagtgattttttctcagaaccaatgacggaagatgaactatatgcatagaaattatactttacgggaagggcctgggatgatcaagccagagctgtagagtggtctgttagttactaagtttagaagctataaaaaaacttgaacgttagtggaaagaacaggcactatcagagaggcttgaacaactttatctttatcttactaattatatataacatgttctgctgtcatgcttcatacttcatgaaaaaaaggaaaaccaaaaggtcattgttctataaaggatggtatgaatgaagctatttgggtatagcactgtattaaacaaacaaaaaagttagaaaacatgtaatgcaaaggaggttgtcaagataggtagaatacgaaccccctctttggttgggtctttgacattatcttgagagatttatttatgtccttgatcatatcatcagcaattggaagtccaaactctgccatggacctcactgcacagatagagtcctctatatcttcagtatgcaatgttacctcatgaatcttttctgcaacctttccctgatgagggaacagggctcatgttagaataccacaaaatcatatcgttaggcagataactttgatatttcctaataagtggtgaccactggcaggaacaaatgaaattgtcaaacagctgagaaattactaattattagtaggtatcagcttattttcaaacttaaaactgcttgaaggaatgcaatattgtacaggaccagaaaaaatctgaatggtaaataacgagcattgtcagttgagaacaaagtttcagcctttcaggtataccgtgttcatctgttcttccatgtttttgtaagagcttccctttaattgttgtacaatgtattggtaaaaaacctgtttcacacaaataatatgacctgcgatcccaacctgacccttgactgaaaacaaataaaaatcaaattttagatgcttaactggtttacaccgcatcagcttctgccaatgctaatcagaatatttattagctctggacttgttatcatgttggaaggtgtaggaggtggtctgtcaaaatctgaaagaagccactataacttgataatacaagatgcacgcacagaagttgataaatgaaattccctgaagttcccttgggtgatggattatatggtgacatgttcaaaaaaaaaaaattctgactctgaagactcaaaattgggtatataacaaatcagctggatccctttaataatgcaactaacacactgtaacaatagttatgccccctaaccaagtgtttaatgtgttgttgctctacttttctcttaatcaagcatctctgaatttcataccaatcacaattctgagataaggccgcgctgatgatagatcagtataacatttcaatcccaacgcgcaacgcagcatgtgcaaaagaatcaaatgccctataccggtagaacattaaggacaaggaggagatagagataggaaggccatggaccttgacgtcgaggaggaggggcatggacgcctgcgcgtgctgctggacgaagtagagcccgacggagggctcgttggccacgtacttgatcatctcgtccaccccgtccttcactgcaaatccccccaagataataaacaccggaatcagatcgctacgcaactgcaggcgaggtgttcgacggaattcctccaaagaatcaggagcaagaacagcaagaaagaaacaagcaggccggcccgcccgggatcgttaccgcagaggaagccgtcggccggtgagagcggcgaaggcgacgcggcggaggaggagatggaggagaggttgcgctgcatgtccgtgtccgccgcagagcgcggcgggcgaccatcacggaatcaccccgccccccacgacaccaccaggagctcggattcgccgccgccgccaccgctcaccggagggagaggaggaggaggaggagaattcaagcaagggaatctctcgcagtagaggggatcgagagagaggaggaggagaaatcgagcgagcgcgatgacgaacaaggacgaggcgagaggcgagagctggagaaggaagaagggtgggtgggttcagaaaattcagatgaagggtggagatttatttatttggtaaaagaaaatagtaggattagagcgagtaaaataatataatatatgatgtaagcggtttatatatattgccacatcatatttatgcttatgtggataagatagaagaggagagagaaaaaagcggactacaagttcgtagccggctacaacacgaaatccaataacctatgtgagagaaatgtgaggaaaacattaatgatgcagtatgtatttataattaaatattatattagtaggctattaagttagctagtatacatgatgtgttaattttaagagctaataattagctatattattaaactcgctcttaggaaacaacaatgtatggattggaagtacttcgtcgtccatgaatactcgttggttttgacaaatggtgtatgaactttgctcgttcaattttaaacgatattagagcaggtcgttttaaataacatatggaacattgtagatataatgtacatatatggcatgaggatatatgtagatgttatttttaaaagttggacaccaagaaaagacttggtatcaatggttttaagaagataagcaaatattcctagtgagcatgttcgaggagaattgaacccggacgaatggggtgcatgacagcaacccctgtcactacgctatgagcgtatctgtagatgttattttttaagtttcaactagcattgtttgcatagttttaatagtcgaagcaagagttctatctagtaataaagttgatggacgaaaattaaaacctcatgaaaagttgagagaagaaatataaactttttcgttagttgaaaatagtgtcttttgcgtttttccccctcagaaacgtataggagagagctgtctattttgcgttcacatagagagaaaatcatgtactatacgtaacagcatgacgtgccaggtaatccatgtaaacttttttatgcctaatcacagaaatttctggactaaaacagatgcccaattttgtctggaccgatcagaagctctcatcatcaggtattcaggtccctgatgtgccgtcagtttacaccatgatcaactttagcattatattgccgccaagtaaacgctagcatgatgtagttttcatcttgtaatcagcatcaagtgcatctctctatacacagccatgcatatacccccatttgattccataaaacattcccattcagtttcatgtaattcagatttatgtacaatttgattgcattcaatgtacaattttctgaatacccccatcttctctgcatttgattccattcagtttacatttttttccagacgagaatgggacacacataacaatttctgcatttgaatgtaatatgtacagggtaatggagtatgcctaatttttacaacagatgtgggggcacacaagaaagccccagtcagggtcatgataacatggagaatagctacctgagcctgatcatcgtttcaacgaattgcaacacaatggtggactaatatattaaccccaactaatgaagatatcctttttggagtttcgacgacagtgcagctgcatcaagttccactggtaggagattcaagaaaatctgcagaggattataatcatatttcattatatccctaagcacgagaaaacgttatctacaacctctctaaaatgtaactctgataatggcaacatatagggatattattgatcattgggtaacctaacatcattagcatagataatggtagtggaataaactgttcataactagtaagtagtcaataaatctccttctgttgtgactgttctgctagcaatcatattgcagttgtttttctatagaaacattgtttatctatgaaagttacgacaaaaagcaatttgcaggacattagctaattgcacaactgaacaccattgtacttaccatttagtgttttcatcagcatctccattgtgcaaactcccgttagagtcctcttctgtatcttctttgtcaaaactcccggtagcactctcgtacccatcttctttgagcaagctcccagcagtattgtcatccacatcttctttgtgcaaactttctctagtattctcatccgcatcttctttgtgtaaactcccattagtgctttgtgaagtagaggatggctccctggaatttccagggttatgtaacatgtttgaaaaaccctgccacaatcttgccggcagaaaaggcgcactttcttgttgctcctcagatggcacttcatacacaccagccgaacccggattcaactcagagaacctcacagctccaagaagtctctcggggagctctgattcggtctgaccctcaataaggaatgctagatctactgttagcgtctgcacgtaaccaaacgccaaatgaacaattgcgtttgcgacaatagaagatccaacatccacatcgatttcaatgaagtttgatccctgagtatacttgcacgtaagagccctacccaatatgcaaatagcttgttctcccacagctgttcgaacaatccaaggccctctaactatgttcgcgattagcttaagcctagatttccggaaagcctcatctcctttcaagaactgatccataagtgagccttccggtaccggctccagcgacacaaagtagaatatagcactgtaattatccttgctgggcagttgcaggttgaaagcccagacgaaaggctgattaccacgcaaaacctcgccgtcgatggctttcctcacacgatgactcttgttattcagaatctcgcatatcttcgcggggcttttcatccaatcaaacccgagaggctttagaagatactccccacctggtatcttcaccttggttgcaagataatcagggcctctgaccatgaatgtgtcccctgggggagtagcccagccattggggcagttgtcagggtcaagaaatgggactgctcctcctgacttgacatcctccatccactgatgctgaacctcaccattggaacaatccatctatacatacaaaaagtgctaactctagttagttattactactcaaagaaaccaaactgacagcaatgtaaatggacagaaaatagatgctcagaagattcagagttgtagattgcagatgtaagcaagagcagaacacacacaaaaaaaaagaaccaattttgccccccaaatcgggtccgcctcttcaa

SEQ ID NO: 82685 - DNA, 28975 bp, Oryza sativa
cccacaatctatactattgcaccacctttcaacaaatcctcccccatttcactattggctccccccaaatttcaaaattatctacttgttcaataagaaaaatcatagtattacttagactaaataagtgtttattgattgattcaataagctagaaacttaatttgtttttcattgcaatgcacgggctcttaggcaaactacttaaatcaagggaaagtttgaaaaaccctgccttctcactttgccccccatgtcccaaaacaccccccgagtgaatactttgtccacttatggaagtgtttatggattttcccttaaattaatataaatatcacaggcataaatcttcatgtattgaaagtgagcttcagttgccactgcttggcactatcctgttaagaattcactaagattttataagaacagcattgtagcccagtggtcatgaagctgccaggagcttgggccagcctgtgttcaagtcctctcagacaggttctctcgccaattttcttctttatcagtcatagatgctaagtccctccttactatcccacattttattcattcaaaaagatctcactagattttctagttctgttagctgttaaagcactccaacattccaaagtgagcatactagagaaagagctagttaccatacttctgtgaagggggtccatttatgtagaaatataccttaggtgtgcttggtgcctctgtaaaggaattttctctgttagctgaaacttcagcttctttattttgcagctgttaacacgaaaggcaaaagataatgatgtattagatgaaaggaaagaaattagagcaaataaggcatataccataaaaactttccctctttgtatatacaccattgaaataaatgagttcgctttaataccacccaaatttcaaaatttcctcaaaataccattccattgcctcttgtcatctctccataagggtttggttcaattccatcacattattggaaattttggtttctctaccaaaagacccaccaccttagcactatctgagtatatgccatttatctttcgtggtacactttattggcattggaagatagtactagtaagatttagataaagcggtgacctctgaatggcaacaagctaagccaaacaaggcctaatggggaacctatttgccgaggcatgacactatctacaaatacaacactgccgataccatttgagagagcacctatcagacgaaatctggacgtgctaccacgatacacacctcatggtgtccttctggatgactgcgctgtaacggtgatcgtgtgaactctacaagtgaggtgcaagcttagtgaagttgtaatgcttgcatctaattcctagtaataccacatatatccctagaatgctaaaatgaccaagcagtgctggcactctatcaacaggaaggtgtttgcttgtgatagaacttccttggggacaacagtggcgtgtgctctcagcagagaagcaggtgggaagggagggtgggtcaaggtgcttggggattatgtcagcctgctctttatggggaaggggttggtttatgcgttaggaggagtgataggaggcaagggaaggtacttggaggagatttgtgaagttattaaagtgaacctaactgtttcaattacaatggtatctaaagagggaagatattttgtatatacctaattttctcaagaaagtaaatcgctataaccaacatttatcatcgatttcccatcttttaatgatattcttcaataggtgcttcaataaaacagtgcatacatttgggatggaagcctaagtgcaaattgtagattaaaagcatgttgctaatcgctactctaagaaatgctaacttcaggagcagcatggttatcgcaagcttcctaaatgtacctgcttctgtaagttaagcagtgtaagtatctcattccgtagttcaagatgctcgacgcaaactgctttcgtcgggaccttgggcttcaaattcacctacagagaaacaatgcatacaatttcatgtatctaattgtgttattaaattataaaagaaaatgcactgcaaacctactagacccaaaaagaacttgaacaacatcagttcggtgcatatcaagtacagattgatgtctaggaaacaaaccccgaggtcttgtaaagtctggtcaacccttttgataactctaaggcccgccgaggcacttgctgcttggaccatttgatcaagcgcttgggttctcaaatacactcgaagctgtaaaagaatgtatagcgagtaaaaaacatctaaaaagaacagtgtgaagagtgatataccaattttcatgtgattcataggcatccacagttaatgagaacaagaccgctagtaatataattaacataaggtctgcttgtgatgagttcggcacaatcctaataacagccacctcccatgcaatgagcaagataacttacactatctttgtttttcaggaataaatgggacatgctataattgctcaggaaacataattttacacttagtttaatagtgacattatggcatggtaagatgaaggataggacaatgtggtttccacagaatggggcaaaatatggttagctttaaataaatagaacaaaatgtctactgtaacaaacaaaatgttaactcatcggcagctcaatataagagacagaaagcaacaatccatagtttcagagttaccattcgcagtgaagcaggtatggagttattcactgctgcagctggaagtgtagcagttgacaatgggtgtgtgttgctcaagggagatacaccatcaacattatcaaagtgtgccagtgctcccgcttcctcagtatgctatagacaaagcctcaaacgcttagagacatgtaaattccagaccactgatcagatagatcaggcagactatatcacttcaaactaactaccatcaaaattcataaggtttattagtgaacaacactatcatccctgcatgacagcaggcatctgggaaagcccaaaaggctaagcgctatttgcttgaacagatcggagtctcatagatatctagatgatttgacatctcttgcatcacagaaggaattctaaaaaaaaactcattatttgcaatataatgcaaattgccaccagaacattcttgcttgagattacttttgtggtgagatgtatggaattaaatgtgctgattactcactttgctagcagcacgagtttccataatgcgttttgcttctgctaaaatctgaaaaggtaacacttgtaatcagacataaaacattggaatctaaggaatgataaactgcacaagtcagctgctcataatactatcatcaacaaatttctcacctcagcatcctttcgttcttgctgttttgtctgggagagaagtgcagataaagcacgctttctctcggtctcatgagcagcattgaatgtttcctgagaagaaacccatatggacagaaataagtacaagggcaaacataataagaaaacaattactcaattattcataggttagatcaacatgtaccttcacaaggggattaccagcaacttcatcaaatgaccgagctctagcaatcagaagagcacgagtaactgcaataacaaagaatatactggtgtagaattcacaaaagcaaatagtaatgcacagactgaattgttgagcatagaattataccaaacttgaaatataataattggcagcttcagcagttgactgattattctaaataacaagccatgcaatcaccttgttctcataaaagaagggcaggggatgtataatgggacaatgaccagaatattgcttatatcaatttgtgtgcgtgtaaccttttcttaagtccccattatacataagtaatgtgagcaatattctggctgttatgataaaaacaaattcggtggaacggttacggagctgacaatttactaactgttcttgtttcatatattgaatgggaaaataaatggatatgataaccacagtaaatcacttgttggtttttgaccaagtaaatgcatgtgtagaacattaaaaattaacaacaaaggagaattttctgtggtggacactatctaagcatagaggttatatcaagatataaggtaccagaataataacggctcttcaaatcctccatgctgcgatcagttgggaacctatcaactattactatgaagcgaaggtcaaagcgttcacatagttcaaatagtttatctgtttcctccctgctccatgcctgaaatgaaatcaacaactgattatttatagaagggctttcaataaaattgtttgcaaatataatattttcaaacaaaggcttgcaactattcgaaatgaatgctcaaatgccacataacaagcatataaagatgagatgataacataattatgtataattttcgaacttcccaacattgttatcaattgtattcaagagcgcaatgatatccacagaaggtttttagcaatataagattttcaacaaaagatcaaacatagcatttataaaaatttattattgcaactagtacctacaggatcggttaaatacttctcatactcctcatcggtgtatttgagaacatccgccttctgcaataggaaaaaacaagcaaaaactgagtaagcatcaatgcaggatatgaaggatgtacccaacacaatatacttcttaccttgttgtattttgcaaagtgatagtcaccagtgggtggagcaccatttacaactctaacctgaaagatcaaaagggtgactttctgagtttttttttctaagatatgtatgccatactacaaattcatgagaaacagacccaatggtaaagttgaaggttgtcagtccgtgcagaggacgtgaaaggtagccactgccatgctatctgcagaagtacttcaaatggtcagatttagtacaagctccatcaaaatgggagcacgaaacaccttgctgcaattacccatatgactcaatggacatgaatatgtgaggtggattcaatctgcttatttgggttgaccaccaatttcaaaacagaagttgcacatgatcaaatcatcatttcatttgtcccatattaatcccatgagcaccttacccttaatgcctaattcctaataggtattaagtatacgagtagctaaactctcagctcagttcatgtgcttctactagagttatcaaattttcagcacatatcagctcaccttctccttctcaacagctggtcgccgcttcaggtgcgaagcctcgatggtcggcatgagtggagccatccccacccctccagtgagcgcgtacacctggatcatcaacaaccatcagcacttcagcagcaacgagaaacgcggggtcgaagtgtgcgggaggatggcggattaggccgcgccgtacctcgcgcgagacgccatcgggcttccgctgcggctccttgggcgcgcggggcttcttctcctggacggacgggaaggcggtcttggggaggccgaggatgtccttcgcgtccattgccgccggacggaggaggcggacctagggttagggttttggtctagtgcgccatgggagagagatcgaggtaggccgaagccgccgcctgcgtctgcgttgcgtcgagctgagctctacctcaacttggcctcgcgagagagatggattggagaagggaaagcctgagattgtatgggcctagtcatattgggccggcccaacttcttatggcctttgctagaccgagtccgagtccgacttcttggcacggtagctttttttatttcctctttcccgtgtctcacggcgaaccagcgaggccgaggcgcggagctgagcggaggaggagacgcgccacccctcacggcgctccggcgaatcggcggtgaacaccggcggtaatgcccccctccccttctccctcttgtagactgcgtcttccggccgcttggggtgggtaggattctgcttgtttgctctcgatcgttgggcgtggaagctggggtttgaatcggcggcgaacaccggcggtaattccccctccccttctctctctggtagacgcaccttctctctctggtaggctgcgtcttccggccgcttggggatgagattctgtttgcttctagcatcgtctcgatcgttgcctcgttgggaaactgcccttcgggtgaagggcatttaggtaattcacattagtactaaactttcaatggaaatataaggatgagtttttttttataagatagagggaatatgccatatctcataataacttattttgggagacagagggaacttgcatattaccctctcaaatatagtagtaattatttttgggacggagacgataaaaatatattctttgtgcgtcgagaatctcccccatcctctctgcgtaaaaaaaaaaattcttcccgtattgtctcgcctgtgccgatcgagcaggaaaatttgataatttaacacttttttcattgtccaattgttttagttgacacttgtgagaatgacatgtgggatcatctgagtgaatgaaagtgggacaggatttcaaataatcaaaacccattttaaggagtgttaaattatcaaatctctcatcgagcatagtgcaggggagaagccagggaagagggaggtgacgtcgtcctggtgagcatccacagctgggtcctggtcttttctccaataaaagttggatggagattaagatttccgttgcatgtttttcaaattgctaaacggtacgtttcgtgtgaaaactttttatatggaagttgctctaaaatatcatattaatctatttttcaagtttgtaataattaaaactcaatcaatcatacgttatttggcctggtttagttcccaatttttttcccaaaacatcacatcgaatatttggacacatgtatggagtattaaatatagattaaaaaaactaattgcaaagttatgggggaaatcgcgagacgaatcttttgagcctaattagtctatgattagccataattgctacagtaacccacatgtgctaatgacagattaattaggctcaaaagattcgtctcgcggtttccaggcaaattatgaaattagttttttcattcgtgtctgaaaacccccttccgacatggatatgacacctaaaaattttcttttcgtgaactaaacaggccttatattattttcttagggctgttttggattagtgccaaaaacgtgccctaccaatactttggtagtttgaacagtgtatctggtgattttggtttgaagccaaatcattggcattgccaatgcccaatttgatattttctatattctactcaatgcttggttctaaattggcctcaaaccaaatacaactctaccctaccaaaaaattggtagtaccaaaacttgcctaggttttggcactaccaacattttggtagggtattgaaccaaacaagcccttaattccacagccttgaacctacaaaagaaagtttgggggattcaactgaacccccatgtcccaagatggatccgcccatggcgccagcgccgccgccctccacccactccaccgcacccttcgcaactccggaggtgcgttctgtcgccgccagacgcccgcggcctgcggcggcgagcatctccgcgcgcctacgcgacgtggcgaggaggaggaaggataggcctcgtcgctgccgggcacaggtggctccccgcggcggcgaccgcatcagcgccctctccgacgatgtgctcctcctcatcctgcggcggctcgccacccgcgccgcgctcgccaccgctatgctctccaagcgctgggcccggctcctgcgctggcttgacaccctcgatttcatggtcggtgaaatactcccgccgcgctaccgtaggtgcatccaactccaccaagcggctggttttgctgcgtatcccgttgatgtcaaggttctcgttgcaagtatcaagcgacacgagcgccttgccatgcgaaacatagcggcctccatcaatagcttgttagacgcggatggcagtgatgaatgtgctggccaagctcgacggagggcccgtgtgctgcgggtggagttctttgcgactcactacaccgatcttatgaaccgattgatcaccaaggcattggatgcttgggaagtcgaggatcttgaagtttttgctaagcctgcatattggtctgagtggtctctgccgccgattgtccacagatttcctcaccatggtctctgcattgagccccacaagtcccggctgagaagcttgaagctaggtggttgtatcattccgccattgcaggggttccacgctctcaccaaaatgaccttgcaagacttgcgaaactccgtggccaaagcatcctatgaagatgtgtttaagtcatgcccccagttgcaagtgctacacctcaagtcatgcaggtgggcggaccggggcattctggttatcgatttcccaaagtcagggattaagcagcttattgtggagttttgcagcgccattgcactacactctcttgggatgcttgagagcatagctataagggagacttgggtcaggtataagcattgctccttctcgcatcttatgcacatgaaccttaacttacgccatggttaccgtaatcgtctgcgtgacttatgtattggttgggacttgaacatccagcagtttcttggattcaccaagaacataaccaacctggttctacgattcactggatatgggagatggttcgtgccatcttgcccctcgttgttgctggctaatctcagaaggctcctgattgctgatgtgccttcatcatgggatgtctcttggcctcgcctcctacttgaagcagcaccatgcctggagagccttcacatccatattatcccttgggatgacgattcttttgatgaaatcatttggcaaccatccactttgcagcatgaagaactaaaagagttggttgtaattggtttcgagggaacagaaagacagatttactttgttaactttgtgatggaagtatcaacaacattgcagcttgttgctctatttagatatgggcatgttcaagaaatggggcgttgggactggaaaattgtgaggcagcaacaccattggaatgatgaggagaaagcccaaattctgaaccagtttgctgatagagattcttgctcaataactccagttcaagtagttgtagagtgatctgttatgttaatgttttacttgtatacaaggctttaagttataaagcatgcatctgttatgttacttgtatacaaggctttaagttataaagcatgcatctgttatgtcagtgtgttacttgtttacaatgctttaagttatactgcatgcattatgatcttaatttatttctgtgcgactttttataagttacttttacagtaactctgtttttgttattatgccttgtatgcatgttcttttgtatttaagtggagccttctgtttgttctctactcctcttctctaaggttttacatttttttagaggttctcaagttttacttttgcatcataggacaccaagtcataaatttcatgagaggtatgtcttttgtaactgacgtgaacaagatgattagtgttcatagattcttatgacaatggggtcaatgtctcactgagtcaccgatcatattttgttgtgcaaggggatgtgccttgataattaacgacttccgtgtacaggatattcattagaatcatttataaaagataaaatcaaactaactaatgtgcagtttagtttcattctaggaccgcttcaacttggtccattgaacaacaaaccacctgtctgatctgctcctgcacggtgagcttcccctcgtcactccaggtatatttctggcttaccatctcctattcacctagcctcttgtccttgacatattcatgcttgagcagaacaacacggcgcaacgaccatgatatgcctcacaagctgaacctttctttctttcttgatctgaaaaccaatgaccaccaactcctccagatgagaatgcagtgctcttgagggctcctgctcccacactatctccaacttccgacgaacggccatctcatcatcgtcttcacaacgttgggaaaagtggacgtggagtctctcaagcgatggagcctcctcaacaagggcacagatccatgtggcatcccagcgcggcggcatgtccacgaccagcagcttcctcaggctgggcatctctaagaaaggactctccggcgtgacccacatttgaggtccagttagccgcagcatgagatctgtcatgttggccttgcagaaatagctgagcatggacagcacggcttcacgcttccacgtctccaataatggctgcaaaccatccccttcctgttggcctatgttgaaggtgagttacggcaccacgtcacccccttctgcccagggattttgtgcctgctgcaaatatgtgtgtctccatcagttgtgatcctttcatggatctggcttcttggtctttgctgatctctgtttcttgacttgaatccccattatctgatttctttttatttgttctttgtgtgtgtgtgtgcaggacagcaggagtgagagggtcacaatggtagagagcatcttgcagattggttgtatggtgagcagatgaatctgtggtaatgccttgtccaataattagtaaatctttgttcactgcaaaatacaaatttatatccctggctcctcccctcccaaacgcgatcgcactgaagtccccatctccttatagagtagattatgatagtgtactttttccactgttgtgtttagtagtattgccttcagcaatgcatctgaagctgttatgatccagtgttcaatcaatcaaatttaatagataacaaaacattagcgagaatttggatgtcgttgatattggttgtcgtttttctattactgtgatatgagtttagatcattttattttgttgaatataagctagcaaagaaaactgggattagctcaatttttttggcttaggataacatatgccagagaagaaacttgtaactaattaagtgtgcagtggtagctcaattttcttgcatatgctttgttggatctcatttttagtttgaattgcttaatgactataagtaagttaattataatcagacaccctttatttggggataacgactgtgtttacttcaataaataagaaagtatcatttttgtggcaagcaattttagtcttattgaactgttaccaatacttaagcgcacgagtccattgatattacagaacccctcagttttatttacaatgaagggttgttattgacctgattttgtttaaatcttgaagagttaggagtaggaaattgatggagctgttgcttgccttcccaatgccccccaatctaatcattgtacattccacaagagctatctaatcattatactggcacatttcagaagtaaaaggatgctcaatttcaacattgaaatcatatctattgctcaattacagatgtgatatggtaccccacttgatttatcgactgaatgggtgttcttgtgtgttgcgttgtaggggcgcaatgtgattattgagagatcccataggtctctcaaagacccaaagtcacaaatggagtaactgttgcaaaaaagcattgagtttgagcacagcgctaagaatgttggtgcaaacctggtgaagcaagttgctgaagctactaataaggtcgcaggagatggtatgggacctgagttgtaggaaaatcctgtacttgagtagccatatgaactatctattcgattgtgctttgagcatagcagatcagcagtccatctgatttctaagcgtactcaatgccaattcgccaacgagcatagtgttaacctgtcttttccgctatgtgcggttaatgttttttctcaactagtagtaatgaatatgttgtcatgataggttaattcttatggcatgaatcaaaatattgattgttatagcattagatggtaaggaccaagttctagtaaattcctgaattttttttaactaaattcatgtactctttttttttcgataactaaattcatgttcagcaaatcagcagcagttcatctgatttcctagtatagggcctattttctgccagaaactccccaaacaattcagattttcacttcgatttttaaaaaaccatatttgtaaaatttagaaaatgaactaaaagtaaacccagttttccagattctcatccgtacagtacctatagcagccccaagaagtctactgggcctatgtgtacatgggctgacatcagggcaagagttcttgtcgcttttcgctactggtacgtgcggttcgttgccgccgcggccgcgattgcgatctcaggcaacctcgccgccgcgccctccgcgacactcctccgccatggctaggaggaaggggaggaaaggtgcgttctaccggcgccgccaccgggatcccgcgacctacggagacgccgctgggaggaagggggcggcggcggcgctgtactgtctccgtcgacgccggacacccgcggcggcgccctgcgacggcgaccgcatcagcgacctctccgacgacgtgctcctcctcatcctgcggcgtctcgacacccgcgccgcgctcgccgccgcgatgctctccacgcgctgggccccgctccgtcgcgagctcgacgccctcgatttcgtggtcggcgacgtactcccgccgcgctaccacaggtccgtccaactccacaaaaccatcgcgtacaacggtgacgccaaggctctcgtcgccaccatcaagcggcaagagcgcctcgccatgcgaaacatggccgcctccatcggctgcttcctcgacgcggatgacagccatgaccgtgccggccgagctcgtcgtcgtcgtcgtcggatcggcaggctgcgggtggagttctttgccactcactacaccgatcttatgaaccgattgatcaccaaggcattggacgcttggggagtcgaggatcttgaggttttcgccaaatctgcttattggtctataccgccggatgtccacagatttcctcaccatggtctctgcaatcagaagtcccgcctgagaagcctgaagctaggaggctgcatcattccgccattgcaggggtttcaagctctcaccgaattgaccttgcaagacttgcaaaactccatgcccaaatcatcctacgaagccgtgatcagctcatgccctcagctgcaagttctacacctcaaatcatgccgctgggtgggtcagggaattctggtcatcgacgcccccaggtcagggatcaagcagcttaccgtggagttctgcagcgtcatcgcgctacactctcttgggatgctcgagagaatagctatcagggagacctgggtgagttacaaacatcactcctccttctcgcgtgttatgcacataaacctgaacttacgccatggttacattaatcgtctgcgtgatttatgtattggttgggacttgaacatcgagaggtttcttggattcaccaagaacataacgaacctggtcctacgattcactggatatgggagatggttcgtgccatcttgcccctcattgttgctggctaatctcacaaggctcctgattgctgatgtgccttcatcatgggatgtctcttggcctcgactcctgctcgaagcagcaccatgcctggagagccttcacatccatattaccccttgggatgatgagcattgtgatgaaatcatttggaaaccatccactttgcagcatgaaaagctgaaggagctggttgtagttggcttcgagggaacagagagacaggtttactttgttaactttgtgatggaagtatcaacggcattgcagcttgttgctctgtttagatatgggcgtgttgaagaaatggggcgttgggactggaaaatcgtgaggctccaacaccattggagtgatgaggagagatcccagattctgaaccagtttgcccatagagattcttgctccacaacttcagttcaagtagttctagagtgatctcttatattaatgtgttacctgtatacaaggctttaagttatactgcatgcattttgatcttacggagtcactgtttgtcttatgtttatgcgcattcataccgcttattagcaactaaactggtaaaacttttttataccgttttagcctagttttccctaagtaactgttcactgtattgtttgttctcttttcctcattaaaatgagacaccttcttctatatataaaacgtcgataacagcctgaccattaaaaaaaagacatttttatatatgttattagcgattcaaaagcaaatgttgtaaaataaaatatgatgaagaaaaccacaaaagcaacttaaaaaattagttctaaaatttaaattttgacttttaagtataagcgaaaatatattgctcttaatttatttgtgttactttttatgtgtttttttgcacgaactctgtttttttttatttatacatatccgtttgtatttagttgaagccttatgtttctacctgccatccagtttcgttctcaagttttacttttgcctaatttaagccgattttccttctgctagtcgactggcggggggagcaaaatcgagcactcccctacatacgcgcacgtgtgccccccgggccccaccatttgtcatgccccaacctgctatgtgtctccacaaaaatgttttcacctagtgtactcataatgtttcactatatatagatttaatgttgtagtattgtagtactgtacaaaatttgtcctaggggtattttggtcatttgaacaaatttatacagtgctaacggaggttaaccggacggcgatggtaaatcgtagaagttaagcaaaagtcgatgacatattgtagaacatgacaaagtcagtgacaaatcatagacaagttagtggcatataatggattgtctatttcactagcgatatcagtcaccaaagcaagaagtcggggtctcggggaccattttgtcattttgtcaaactggacctaggcccattggacttcttaggcccatggaccgtacgtggagccgaagcttccggaacccaaaacccttcttccctagcaaaaccctctctctctcttctcgaatcgaaattgcgaagccgcaagcaaagccgccggaggaaggagcaatcgcgagtactcgccaccatgtaccgggcggcggcggcggcggcgtcgtcgatttcgaggtcctcgtcggcgctgcggaagcaggtaaccggcgcgctacctccgcctcctcctccttcccacctgacgcatctcttccgggcgacgctaacggacggggactcttgcttgcgaggcagctgtcgcgcggcggttgcggggagcagcggctgtgggcgcgggggtatgcggcgaaggaggtggcgttcggcgtcggagcccgggccgccttgctgcagggcgtgaacgacctcgccgacgccgtcaaggtcaccatgggccccaaggttcgtgctctctgacagactccgagatgcgtggattggttggggagagtgttgcagcgatcgggctggatctagtggtggaagcgctagattttcgcactcgatttggcgactgaatgggcgtgtttgtctgtgtcgttgtaggggcgcaatgtgattatcgagagatcccatagagctcccaaagtcacaaaggatggagtcacggttgcaaaaagcattgagtttgaggacagtgctaagaatgttggtgcaaacctggtgaagcaagttgctgaagctactaataaggtcgcaggagatggtaaggaccgagctctaggaaattactttacttgagctgccatatgaactatatattcgattgagctttgagcatagcagattagcatcccgtttgatttgtaagcctactcaatgcaaacaagcatattgttaatctgttttttctgctatatgtgttaatccttcttgtcagctagtaatgaatgtgtcgtcaggataggtaaattctgatagcatgaatcaaaatattgattcttaagtaaactcacttgagtgtgatgctcagtgacttaagttctcacagtggataatggcggcaatagtttctgatatgtgtggttttcatgttctgtttttttttttgggggcctcatcgcaaacattatcaaccctatgaatagcataattactagcatgaatataatattcagtgtcactcactgcatttctggttgtatggggtaacaggtaccacttgtgcaactgtacttacacaggctattcttacggaaggctgcaaggctgtggcagcaggggtcaatgttatggacttacgtaatggcataaacaaggccataagttctatcactacacacctcaaaagtaaagcatggattatcaactcctcagaagaaataaatcaggtgggatgctctggtttggagtggtattttgatctctctgctccctccagctacattgtataaaccatattgagttgcttatgcatctttgctgtagttattgtttgcatctgctgtaaataagctaaataatcactttgactctatattactgcaaactttccatagtaattatcccgcattcttgcatgcttaagaatatgttatttcatatttctgtaaaccaggtagcaactatttctgcaaatggagaaaaggaaataggagatttgatatcaaaggcgatggaaaaggttggaaaggatggagttattactattactgtgagtaccaagtgctgcttttattattagcctcatactgcagaatcattctatttggtaatacctacttacctaggctgcaacttattttgggaaattggcaggatggcaagacattagacaatgagcttgaagcggtacagggaatgaaactttccagaggctacatatctccttactttgtgactgatcagaagactcagaagtgtgtaagtctgtatttcttggtcaaatcagtgaatccagcatgaactacattgtagaaagttcgctacattccctcatttgctttgactttatgatggaaatatgcatggaagtggatcacatcagtaataattgtgagtcaggttgtgtattttgattggttttggttttctgccactttgatataatcattagtagattatgtctcttagtgttgaccttataggatgactcagggtgcttatccttgcaaggttttatttcctgtttgttaagttggtttcttagatagctttagacccagaaaagacctgatgagagcagagaaaatatatatgagagttgtatcaactggcatggaatattccaaataatggtctgagacgatctcatgtatccctatgtttgtgcaggagatggaaaatcctcttattctaattcatgacaagaaaatctcaacgatgaattcacttcttccagttttagaaatgtctatcaaggtgattatgtcccataatgtctcagcttcttttgaatatggcaatggtaaattggtttagtactaaccagtgtctcatgtatgcagaatcgtaggcctcttctcatcattgctgaggatgttgagggagaagctctatcaatgcttgttctgaacaagcatcgtgctggattaaaggtgatattaactactggtcctactgtatacaatactgaattgcgtatacaagctgcttgatgatatgtgtccgttgttagttaaagtgcaagcttcttaccttcttcaagctagagctatggatcgttgatattctggtaaattagtaattatcatgcatcgattatagatatgtgctgtcaaagctcctggatttggtgaaaacagaagagccaatctggatgacgtggctgtgttgacaggaggagaggtcagtcatgatcaacaaccataaaagtccttaaacacaagtgatacaatatgactgaaattggcttgcttatttcgtttaatttaatttcaaggttgtcagcgaggaccaaggtcttgatcttggtaaagtcgaactacaaatgcttggcactgctaaaaaggtttgtcaatcttcacaaattatttcacctgagaaacagacagtgagaatttcctttacaggttactgtatcccttgatgatactatcattctagatggtggaggcgacaaacagcagatagaggagaggtgtcaacaggtgctgcaataaaattgtcactcttgaccttcatcccaactatctagataatagtggccggattctcctttgatagaaattaaattgtttgttatgtgaatgcccttaacagcttagagaatcaatggacaaaagcactgctgtatttgacaaagaaaaggctcaagaacgtctatcaaagttatctggtggtgttgctgtcctcaaggtttgttatttttcaggtgcacagtgatgtttcactgtatttcttttccccactttgctcctctcaggatatccattttgactgcagattgggggagctagtgaagttgaagttggtgagaaaaaagatagggtaacagacgctttacatgcagcaagggctgctgtggaggagggcattgtaccaggtgtagtgacggttttcttattttttccactttggtgtcttttttcctaaacttgtttcttgatgttttgctttcgtgtaacttgtccatatgttttgtgccaatttggaacttcaaacaggtggtggagttgcccttctgtatgccaccaaggagcttgacaagattatcacagcaaatgaggatgaaaagattggagttcaaattatcaagaatgctttgaaggttagttcctgtattggttttggcgtttcatgtgcctgatggcttgtttcttaaacatgtaataatctctgaatttctgtaggctcctttgatgactatagctgcaaatgctggcattgatggtggtgtggtcattgggaagctaattgaacaagataatcttaatatgggctatgatgcagcaagaggtttgtgctgtttagctatgttttggcattactggctgtaacaaaaattatgttgagttcctttattgcggtttagatagtccttgaaaaggctatccatatgccttcaaaagcatagtaatctttatgattcattagctgattcctgctctttgccaactacaggggagtatgttgacatgattaaggctgggatcatcgaccctgtgaaagtcatccgaacagcgctacaagatgcatcaaggtacgcacgttccttaagttgattactatttttcctttgcattactaaaatttccacacttgcttaataacttgtgtttttgtttcagtgtttctttgctgatgacaacgacagaggcagctgttgctgagcccccagcagcaaaggccagaatggctagtcggatgccgcagatgagcgggatggatttttgagagcaagtaacatgatttatgatatgtcttctcctgatgtaaggcagtgcccctcaaatgaaaggggtgattttttgaaagctatatgacgtgattttgtcttttcgtggtgaaaggcagtagtagtacttaatatttctacagaatttcacggcccgggagaaagacgttacagatataatttattttaaacttgggaattgggaatccgtctgatgtaaactgaactaatgtggagcagcacctcattttgtagattactacatatgtgaaattgatactgtgaaagctgcaatattttactatgcattttggcaataattttgcctgcgcaaaaccaccatttgtccgaccacctgaacgaattattctcccctgatctccttgaatgtgcgtacgctgcacatgttcataagcacgaactgattcaaacacatcacaactcgactgttatcaggaaggcgaaaatgcaaagtagacaaacaaggagtgaagatttatgactcatgaacacttccaatttctcattataaggggataaggggaaataaaccgtttataccgtataatatagatcgtatctaactctacttgccttgagatcgatgggggcaaactgtttattcacgcaacaaacactacatatcgtgtccttacagacacgcaacatttaaaagattcagtgatcattgaagattttatgccggtttcgcctcttctggtgtctgcataaagcgtggaacttctccgttcatcaccctccatggcccccagtagaatttgggcggcatgagcggcacggcctcgcccggatgatcttcccagtacttctcctgctccaaaatgcggtcacaatcaggcaaaagcaactgtaaattgaggtcaaattgccaatcctagttatttcaaaggtatattgcttgcattgttttgtacaacctgattcatataggacaatagggcgatctgattctatatatatatcaccaatcaaacctggccaaacttgcttgtagggtaaattgacagtcctaaactcctaatcagttcaacaaagtatgcaaccaaaatttgttgtgatccagctagctactactaccgagtacatgttaatcataccatacgggaacatatgctaaacagacctttgatcactgaagcatgcgaaattcatgtccaagtttcgagaccaaggggcctaagcattccgtcgagcaccttatgcgcggaagccccaccgagggcaaccacaaggagtgaagcagggaggggggaggaggagtggaggagcggtctgttcctagagtatcctgaccttgtaaagctgctcggtgatggcggaggcgacgacgccggtgtagaaggcggcgacgtaggtgccgatgagtggcgcgaacgagcgcggcgggcggtacggctccaccatgtcccagagcaccgtcttctcccacctgttgaattgccggtccgcgtaccacctccacaaccgcctcgccatccctctctcccctcgccgccgccgccgctcgcctccgcctccgcctccgtcccctcgccgccgcaagcctctgcaacgccgccaccggcaaagaacagcgccaccgctcagcacgtcacctgattaggctttcaattgggccgaaatgagactgcagatcacgtgggccgcacgttgcgttgcagtccaatttcagcccgacccggcccgtactcgaggcccaactagaccggttctacccagcccagccttagcccagaccggcccgagaacgggaagtgaaaacgcaaaggcggggggccgagcacgaaaactcgaaatagcccgcgacctctctctctgtgtctccgccgccgccgcctccgccgctcgccgcatccgtcggaggcgagatgggcatcaaggtgagcgcgggagggggggggggtgccgcgccgtcctcgttcggatttgtgaccggtggtgtgggttgtagctgtttttgcggccgattcgtgatgggttttcgtctcgattttgtgcgggtttttttttgttagggtttgacgaagcttttggcggacaatgcgcccaaggcgatgaaggagcagaagttcgagagctacttcggccggcgcattgccgtcgacgccagcatgagcatctaccagttcctcgtatgcccccatgtctcctctcacattctgcgagttggctttgaaatgtgctcacttacttggggtttagggtttcttaagcctttgattgcgcgagagagattgtatttttttctatttaactgcccagtgttgtaaggattcctcatttcaaattgctctcttagaccaaatcgggttgggtgaaattgggatacctccattgtgcctcatattttcttctttggtcggctatatttattaacattaaactaaacacctctagcattggatgttttgctttaaaaatgggagtagagcatagcaattccatattacattcactatatgttctgtgtgcaaatgcttgacaagttttggtgaggtattaggaaatccttacccactgctttataagttgggacagctttttatgttttacttgtatagattgtagttggaaggacggggatggaaaccctcacgaacgaggccggtgaagtcaccaggttctaaatattaatcttacaccgtttctagtgctaggattctgttaattcttttataaattagaactttttgctgtgcagtcatttgcaaggtatgttcaaccggacaataaggttgctggaggcaggaatcaagccagtgtaaacccaaattcctcatgtgttgttattgaaattatccatataaatacacttaaattgtgacactcatgcagatatgtttttgacggcaagcctcctgattgaagaaacaagagctcgcaaaaaggcatgatatgtttctttcatccttagattgtttttcctgctgctacttataacttgtcctatatcccattttgggctatgatctgtttctaacatggcatgttctgcaggtctcgaagagggaggatgccaccaaaaactaacagaggcagtagaggtgagctaacagtttgttgtgctatttacaatgttctattatgttctgtcctgtgcttgttctccttccttccttgatccccagagaaatgacttttaatgtgcaggaaggagataaagacgcaattgaaaaattcagcaagagaactgtgaaggtgagaaggggggttgatcttacacactaaaagaaatgtaaaaaaaaaatctatgatgtttgagggacaacagattcattcgctgagaaaaatatcaatgaaaacagttggtttgaataacatgatatggaagatgcaaaaaaggtaagtatgagagtaaccttatctttgcatcttctttttccttgagcaggtcacgaagcagcacaatgaagaatgtaaacgactattaagacttatgggggttcctgttgtagaggtaaatccaattttctttggtgccacatgctttttcagggaatgagtcaatatataatcgttggatttgtttattttactatgctagcataaaatctatgatttatcatgtatttgccatgctctcaatctcatccaaagacatcttctttccggtaccaataggcgccatgtgaagcagaagcagaatgtgctgcactttgcataaatgatatggtaatgttaacatagtggacttctgccttcttgtttccatctcttgcttccatttttattaattactgttttttttataggtttatgcagttgcatcagaagatatggactctcttacttttggagctccacggtttcttcgtcatttgatggatccaagttccaagaaaattccagttatggaatttgaagtcgcgaaagtatgcagcactgtgatttgcttggtacagacactgatgttgtacacacttgaccaattttcatattgcaggttttggaggagcttgaactcactatggaccaattcattgacttgtgcatcctatctggatgtgactattgtgatagcattaaaggtatttttgctttccctcttctcatgagtagtattcctataaattcttgcttgcttgaatttctgtccatgcaaactttttttcctaaccaactatgtgtgcttgtccgctaggtattggaggtcaaacagctctgaaacttattcgtcaacatgggtccatagaaagcattctggaaaacataaataaagacaggttaatcttttgaactatttgaatatttcccacttgactgagaactcaactgagacatgtatatcagctgtgtggcaaaggcagcccaaaattttctatatgtgccactttatttcatttcttggtcgcattatcttacttagatgtaatgatgtattgtaatgtgatgaagaccatttcctatgctaatttgtgctaaattttgatcatatctatcgcctactgcagatatcagattcctgaggactggccttatcaagaagctcgacgcttgttcaaggaacccaatgttacattggatattcctgagctgaaatggaatgctcccgatgaggaagtatgcctgtcacctttttttccttgccttcaaattttacaagtgatgtcgtcccaatactttaattctttctccagggtcttgtagagtttctggtgaaagaaaatggtttcaaccaagatagagtgacaaaggcatgcacttttcttctgacttactatgttatattcttgaaatatttttatcagcaatttgtttctccggtttatgtaggccatagagaagattaaatttgccaagaacaaatcttcccaaggaaggtgagacgtgagcattgtggtacatttttatactttggttctaagagtgttgcatgcctatatcatttgttaaaccataccaactcttgaattaatgtgaccaggctcgaatccttcttcaagccagttgttagcacatcagtgcctctgaaaagaaaggtaccttaacctgaatgccatcaatcttgtcgtgcttaaatttagaacttttagccttctccaggttcatccattgtagcatgatatacaaccaattcatgtcattgaattgcgtactttatctgtccattcaactaacaatgttgaatcacgtggtttgatgttttgattgtccaatgtacctgccaaataacagatcacagatgaatgataaaaatatgtccattagaccagtactcaacaatatatttgcaagcagccagaagtaggcagatacaatagccaaagctgaatcttgtaagccatgctaaaatccttctactatgagaaggttatagccttgtttggcatgattttctcgcagatcttgtactgttccatgtaaaactgcaaccatagtgctatactatatgtaggcttgcaaatgttgtggccataattatatttttgtagcaatattatgtctcatgatttgtttctatgatataatggcaggacacttcagaaaaaccaaccaaagcagtcgctaacaagaaaacaaagggagccggcggaaagaagaaataagttcgattgtgccattcatcaacaagacctcctgcacgtgtcatttcaattttaactcccatgtttgtaactcatcctccatctgatgttttctatgttcctagtaaaccagaagtccagaacttcgtctaatactagttcatctatgtagtacgtctctcttctctactagggatttgtagtgttggtttggttgctgcgtagtgtatgaagaaccaacaaaattggctttgccgcgcaaaattaactggttccgattcgcaaaatcagcgatctcccggacgatgtgctccgcgaaatcttgcgccgcgtcaactcccgcgccgcgctgggcaagcgctgggccggcctcgcgcgcgagctgcccagcctcgatctgagggtcgccgacatcctgccgcgcgactactacctagagcttcgccggcgcgacgaggccaagaggtcgttctgggtgtacgactacggcaagaagtacgacgccgtcatcagacggtacgagcgccgcgccatgcgcgccatggccgcctgcatgaaggagctctcgccgtcgacgccgcgccggagcgtccacaggctcgcggtggagttcatcgacaccaacagctcgaaccacatcaaccgcctgatcaccacggccgtcgacgcgtggggcgtcgagcacctcgacgtcgccgccgttctcctgacgtcgtcgtcgtcggcgcagctggatcacccggcctacaggttccccgacggccgcatcagcgacgacccccacggctcccggctaaggacgctcgagctcaccagatgccggcctccggatctccgaggcttcgacgcgctcaccacgctggtcctgcgcggcttgccccgcacgacgcgggcggccgtctacgagcgcgccgtggcgagctgcccgtcgctccgagccctccacctcgtctcctgccgatgccgctactccaaggtcgtgatcgacgcgccattgccggacctccgggagctcgtcgtcgtcggcggcggcgacatgagcgtacgcttcctccacggactccccagcctcgagacgctcgtcgctgtccagaacagcgtggagctgtaccgccccgacgccgacgccgcgccgcgcctcgcgcgcgccaccgtcgcgttccgcgtcggccagatggaaggggatcccccggactgcagccattgcaggagaggatcaagcgcgacgccgcgctgtccgcgctcggctacctctgcagggccgccattaacgtgacggatctcgcgctgcgtctcacggggcctcagatgtgggtcgtcccggagagccctttcctggagatgcccagcctgaggaggctgctggtcgccgacgtgccgccgcgctgggacgcgacgtggatccgcgccgtcgtcgaggcggcggcgccgtcgcttgagcgcctccacgtccacttctcccaacactatcgccaagacgacgacgacccggcggcggatcgtcggagattggagatagtgtgggagaatgagccgtcaagaacacagcattgtgacaatctggaggagcttgtggtcattggtttccagagcaagaaagagaggcaggttcagtttgtgaggtacgtcatggaggaagcatccatggcgttgcgccgtgttgtgctgatcaagcatggacacgtcgaggatagaggcccaggtgaatgggagatggtgagccagaaatgtacttggagcgatgaggagaagctcgccgtgaaggagcagatcatggagggggtttgctgttcgatggaccaagttgaattggtcctagaataatgaaaccaaactatgtgttgattgtacattagttaaacattcataaaggttatacaatacatcgaacagttataattcccagagtgctaataaaacaggaaggattgaatccatgcagttttgacgcttcactcacaaagaaaactgcattgaatttggctattttaacatgttcatcaaaagctacagagaatcatccactttgaacagatcatgatttacaaggttcttggcttctacccaaattacatcactaaacaagtcacttctaccaaaaaggaagttgtaggaacaaaaatattcaacaatttgcatgtgttggctgtctattccgccttgtcgagactatttgtcccagccatcctctctcatgccaaatagccatttctgggggagagggccatatatggaggcgaacttcgccaagcatttcgttctgatgtcatagtgcttctgcgtgtctcggctaatagcaactgaagaaagcttggaagtgtcgatagcccaagcagggtgaacatactccacagtcctcgaagagcttgcatttgcatacagaaaattcatgagcaagtcctcgcagttgaagttcttgtggacatagtctctgccttccttagcttcttgactccagtatttactgaaagcgaactcactgtccatgaaagcagcacctgtgaggatcaaattgtagcccttcttgccccgagcatatcgctcattcctgtactgcaaaggatcaccgtctatcattcgagggtaaaagcccaccatcctctcagggtgttctctccataccttgaatcctttctctacatcactgcaagtcatcatgatatcatcatccagttccaggacagcccttgtctttatcaaagggtcacccctaaatcggttgttaagggagttgatttcttccacacgtattctgacagggactgttgaatcaaaggcgtcgctggtaggatggttgcctttgttccagacaacaactatctctctgactgactcacatctagagtagtgttcaacaaatagtttcaggttccagagtcgagcttcatatgtcattgtgaccattgtaaattgagagtgctgcccttgatgtgtatatgcctcttcagcgccattgccaccaagtaagaaatgcacagcaatgcagacattaacaatacctatgagagcaatcacacaaaagaatagtgtgtttgaccatgttttctcactgagccttgctttggtagcagagatattcctgccaatactggttgaatatctacggattttcaggttgaagcgatgcacaggtaaaatacgagataactcacttctcctagttagaggaacccaaaaacttggaggaatgtagcaactgattgcaccttttacaaaacctacaaaagtgaccagagcaacagctaccaaaaaacccatgtaaccaaatagagaccgtcttgttgaatcacctgaagggacacgatcaccatccatgacagcaacccatccaccagaggcaagttgctgtgcatctatgtgatggtacctcataccattccaagcattcctccctttctttgcctcttcgattccaagatttaccggaacctctttgtattcttccttagttagcttttcaatcttgtacagcttaaccttccgtccataggtaccactgcaatcctgccctggacgatacaatgacccttcaaagatgaatagccttccaccgtttcgagctcctaaacttttgtcagatctgtaaatagggttttgcttatgttcactccaaggaccaagaggtgagttgctgtaccaaatttcaagctctgcattcttttctataccatgccgtgtaaaatctgaggcaaacagccaccacagtccatcatattgaactaatgaggaatcaataagtggcttatcaatgagcaccttctccaatgtccattcaagaggaaacttagtagctcgataaagtcgtagctccttctttttgttcccctctggcatcatataaatctacaagagaaaaggtaacgtattgacatattcagaaacagctactcatt

SEQ ID NO: 82686 - DNA, 15504 bp, Oryza sativa
gcccataacactagggcagatcgaagtctaaagagttaggagtaaatgctatactaatacatggaaatagcttacaaagatgccactcagataacactccagtttttacaatgcatagatagaagcccctctatccattcaaggcggaagcttgctgacagctttccaggtgactttcacagaaatggtagtgaaatcaccaagcttcaccacttcctctacagttccatgaaaaccagcaccaaatctgtgctcccaccttgtacaaggcagcttctcaccaagatcgatatccgctggagacccttcaatacagagatcaaggtgactacgtctcaccaccgccacaacagaactaattttgcgactagattgtgcaacacctcggaagagacggagcacatcgctgaagccactggttttggcatataacttcagattaaggccacaagcacgtgaatgtataatctcaacatcaactgttgcttgaactgcatttacaagcagaagaaacttcacacccaacccacacttctcaccatacagacggacagtttcggtgaatgatgttgatctcaaaatgttggtgaattcagtgcatccttcaatcaatgtgccacctttgggctcatcctcagcctcaggtgagtcttcagtccgaatacagagttggaattcaaacagtgcacggcttgtaatgcaaatacctcgagctgggctagtcaatggtaaacatgccataccctacaatgaggaacaccaagtattacatcatgtatttgagttattcttcagtaacatcacataccaccagtacatgtgtaagaatgcaatcaagaaaaatgctatgtacagtgacgatgttattttaagtcttactgttagattggattgtgctacatgcattgagagaaatatccaaacttacgaaaataattactaaatgtcaatatgccaaaacatgagtatggaagcaaacagtcacatgtttgcaaactaaattaccgtctttggtttcacagagacagcttcataattgtcaatcgcatgcctaaagacatagttgcgcagaggttccaagtcatcccgcaccgcaaaaaacccgaagattttggcacgtccaggctgggtatggcgatatccagagatttacagatcaatcaactggagcagattcatcgaatggcacctacacccatttaagcaatcaacggtccgagcgctgttgacattgactgcaaaattgatgactaaagaatgagaaatatgtgcaggtttacagtaatctatagatgatgatatgacaaaagaaagcaccagagaactcaaagaagttaatttaaagaaggcatttactttcagattcgtcatcgagtcggtaatcagaaccaaaccaatgcctgcgtttgtcagtgagaggatcgttgaaggcacggaaaagaatgagtggcaaagggccttgaaggcaaagatctggaaatctataccgcgcttcagtctgcgcagaatgatcactactaagccttggaaaatcatcaaccgtaaatgggcggtgcatccctacataaaaaaaatcatgggataattaaatcaactgaaacaatttcaaatgctctggagtttgatctaccaccatctatcatttgtatggaagctaaaattagacgcgtgacagaaaacatagcgatggaaatcgacaagtcaaaaagactatacactgaacgtacatgaatggttgcacactcatttctttctttgtgtgtgtgtgtgtgtgttattattaccaaagtttagtaggatcaggtacgaactaattcaagcaagatgttcttagtgatgttcgttgaagtgtcacccaatcaaagagcaaagcaccggttcctaaatcctaatccagatagtcaatcacaagctaaaagaaccaagtaaatagataagcaccttttttcccattatatttcagtctgaatcaaagaagggaacttataaaaaaagcaaggaggcactagcttaactcaatgatggactgccactgcactgtatgtaacattatattgcggcatgcagacattgaattgctaacatcctctaagtgtgtgagtgtaaccctgtggagaagaggaacacacactgcactgcgccgcaccttgatagttcatacaactacacattagtaactgtaggttgttagtcagatactcagatatttctcagctacgtacctaatgcacatcttctgtttctgaaacttgtactgttgtacagtacaatatggagtgagggcacatgccaacaagtgagcagcatttcagttattcagcaatagcagattcatagcatgagacaatcaaattcctgaaattactttcaaccagaatctctgtggcttatcatcaagaacaagcaaaaaaaaaaaagtaaaccaatatgcaaatcgcttagcacgttgttttctgcattacatatttcagtcggaatcaaagagggggaaaatttaaaaaccgaaaactgaacaagattacagaggctcgtcgaacgaaatattcaggagccattcagatagtaaaagaattatagtgatcatcctgtaccttcttgatcctcctcgccttcgtcttcgtcttcctcctcctcctcgtcgctgaccgcgcagctgtcgtcggagtcctccccgtcgtcgctcggagtcggaggagttgagggggaaggcggtctcttcttcccgcggccggggtcagccatcgccgccgccgccgactcgtctccgcctccatcgacctccatttctcctcaacaccgcctccgcctccgcctccgccgccgccaccgccgccaccgccggcgatctctcccacaaaccctagcaagaggaaaatcgaggacgctcgctagcgtcctcgattttgcaagtgggggccacatcgctgccgagtggggcccacggcatggcgttcgtttcactgacaggtgggtcctgggtcctgggtcgcttcttcttccgaactccggaaggggaagggccacgtgtcgattttgcaaggcactagcgcccaactgcagaccgtagtattggagtacatctgtgatctgtacatacaagcatttcttatctttgaaaaaacaaacattttataaagcctctttgtacggaaaaattttagacgaatttcgtaaaatttgaagaaactataaagttatttgcatgaccgaacaaattgtccaggaacttgcaatgcaatgcctaacagaacatacaagcattggatgctaagttaaatccatgtatgatatttcttcgatttgcattatttccttcaatttatcttccttctaaattctccatcaatgtatgacattttttaaagaataatgtattgtatgatatttctgcgttgtcaggctttgcctgcatacaccaaccaaaattcttccgaaacacaaggatctcttttgataaacttcatatttcacaaggcagcgaaaaatataatttttttaataataaaacagaaaaactacagcatggtgtctcatctaggggagcgagaacgggataaaatgagtagtgctccttatccactagacacgctcctcttccgcccatcgctctccgcctagcattgccaccctcttccttgtgtgcttctcctcctcctccctcccctcttcctccttgtccgagccagcttggaaatggatcatcgctccttcttcccttcactggtcgtctggtccctgctcattcacatgtgctccactcttggttgctgctccgtgccactcatcagtgaatcaggaagcgggctgctaacaccgaatctaaaggtctatggccttaccatcaccggatccaacccaagcgcatgttggcgacgagggcaacggatgggattggttccatgacatcctccttcgtatcatgcttgcagcatggcgacgcccactagatccggttcccatgccgatacgggaacaactaggaaaaaatgaggtcaggaaggacgccaaccgtcacgagctctgctgatacccatagattttagacttgatatatattgtatcatgggtactagacctgatactcataatacttcctccgtcccacaatacttatttttctagcattcaaaagttatcccaaaatggttatcacttggaagtactacttattacaccaaccaattctaattcaaatttcttcccattatacccccaaccaccatctcacatccaactatacattagttactaaggggtattatagtatttttttctcttaaccttagtacatactaaacaacctagaatgacatatattttgggatggaggtagcgtatcaggcctgttattcctaagggtaccatgtagatactagctaatacctatagctactagctgatttttgtattttagataatgatagctactagctgatacgagcacatggtactccctccatcccctaatataagggattttgatattttacttgcactgtttgaccactcgtcttattcaaaaaatttggacaaatataaaaaacgaaacattatttttaaaatactttggataataaagtaaatcacaaataaaataaataataattctaaaattttttgaataagatgaatggttaaacagtgtaagtaaaatgtcaaaatctcttatattaagggacgcatggagtataagtatcaaatggtaaagtgcagggaaaggacacgtggcaccgctaattggccgaccggcgaaccatctgccgccagcgcctcctctcctcggctccaacttttccttccctcgtgtttgctacaagcatcaccctgctactgctatggccaacgttgccagtttgccacctatgtcagtgcctcccagcagctgatgcctcctgctagcgtcgttctgctcaaggtgcggagcacaagcacgcagcgtaggacatgatggaggggcagatcgactcacgagtatgaagtggagacgtggataatgttagcgcaattagttaatttgtgtagatgagcaaagttaccctgatgggacccacccctcctgcacataaaatagagtgactttttaacacatgattaattacgtattagctaatttctttttaaaaatgaattaatttgatttttttaagcaactttcgtatagacaatttttaccaaaaaaacacaccgtttagtagtttgaaaagcatgcgtgcgaaaaacaagggagaaaggttgggaacatggggttgcaaacacagcctcaagcatcatgctaatacagtatgttgcattctttgtgatggcacttagggcaagtactgtaaccgcttcatgttccccctaaatttaccacataggattaggtgatgagttggagaaaagttaggagagagagaatgagccacccctcatgcaaggggcaacctccacacaatctccaagaaaaatataagatgatgtgagagcaggtacaatagcaggctataagccagctgcaaacatattttaaggagataaatcaggagagagaagagcagcgggctacagatttgtagccagctgtagcacggacttcaagacgcagtgtgtctatgacaggtgagactaggtattaatagtgtagtatgtaactattgtatgaatgagctattagattggctataaatgaattagagctagtagttggctatactattgaacttgctctgagaagatgacatggtttaaattagatgtgtcactcacctccactttaaaacttgcccttacagactcttcaccttttttagccagccggtggtgagtctctgccactctgattggcccgagacttttcactgcacatttctctgcagttctgcatgcatgactgaacattgaacaaactgttcaggaacttgcaatgcaattccacgcctgatggaaacctacaggcattgggtaccaaattaaagctatgttttgtaccaaactgcaaatcaacgtgcattcttcagaaacacaacggcggtctcttcacaaggcagcaagaatgtcatctactttacaacgtttcattcagaaaccataaaaattctatcagtctttcacaaagacattgtcactgtttacatttcagtatggatggatcaaacagctaatggaagttttttctttccacacaaattggctactatctacaaaaggaaccatatcatcagtaaacagataaatctgttagtcggctgcgagcagcagggtccaaagttctattgacagatccatggccaccctaagagatcactagccttgctaacatatacgtttcaaaaagttctacattactctgacaaatttgtccctgacacttaggcagctcgaagtcaagcatgttaagagtataactctataggtgtcgagatagcgcacaaaaagatgccaaacacataacatcttccaatttttacattgcatatagaagctcctctatcccttcggcggcggatgcttgtcgacagctttccatgtaactttcacagaaattgtggtaaaatcaccaagcttcaccacttcatctgcagttctatgaaaaccagcaccaaatttgtgctcccaccttacacagggcagcttctcaccaagaccgatatctgctggagacccttcgatacaaagatcaaggtgactacgtcgtaccaccgccacaagagatctaattctgcgaccagattgtgcaacacctcggaagagacggatcacatcgctgaagccactggttttggcatataacttcaaattaaggccacaagcaggtgaatgtataatctcaacatcaactgttgcttgaactgcatttaccagcagagcaaacttcacatccaatccacacttctcaccatacagacgaacagttttggtgaatgatgctgatcttaaaatgttggtgaattcagtgcatctttcaatcaatgtttcacctatgggctcatcctcagcctcaggtgagtcttcagtccgaatacagagttggaattcaaacagtgcacggcttgtaatgcaaatacctcgagcagggctagtcaatggtaaacatgccataccctacaatgaggaacacaaagtattacgtcatgtatttgagttattcttcagtaacatcacataccaccagtaaatgtgtaataatgcaatcaagagaagtgctattgacaatgaggatgttactttaagttttactattagattgttactgtgtacagtgatgatgcaatcaagagaaatatccaaacttacaaaaataatgactaaatgtcaaacatgccaaaagataagtatggaagtaaaaagaaccaaaccaatgcatgcgtttgtcagtgagaggatcattgaatgcacggaaaagactgagtggtgaagggcctcgaagacgaagatgtggaatatcatagagtgcatcagtctgcacagaatggtcactactaagccttggaaaatcatcaacagtaaatgggcggtgcatccctatacaaaaaaatcataggaaaatcaatcaactgaaacaatttccatggctctgtagtttgatctaccaccatctatcatatgtatgcaagctaaaattagacgcttgacagaaaacatagcgatggaagttgattaagtcaaaaagtctgtaattatgtatactgaatatagaataaaaggttgcattttttttcctttttgcattttatattattgccaaagttcattacaagtaggattaggtaggaactaattcaagcaagatattcttagtgatgttccttccaatgtcacccaatcaaagagcaagaactgaatcctaaatcctaatccaagttgtcaatcacaagctaaaagtattaaggaaactgatgagcaccttttttttttcaattgtatttcagtctgaatcaaagaggggaatgggaacttataaaaagcaaggaggcactagattaactgaatggtggactgccactgcactgcattgaacattatattgcggcatgtagcattgaatcgctaacattctcaaagtgtgtaactgtaactctgtagagaaaaggaacacactctgcactgcactgcaacttgattgccgccttgatagttcgatacaagtacatattagtaactgcaagttgttattgccaggttttttctcagccatgtacctaatgaagtaaatgatcctcttctgtttctgcaacttgtacagtatggagtgagggcacatgtgaagcaacatttcagttatccagcagtatcagacttgcagtatgctatttcctctctctctctctttttttctttttttagtttggcttatcataagacaatcaaattcctgaaattacttctaaccagaatatatgttacttatcatcaaataaatagattagcacgttgttttttttatctgaaattttcgccgtgctcggcatttcggtctgaatcaaacaaggggaacatatatgaaaccgaaaaactgaataagattaacgactcgtgaaacaaaatattcaggaatcattcatcattcagatagaagaagatttagaactcatcctgtaccttcctgctcctcctcgtcgtcgtattcctcctcctcctcctcgctgccgctgtcgctcaccgcccagccgtcgtcggagtcctccccgtcgtcgctcggagtcggagttgagggggaaggcggcctcttcctgccgcggccggggtcagtgctcgtcgccgccgccgccgccgccgctgactcgtctccgcttccgtcgatctccatttctcctcaactccgccgcggcgctctcccgcaaaccctagcgagaggaggaatcgaggaaggcgatggccgccgcagaaacggcggcagtagaccacgcgcggcgaggtggggaccacatcgctgccgcgtggggcccacggcatggcattgacgggtgggtccaggagtagtggacttctgaattcggaggaggagagccacgtgtcgacttggcaaggcactagcgcttataaagtgcgaatcctacatgaacatttcagatgaatttcgtgcaaactgagcaaactgcagggttatttgtgcgggtgagcaaactgtccgggaacttgcaatacaatgcctaaaagtaattacagacataacatacacaaacacatttcttgtgcctccttgagatggagaaatttagtggaaaaaattgaacagactactgtactgtaggtactgtagagaatttgatttagaaaccatggaatgtattagtctttcaaagagacacttgtcacagtttacatttctgtatggatggctcaaacagctaacgtaagctatttaattctttccacacaaattaacaactatctaccacaggatggccactgaaaaggcacatcgctctctttctcagaaaaaaagaaagaacaaacatcatcactaaacgaataaatttgttactaggcaaggcgacctcttgatgcatcagccagcccgacccgtttaggcccgtagctctaagagatcgatcactagtcccgccagcagacgagcatggtgacgcagcgacgcatgatgtagaacctggccctttgctccttcaccaggctcgccagccgccctggcacagaccgggatgggcctctcgaagcccggccctcctccaaccttcggctgcccttcttggtgagcttccacttgtcatccatgcacatctccatctctctctaacacaccctttgcagcttctctctctaaaaatgtataggttgagcagactggtgcctctttcttctggttgtggctggagattttggggaagaaggtttggtatgcaatgaggcatgggtgggggtatttatagtgcacagttgccaatcaatccaagtgatatgtttatgctaatgtatgtgattatgcattggatttggagggagattgattagctagttaattaaagtaggacttggtttagtttatattgtttggtggggcatctctttccatgtctgaaataatttatgggaccatgtcccctggggcaatggccatgggacactccctttcggctctgctcatgtcattgtggtgcaaaatattcataattgatatggatctctgtattttaccttggtttgtactgttgcacaatgctaggatctctgtattttacattggtttgtattaattgcatgaagcattcgaattctactgagctgctgctaattgatattgggtgttagtttttttttttgaaaaaaaaaagattgctatgtgattgtaaatgttgtgctgtaggtggatattttaggaaaattgattcttctcagtcctttttttcctagaaaaatgtttggtttctaaagaagttttttttggttaaaatcaagcaggttcaattttaagaacaatattctaactgatctagggtgttgattccgtaaaaaaaaatctatgtaatagtagaagttgtattacaggtggattcttttaggacaacttgattcttctcaggcatttttttccctataaaaattctgcgttagtaagaatttctttttaaaaaccatatgtattccaaagcaggttcatttttgtggaaaaattaatccgtttacgataatctaatgcaggatgctctcctctagagagtgagagaaaaaagttcacattctactgcatcttgtctacatatatacgtgtgtatatacgagtacaaatgtacaatgcacacatacgtacacgtgtgcccacgtgggagcacctacgtggtggggcccatgtggcagggggtggtcagtctcggcgacaagccgccgtccaccggccggcatcgcgtcgccggagagagagagagagggcgcgcgcagatgcggccacacagcgtcgcgcccacagaagcgacgggtgggcgcggcgcacgcacgcgcggccaccaccaccacccacggagcccacggatcttctgcgcccggccagccggcctcatccgagcaccacagcaaattcgtctccgccgctgcattctattccatccatccgttctagaataaaccaacttcgtattagtaaatgttatgaggttaatttattttaaaacgaaataaaccaacttagtattaataatttttttccttccatttgcctcaaaataattaagtttacttttgagaaattattacatcagattttgtgaaaatgaagaataattgtattaggagtagataaagtgagaaatagctgcatcgagatttgataaaataggagtatttagtcttttttttattgctacgtatgagattcttaacttcgtcttcttcgtttttcgtgcgtatatttttcaaaactactaaataatatgtatttcataaaaaatactttaaactattaaagtgatatattttctaaatcttagttaattatgtattaatttactgctctgtttgcgtgcggatgaggaagggtttcaaaccttctcaaaaggggacagccagcattcggatttcagagcatggcactgtctctctgtgatcttggactggatgaatgcatgcatccggcagtgaggctgattgctcaccaatccgtcatgggattttctttttagaactcatggcaggagtcaaagactaatttttgagatatataacatctctcctatccctatctctttccctaccctacatcattattgtcataacaaaaatgagaaggaagattgggatcgcaggacaacggacagccttcgcgctgcccatgccctcgtgtcttctgtcataatccgtcacacggtaatatgatagggacatgctcctgtgagctcacacgtactaatgatggcactcttttgtacgtctgaattttacctggattctatgggaatttttaacggagacaattaattttatttcaacggtttaattgacagattcaagtttttttaaaacggggcgtgatttagtgcttttttataagtaattagttgtccatgttgtttctcctttcattttcaactagtgttggatcacgcatttgtttggaactttatattgccatttgttggagaaacagggggaaatttaagtgttcagattcatgtgcaccaacacattgtagcacacaaagcccacatggctcctactggaccagacagcacatttatgtttgcacacgctgcatcaggacaagccatgcacaggcaatggtcaattaggctgcaatttgacctaattaagttcatgtccgttgatctaactacattgatgatataaatctctacacattggtgtaaccatatgtccatatggcaaatctgaatagttttctgaaaaaaaaaaacaagatttggagagagagacgtcactccaaacatttttttaagaaattatgagcgtgttagggattgaatacgagacctcagggtaaaacaacacaaccattacctttgtactattaagtatatctcgaaatagttttatgaacataacaactccaagtgttgtgccggatatttctttttggggaaggtttttttagggatttaataatcagttttatagatttttatatgcatgaatttataacacgacaattatttaagaatgtaaaaaaagtactacctccgtcacaaaataagtgcagccgtggaactccgtgtccaacgtttgaccgtccgtcttatttgaaaaatttataattttttttaaaaaatagtcacacataaagtactattcatgttttatcatctaataacaataaaaatagtaatcataaaaaaattttaaataagacgaatggtcaaacattggagatgaatagtgcaaaactgtatttattttgggacggagggagtaataggcagcaatttgtgccgcaaacaaacaagaaatcaaacggttagaagatgccaatcaacaaaagcaaagctcatccactgctctggcttcactgtctgccatgtgattatcagataagcttagatttagctaccttaattagtttattatcacaaaaccactatcagctaacttttcgccacatgatcatcagtcactaggggatagtgagcacaaaccagcaatgccactgacactaatcattatttgaccggtcaacagcgcatgccgtcacgacacgtgtcctgatcacgacagtggatacatcatgccggccatgcttatggcggttaagtggatagatattcagctcaatcttgatcatcatttttgccgacatgaagccgaaagatacacacatattatactctacatggaaaaatccatatatgcagagacaatcagacaagatagagtgaacagtgatcaacatgagatatatatgatggtgatgaatcatgcttttagcccttttgtggtgtaattaatctgaaacccatcatgcatcagcatgtgagccaagtagatgcatatgtgattgtcaagtatgcaacaagtgaagccatgtgcatgcagagagacagattcttataatctctccatgacacatgatgagctctggatatttattggttgcaaatgggtccaaattagggttcaaaaccagcctgaaatcaggccaaatttatgaatgtacatgcatggatggaataattagtggtggcaggagactgatttgcagcctaaatggtggatttgggagagaatttagcaggccagatctggtcatgagaggggacaaagtgaccaactgtctagttgtccatttgcccccaaagcttaattttgcatcacatgtgcagtggttgatggcttgatgcagtgtttagattctgcacgaggatgatcgtcctttggcaggaccaaatccgattggccgtgtgtctcgcaaggacgatgtgatggctcaacggttaagacattttcgtccccttgctagcagtgacattttcgtcacacgaccttgagtaaattattcaattttaactattttgtgttatattaattagtatattactccctccgtccttaaatgtttgatgccattaacttttttaaacatgtttgaccgttcgtcttattcaaaaacttttgtaaaatatgtaaaattatatatctacataaaagtatatttaacaatgaatcaaatgataggaaaaaatttaataattacttaaattttttgaataagacgaacggtcaaacctatttaaaaaagtcaatggcgtcaaacatttagagacggaaggagtagttaataattagatagtatggaggaattaattatatataggacccccagtaatttttcttctgatcgagttcatcacttcttgctatgttatataacttgactctccctcttaattaggagatgtctatgttggagattgtttggtttgaggaaagatttaggtccgatctaaaaatccatgagttcaagaaagaaaaactgtaaaaccttaaagcatattaattgtcagaaaaaccacaggacccacaaaagaaaagggaaaaccacacaaattgctactggagggaaacaacaactcatacaaaatgtgggaaactcaaaagaaatataagaaggggaaataaaggacataaggaaacaagcaaagaagcccatctgggcccaaactactagtaaccagactattgatcaaattgggcccaaagttcattgtggcctgtgatcaaattgagtccaaactactaatcaccgatctagtggaacccagaatgggtttctaagttgggaataagttcactttgagtccctcaaatatagctccaatctaattcatgtccctcaaccgtaataccaaatatgttgaccacttgaacccccacaactattgaaaccggtgcaaaaaaataacccccttggtgcttttgtgagtggttttcactgatgtggcgcattgacttatttgactggctgactcaatgtgtgggaccaacatgtcattgcctccatcttttttttcctcctctttcttttctctctctcctcccttctccttctcttcctggtgcggtgcaggtgacataggtcggcgtcggtggcggagcacgagtgtagagtgagatgctcatgggcgcggcgatggtagcacaggcgctgcggcgggagctaggcgacggcggaggacacgggaacgcgagaacaccgtcgcctcgacgtcggcgcggcggaccccggcccgagcctcctgtccctgccaccggcttccccaacctccacgcgcgaggctgctacgggcgcggtcggcgacaagctagtccaaaaagaagaagaaagaagaaggggttcgtgactttcgtagtggacggtggtcggggaaggggcccgcagtgtcggaggtggaggaggggccgtcgtcgccggcgatcggcaatgccgaggaaggagtagggggtgttagggagctagccgggggaagaagccacgcgtgaggaggctgagctccaaccgctgctccgtcttaggttgcgtcgtcgcttcgcctggtcaccgtcggcgtcggggaggatggagggagg

SEQ ID NO: 82687 - DNA, 4406 bp, Oryza sativa
tttttgcattaattaagtacatcagggaagccaatgatttgagagtattccagttaattcctagcaattcttcttattcttgcaaacaacaagctagaatataaggtgttggggaaaaagggggaaaaaaaagggggggcctttttaaaccttaatccaaatggtaggccaaagcgattcaagatcttctccacataatgggactgcaagagtgtaatctcattctcacctctaattagcttaatgtttaagataacatcagctactcccaaatccttcatatcaaaattttgagacaagaatgatttaacctcatttatcacctcaaggtttgtcccaaatatcagtatgtcatcaacatacaagcacagaataactccctcacccccaccatggcgataatacacacatttatctgcctcattgactgcaaagcttgcagatgtcaatgttttgtcaaatttcttatgccatttcttatgagcttgtttcagaccatacaaagacttcaacaatttacacactttgccttcttgaccttcaactacaaacccatcacgttgatccatatagatctcctcatccagctctccattaagaaaagctgtcttaatgtccatttgatgaacgagaagaccatgtgaggctgctagggaaagtagcacacgaattgtggtcaatctagcaacaagtgagtaagtgtcaaagaaatcttcgccttctttctgagtataacccttagcaataagccgagccttgtacttttcaatagtaccatcaagcctgagcttcttcttgaacacccacttgcaccccacaggtttacacccatagggtcgctctgtcacctcccaagtcccgttagtgataatggaatccatttcactacggatagcctccttccagtagtctgcatcaagagatgcgtatgcttctgaaattgacttaggagtgtcatccacgaggtacacagtgaaatcataaccaaaagacttagctgtcctttgtcttttgctacttcgaggagcttcactgtcatcctccttagtaacatgttcatgtgtatgttcagtttgttctggtggtgtgattgaactgggaattatttcagagggttggctagaactactatgtgtatccttcattgggaaaaagctctcaaagaaggtagcatcacgagactccataattgtaccaacatgcatgtcaggtacctcagatttaactattaaaaatctataggcaatgctgtggtgagcatatcccagaaagacacagtccacagtcttaggtccaagtttgcgcttcttcgttattggtacattgactttcgccaagcaccctcatgtgcgcaagtaagaaagtgatggttttctcccaatccatatctcatatggtgttttgtccttatttctgttaggaactctgtttaacacatgattcgaggtcaacaatgcctccctccaccatgctttaggtaatcccgcggtgtccaacatggcattcaccaagtcggtcagtgtgcggttcttcctttcagcaatcctattagactcgggagaatagggaggcgtcctctcatgtataataccatgttcctcacagaataagtcaaactcgtttgagaaaaactctccaccacgatcagacctaagtatttttatctttctgtcaagttgattttcaacttctgccttataaattttaaaatagtctagagcctcgtctttcgttttcaacaagtacacatagcaaaatctagtagcatcatcaatcaacgtcatgaaatatcgttttccacccttcgtcaacaccccattcatttcacagagatctgagtgtaggagttctagaggtgccaagtttctctcctcagtagccttgtgaggcttgcgaggttgctttgattgcacacaactatggcacttagaacctttgacaatggaaaacttaggaattaaacacatgctggaaaaccgagacatcaatccaaaattaatatgacataaacgtgagtgccatacattagcctcatcatccacactgccacaaatatggttcacagacttattgcagaaagcagaaagggaaaagcggaacaggcctccgcactcataacctttaccaataaaatatccatgtttagacacgactactttattagactcaaaaaccaacttaaatccgtctctagtcagacgggagccactaacaagattcttgtcgatagaagggacatgctgcatgttcttcagctgcacgatctttcccgaagtaaacttcagatctaccgtgccaacatcatgaacagaagcatgtgacccattccccattaggacggtagaaccccgtgcgacctgataagaagacaataatgagatgtcagcacaaacatgtacattggcccctgtatcaacccaccaattagtagactggttaactgaaaaaacagtaggtaaattaccatacccgcttccatctccagtgttgccaatggtcacattagcaaacttagaggtctgccctccaggtgccttcatccccttgcgttgtggacacttcctggccagatggccaggttgaccacacacaaagcaagtcctctcatcctgattaggattgctgttgttcttcttcttcttgaagttggtggtctgctgagctttgtatttccccttgctcttgttctgggcctggtgcacaacattggcaatggactgcccaccatcgcccttagacgccgcatctttttcccgagctttctcctcaacatcaagagacgctatcaacccctcaacggagtattcctgtctcttgtgtttgagtgcagtaccgaaacctctccaagatggaggtagtttcgcaataatgcacccgaccacaaatttgtcgggtaagacacacttaaggagttcgagttccttagccatggtttgtatctcatgagcttgttcgactacagaacggttgtcagccatcttgtagtcatgaaactgctccatgatatacagatcattgctagcattagtagcaccgaatttagtattcaatgcatcccacaactccttagcgtcggtcatatgcatatacacctcgaccagatgatcgccaagcacgctaagaatgcatcccacaaagagagtagtggcctcatcgaattctttctgctagtcagcattaagaacgcccataggcttgccagtactcacccagaagcatttcatagctgtcagccacagagtgaccctgatctgccatctcttaaagtgcacaccattaaatttatccggcctcagtgcatcggcaaaaacagccatagtaaaatcatagcgcctatattaagatttttggattgttgagaatatagtcatataatgatttaatatattccataaataaatcatgacattacagatgtatactagcattaacgcatcattagatctatacatgtaaactaagcagtaaaacatgaacagatcaaatatgcgcaacatgtcgaacacgtaccgaggtggcggaaagactgattgctcggcaggaactactcgcggttgcgagcgtcgatgaaggcgtgcagcacgcgagcggagaggaaggcgagccatcgcggacgaacagggagcagtcgcgtgaagcgcttcccaaaaaccttatcgccgccttctccaggtgcaggacgtcgaaaggcagaggttccggagacctgctctcccgatcgccggtgcacactgacgagcgggatggagtagtccacgagcgacgacgcaacacagaggaggaggcaaaccctagattgatttcatgtgttttgcgtgaaggcggtggctcggtttatatagagataggtcgcttgatcagggtgcccgcacgatctccactccgcgtaaccgaaccggataagtcgcgcgtaacttatccggactccacgccgttttcaggcaccggatttttcggaatgttttcaaaacaaaacaaatccaaattttcttgcaactaaacaaaactgcaaaaggaggctgcatctgcgcaagggtgagaagccaattttgcggaccattcgacgggtacgttgtgcacgcgagccgcttgccagtcaaggtaaggcgagtgagcacgcgcgtgtattccccctcttctctccaccacacatgtttcaagtggataggagggcatcctcccttttaaggaggtccccctctcctaaaataagcaaggtggtactaaacaccacatgcatgccatcccatgaggtgggctttgtgattttccaaagaattaattttagaatgggccttagcccatgtattaattccaacaaagtacccgtattctcatgtcaacttttgggagagtgcaaaagatgaagcaaatttgatgttatttttttcccaagtcagtaatga

SEQ ID NO: 82688 - DNA, 684 bp, Oryza sativa
  unsure (1)..(684): unsure at all n locations
atatttttggcattttcttgaacttttgatataattctttcatgtttctatgttgaagctcattattcattttctctttaatgttcttttcatcctaaaaagctcattgctacaaggtgatgctaatacttctttttttttcatggagtagaaaagacacattttctctttgtaaagtggggatcaaaccatttctgagtttaaggatatataggaacttgtgtatagttactataagaaactttttggtaaggaagagtgcaggaatgtacatttggggggaaatgtttggagtgcttctcttagattgaatgatgcttaaaaggaaaacatgatcatacctttctctcttgagtaactagacaaaaatatgaaggtgatgaaagctaatactgcccctggaccatcaaacaatatagccctatctgtctgcagaatgtttttttcaaaatcttgacaaagacaatcaatggaagggtttcagaattggtagataaaatattaagggaggaatattcttgaggggtgtgtcatcctgcatgagttgcaaagaaagggtgacatggggattatctttaagattgattttgagaaggcatatgatagagttaattggaacttcctgtatggggatcctctagtatagtcgtgctggngggctgcaagcatgttatactataagct

SEQ ID NO: 82689 - DNA, 14191 bp, Oryza sativa
ttcttgcacaggagaaagagagaggagagagatgcacttacaccgactcctagtgctctgatggagtgaaactgtgaaagaaaggtttccagtcccagtgccatctcatggactatacacagctgtccaaaattgggacccacatgtcctggactgtatgtgggccccacacatcacgggctcatgcagaagttacctgcagtgaagctctgggggggaggctttcagtttcagtacagacagtttcagtcaggaggttcagtcactgatttggtggggtcagagtgttggtgggcccaacagccagtgacagtaaaagggaagcggttggttctgatgtggaactagcctgtgggtcccagttgtcatacgtggatgaactgcaattatccacatatgacttctgctttttgctcatcagaaagttcaacaccgttcagcatacggttgtcgtgatctgcaactcatacagtcatactactacctgtggcctacaagtgtcctgcacaatcatagtcgtagcaagcatgaatccaatatgttattgagggcattgaaatgtttgttttcgaagatagtagcaaacaaaaagagaagacaatgacattttatacattgggtacagattaatacccaattaataccaccaatgctactctaatagggcaatgtatagggcaacgtatcctatccacacgctacctctaatgcacttatgcactcagtcattgtaggccctccgattccaatccaacggatacaaactgaggttggcatatttttgcacgaaaccgcccacacccctccacctaaatttagaggtaacacctcacttggctttcctcttctcttattcaacatttttcccaaatcgatcaccaatctccaccatgctgtaggaatggatgccggcggcatctcgaatcacccacacagaggcacgcagggcctcgccggtggtgcctgcgtcatggacaccggcgaatgcgtgtctatccaggcacagttggatgttgatctagccaagctcaattaggcatcacggcctggctggcctccaagcagcgaccttgccgaggagcaaggcagtttccaatcgattaaaaaacgagaagagacatcgagagattgaccaggccacaattcatttccagtatcgtctagagcgttagcatcatctgaataataccaatatattttacacccgatgctattggcatccgagaaaaaaacaaagtgcattcagttaaaagcaaaggtaaaaacacaagtcatggattcatcctagttaatcatccttgacacaatcaaacactgtgtgctaagttgctaacgacctggaaagcaataccctgagcgtgtggcatgccgtcagcgtgaccctcgccgttgtgaagacgatcaccacaagagtcctatagatggcaaaaccagcccgcgagccgataacaaccagcagctgcgagagatagcgtctggaaagggcacagaacggccattgcttgcccgctcgcctcctacaacaggaggtagtgcgtgccctccggcgtgggctgcatctccagatgctcgtcgcgccccccttcctacatcatgctgaggattggggatcgatttaggaagaaggttgaacaagagaaggtgagagccaagtgaggggttacatgtaaatttaggtggagggacatgggttgttttctgcaaaaatgcaccatctcgatttgtatccgtcggattggaatcagatggtctagggtggcggagtgcattagaggtagtgtgtgcataggatacgttgcccaaattatagttgtgcaaagacagactcttctagcatgagatgtgcacctacttcagctcaaaacattttgctgaaactgatttctcaaaaggtctggccgctaataatagttcatgacaagattcatccatgtatagtttaattacctatcttagagtgccatctagttcctcctaccaccacgtcctcttttcctgcatatacacaggcatatttctttaaaagaaaaattgtgaaaaatctacgcttcaacattggggaatcaggggttttctctctttattcaacaatgatgagagagagaaagagagtgagtttgtgtcctgctttttttaatatatatatatatatatatatatatatatatatatatatatatatatatatatatatatatatatatatatatgaaagttgttttaaaaaattatattaatttatttattaaaatttaaataattaatactttttctctccatttaatattataagtcgtttgtcagtggccacgctgatatgtgggtctcatgctgactcatccgccacgtcagataaaaccggggtcaaaaccaccgaatgatctaaagtgaacggttttattagttgagggacacccggtatttctgtggttaggggacgattttgtaactcgatgataagttgagggaccttcagtatactttttcctttattctcttctcaaaccagtgtacacaccagtgtacgctgtgcagcccaaacatatgggccgcaaggaggaggaggagggaatcccactccgggccaaccgtaatggcccacaattacgacggagccccaactacatgggcctcaaagaggcccatgtaatcgaaagcccataaggcccacccacttctctattactatctccctcgcgtccggccgcggagacctcccgcatccccccaccgatttcgtcccctccggcggcggcggcggcggcggcgcacggcttctccgggagctctacgcggtaactctcgccgcgctctcgctctctctctccaccccatcctctattcacgcttgttcccgtgcgtgttcgtgtggtggtcatgcggtttccgcttgtcgccgcaaaccctagattcagaggtggctcggatgggtcgcatgattggctcgcgttgattcgggtagcttgacctaattggttatttagtggtaaatatgtgaattgactgaattcctttggtttggggatgctggttggtggttatttattcgtacgcacaggtttaagggttagatttatatataacttagatgtggagaacgtatagcttcgtttgttgacgttctgtacgtgggttagttttggagtgcatgagaaacttgcgttagagatttccgttgggaggggaatattttttttatctaatatatcgatcattctcttactcctagatatattgtattgttttttcctatggataaagtagtacgggaatgtcatggcatgaaaatcgtgtttggcaatttggcatgctactactatgattgtaaactttggttagttttgcaatgcatgaggaacttgctttacgcatatctgatgacctgaatgtatataaactgtgcggtgtgttaaagtaagattttaattgacgtagttttttttttctggacttgaaaagctctgcaatgtagtcttatgcttgcaatagttggcccaacatattttctgattatatttccgcttttctctttgactctacacttaacactttcaagggcagtaattttctaaatcttgtgcctatacgctaattgattcgctaatttctctcattttgttccatccgtcttctttctgttaacattttctgttatgtgcttcagacaaaacaatgaggaggtacagcccaccatatcgcagtccccctaggaggggctatggtggcagaggaagaagtccccctaggaggggatatggaggacggagggagcagggttctggaagtctcttggtccgcaacatcccattaagctgcaggtagtgaaaattgataactatgcaaaattggcatgtcgattccattttgatgactgtgttcttcatgaaagagacaaatgtttcaattcacaagttacacacttaattcaatttcattgattaccttaactgtggcagaggggaggatcttcgagttccttttgaaaggtttggtcctgttcgggatgtttacctgccaaaggattattacagcgggtaaggcattactgaacaattatattaacataatttggtttgttagttgtcaattgctgaacaacatttatcttctttactctagcgtagtaaatgtagattgtctatatttgtctgtgctgttggcctgtcgttgaaatgattttagaagctgttctgatgttatgcagtaaaccacaaatataaccatttttttcatgacgggaactctcagcaaacatcttccagctttagtgtgttgtcgaattcgtcagtcacctttgtgcatttctgctcaaatagaatgctttaatcatttttttttgggtctggtgatctagttaatagatttattgttgtctcaagacatgtaatgcactccttgccctgagtttttcccctgaaattattcccagggtcatgttggattgaagtaaatacaatgttgaaggataccttttaatattcctaacaattcatttgtttggcaagataaagtcttttccgtacgaagttcttctatgaagacaagatttgtttcattgagaaaattagtttcacgaagagaagataagagagttgtactgggtggtccatgagaagataaatatgaagtgaagtttatttgaagtactatcatgacttctcaaacatttggaaacttgaagcgaatgattttgtgaagatactctttatgaggatcaccatgcgtagtgttacacaagaaattcagatactagagcctggacatctaactgcttttgcatcgagaatcatagaggacatattgagttttgaactgtaatggtaacatgacagacacaatgctatacatgagcactttacaccctcgttatggttaggttttttcatcaatctgctttaaactaccttttctaatataatcaacatttacagggaaccacggggatttgcatttgtggagttcgttgacccttatgatgcctctgaggctcaatatcacatgaatcgccaggtgtttttcggccgggagataactgttgttcttgctgctgagtcgcggaaaaggccagaggaaatgcgcagtagagctagagtcaggtactttattcccattattgttttgaatgtccagccttatcttctgtcatgtgctcgtttagtcgtttgcattaacgttatgtcattgtgtgcttgatttgcaggggttactctggaaacgaagggcgccgctcttcatattatggtatttttagcattagtcattatttgtgataaggcctttcaaaatgcatatctataaatctatgccttttttaactgtactgaggaaatatgctctcgtcttatcacaacaaaattccttcagtttttctcgagtttcttctgaaaagttctgtttgctaattccttttgttgccacaccaaaattactgataggctttattgtttcatacagggaggtctcgttcccgttctcgctctccccactatcgaggtcgtccacggtcaaggtagatgaataatgtccatatatcaatcctcaagccattcaccttgtactcatgaatccggtcgcttttaaaaggtcatactctcctgctccaagacggcgagatgactactcagcttccccaccgagaaaggatacgcaccccacaaaatctcctaggcgtcagccaaaagaacatgatgaagagaagaagcggagatcctactctcctgccagtagagatggcgaccctcgcgatgctgataacggttatgagaagtaagcatagtatttcatacttccatcactttttccttaaatgcaatatttgttttcattattgcaatagggccatttacacaccaatctggtgttttacgagtagtaaccttctgtagacttgtaaagtatgatgaatatgaaaggatgtgggccttagggtcacttgaactatgggcagcattttaatctttgctgcatactcacgacagattttgttagtcttattctgtattaattaacaggaatacatagagtgaaagtgctaactatggtttatgttcttcacaggaggtcgcccccacctgacagcgatggatcccctccacaccggaggtctcctaggcactcctcagggtcgcctccaggatcccgctctaggtccgccgatgtttcccctgcccgcagcgactgacagaactttgaaccaacgaaatgggatagctgcatgatctccacagcacctccaattctagtcagtctccatcttccttcctggtccaaccaagctgtttcaattaaaccgaagccctaagcggcgtgttgtattattgctaagtgtgcttgccatgagtttggtatggcacatcgcctgtttgtgtgctcatatgttgggagtccaggatgttgtagtcttttgagagctgctttgtttggtggtcatttgctttttgctgaacattaacttgaaacaatgtgacattggtgttgtgtactaccactagtgagccttgaactgggtaaccgcctatttccacatctatctatgcttgtgagtgcttagcccaggggcccatgctgccatgccaatattgccatcgactttgtttgggaaaaagcttttgattggatctaccactgactgggccagcagtacactacactgcctctcttttcttcctcacactgcaacgattggattggacttgtgaatgcagcagcatcatgctgctgctgcaaacgcaatcccttttaatcatggagcaattgttgggttgcaggtgatcgatccatggcgtgcattgcttccatggttgttgtcaatgtttgcaatttactccctaaatgtttgacattgttgactttttagcacatgtttgatcgttcgtcttattcaaaaacttttgtgaaatatataaaattatatgtctatataaaaatatatttaacaatgaaacaaatgataggaaaagaattaataattacttaatttttttttgaataagacgaacggtcaaacatgtgctaaaaagttaacgaccgtcaaacatttcaaaacggagggagtatttatttatttatttttactttcatgatgcagcagtgaaaggcaggggttggtaggatgtgtcacgcagaaagtgtactgctttttgtgcgtggttgggtttgtgttgtgttgcttgattgcaggcactgcagatacgtgggctttgttgtggtggccggcctgaaaagttgacaaatctgtctatctgtccgctgctgactgctgtctcatctttcggctgagaattaaaagtggcaacggttcatcgccctgacgaccatcgttgatcgatccatcatgcaacaggatatatatactgcatgagtactggtactcgtagagtcgtagtgtatttctcggagtagcagcatagcatactcattagcatgctgggtaacgattaatctaggagctgtccgatggcaatgatcgggtgtatcagacccaccaacccccccccccccctaaaaaaaactgttgcatctaaaatttgcagaccttttcttttattttttatggatctcacgaaatgtactagattcaatcaaattttatattcaaatattctaaaattttacaaaattcagtcctatcggttttctccgatagaaatagcctaaccaatactacattaaaccttggtctacaccgatcataatcaagtagcctttccctcgaggacgcaaatcacacggttataggttttttttccctcaacccacacctagggtttaacttttcggcttgaccgattgtatcggaggtcaccggtagaccgaaaattaggaatttttgaataaatattactaaaattcacgaaaagttaaaactttttaaatattttggccaaaataatatcgtaacggaggggtccaaaatgactgaaatttcagaaatcaaagtccgaaatttccaaccttgcccacacctactccctccgtaaaaaaaaaacctaaccaatgacttgatataacataggacaacgaacatgtccagtcctatattatatcatatccttgtctatgttgtttttttttatgaaaggagtaggtgggtaaaatacactcgatgggtgacctagaccatgcaaatagaaacaactggataaagtatagcacatatgaacaatcaatagtttaagttaacaaaaataaagagcacacacatatatataaattgaagtgcaaatttaaccattatagtgtatccaattccacaagttcaccacttaatttaaaaggtgtataaactattctagattctactttatactaatgcatgttcatgcttcatacaaccaatagtatgtatatgtgaccattcaattgttgtcgctacatgagaaagacttctctttatctcatttctttaaccttattggttcatcatccttaataagctcctattgtatgaggaccctaactcatttctttgaaaatggtgtatccaattccattatagtgtatccaattccacaagttcaccacttaatttaaaaggtgtataaactattctagattctactttatactaatgcatgttcatgcttcatacaaccaataggactgtggagaacaaaaggccattgccatttgccagtttgtcacataacaatttacaacatgtcataatatatattcccttctatatcttttgtatgacattgacgaattcaattttgaacaaaccaacgtcataatttaaagggagaaggtactgtatgctatccatttaggatatgggtgtgactattgcgaaaccataccactgataccaacgcacatttctcaccacttaagtgttgtttttattctcgttgaaggtgcatccacaggtggatgaattgacctatcattatctaaggttttgttcgattaaaccctatctcaaggggatttgaaggatattgattatacacttctcactatcccctccaatctattactcctatgaaggctttgttcggaggcacttgctacggctgcggcaattcaaatcggctgtcagttgcaaccattcacaactgctgcaggctacggtagctagtctagctaaacgcagccgaattaaccaaacaaactctaatatggttaagggtttgggtttgtctccattttgatcatttttgaagaagttcacgtagtagtagtacaatactaaggctgtgtttagatccaaagtttagatccaaacttcagtcattttccatcacatcaacctgttatacacacaactttttagtcacatcatctccaatttcaaccaaaatctaaattttgtgctgaactaaacacagcctaaaatgaggaaaaaaaaggatttgaattttttcaccctccgaggggagacgcgtccggtttacccggggagggaagaagatgcagaggcgcagagcaccaatgcatatgcagcagctgcaggcggcagcagcgaccacttgtgacctgcactactacacgtcctccctcctcctccttcctctgctggcttcttgctgatttggtgtgatctcttctgatacgcatcaacacgagaagcatcgaatcgagtgtacatgtacagtagtcgacagtactactacagtatggacattcagccagctgcatcgatctgcgccgttggatcgacacgacgtgcggcccggatgcatctgtcggtcgtggactgtagcaaaccacagccagtgatgtgatgagtgatcaatcgatggatctctatatcagctgacctgatgcgttgggggatccaaggttactactgcgcgtgtatggatcaatctttggtggtagccagggtttacaaaaccatcttattattacgtaacattctcagttttttaaaccacggcatactttgttgtaaccgtaaccgtgcggttaccgtaataaccgtcaaactatagagtgacggtaactctacacaaaacagtttgacgaattatggtggtagcgtgtcctcttgttttctagggaacgaaagatgagagagttggttagaggggtccgtccattggagtactagcttaatttgatctcgattgatacttgcaaaggttgatgtttaatcatagattcggtcctcgatctaataacaatatctaacccctctgctcaatctaatttagtgctagtacatgtatctatctggtcccgttgcgtgtcttcttttctactactgctcatttgctttagttgtgttctttagttcatcggccagctgaaaaatgcttttattttcttagaatccctgccgtttaatttgaaaatgatgtgaatctgaacatatattcatggtagttcatacgaaattaatagtggtcttcatataatgaagtttactgcattacttaggatgcatccatttggaatggttgggatctcctcttctgccgtacgtaaaatgggacgagtcactagcacataactaattaaagtattggattaaaaaaccctgaaaatatattaatataattttctcaagcaacttcatatataatttactagtgccaaaaccgaactgtttagcgatttgaaaaagactgagttcctgcttgaggttccaactctcctccctcgtttttttttgaaactgctaaacggtatgtttttttttgaaaaaaaaagttatgtcgtttgcattaacgttatgtcattgtgtgcttgatttgcaggggttactctggaaacgaagggcgccgctcttcatattatggtatttttagcattagtcattatttgtgataaggcctttcaaaatgcatatctataaatctatgccttttttaactgtactgaggaaatatgctctcgtcttatcacaacaaaattccttcagtttttctcgagtttcttctgaaaagttctgtttgctaattccttttgttgccacaccaaaattactgataggctttattgtttcatacagggaggtctcgttcccgttctcgctctccccactatcgaggtcgtccacggtcaaggtagatgaataatgtccatatatcaatcctcaagccattcaccttgtactcatgaatccggtcgcttttaaaaggtcatactctcctgctccaagacggcgagatgactactcagcttccccaccgagaaaggatacgcaccccacaaaatctcctaggcgtcagccaaaagaacatgatgaagagaagaagcggagatcctactctcctgccagtagagatggcgaccctcgcgatgctgataacggttatgagaagtaagcatagtatttcatacttccatcactttttccttaaatgcaatatttgttttcattattgcaatagggccatttacacaccaatctggtgttttacgagtagtaaccttctgtagacttgtaaagtatgatgaatatgaaaggatgtgggccttagggtcacttgaactatgggcagcattttaatctttgctgcatactcacgacagattttgttagtcttattctgtattaattaacaggaatacatagagtgaaagtgctaactatggtttatgttcttcacaggaggtcgcccccacctgacagcgatggatcccctccacaccggaggtctcctaggcactcctcagggtcgcctccaggatcccgctctaggtccgccgatgtttcccctgcccgcagcgactgacagaactttgaaccaacgaaatgggatagctgcatgatctccacagcacctccaattctagtcagtctccatcttccttctggtccaaccaagctgtttcaattaaaccgaagccctaagcggcgtgttgtattattgctaagtgtgcttgccatgagtttggtatggcacatcgcctgtttgtgtgctcatatgttgggagtccaggatgttgtagtcttttgagagctgctttgtttggtggtcatttgctttttgctgaacattaacttgaaacaatgtgacattggtgttgtgtactaccactagtgagccttgaactgggtaaccgcctatttccacatctatctatgcttgtgagtgcttagcccaggggcccatgctgccatgccaatattgccatcgactttgtttgggaaaaagcttttgattggatctaccactgactgggccagcagtacactacactgcctctcttttcttcctcacactgcaacgattggattggacttgtgaatgcagcagcatcatgctgctgctgcaaacgcaatcccttttaatcatggagcaattgttgggttgcaggtgatcgatccatggcgtgcattgcttccatggttgttgtcaatgtttgcaatttactccctaaatgtttgacattgttgactttttagcacatgtttgatcgttcgtcttattcaaaaacttttgtgaaatatataaaattatatgtctatataaaaatatatttaacaatgaaacaaatgataggaaaagaattaataattacttaatttttttttgaataagacgaacggtcaaacatgtgctaaaaagttaacgaccgtcaaacatttcaaaacggagggagtatttatttatttatttttactttcatgatgcagcagtgaaaggcaggggttggtaggatgtgtcacgcagaaagtgtactgctttttgtgcgtggttgggtttgtgttgtgttgcttgattgcaggcactgcagatacgtgggctttgttgtggtggccggcctgaaaagttgacaaatctgtctatctgtccgctgctgactgctgtctcatctttcggctgagaattaaaagtggcaacggttcatcgccctgacgaccatcgttgatcgatccatcatgcaacaggatatatatactgcatgagtactggtactcgtagagtcgtagtgtatttctcggagtagcagcatagcatactcattagcatgctgggtaacgattaatctaggagctgtccgatggcaatgatcgggtgtatcagacccaccaacccccccccccccctaaaaaaaactgttgcatctaaaatttgcagaccttttcttttattttttatggatctcacgaaatgtactagattcaatcaaattttatattcaaatattctaaaattttacaaaattcagtcctatcggttttctccgatagaaatagcctaaccaatactacattaaaccttggtctacaccgatcataatcaagtagcctttccctcgaggacgcaaatcacacggttataggttttttttccctcaacccacacctagggtttaacttttcggcttgaccgattgtatcggaggtcaccggtagaccgaaaattaggaatttttgaataaatattactaaaattcacgaaaagttaaaactttttaaatattttggccaaaataatatcgtaacggaggggtccaaaatgactgaaatttcagaaatcaaagtccgaaatttccaaccttgcccacacctactccctccgtaaaaaaaaaacctaaccaatgacttgatataacataggacaacgaacatgtccagtcctatattatatcatatccttgtctatgttgtttttttttatgaaaggagtaggtgggtaaaatacactcgatgggtgacctagaccatgcaaatagaaacaactggataaagtatagcacatatgaacaatcaatagtttaagttaacaaaaataaagagcacacacatatatataaattgaagtgcaaatttaaccattatagtgtatccaattccacaagttcaccacttaatttaaaaggtgtataaactattctagattctactttatactaatgcatgttcatgcttcatacaaccaatagtatgtatatgtgaccattcaattgttgtcgctacatgagaaagacttctctttatctcatttctttaaccttattggttcatcatccttaataagctcctattgtatgaggaccctaactcatttctttgaaaatggtgtatccaattccattatagtgtatccaattccacaagttcaccacttaatttaaaaggtgtataaactattctagattctactttatactaatgcatgttcatgcttcatacaaccaataggactgtggagaacaaaaggccattgccatttgccagtttgtcacataacaatttacaacatgtcataatatatattcccttctatat

SEQ ID NO: 82690 - DNA, 6998 bp, Oryza sativa
accaaacaccctgaaaagggattcactttaatccgactcatcccgttgctccaaccagacacatgcttagttgtgtgaacaataacttttgatcttgtagatgtgtcaaattaatggcaaaaccaactggtaacgtcctattctattagctagttccattttatgagaaatgggcaacttagatccttcttgttttcctctacgacaagagaggaaattcaaaggatttcaatccttgcgaaatattttcaatgaggtccttgcaataaaggaataaaatcatatggattggttttctaggccttcattccataggaaacaaatatgagattcgtgctcatgttttcattcccttatatagaaacgcaatgcactttctctctctctctctctatgctcagtgtaaatcctctaagattctttgtgttctattttagtacgaactattcaaattaagacattgcttacaaaaattcatgtgttttagaatccggtaggactctactgtgtatgacatcttatctctacggtttttttcatgtgttccaaaggagcagcatttatctaaagctagcttgcaggtacttcctctatccacattagttttccatatgattccaggtacacgtgcgtaattgaaggtgtgttcaagttaaaatatttgagttcaattgtgagttttgaggttatttttgtctagattaaccccacggcaacaaaagtcgacaactgtggtattttgtcaaagaaatgaacacacatcttaatcttgtgatatactccagttccagctaaaccaatggttttttccttcaaacttagccggagagagagagagagagagaatatttgtaatatttcttcaaacttatgcagaatttcagcggctgccggagctaaaccatggcttttttctgcgaattgatgaaaaattgcgaccaattcacgcgatgacataaaggggaggaaaagattagcgctgaccactgagctattaatgcatgccttgcaaagacgagtaattaattaacacggctaaattatttattaccgcgcgttgtaaatcaattaatatatatacttgcttctcgtacacatctagtagtaccaagccacagaattcgattggtttaactaaattaattaatagtagaaattgaattgtatgtgtcatacatttactatcaagtaactactccctccatactcgtaaaagaagttgtttaggacaatatttaagtcaaaccttagaaatataaatcataaataactctaagttgttgagtttgaaaatataaaaatcatatgaatagatttgtcttgaaaaatactttcacaagaagtatacatatatcacttttcaataaatatttttatagaaacaaaaagtcaaagttatattttggagactgtgtcgctgtccaaaacgacttcctttaccagtacgaagggtgtactacaaattaagtaaaagagcttattttcatatatctgctgagaacatcagctaatccactcattaattctgatcgtacagttttgagagacatgcattgcatgtaatcaagcatgcattaagtcaaatgcccgtgcgctacagtagattcagaagaaatatatatcattggttttaaacttaaaagggcaggaaagtcgcacatagtataaaataaaatactagctccatctattttatattataagtcgttttgatttttttctaattaattttttaagtgatcaaataaataaaaatatatagcaatatatttgacacaaaacaaacatattatcaaaatatgaacagaggaagtaatatattgataggcaagctccttgttgtaaccaaggttaggggatggtcactacatagtacaaaatagattttcgtggacacttcgctctgaactacaccggcggcctaaaagcacaatagcatgtataatacacgggggatgtgcacggttaaaagaagatctattacaggcagttacatataaaaataaacatatttacacatacggctatcatagtgcgcccgtgtatatagtgtaagtaaaatcttggcattaatttcaattggcattttagactttctatagcatttgaaaaacccttggagcgatcaggatcggacaatgtgagtatgacacccccacttcatactacttgtgttaggtacgttcatggttgattgctgatctctcaagtggcatgtatatgtcatctgcatttgacatgccgcagctcagatcaaacttaaaaacagctattgtacccattgtatacatgactggagtagctgttgctttgacagaagagaggtacatggttgacatggctgctagcaatatacattgctcttcttcccctgccacatcatccggtttccgcttttcaaaaatccgtgaaaatatacatgtattatctaaaaaatagataaaatgattacatttaattcgatcggcagcagcagcttcggtggctatcacctccgtcgctgcaaattagtccactggttttaaatcaaatatatacaatttaacgcacatgtgaaaaccgggccgcattggagatgcatgcctatacgccttttttaataataataataataataataataatagaaataggttatatcttcggtcttgccattatagaggtacatggttgacatggctgctagtaaaaatatacattggtcttcttccccagcggcatcatcccgtttccgcttttcaaaaatccataaaaatatacatatattatctaaaaattagataaaataattatgtttaattcgataggtggtagcagcttcagcgccatcaccttcgctgctgcaaattagtccactggtttcaaatcaaatatatacaatttaacacgcatgtgaaaatcaggctgtattggagatgcctgtacgccttttttaataataataaaatgagttatatcttcggtctttacccgttagacacactgtcatccagaggcctatatatacagagcacctatcacactgcatgccatgctcctcatccaaagttcagacaaccagaaaattaaccaagaattgctctgcctatagcaagatctagtagcaaagcttgactctgagctcaggaggaagaagatggaagggcacaagagtggcatggaagctgtagcagttgccatccctcccttgcacactggtgagagcaaccacaggattgacagcaatgtcagctcgcaatgccatgctgatcctgcagagctctctgatgaaactcagcagcaatctctgtggcatctaggcctaagaaagataataccatcatctgttcctctcctcaagaaggtacacactttttttaccccatattttcacctctcatcgtctgttttttgtcttatcagttgtgaccaaaatttgaattttaaaatataattttagagtaaattttgaggtttatttttcagtactgacttttaaactgctaaaaacataggtattataaaagttttgcccataaataatgtttggttaaacgttgttataaaagtttatttttccacactttattggccatagattaaacaataagagcaaaattcttgaacttcctcatcctctttctcttcttcttcagaaaatgtacagatatctgacagacaacaacctttttcccccgtaatctttttcttcagatgaatctctgaaatgtttcaggtcagtgctgagttctttggcacattcatactgatcttcaccgtgctatcaaccatcatcatggatgaacaacacaaaagtatcgagacgctcctcggaatcgcaacatctgcaggcttagcagtcactgttctagttctgtccctcatccacatatcaggatgccatctgaaccctgcaatcagcatcgccatggccgtctttggtcacctcccttctgctcatcttctaccttacatttcttcacaaattctcggggccgtcgccgcctccttcgccgtcaaaggtctgtatcatccggtgaaccccgggattgtcaccgtgccaaatgtcggcacggttgaggcgtttttcgtcgagttcataataacattttttctactgttcatcatcactgctcttgccactgatcctaatgcagtaagtgtggttttctgatgtattttgatcagtttggttttcttttctttgaaatgtttgattcaaattttgtccttttgatcaaaatcttcatcaggtgaaagaactgatagcagtggcagttggggcaacagtcatgatgaacattcttgtggcagggtatgtgcgtatggattgattaggaacaatacatagctttcctgggtattttaaactgtcatgtaatactatttgtgttgtattttacaaaatataatttagatttgaataatttgaacaggccatcaacaggagcatcgatgaatccggcgcgtacaattggcgcggctattgccacagggagatatactcagatttgggtttacttggtggcaactccactgggtgctatagctggaactggggcttatgttgcaattaagctgtagtttacaccaggtaaagtaaaacaatattgtaaaggaaatcaaaacatttatcatattgtgatatatgaccattacattttaaataagtaataactctgtctttttacaggtaacttgtgactctttgagcatgctgatataaccatttcgccagaatgtaaataaacaaaattctactagctccatgatcaagtatagacactgtaattacttctaatagctgtttttttactatctccgtgaccaaaatgtcaataattacttgtaatagctgtttttactagctccaagaccaaaatgtcaataattacttgtaatagctgtttttagctatggtaagaagaacacttcagtgtagatacccaataaagtgtgatttctccaagtccatcaattctacaaactaaatcacttctatgaaaagaacaattgaatcactccgaggtctctgagcaaaacaaccctcattaagatatacatttttttcctgacagcatcaagttacagcggcaaattggatctcacaactacttttctatatgaacaattatgaaattaagcagaacaaggtacaagattacttttattaataaagacagagttcaaggggaatgaatcccagtacatcgccgaacagatgttatgtggcactaaaccatccttagataggaaactgaggataggaaccagacttcctaaggaaaccaagcagcaagggagaagcagatccacagggagcccgcgacgactacatccttgagcctcttttaacgtgcacaccgcttgacaaaccggtaatacccttcggctgcctctacgggaacggaattgctaattagtagcatgatcagcaagagaagccaatgaccgttcgggtgccatcgccatcgttgaggtcctagctcgttcaagctgaacccgtgacggcggcggcggctgatcgcagcgatcgccttggacggccgcttcatggcaacggtgagacggccgtctcgcagaaggagcgcaaccttgtctcgctctccttggtttgctcggtgggagacgggaactcggtgttgttctgggaagattgttggctgcagggcgcttcaattcggtcgctggcactggctgtttgggcggctgtcccagggcggttgcggggcaaacgcacggtgtctgaggcgctacacgacaggagatagattcgtgatatctcctcggcgttagggatgcaagcgatccttgaatacttcaagctctgggagctcctccgatcggtgcagctgtctaacgagccggacaagctttcttggtgttgggagaactcggggtagtactcctcccgctcggcttatcgggttctcttcttggggagaactcaattccaacacaagccaatctggaagtctttcgcccctcctcgatgccgttacttcctctggctggtcgctctcaaccgatgctggacggcggaccgccttcgaagccgaggtctgtcgcacccggatcgttgcccccactgcgatcaatgcgacgaaacgattgatcatctcctggtcgcatgcccggactctcggcagctttggtggattgctcttactgctatcggtcattctgaatgtctacctctcaatgagcagttctttcatgcctgttgtgtgacagtcgcaaaaggatgattaaagaccatcgccgagggttcgacacaattgcggcactggtagcatggacaatctggaaggaaaggaacaaccgggtcttcaaccagaagatcagaccttggatggagatagctagggctatgagggggaagcggacctctggcggatggctagatcagccataccgaccatgacagtcccttcgcttgttctttggtcgccaaatcattcgagagattaggcttctacttttctcttcccctctcctgtaccctgtccctttctttttatttttcagtcccgttctgtaaatacatttattcctcttaatacaaaaatacgcgtctcgcgacggtgaactcgagcatcttctcggtgaggtcgacctcgtcgccggcgacctcgcgccagtcgaactcccagacgaggttggcgacgaagtactcgaggtggagcagcgccagcgccatgccggggcacaccctccgcccggcgccgaacggcatcatctttatctccttgctgccggtgaggtccacgtcctcgccctcgccgccggcgaggaaccgctccggccggaacacctccggcgaggtccacacctcgctgtcgagcccgatctccctcaccgcgaagttcaccggcgtgttcgccggcacgcggtacccgtccagcgtcgtctcgtcttccacggcgcgcgggagcgcgtagaggccgggcgaatgtcgccggagaccttccagcaccaccgccttgaggtacggcatcgcctggagatcctcctctcgc

SEQ ID NO: 82691 - DNA, 3077 bp, Oryza sativa
aaaaaatatacctgttttccgtaatgaaatcaatacacttcccttttatacttacatgtgctgaaagtgggcctttggggtctgaaagaacagaatgcagacaacgaagaaatgaggtataaaatctgaaagatagtgaatttagcttgagattagcattcattcatttcactatattcaatgacaaaaccagagtactaaccttgacatagtgctactctctatgataaagttccttgctgtcaaaaaatccatcaccttcctcaaaacctacaaagtgcaagagaggagatttgacaaagagaaaatgaatactaacaccgtaaacttctagcaacaaaacaaatgcataaaatgcatcagccagtggttgtgtagtaagtattggtaaagtgtatcatcaaatgacaacagtacagcacaaatcttggaccaatggtggaagaaccaataatgctgtttgcatcccagatactaaacagctacaaatttccttgctacggtacttgctatggttacatcgctcaatgatatgtgacaaccaaccagagcgaaggaaacacaaaatactgacctcaacaatggactgccacaaatcttctgataaacttgaggctatcttagatagtgcatcttcaatcatggaaaatgcagagatttccatatcccagatatttggattcttattatttattggtccaaatgtgtgggaagaaaaaccagcaccattaggtttatctgtgaggttcagctcagattgcaagcatgatacaattgatatgagcactcgaagcaaatgtgcattctcaggtaaagaagtacttccgccaaaatctttgctcaaaaacctggccattgagaagaagactacaatgagaagcacaaaaaagattgtacatgcctgatgaaatttcattaatagtggtgaattcctaaagggtactagaatagaggtgtcacatcaaattattaaattaccaattcattcggtaaagctaaaagcagtatcttttcatgaaataatacaaaataatatataaatttgggaagatcgtacttctactatggcaattcaacacctgtacccttgaaatgatgggtttatagatattaccatatttactttggttatggcaatttgcctacgtaatttagtgtagtttaccgcatgtgcaggtagcaattctcttattcgcaccagtataggtgaggaattgccaatttcaaaagtactggagggattctgaaaacttggaaaagaacatttggtgctgtgaattaacaaaagactccaattaaaggattgagctagtatatatgtacagaaaaaagatgataatttatcgagtcctttcaataaatgtcggttaagcctaaaagactgaagtaaataaatgtagaagccattctcttgaggcgagcaaataagaactaaaaagattattattacaaaagtttagctaaaaccatgggaacacactctacattgttgatgtactaggtcattagtacttagcacaacaaaaacaagcagagaaagaagatttttaagcattttacactaatcttaagctcacctgaggatctgtaaacattcagatacagtgtccaatgcggttttcctaacagagaggcccttaccacatgaaccctccaatgaacattgcataagaacatcaagaaacttcagcattgccagtaaacaagacgagtcgatctccatatttgttttgtacatgatatcatgaatctgcatgagtagattttcagaaaaatcagagcataagtattcagcaaacaaattgacacggaggaacaaaaaccaaatccgacggttttaattcgtcagtcacattgatcaacaaatattagaattccatatcgcagcacgatatctcaccaaccattagagcttagagtaatgagaactaaaaatgccatacattttgtgctaatggtctcccatctgaattctttttttagataacatcaaagtgatacaaccgtactgagaacactcccagcctctgcacagcaaagatgaacacagccaaaacacccacccacgtactagtttgaaacgaaggaaaaattaaacagggacaattaagggacatcaatccgtagacaatctgaatgttctacactatcattgtcagtccacattaaagcaagatctcgagcgagtggaatcagaatcatcaccagatggcaaacgccacgcagcacatcatcggcgccgtcgcagggggacaccgccgcggccgtctccgcgaggaacgccacatccgagcccacctgcacacggtcacagcagcagacgagagtgtgagagagaccgaaaccagagcacacgcagagcagagaccaagctgcgcgggagcgggggggggggacctcgtgggcggagaccgcggcggcggacgcggcgagggagtgcggcggggcggcggcggcggcggagaggaggaggacgcggcggaggagcgcgaggagcgccggtggggagggcgagaccaccgactcgtcgcggagggtgaggagcgccgtgcgccactcccgcgcgccgccgcgggatggggcggcggatgtggcggcggaggtggaggccatcgccggcgaccaccgtggcgggcggttgctggtgaaactccttcgccgatctactccagtgaagagaagagaaaaatccttcagacccaaaggagggactaagggaggcctgcttagttcgcgaaaacaaaatttctaggtgtcatgtcggacgtttgaccggatattagaaggagttttggatacgaataaaaaaactaattttataactcgcctggaaaccgcgagacgaatcttttgagcctaattaattcgtcattagtatatgtgggttattgtagcacgtatggctaatcatggactaattagactcaaaagattcgtctcgcaattttccccctaactgtggaattagttttttaatttatctatatttaatactatatgtatgtgtccaaagattcaatgtgatgtttttgggaaaaagtttttggaactaaacagggcctaatttgcataaaact

SEQ ID NO: 82692 - DNA, 61712 bp, Oryza sativa
  unsure (1)..(61712): unsure at all n locations
ggatgctttggcgttaatttcattcccagccatttcaaggacctccaactggggtgctgactgtttgagggtattgataattgctacagtgcccttgttctcaagattgagatcactgagatacagctcaacaagatcaggaagttttgaaagggttttgctgagagccaaccctgcctcaactccaaacaagttgtccctgagatcaagtttcttcagacgagtacaagtccctaatgcctcagccagagccaccccaccatcagatcctatccttgttgctgagcacctgaaactctctagattaggagaacgtttaaccatctcagcaataaacatagcaccttcatcccccgtcatattgttgtggaagtggaggatcttaagcttctcagttgaaggaataagttcagaaagagcttgtgcggcttcctctgatataccatcattcatcacatatagttcttccaggttgtcctgtgatttcaggagctcttcaaatgctctgacacccttctcacctaaagcattatcagagatgttcaagtatctcagtacagcgccttctaaagcttttgagaagatgcgcatcacatcaagggcttcatcctcaggtctgccagcaacaaaatctgatatatccacctctgtgagttgctttttgattgattccagaataggtccagcaacattggcagcaccaataccaaagctcctgttgctgaagcaaatccgtttatatgcatttcctggtttgataagcgggctcaaaagttccttcgcttcatctgcctcaataaacgcacgcttgccaccagatatatcaaatacagaatcagcaggctcaagaggtgtatcagcaacaggtacttctggttccacagtggtccttggccctcttttcagaacttccagcatcaacttgctagtttcctttgcgtacagctggacagcagaactcccatccccatcaggctcctccttgaaatgctcgtctgcagaggcaaagcatacctcttcgatccttttagcattatcatgagcctcttccttgcccaaaaggccgtacttgcgagaaaatatggactctgtggaaaggttcttggtcatcctctccacaagcatgagacgagtgctttcacttggtggccacagtttgatggagaatgtccggggttggaaatcttgcttagtcgaatccatgtgaaaatatggcagtaacagcaacctaaatgacagatgatcaattattaggatgattgcaataatagaacatgaggcaatagctgcaacattttaaaaaaatgcaaatagtgtggaaaactagtacttggagttctatccaccaaagcatagtaccaatgggagtaaacctaaacaatagctagcaaaaagaataataaactctgcactgtaacagcaggaaaaataacaattgttataatagcaggaaaaatagctatcaccaagtgatttctctgaaaattcattcagcagttataggatgagttgctataatagaagatgaggcaatagctgcaaatttaaatagaataatgtaagcagtgttgcatactagcaactgaagttctatccgccaaaacatagtaacaatgggaatacaactaaactagctagctgaaaaaaaaagcctgcactgtaacagcagcagcagcaacaacaactgctcttttagcaggcatcaccaagcgcttcgtcagaagattcatttagcagttataggatcatgatatcagagtttcactgaaagaaaagaatcaaagcgaaaacgtgtgatgctgctattccattatcaatcaggctaaacttgcttatgctactcaccctactacaagcaggggcggatccaacttgggacacgagggttcaattcagttgaaccccaaacttttggggaacaaacaaacaaactgttaattgtattaaggctaaggatctgaaattaagagaagagcttcttccagatctagaagagaagctagggttaacgaacgcaggcaaattccaggcaaaggtaggtcgggggagagagatggatcatcagaaagaggatgcggatgctcaccaggatcccctcccctgttcagccgcgagatggcacgaggagcggaggagacgacgaggagggatttacccgcggcggaggcggaggcggcggcgggggatgcggcgcgctagggtttttggctctttggaattttggttgatgcggcgggcgcggacggggcgaggcgaggcgaggcttatagctcggtgacccgggccgtagccactgaaccgtgggtcccacggcccaacaagtagcgggaggggaacagaaaaaaaaaagtaaattttactccctccgtcgtataatgatgcagcaacctaaaatacgatggatctcatcccgtcctaggttgctatattatggggcggagggggagtatagaactagcgatgcttcgattagactatcacaaaactacagaatcgatacattacaatataatttatcataaaactacatattatagagtttaatctgtcatgttatagctatagatgctatggtttggtgattaaattggcactaaatctatagtttttattacttttgtgatactctgtggtgaatttgtatacctcctcactaccaaaatattgcccatcctaaataccccatccgttccattataaatacaatcgtaagggcatgtttggtacagctccaactcctaaatttaactccaggagttgggtctggagagnagnnnngnannngcntanacccagctccacaactccagttcattttatgagagagctccacccaactccactcccagttttggtggagctgaaactatttggctgagctccagctccaggaggggtgaagctggagctggagctgtgccaaacaggccctaagtttccgcgcctaattttgatcgttcgtctaatttgaaaaaaaatttaattagtattttttttgttgctaatgagatgataaaatatgaatagtactttactcatgacttatgcttttaatttctttcaaaaaatctattatattattaaaggaatagaaaaggaagcctccacgttcgctctcatggcctagaaattctcacattaatcggagaaaaagaaaaagcagagtccatatagaaatacaatttagaaatagctgaaattcggaattaaaaataagaaatattagaagaggagactagagtccatatagaaatacatttagaaatagctgaaattcggaataaaaaaaggaatattagaagaggagactagagtctatatagaaatacatttataaatagctgaaattcggaattaaaaaaaaggaatattagaagaggaaactagggtccatatagaaatacatttagaaatagctgaaattcagaattaaaaaataaggaatattataagaggagactagagtccatatagaaatacaattaggaaataattgaaattcagaattaaaaaataaggaatattagaagaggagactagagtccatataaaaatacaattaggaaataactgaaattcggaatcaaaaataaggaatattagaagtagagtatagagcccatatagaaatacaattaggaaataactgaaattcggaattaaaaataaggaatattagaagtagagtatagagtacatatagaaatacaattagaaaataatataaatttggaattaaaaataaggaatattagaagtagagtatagagtccatataggaatttaaaactaacaaaaatttgaaataaacatgataaaattaaaagtagagtttggagtccatataaaaatacaatttataaataactaaaattcgaaattaagaaaaacatgggaagaagagtttaaggtcaatataggaatacaatttagaagtaactgaaattcaaacttaaaaattaaagaatattgaaagatgagtttagagtgaacatagaaatacaattaaaaataataaaaatttagaaataaaaataaataatattggaaaaagagcatagagtctatatagaaatacaatttataaaaaattcgaaattaaaaaaaaagaaatattaaaagacgagtctagagtccatataggaataaatataatttacaaataactaaaaattgatattaaaaatgattaatgactaacagatatataaaatataatatgaaaattcagaaataaaaataaataatattgaaagaagagcatagagtctatatagaaatacaatttacagaaaattcagaattaaaataaaatattaaaagacgagtgtagagtccatataggaatatatataatttacaaataactaaaatttgatattaaaaataattaataactaacacgtatataaaatataatatgaatattacatattagtggttttgtaaagttattgcaaaatttaaaattatgttgttattttaatatatttgaataatataatgagaaaacatatatgctattatatgagagaaaatataatgatgctagcggcgcaatctgcacgggccaatatgctagtttttaaataaaatggacggtcaaagttaggcgcggaaaaccatggctgcacttaaaatgggacgtaaggaatagcaaacattttaagacgtagttctagagaaatttcacgttaaatatatagttttatatatctctagttttttttataatagttttgtgaaatgtaatcaaaataattcctgaatccatctaactccaacgtcgtctccgatctccccgtccatctccctctccgcctccgccaacgcgaacgcccagaggtgcacgagagcgcgcgcgccgcgccgcgcctcgcctcgctgatccggcaagcaaaccgcggcgccgcgacgcgacgcgaaccccgccgcgccgcgagtgtgggggagcacgaatggtagccggccgcggttaggtaggtgggcgccgcggggtgtcgatagctccggagggtgggggtggggggagcagatccagatccagcgagggcgcgagcaatggcggcgggggcggtgtcggcgctgttcctgctcgacatcaagggccgcgtcctcgtctggcgcgactaccgcggcgacgtctccgcgctccaggccgagcgcttcttcaccaagctcctcgacaaggaggtaatgcaatgccccctccatttcacctagatctgtgcaaatgccgggcttctcgatgagctttttgccctgtgtgatcagagcgacgcggaggtgctctcccccgtcgtccacgatgacgccggcgtctcctacatgttcatccagcacaacaatgtgttcctcctcaccgcgtcccgtcagaactgcaacgccgccagcatactcctcttcctccaccgcgtcgtcgatgtatgggttgctgcccccatcttcacagcaacattctgcgtttgttagtatggacaatgccattggattttgttcatatgatttgtgtgtgtgtgggcgtaggtgttcaagcattacttcgaggagctggaggaggaatcattgagggacaacttcgtcgttgtggtatgtgcgcttgcgtgttacgtgaactgagtactgggtctggttcaatcggaattgccgtgtcactgaaattggagggttgatgtcatttgctgtgtgtgtagtatgagttgcttgatgagatgatggatttcgggtacccacaatacacggaagcaatgatcctgagcgagttcattaaaacggacgcgtacaggatggaggtcactcagaggccgcccatggcagtgacaaatgctgtgtcatggaggagcgaggggattcggtacaagaagaatgaagtctgatacactacacctgtatttttatttttttggttcacatgaacgtgtgatggatttagaaaattatcaacattttgtgctgcaggtgttcttggatgtggtggagagtgtcaatatcctcgttaacagcaatgggcagatagtgaggtctgatgtcatcggtgagctgaaaatgcgaacctttctaaggtagtaactgcatggtcattctcatatcacaaattcacattgtgctgataactcagctgcttcagtaataatttaatgggagttgcagttagagggatgcgaaacactgtttttatatgatgtatccaacccattattgtgaacttctagtttaactgtttatcacatcactgaagcaagttgatattgatgaataaagactattaaattgtgtatacaatattctgccaactatgagtctacgacatatatgttgcaaccatgtcaaataaatgtaggtaatgtaattctcatccagataatagcatcaaacagtacataaaaatgaactttgttgcagtatgtaataatgctctaattggactagtcattgacctgactagtttgtatttcagactatctgttggattgtccaagatatcgttagactatatgtttcccaagtacccagttacgttatgaatgctaagtggactagccattgaactgactagtttgtttttcagacgatctggtagattgtccaaaatatatgttcaacttatgcatcatagctaatatccatctgcttgtacagtggaatgcccgagtgcaaactggggttgaatgatagggttctcttggaggctcaaggccgaacaactaaaggaaaagcaatagatttggacgatatcaaattccatcagtaagatactaacatacagtataactatgatggttctttatcaaatgtaattcatttctattacatcatccatgttacaactctgaattggccaaaccttcgttaggtgtgttcggttggccagatttgagaatgacaggactatatccttcattcctccagatggatcatttgatctgatgacttacagacttagcacccaggtttgtccctgcttgatctttgctgctagtatagcgctaggttatgatctatatttcacctaatctatcttcctctggtccctcccacaggtgaaacctcttatctgggtagaagcacaagtggagaaacattcaagaagtcggatacagatcacagtgaagacaagaagtcagttcaaagaaaggaggtgttattttattttattttcttaaaaaagcgataatgtctctgcatcagtgtcttagttccagacaagttactgttattgttttttctcatttccagcacagcaacaaatgtagaaattgaagtaccagtgcctgaggattcgacaaacccaaatataagaacttcaatgggctctgcggcatatgcacctgagagagatgcgatggtctggaaaataaaatcatttcctggtggcaaggtaagtgctgagttgataccaacttaccactttgcctttcacttttgtgctatgtccatcaactctaatttcctagaatctctccattaggaatatatgtgtagagcagaatttagccttccaagcataacatcagaagatggaatgcctgaaaagaaggctccgatacgtgtgaaatttgagataccgtattttaccgtgtcgggtattcaggtaacataccaaattatgttgcacatctcttaccactatgtttggaacttcctttggtatcctactcctttattgactttgtgcttttgcaggttcgctatctgaaaatcatcgaaaagagtggatatcaggcccttccttgggttcgatacatcacaatggctggtgaatatgagttgagactcatctgattttcacacctctggttgctggaagaaatgattgatttcctggagtccaagcctcccagggggcgtttacagaggcaactcagacgaacattcactcgctggatgggctcccgaggcttcatggttccatctcgcgcaagcgaggaaagctgctgacagccatgttattgattttacccatgttttgctgcaagtttgtcatcagtataggtccccagaatcttcatttcttttctgcgttttgttcccagccgatatctcttgtatcattgtaaaatttatttaatcaactgatgtcacaagcttggatttttttttgtatctcctgtacctaattaacaagcttggatcatgtataccactatgtatatctctcctttccatcatgctttcttgtgtcaagtttgatcatgtcaggttgatgcatgggcatgaacagtgtagcaagatcttagcagcgctacggcaaagcctctgcaccaagggcatgtttggttgctaccctgagtgtatgcctgagtaaaagtggtacttgagacttcaatgaattttttttatgctttttgcctgatgaggcgtccctgagttttctcatttttgtagaaggcctggagccctggactaaacaggattgtcgcgcttgaaattagctccggccactaatttcgagcgcatgagccaggctagtgaaattggcggataagcttaggtcaggcaggtgctttaagcatcatcaggcgtatctctggcatgcatctggtcaggcagatgttactcaggctatgttagagtttgatagcattgctttctcgtatgctcctcggtccagtaattcttgtgctcatgatctggcccagatgagggtgaagggggacccggattggttcggcatatggactgatcccctccccgagtttgtaactcgcctggttgctcgtgacatcactgagccaaccgcgaaataaagttgggaacctgaatataaaaaaaaaaggcccaaatcactgatgtatatgcagccttcgactgtcactcaccgatctgccaagctggcgggtcctaggggtggtttgatttactctcaaactttgctagaggttgtcaatctcatgttagacaagtttgattaagtaaacttcttgttggttcataaccatacctgtggcatgattctctctcagtctcatggtccatatatcgccaactaaaaaaagtatggcactagctaagatgtgtctatttttttactagctatacaatttagataattgtggaaaaaaatggtaattttagtatagcatccaaattccaaacaacaccttttttttttctaccggagcagcatgttgagcggtcaaaaaatattatgtggcatgtaggggagcctatgagcatgtagtgattctatcaatgtctagtgatacttttcatgaatgtcatgtttggttgcctgtatcaagcctggctcgcatccctcatgcagctttgggtcgtttggttgcctacaccagtccatgtgacaagctaaacggataaaaaaacaatgtgttttagttcacgctaaaactgaaaatttggttgaaattggaacgatgtgacggaaaatttagaagtttatgtgtgtaggaaagttttgatgtgatggaaaaattgaaagtttgaagaaatattttgtaactaaacaaggcaaaagttgagcaggaatgcttgatttgagctgtgctgctcgatcatgaccgtacgtgggtaggagatagggccaccaccctaccccttgtccccttcttacttctcctgcaagtgacgaggcaatgaacacgacgatgacgaacccgacggagggcacggtgtacgacacatccaccttgtcgctacacccctcctgttttcagagctccagaaatttactagctcattgactcattgagtcattggttctgaatttctaatgaatgatgaatacaatcatgtccattgaaaatattcttttattaatcaagatgcctaatatatattcacttcattgtataatactccctccatcccataatataaagcatggccaaacttggcataatcttcgacactaatctttgacttataatttctcatatactataaggtttattgtaacaaaattataaccatcttaaagtaaatttaaatgtcaatccaatgatataaattttagtaaaaaaataatttatattataataatcattggtcaaatgtttttaaagttgaattttggaatgtgtgcacgccttatattataggatagagggagtatataacatctttaatttgacttttgaataggcatttcatcattcttcttattcaattcttttaccaataaaatataagtcatgtttttcaatttattatacaaataaaatttaagccatgtataaaataccttaaatgataaaacaatcattaatagtaaataaatgacaattacgtgatagttttaaataaaataattagttaaatatatgtctagaagttaacggacattgtatctttatctttacctacttaaaaaattggtagtgtttttacgtccatcaatccaacggtcatgacctccaacagatccaacaactagatcgctactcctcgactccttcccctcgcttactgcctctgcccccacttcccgagtcagagtcgaagttgatgagtaggaaagaagccatgtcggacatggagagggaaagaggagtgttgatttgttgatggatccgatttcaatcaccctaaacaaaatcagtattaccaaaaaaaagagaggaagagatcgaccgattgatttcttgggctgaggtgatttggacgatatgagtaggggtgcgatgcatggccaacatgcagcaacatgtggcgacaagagagctctcggtcagtgtcggctactttgtgaggaggcggtggaggggaggtctggcaatggcttcctatcttatcgatgaaccttatcgatgttgcatctttacaatgataagctacgtcatgtgattattattattgttgtaaaaacgtgaaataatacgtggtttaatatgtttgccttcactcgttgcaaagtaagatattcttgttagtacgttaaaagaaaagagaagtgcatacgatgtcggtcgttgaattcgccatatatattaatcaccttaaaaattaagatagcatactacatttttgttctccagccttttttttatatttttttttcacaagtgcgagatacgccaccacttctgtgatctgttgatcgatcttacacatatgcatgcgtgcgtacacacataacgcgcggacgcatgcatgagctaggtgtaattttatagttgatcaatcattcatatcgattgatgatcagttggctaattatagcttgagcttggcggcgatggcgagggcgccggtgacgacgcggttgacgttgttcttggtggccttgagcgcgaggctgggctccagctcccgctcctcgtaggcgttgccgcagtcgccggtgaaggtggtcgccgccgacatcttggtgatgaggctcgccttgctgtcgttggcgtcgatgcagcgctgcacctcctgcagcgccgacaccgtgctgtcgtacccttccttgcaggtgtccaggatggactccatcggcgtccccttctccgccgccctcgccgccgcctcgaacctcgccctcgccgccttcgccttcctcatcgacagcttcaccgccgccgtcaggagctccttcggcgagctcacccccggcagcttcctcagcgtgttgcacatcttcttgttacccgcctgcatcaacatcaatagacagactgttcatccatgacatgagcagtaagtaattttctgaccatttctggagcgggagtggattttaatccctcgaggaacatcattccctcattgtttacatgtcactcaaatagttataaaaaaattaaaaaaaattcgagaagatgtattaacatgttatatatcacttcacaaatatccaagttcaaattaaacatctatatttggtttaatttatttttttcgttgcgagatacagaagttgaatttgaacgtgtatgtttgtggggtgatatatcacaggttaacacgtcttcttaatttttttaatttttttataattatttaagtgacatataaatacgagggaccctctcgagcgatcaaaataagcttccatggacaatagtgtcgtcactcaccgcgacatgatcgcaggtccaggcgcactcgtcgacgacggcgccggtgatcttgcggccattgtcgatgatggcaccgagtgggttggtgatcaggttggtcggagcgacgtcgataggtccaacccgggcctcaacgacagcggcagcggcgaaggcggcgacgacgacgacggagatgatgacgaatcgcgccatggtgtaatgtgttattttgctcttcctttctctcttttttttggccgccctcgatggttaaattgagggatataagagagacggccaagaaagagagtagaaagagaggcaaaaggctgagaagctaaaaggtttggtgatggcttggcttctccgacaagctgagtacggtttatataggggagaggtaaaggtaaatgaatggccatggtttctttcaggttgggtggttgcatgccatgggtcatggttattttcagattttggtggttgcataccatgggctctccttggtttcaggctgtcttggctaaacttggtgttgccttttttttttcttttattgtttataagaactttgtacatattttttaaaattaaacttgtaacttattttttttttatgaatgtttcgacaacgccaaaattagcgatgtatgatttgttttctaaaaataaattagatctagccgtataatttgcaccaccatccagctagtttatttatttttttataagagtacagaagggcaacatgtcaaaaatctataccatgatttccgcaatgcttgcccgccataacattttaattaaactagttggcaccatgtgtgcgccttacagtgggattcattagttctatcgtcaaccaaaatcaaagttctaaaggattagatgcaactctatggttgtgttatttaccctatctgcctaactcatctccctcattttccatgtacacgcttcccaaactactaaacagtatgttcttaaaaaaatctatacgaaagttgctttagaaaatcatgttaatgcattttttaaaaaatagttaatacttaattagctatatgctaataaatctttctgttttacgtgcgtgacggatttagttcccaacaccaacaaccgaacgcagcctatgtatatacaaaatactaatgtagcttcatatgtaccttcaatattacaatacaagtattgatatatgaatgttattgttcatatgtaatctagatatcgttgtaattactacaatctcaagtttgatctgaaaatgggtttgggttagtgactcccaataattatatgctatctaattattcataataaaacaaagctcacatcttaaacaataattggaatcgtattaaaaaaagataagttagcattatatttgaggacttaggaaggaaaagcatggtgctatgtgcaaaatgggtaaagattcttgatcgagcgacagttatctttttattaataaatttgaaggcttactacatgttttactctatagaagtaaatgctcctaactaagagtaccaactcctacccctctctcaaagtagagggaaatttgtccatgtaactatatgtgcacaaaatcccagcttttttggaatgcaggattttagaaacacacgaatgtgaaaaaatatgggtgaatagctaatttagtccctcaagttttagcgaaggctcaatttggtccttcacgtttcattttgtccacataggtccttcaaatatttgttttggcttaaaatcatccttgggtccacttaatatgccatatggctatttctagtcaatatttctattagaaaatatcatttttgcccttaatttgtatacatctatatactagaaaagagaaagccaacatgaataaacaacattatagatgtacttcccattatttcaatatgtgcacatgaaacttaagcaatggctatcgtatacacttgttagtgcataattttttttcgttttacataatatactatgtattatctataaaaaattcaagcatgcaatttttctcttatatatgtgaatgatgagggatataagtgtcatttatgaagagagttgttggttcaaggataagtttgaactaaaatgaaagagcaattttacagtccttgaggaggtaccatgaggtaccaaaaatttagtgtaaaatttggtaccccatggtacctcatagtacctaggtaccaagaggtaccaaatttacaatagaaaaaaggtacctcatagtagctcctcaagaaccgtaaaattgcccaaaatgaaaacttgaaagactaatatggatagattgaaacatcaaggactaaaccgaacctcagatgaaacttggaggactactttggctattcacccaaaaaatatagaattacagtagtgtaaatcaggaaaccataagctccaaagtttgtttctcgatttatccgcatcagccaaagtttcaattttaaaaacattaattttgatgttttattttctaatattttaatttatcttttcagcattactagcttttaattgctgataacaaatatgaatgttttactcgcaaattattttttctgctaataagcgctattacctccgttacaaaatatagcaatctagaacggaatgagacccatcctaaaactacgaatctggacatgaggcatgtccatattcatatttctaagatgggtaggttgctacatttcttaatggagtgagtatatcttataattaccgctcaacgcgctaagcacttgaaagaaaaagagtagaagtagcaagatgtacgatgaagcgtgcgtaaatgtagagaaaatgctagtcaatctgaacaacccaatcatcgcctccttgcacgataatctcatcctaacatcgtggccgtccttctcttgttttattaaaagttttttttttacgattacacgatagatacatggtatgtgggttctaaacttttattatcctcacacgttagtacatgtaataatagcgttattatggtaaaggatgtgaacacgtccactacacacgctgacttaacctgccacggtttcaccgatcgtcatcttctcctcccttctcctgcgttccgccgccggcggcggcggcggaggcggggacttgccggcggaggtagtcctccttcccgaggcacgagtccgggacgacgacgccgacgctcttcccgaacgcgtggtggcagtaggcggacgcgttctgcccgccggccatggtgatgttcacgttctccagcgacagcttgctgcacggcgccgcctcgctgcacgcgaacgtcaccgcccgctccgacgccgacgtgccggtgatgtccgtgtagctgatctcccccaccgtcaccgcgcttccgttctgcacaccatccaatccaccccaaaaaactcaatgttcagagatgttaggcaaaatgttcagagatgttgatcttctactatgtgctgatcagatcagatgctgatcatgagctcactgtacctttgatccgcagggaatttcgttgctcgaggagttctgctgatcgatgacgatcgggttcttgacgttcttcataaggatgtcaccgaacttcattttccgggcggtgccgcagccgccctgaagaacaacagcagaagttagctagctaggcagttttgagttcagagttcagtgtaatcttgggtgtttctgacgaagattcatgtgagaagtgggcgttgggtttacggttaacctggaaggtcttgacgcgtacgccgttttcagtgttggaaatgaacagggtgtccatcttgatcttttctaccctgtggtaacttcggttctcgcctaatcctccaatactgacaagcacaaactgttaattagctctgttacgaactgctactataaatggatgtggtcatgtggagtgtgtttgggtggagtcattgtctgaatttagttcaaaatctgatgcaaattccactgaaaagatggagaaaaaaatgctaacctgataccatggccaggtccacatgagatggctcttagacgaacatccgtagaattgcccacaatcgagacacaatcatgaccttaaaaaggcaaaaagaaggggaagaaaatgttctttgtgagcctttttactgtcctgcaaaacatatctgatcaactaatttcaaacgagacatctgtttcagcaacagacatcattcagaaattcagagcaaagctccatttcttcagaagaaaaaaaaatgtgtagtacctgtggagatcgagtcgtccatgatgtgaacattgcgcgagctgacgacgtgaactccggtggtgtccgggctgtcctccggcgaggttatcctcaggtagttggccttgacgtgcgagcaccgggtgaacgtcaggtggctctcctggctgttctgcagcgtgatccccatcacgctgataccctgacaatcctcgaagtgcagcgcctgcaaattaacaccgcgaaaatgcaatccatgcatgaattctccatctttttggtccaaatcctctcgagctagccaagatctctgatcaaattaaagcgaaaatctcacctttggagcagcctgggtagtgcaattctgcagagacaagattgttcagaacttcagaataattcagatatttctgtgttgcaattggcaacatcatggtcatggaggagaccattggttacctcggtcgcgttgtgctttgccttgcacgaccgggcccaccaccggtggccacggccgtcgatgacgcccccgccgctcagcgtcaggtcgctgacgccgacgaagtggagccattcgccgccgccgccgccgccctccggccactcgtcggggctctccggcgcgacgatgttgccggagatctgaggaaccggacgcgattaacgaagtggataaggcacaagaaatggaagaggcggagatagtgtgtggtggtgtgtgcgtacgaagagcttgatctcctccctgcaaggtccggcgagggtgaccggccagacgaggtaggacttggcggcggggacgtggaggaaggtgtggtcgccggtggcgcaggcggcgctccaggcgtccaccaaggcctggacgaggcggcagaaagagtgaagacgccattgtgagctgagctagtgaagctggagtggctagctgctgctcacctgcgtgtcgttggcgacgccgtcgccgacggcgccgaagtcgtcgagcgagaggagagtgcggggctcggcggcctccggcaggaggagcaggagcgcggcggcgaccaccaccacgccggcgagcggcggcggcgccatccttgaactaggtggcatccaagatcagcagcttcgactttctgacaacaagtgtccaagtccacgagatattattttgacgaaaatctgatccacgatttattttttttcttttcttgggagaatcttggatccacaattccacatcaccacgtggacatcgagaaaacacgtgggccgtgggccgtgggccaccgacaccttcgttacgtggggccaatataattgggccatcggcccatcactgctagtagcagaaactccggtaaaattatgtttttttgtatccattttaacttcacataatgccctctaaaaaattcttgacacaaacgtcgtatacagcttacaactctctgtactcatacactctcccaaatacggcaacagtttctacacctacgtgtacggtatttatacttcagcttttttccggtgatcgttgccaggatcgggcattgccggcggcgatcaagaaccgactctggccgccggcgtggcgtcgccgagcatcctgtggggcgccttggcgaggcaggacgccggcacgacggcgccggccgccttcccggacgccctgtggcagaacgccgacgccgcgccgccgcccaccattgtcaggttgacgttcctcagctccagatcccggcacggcacggcgtcgctgcacgccagcttgatcgcctgctccgtcgccgacgtgccccggatgcccgcgaactcgatcttgcgcacctccaccgcctgcgtctgcatccacagagacgaaaaattcccaagtttcagagatgatgaactagtgctctgaacaatggcaaaagttcagagtttcagagatgatacgatgctttgcaggtgaaaatgcagattattacctggtttgcacagggtgttggttggtcacagtagtactgatcgatgatgattggattggagacgttcttcatcacgatgccctcgaacctcaggttgtgagcataccccatccctccctgatcaagcacaaagttgcattttgtcatataattactcctttttctgaatagattgttcttgtcagaaccaagaactgcaagtgttttttcccctcatcagattgttcttgtgagaattcagaagtgtgatgtcctgcaactaacctgccaactcttgatccgtacaccgttggttgtgtttgtcagcaagcaggtgtccaccctcacgttctctattctgtcagtggtccggttcttgcctaagcttccgatactgtcaatcaaacaagtgccacgtgtcagtgacattggcagttccagtaacagaatcctctttagaaacagaaaaatctattgttatactgatcagagatcatgggcaaagactggcatggaatcctggaaagtactgcaacctgatgccatgtccaggcccacatgatatgtccttcactcggacgtcagagcaattgccaaccattgacacgcaatcatctcctgaagaaagtgattaaacagcagattaattaaccaatcatccaaatatcagcggtaatcactgcctgcttcaaacttcaaaggaagcccaagattctgaccaagagcagcaatgtatgacctgatctcttatcaatcaactacattaatttaacaactttcaagtattccttttccaggtcaattattcgattttgggcgccgacttggcggatttgatcttatcttgaataacaaaatgcgaaaaatggaatcagatagctgaattagtttgaccagaagtaggagagacactgacacactgtctcagaaagtcagcatctgaaactgaagattagtccaagcttgcaagcaagtacattccgaattttgtcatggcattggcatgcacagcacactgacctgtggagatgaggttgtccatgatctgggcatgggtggtgtcgttgaggtggatcccgtcggtgttcgggctgctctccggcgccacgacgcggaggaagcttgccttgacgtccgtgcaccgggtgaacatcaggtggaactgcggcccgttctgcatcgtgatcccctgcacgctcacccgcctgcactcctcgaactgcagcgcctgcaattcaatgcaatgcaatcgcagagagaagaatcagtcacggtcgccgccggcgaccgtactccggcggccggaatggaggagcgttcgctctcgctcaccttgggagcagacaccgtgctgcaaggctgcaagaacgcaagaagagcaaacgttcagatgatgctttgatggttaacaatggcgaattggttgttgttgttaccttggtcttcttgcgcttgcaggagcgcgcccaccactcggcgcccatgccgtcgatggtgccgccgccggagacggacaggtcgtcgacgcggaagacgtagagccacttcgtcgggtcgcgccccgcccactcgtcggggctcgccggcgccgcgatcgtcccggaaatctgtcacaaacacaatgcagctcgcgtcatcgaatcgaacagacgaacgccgccgccgccgccggcgcgcggcgcgacacggggcaagcacgtacgtaccatgagcttgagcttcttcttgcagggcccggcgagccgcaccggccagatctggtacgtcttcccggccggcacggcgaggacggccggctccgtcgaggcgcaggcggcgttccaggcgtccaagaaggcctagacacgaaaagacagagtgcaccgtcgtgccagagttctcgccgaccaaaaaaaaaaattgcaccgagctcgaacacctcacctgcgtgtcgttggtaatgccgtcgccgacggcgccgaagtcgtcgagggtgaggagcacgcgcgcctcgccggcgccggagaagaagagaacaccagctgcaacagccatggccgcaacaaccagccgcatcacggacacacgaagaatcgccattgcttcctgcaccaaagaaccgaacaaggagacgacacgacacgattgaaggagaagaagaagaggaagattagaggaagcagggcaacaaaatagcaggacacctagcagctgctactaatagcagcgcatgtgctgccttgtactaactaggttgcttttgcggttgaatcatccatccatggcgatggatagcgagatttaagcatgcaaagcgagggggggggggaattttgcatggccgtctgtggattgggcaattgcacatttgcacaccctgattgcgacttttgctgattgatttggtgactaaaagattccaacttttgtgcttgtgtacgtactttgtgtaggttggtaagtaactgaatgtgatggctaataaatcagctgcataagtcatttcctttgtgctatttattagagatttttttcaaggtaattaaatagacataaaggtagtaagaatttctccaaatgggggaaggaatcagggccatttggtggcaactggcaaggttgcatgcatgacatgaggcatgtagtaataatttatgcactgttatggtaaaatgttaatattatttttttttgcatttcaaacggtagcagagcaagagttgcattccatatttccatgcctgctatgctgcttagctgtttagagctcttgcgtcaaggaactgaaagcgctggaagctgaaagaccgatcggctcttcttcagtttcacctcttatttcactttttcttttctgaagtttataaaacaatgatgaaagcatttacctgttatgacctgacctaaccaaacagctagttacagcgtgaatttactgtaattttgttctgttgtttgtcaactgtctgtaccttttgttctattatctatcaatcagtttgttgctttaaatcctaactaccaaactttgccctctccagaatcccattctgatttgtccttgctaagcattattccactactaatgcaccgattagacacctgcccttttcctccctctgaatcaagtagccacttttctagctctcgttttctcagggacacttttctagctcttgaaaagcatcaaatgataaaaacatccacatgagaacattatcctgcttctggcaccttaaatgagtggctcaagcgaatctaagcactcagttgcttttgtcagataatctaggtgtaggtgacgtcttgcataatttctaatcggagtatttgagatgcatttgtctgattctagttttgatccactgaactcagttaaaaatgttattagtgagctgaagccttcgtttacaatatgagaagcagaagcatcaggtaaagaaaattcagtacgtacttgctactgtacggttttgcatttacagacataaaccaaacacacgctcaaaagtccaccttcaactaccaaacagtgcagtactgttctatgtgctaagaacacagaattatttggccggcatccatcttcatgctgtcaaaatgcatccatcttcatgctgtcaggactgagagtaactctgttactaggaacagaatcatttctgcattgaaaacactagctgataaagagccgcatagatatccagggttggcattgctaaatgctctcctcttttgcgaattatttggccggcaagtttgaacacgatctgtccttgtgcaaatggcaaattctgaacaaaaacgttcagctttctgactcctgaatcttcaaaggaagcagctcaccatcatcgcaggtgccgtgcttcagaagggtgctggaggatgattaatgccacgcgtaacaggaaagaaagaaagaagaaaaagacgaagaaatgccattcattattaatccaaattacagaaaaggccaaacaagtttcagagaattcagaaaacaaaaaagttgattcacaccagctgaggagcaacttgggtagcttcaggtttcagctctccttcgtcagaaagaaaaaatgagtttcagtttcaagcagcacaggcataacgcctgccaaattctgcactagcacatgaggttccaaaaaaaaaaaactatacaaaaagtggaggaaaaggatattgcagagcaatttttttcccagataacacaacatttagcacgtcgttgcatatgaaaaagaaaatctgatatcgtccgaatagattaattacaagaaataagattatcaagctctgcagatgatactccacggacacattcactgttcacatgaaaaatacttaatagttcatagttgcttgcacgtcatagttttctagtgctaatcacctacttgacatgaaacaatttacaagataagcaaagaaactatatgaaaaaataaaaaggctacgaaatggactaatggattggagcatgatccgatcagatggggaattgcatgtatgtacagatgatgagacgatgagtcgctctagctctcgacggatcacgacgacgagtggcgcctagccttggccttgccgccggcgacggcggcggcggcgccgccgccgctcctcccgcccttgccgctgccgccgaagaacctgcagaagccgcacacggcgacgcgcggcgacggcgggtcgagcgccggctggacgcgccccgccgccctgtacccgccgtgcccggccgaccggctgcgctccaccctcgccgccgcgccgccgccgccgccgtccgccggcttgatctccccggacaggtgcctgtcgtcccacacgagccccgacgagcccgaccgccggaacgtctcgctcgaccgctgcagccccgccatggatcgatcgatcgatcacaaaaattcccgaaattcacaggatcagagacccagaagatccgctatatacgaagaaaacacggggggtggttcaccgagaaccgaaagatcgaattcttattggggaggggaagatagtggatgaaaccgatcgatgatgaaaccgaaagggacggcgacgtgtgatgacgatgagcgtaaaaataaaaataattcaaaaaaatataaactaaaaaggaaaaataatggccgccaccggtcacttggctccggagataatctactctgatccggcgatcgatcagctcaactgttccgaggcgaaaaaggagagaaaataatggatttttttttctcatcggcaacgctggttggcgggtgggcaaatggatataaacggtggcggcttggtccaagaacgtggacctactccaccgcaggtagttcattcatatttgaccagaagaacaggcatggatgatttgatcaagctctaatccgttttgggttaggttaaccacgaggttaattcttttttttagttttatagaaaaatgcccgtgcattgcaacgggtgaagactattttaatcttattattgttttacggtttagctaaggtgaaattcaccgtgggaattcgcttgtatattctttttataaaatcatgagccgcaattaggggtctgattgtctcaaattagcatgcaagtttttttaaagagatttcttatacaactccttttgtatttctaaaacgaacaaaattaaaaaccggctcaaatacagatttatatttctaaaaacgattgaatttaaaaatcgattcaaacatggatgacatactaaaagctgacgtttttataatagtagagattctgaccttgtgtgtgtgggaagaattattctagcactagtccactgtagtgtgcagtggagattgggaaaaacggatgtgattcgagcggacgagcaccatccagtgtttgcacacttgcaccgttggtgaacctggagctgcattttgcagctttcatgatggattcgttcggcctaaacaatgattggacgtggatatagggggtgtttgggaagtagggactaaatttagttcctctcacaaaaatataagtccctatgatagggacttatgtttttgtgagatagactacactttagtccctacaaccaaacaccaccctaggtggcgtctaagctttcatgagtagtacggcacggctccgatctggcatcctccgtaacttggacgcgagatgtattgtctcgatcgattttgctttccaattcgatcattaccgggtggcgatgtcaaagaacaggggcaacactggcccatgtgatgcttgaagtgtgaaccttggaactgatagcttctgccggcttccattccaaggtgggacattcagtttcgttcacggaaaagctccaaatacatttccatgccatggcaccaccactgaaacgaatccgtcatctgtcgaaactgcaggtcgacagcatgttgtcgtcactggacaaagaccccattgaataccatggttcaagtacagtggataattgcagatatactgatcataacagaagtctccatgcattgtatacacaaaatactccctccgtcccataatataaaagattttaagtttttacttgcaacgtttgaccactcgtcttatttaattttttttaaaattattatttattttatttgtgacttattttattatctaccgtactttaagtataacttttcgttttttatatttgcaaaacaaatttgaataaaacgaatggtcaaacattgcaatcaaaaacttaaaatctcttatattgtgggacggagggagtacttcctatccagtcaatgtcgcccacttgacactttggcagcaagtgtgcctgagcatttcagcttttggattggtaatagtacatgatctgttccaacagcaaagcaaaaacaagcttcgtctttgcctgcacgggaaatgcattgcatcttaattagcaatagctcaaagaaagcaaccaccccagcacaaactacaagctcatggaataagccctcggaagggaaagggatttggcgcaaattaagcagcagcgcgaggaacagcagtacaaagccaagggaggccgcagtaacttttacaacagcactggtgctgaggagttgaggtatgtacaaagccactgtacacaccttcatacaccggaaaaatggggattgcagatagcaaggggtggaaccgcagctcacgatattcaccatgtcaagtgaacaagattgaaatcaggaagcctttctccggccggtgccgctaggacttctggggctcatttgcttatcctgtgccatcagagaactggtgccactagtcccatgatacatcaagcgacgaggagaatcatttctcatgctctggttctctgcctcaagttgtttagcctcctccattagcatagataactgttcacagaaccaagtagccattagtggcaactccctttaagagcagtgtaataagatgcaggctccactcacccgaagttcattttccttcagacgatcctgaagtacagttatagcagggctcaaactagaatagcagaatgcaagataagttagcagagggctgcacataaataaacatatcagccaattaacagacagagattgtgctactaaccaatattccattaatttgcagagagatgagttgtatgtagatgcatggtgaatagatgtaagtgggtggatcttcccatcactgcaaaagaaccatacaagatgtgcattttaccacataataaacacgtagtactatataaggcaaagtaagtaactttagttaccgaatattttgatgcatggcttgattatatgctgatttttcctcttcgaaaacgacatgttgcatatcacagtaagaagttaatgtggtgtccagctttagcagatgcctggtcggaaatacataaagtggcacctcctttcttacatattctgcaccactattggcaacacattctagttagaagttaatatatgattatattgcaccacactagctaaactgtttggcatgtacaattttgatatataaaaaaagacaataatccaaatacgcccttctggtgtgatatatcatacactatttagaaaatgcagaaaactacagctgttcttttatagtagaacatgcttagaatttagacaagaagtaaaataaagcacagtctattagatagcatcttagggattgccatgctttgctcaggaaaaagaaaaaggacactgccatttggcaaacttaagagaccatagatcagtcatgctacaattggtttgtttcaaaacagaacatatgtgacgtggatatagctccatgagaaagaagtgtcactggaattgtgtttattaaatgtatgtttctagctgatagggacttagagatcctatagaagcaggtgtcacagaaagtaagtcagcctgatcattcaactgacatttctacagcataaaaaggataaatgcattttacgggaataacaagttttcaactataatacctaatgtccatgtttgacctgtgcaacgcctcctggatgcttggggtcatatctgattcatctagatcaacaggggtctcaggtgcattattgggatcgtatgcaactatagcattttctttggattgatgttttgctgagtgattggcgtcaaaatgaggatagaaatccacatcagaagattttgcccacacctagataataagcacaagcacagtaagtttaccaatattaatatacttgcaggaaggcacacagacaaattgtattgcataaatagacatctaaacaaaattatcatctcccattttaacatacatagtatagaaatttccatgcttcacacctgtcgcatcacaataaggaattatcattaaatgatacctaaaagctacgtagattcaacaaagctgtgtaattttcagacaacaattacagtagaggtaaaatgtgtctccaattgatatggatcagtggacagggttgcccaaacaatgtagtgcatgctatctgttaatatctgatgtacattggttcatgtaaaaccatatcaggacatgtataatccatcagaagaattggtcatagtcataaatgtcagcagtcatcctgtggatgttatatatcaggctggtgtatattcaagaatgaaaaagcatctgccagatactactgagcataacaatcataactgttatggggcttggctgatttattggtgtcaatacttaagatacaaaacccatatacaatatctttattacataatgtttatcacttataagagacagtatcatatcccaatgtaaaatcagatggatattttatgactacaaatatatatcatgagcttatttcagtttgttttcaaaatgttctacatcatgtcatgatgttcatacctaaaaaagaatagaaattctatgttttccattgacaagtgatcgcttttagaattgccatcaacgaacataagttacacagaataccatcggtgtcagttgaccattagtttaactccattaaccctgtgcaaacagtccattttacccctagaatatactccctccatctcaagatatagctacttttggaattcaaattttgtctcaaaatataggtacttctccacctaccccctcacattgaccaatcaaaaccatcccccattcaatctctccacctcatttcaaccaatcacaatcatcccctattcaattccacctactttcttaatattcccgcaaaaacctgaaggtagcaatattttgagatggatggagtccaaagggtaaaatggactttttgtatggggttcatggatgtcaactaacggtgatggcaatagggaaggaaatctcttgtgcgatggtatttcatagaactcacgttcgtcgatggcaattcgtaggattgatcacttgtcaatgacaaaacatagaatttctcaaaaaatcaaactaggttgctattaataaatggcaaagcccaaatggatttggatctttgcacatttcctatttagctaactgtttcatctttattcattcattaattagatgttttatttaatccaaaaaatgtaacaatgccacttaggtatccttgcatactatgctatgacagtgcaacgactaacattgccacatgatcaggtagttgtagaacattgctagtgtggtttaaatgttgcccatcaaaagggaaggcatgggaggcttctagaaggacacatatcactgctatgtaagagaaaaggtcattcttggtctatatatattgcccaaacagatggaactgttaagtttcataaacataatttctatagcgccacaaagagccagatctaaaatccacttttcactcttattgcttacttttttagtacagaaattgcggttgtggaatcctatcttagagaccagccctatattttcttaataaaattgaaaagaaatttcatgacatgagagtacaacgaatacaagaataaaccttgctatttcttgaagatttagaatcccccgtgtcttgttcaatgccttcaatcaatgccggatgtgaggtatcatccaacgaactccaagatgattcaaggttaatgactggatcattaacaggaacaacagattgctgatttccaccaagtgactgaaaagcaatcacttggatttttccaacctgtgggaaccaaaaaagaaatcaattcagcagggctaattaaatgtcatgggtgccccaaactagaagtaaacatgatgtgcatatgaagtacaagaatcataccttttgagcatcttcgctaaaacaagagaatatcagacccacaaaacctggctccatcaactgaaacattgcctgggtccgaacatctgcagtatatgactcatgtaagtcagatataacaagcaaagtccagccctcactgcaaacgggcagcatctcataagagacaaataaagcataaaagcagatgcactagcgaattccctagatctacattgtcatcgtcaatttgtcctgatatggaccctctactgccttcgtactcagggaagtataagttggtgccataacggaaaaaatggagtaaacccacatgcctaaatatagcattcccaaatacaaaaaaagcatacattaccaccaacaaaaaggaaatgggctctagcataattaacattcgttttccaaacatcagataggataacgaaaggtttcacatcacttcaaattcaaaatggcattagtacaataacacaattgcaatcaaatttcaaaaccgtgcaaagttccatatcatctcacgacatcacaaatacggaatgcgacaaagtactgcacaccaagggggttatcagaaggcgctccagccttagtgaagcacagcaaattggaggtaacttgaaccacctacctacatgggaaggcagaacggtgatatgcgggtgcgagtggtaccatccaatcaccctcgttttctcgccgatggtggccgacaagctgtgcgaacagagttaagtccaactccaactcccgaaaccccaacattaggcttctcaacacaaaaccaaacacacaaaatcacagaaatggaggggaaaaaggatatctcggcctgcgccgtcgccgccgcgagcagctcggggttgacctccaccctgtccttcttccgctcgcacctcatctgcggcgacgccccccatatcagagcagtcaccccgcccctgctcgaatgctgcgaagcaggcaaaaaaccaccatgatctcaacaccagcaagcgccacgcattcgcgctggaggaggagcaggagaacggggagagaggagaagcaggtgaccttgatgtcgccgaagaggaggcccatgacctcctccgtctcggtggtgagggcgtgggagaggcaggtgagccacacctcctccccgatcctgacctccgtcagcgacatctcctccgcccgccggcctcctgccgccgccgccgccgccgatccggtggggtttcgggccgcggcggaggaggggttgggtttggtttggtttgcctcttcgatttggcttgtagcgctgcgcctctttgaagctcggtttttttttttccttttctttttctttctcgtgcgaaatgggctctctcgctcgcctctcggtcggatgacggctgcgccgctggctccctggccttctgttacgtgtttcgctgcaaagtggggccctggtctgatgtagccggcagatactgcaggtggggcctacctcaaagtagattttgctacggcttgtttggtaactcgacgtaaagggattaggagtttacacaagggaattaatgatgagattaagatgggaatttgatttttaatcccaatatcttgtttgacaggggagatggaaattgatagggagtttagttggagattaggtcattaataaaaacatatgtctgatatttgcttagacaaaataaaggaggaattccctcctaattacctgcccctacccagttattgaaaatgaggtagttcctttctcaattccccatccctatcccaccaaaattttcatgtctcccaaccaaataaaacacttaatagcccatccctctaaactcccaatccctccttaaaaactcactccaaccaaacgggccgctatagtcgtgacacttcgatttggcacgtcagcagcaatcccgcttattaggccccacccctatgttggagaaggctaatccacgaccagttccccactgtgagcctgcctgtttaggtctttaggggagtttaagattttgagaaactattgttgaaaaactaacttgtgggaatctgaagaagctagaaaacctagtttctcgcttttttttctcgcttctagttcatttttcagattttataactacaaattctcaaaatttgggaaccttgagaatttaggtaaaaaactggactgtttgagagagctgttagcacctaaaaattttaggagaagctgcaggcgctaagttcgtttggagaagttcccgacctttccctatgcacaaacaacggaagttcaggcccaaactacatgggccacacgtcagcagcgatcccgttacggcctagtacatatgggcctcacatgagccgcaatcccgttacagcccaatatatatggaccggaatccccgttccaggcccgactgagaagagctgcaagtgtgttacggcccaattaaccgatgcaccgttgtggtcgtggcagtgccaagcgtggtgaagtgctggcttgctctcggccgtccatggtcgatccaacggctgactaggggaatcacctgatccccttaggagggcctcatcgtttggcttttttttttaataagccaaaacggtttattagagaataaaaataaatttgttggttaaacttttatatatgttctcgttgacttaaataccaatgctgaaaaaaatacattaaaaatatctcaaaatcaatgttacaatgtcaaaattaagtttgaaattttaaattttagctttctcttaaaatttaaattttaaattttagctttttcgttggcttaataaatagggcatctagggcatccgatgagagcctcttatggtcgagtgtataaaaatatgaatgatccaaagtattttttaaaaaaattctgtgatcacgagtacaagggaagatgatacggtgaatgtaaacacatcgaaatgataaaccacaaatgcgggctttaggcccaaacttttattattgttacgccataataaacagaacacagacgagaaactctgacgaaaacaactgaacatcatcagtacacatcacccacacccgtcagaaatcctcccctgcgacgaccaccacttcatacagcatcgatacagactcaaaacgacacaaaaacaaattcaaacttgcaccgaatttgaagtgaaaacatacataaatagacccaaagggaaatcattcacggcgtctagtgatccctcgccgtcgtctccgtggcggcggcggtggcagaggtgtccttgttggcgccgtcgtcggtgccggcctcgtcttcggtcatccccagcgtgctcatcaccgcgtccttggcgccgaccaccgtgctcttcacctgctcactcgcctgaaacacaaacaattctcctcaagatccacaacaatggtgttcgacgaggagaaactaatcaaagagcaattttacagtgcttaagaaggtactactttttctattgtaaatttaataactggtaccgtatttttttatctcacggtacctctgctccccgcaaaaaaaaaaaaaaaggaggtagaattgcttttaatcctgtgtgtacctgttggaggacgctgccggtcttgtccttgccggcgatggcagagtccttggtgtactgcgccgtctcggcggtcttctgcttggcggcgccagcggtctcggcggccttctgcttggcctgctcggtcttctcgccgaggaagccgccggtctggtccttgctctcggcggctttgtccctcgccgcctgcgacgtgctggaggtcttgtccttcgccgcctgcgccgtctccgacgccctctccttcgccgcctgcgccttctccttcgtcgcctccttggtatcctgccccttgccggcggcgtgccccgccgcctccgacgccctgtccttcgcctcgctcgccttgtccttgctcgcccccatcacctgccccgccttctcctgcacaccaagaacaatcaagtgatcaacaaattaactggaagctcgccggagctggagaagatggccggccggtggtggctgacgctgacctcggtgtgggccttggtctcgccggcgcggtagctagcctggtcctggtgggaagccattgatcctaagcttcaaaaattaacctcgaaattcacgcgcgaatgttagaactctgatggattttgctcgattatcttgatcgatcagatttgcactggctgtggcgatgggattggaatggaacagtatttataagggttggcatcgagacatcctccgggacacgtagcatggcgagacgcctacacgatggccacgtagaaaggacacgcgttgtgtaaggttccgtaccttcgcgaagccctctcatgcgatccatccatccatccatcgatgcaagctaaaagccaaacaggagaggactactatagtatactgttgctactaaacaagtgtatttatgagcggctgagagctcaggcacgtgccgatctctcgacacgtgggcacagcgagttgaaactgatcatgatcagatcgatcagtgtgtcgatacaggcgatcgaaacgtcgatcgatcggtggctgtttggcgagtacaagttggatgcggctttagtttttacacttggtgatcgatcgggtgtcgttgccatgtgcggcgcctgatgtcgccgatcaacgtgttcaggtctgattgtaaatggtgttgttgttaatttggatgcctgatgtgttctgctacctttcgcttttgagtgtacttctgccacaaaagtttggagtgtgtagtaaccactttggcggcaaagggagtaaacaatgttaaggggacacatgttaggaaggtctcgcactcaaatgagtaggcacagaagcttcgggagatgcatggcattgttaacgattgttatcattacatgggtggcagatgtttgcggtttaattacgagtatctgctcatcttttcgagatcgagagaaaaagagaaagacaaggtcaatcatggggaatggatgccatgggctcaccatgggccagtaattcggcctgacgctgtgacgaagtgggcttctcaaaccaaaattactgggccaaattcagcctggccctgacctcaaaccatgggctgggccttgccgattaactcaagtcgatcaccacagatcaacaaaggatgagtggtgtgtcaccgtacgatgacacattgagcggccattattgatcgcacacaagcatcctttggtcatagtggcaatcctgacctgcactgcactgcacacaccggctaggctacatcgatcgtcgccgtcgcagcgtagcacgcactaacccatgcagatgcaggatgggcacgcactgtgccatccatcgtgctagggctaggcgtaggttatggaggccctttcgtgctgctagcctcggtgcagcatcgaccatacgtacatattgtggcatcggtacacgcgcgtatctcacctgacacgtccaacttcggggctcatgggtaagccccataggtcggtcagtcggtgcgccgtagtgctccctcctccctaaatataagggattttggttagatatgataaatcctaatacgataaatctagatatgaaatatatcacatcaaaccaaaatctcttatatttagggacatagggaatacttactttgcacgagtgcgattaaaactagggtgaatagttaatatggtccttgaagtttcgttttgagctcagtttagttcttgagatttcaaatcgtccaaacaagtcctctaaattaatcatttgggttaatatagtccttagaccaaaaaaaatgccacgtgagcatgccaagtcatcctcaatgaaatgactattctaccattatataccatatagaaaagaaagaaaagacaaacaggaaaaataaacaggccagcccatgcccaatattattgcggagggtggccgacaaaagaatttatacgatcagtgcttggttgtagcaatcataagtgacaattgtaaaacgatcatacacgcgtgaaaacatttgttttctttttttattcttttctatatggtatataagggtagaatggtcatttcattcatatcgctgcatgtgaggatgacttgatatgctcacatggcactttttgtgagtccaagaactacattaacccaaatgtttaatttagaggacttgtttcgatgatttgaaatttcaagtactaaactgaacccgaaacaaaacttcagggaccatattagctattcacccttaaaactataaattccttaccactgcactattaagtgcatctgatattctgataagtgacgtaactacaacctacacaaagttagaggattgtattttctggctggctaccttacgtacgttgcacttgtagtcggtagtccccttccatttgggtcgacgactagcaccatagcatcgattctaggtactgctatacagatacaacgtaggagtactgctatacagatacaatgcatgcaactatatatgttttacgttggcctgccatgtgtaagtgcaactgcaaccaacaggaccagctccactatagaaagcactatgtagacgaagacacttatattatagatgatgaaaatataatggtggcgaaaatttcaggccgttttttattttatctatataaaaaagtaacttttacaatttctatcacagacgtatggcagtcatcattaaatagttaaattgacaaaataaaaaatccttgaccgactgactatcatttctatagagatgatattgatacaaactgttttcatacatatatgaactgcgtccatctttgaacctctcataatatataacagagggaatatgatattaaataaatacacattttaatatatctgaagggaaagtattctaaaccctcaagggatgtcctctcgtcttttgcatatcacctaaatagttattaaaaaaataaaagcttggcgagatacactaaaatgtgatatgtcatttcacaaatatgtgagtttaaatggcttcttacaagttgtaacaaaaaaaataactataaatatacacgtacaggtaagagtttaatttgtctttttttgttacaactcgtagaacatatttaaacttgtatatttgtggagtgacatatcacacacacacacacacacacacacacacacacacacacacacacacacacacacacacacacacacacacacacacacacacacacacacacacacacacacacacacacacacacacacacatatatatatatatatatatatatatatatatatctaagttactatttttttacaactattttcatgacatgcaagagacaaggggtaatcaccttgaaagttagaatcctcttttcatggtgaattcgaatgaaaataatttagtgatgtactatgtgaaagggcatgtagcctagtggttgcagtgacctaagtaacaccacatggtcctaagttcaaatcttcataagagcgaatttcagatagagttatttgagggctaagttcctaatttaaaaaggctgcatatatccggttggatgtagaggccaagtaaaaaaaatacccttctctaaaaaaataattttcttttagctaaaacagtactctacaatctacattctaaaacgttgaatttgtggaaaactgcctaactattatcagcaaatttccatacaactgatcagcgatcagcgatgacctgcagcaaaacagggtatagtggacttacactcgccaccagcagcgttcaccaccgaaagcctggttgtactcgtacttgccatgatccaaagaccttagaagaatgctgatacctgatagctacccaatgctagctatcagattcccccatatatagcgctcccactagaatgtgcattgtgcaaacgacagtacactacactacaccttacaagacagcaacaagcacgaacttaaactgccccttaattaattgcagctaattaatcaccagttctctgaaagaagttagctcaagattaatcctgtcagtattactctttactcttttcgtcctaggttagtgaaaaagttgagcacttgcataagcaataagtggctaagtgacttcttcttctggtagtagtttctgaagatcgagtcgatctggtatctttctgcaggtaaatcatgcaaatgcatgtatgatagttgaccctgcatttgggccggctaggtagcgcatacatgtggattgtggagttgtggacttcgctatcatcgctatctcgtagagcaaaatcattgttggtatgcaccattgcaccattgacaaaaggctgctgctgttcacttgtcctttccagctgtagatcatgcaaattcatcggatggccatcggtagtatataagcaagggcaatggcactgcagctcctcaaccaacagtgcagtcacactctcgcacactatctgcataagaaggggataagctacctgattcatgccatcagtttcagttgcatccagcatgagcaagctcaagttcttggtcactgtcgtcctcgtgatcctgctactgttcgattcatcgtcttcaggcatgttgtttatcatgttcttgttcttttgtgtgttggtctgtcgggctgtgtaatactgatcagtgattttttttcttttttgcttggtccgtaactgattaatggacagttttaatttatctgtcgtctaaatgcagggcaagctgagacagcatataccaattatgaagtgacttctaaagtgaaagaggtatgtacttaattatccatcaatctttgtagtgaccatcagagagatgttagggtaatatatatttcagatctatcttggtgcttttcacgattccggtcttaatcaataactccgtatgctagctgactttaatttttgaaggacccaacatgattcatgacagctgacttagtattaacgagaagaaaactgtataacttgccctgttgtgcatgctaaatgtgcagaggcgtgttagctgataaaaaaaatgactctgaaactatctaatgttcgctgataaatacatgtgctggctgctgttggacacaataatcatcagaactgtgctatgatcagtgatgttttctttacagaaactacagttttcagtcaagtatgtatgtactaattaagtttcatatgtccttaccacctcagagaattcagaaacatagcaggagggttctgacagatgttcaggactatgactatggaggacccaaccctagacatgaaccacgtaagaagcctggaaatggacactaatcgcctcttctccacactgaaaccttgacaaagataagtcagatactcagatgatcccaaatgctacaatcaccagaccactatcttactgtaatgtactagaattaagcagaactgttaggtactattgtgtcgttaattaccttgtaatatgttggtcaggtgcatggagttcaggtcattttagacagtacctgcgtgtattcaggtgtgtgcttatataactagcaactggtaaaatacaactactgaggacattttgtaagttgagacttcagatatgtgagctatcttgtttgcaaatcttcggttgtgttttgaataaaacgagcattttggctccgtataaagtttgaatgttcagagtactcgtcaagttgagagcgttgctcgtaaaattcagttaagctgtatgtattaccctccacagccagcgaagatgtaagaatatcagtagcaaaaaatctgaaacacatcttctctcttaacaaatgtgcccttcttatatctgataaaaaaacaagataatatttcacgtgtaacagacatccttagctgctgaattcagaaccgagcagtcatactcatctgcagtagttcagcagcagcagatcctctcgtcctcttctgaaacacaaaacagacaagcttctctcgttactccaccctacaccatccatttatttcttcattcacctcgtcattaggaagccatgcaatcctaactagtttagaccaattcatacatccaaagaaaacgctccaatatatataatatattcaggaagcatcttagtacttgcgacaaactctgaagactgttagctaggtctgaatctatttgatggcgtgctgaattttgcctgtctcttgatttttcatttttgcataaatccgtcattacacacaaggcaatcatcatcaccatactaggacaagtttctatccgttctcgttcttatccgtgatcgaagcagtcgtgcagcaattgactctgcttccagaagttcagatacctgaactctcgagaatgaacagtgctgcatctgtgagcttctttaccctcgcagataggaaatcacaactgcacacaaaagagggtagcaacacctgcagaaaacacatgaagatgaagggggggaaaatggcaactgtatcgttgccttgtagtgcagcaatgctactagttttttttttttttttggaaagatttctaatcaatctctagaagcgttgttcggtcagaaacttcaactgccaaacagtagtttattaatgatttctggtgtttattggctatagaaattatgagcaacggcctcaaattgggacttctaattttgttcagcagagacacacaaagtcatggtcaaaggagatggcttgcagtacttggtcgttcattaagcacatgatgttgagataattacccggacttggactaggctcctaaagcacacctgctctttatgattaaagatgaattaagtactactagtatagtattagctatcggttactagtaatactattttggttagctcattttactattaggaaagcaattaagtacacatcgctttagactccatcaagctcttcaagcaccttgtgatgattcatgcacaaggctcttaatggagatattgccaaattgctacgaaaacaagaggctttccaccgtccacgtccctgaaaaaataatagtgaaaattgatctgtcggccatttctcgtttttctttttcctacgcaagacgtttcctgattggatatctcatcctcgtctcatccgtcgtcgttgtgctggaaggaacaatctgcatgtagtagctttgacacctcatgaggcaaaatataaccggtggatcacaattttctggcaaaaggataaactatttttgtttgataaaattaaagccacaattttctaactcaagataaacaacaaatggtggtttgcattgtgctataagctagacaagcatacgcttttttatttcagatggtggtttgcattggtctattctccaacaactccatgtttttggtggcggcaggtcagctcatccttttcctcatgttgcgtaactgcatagcttcatccacaaatatgctccgtacctgaggtttggaggatggcaagaacattcatcgcaaacatggttcggattcgctgtaattttgcaaacctgtggttttgcctgacaaaatctgacacatttttcgacgcgatcgatcccggcaagttgaatcgttctcttcgtataggcatatgagttcagattccttccttgccaaccctgaaaccggaggagatcgaatctctcaaatctgaacgtgcaaccgttgcagtaacagcgtacgcaagagagagatccccttggagaagacacacgattcagctcaccagttggtggttgacatgaaccgctgatgcagagatcactccacacgcgaaacacaagcgactctgactgacgtacacacggcgatgcgatgcaagtgcatcttaagaaataccgcctcaatttcgaaatgcacgacactacttacttttcgcataatattacactattcatcttattaatttttttaaaatacataaaagtataagttaagattatattttctttggtaataaaacaagttcaaataaaataaataatactccctccgtttttaatatatgatgtcattgaatattttagatacgtttgatcattcgttttattaaaaaaaataattatcatttattttattgtgacttgatttatcataaaatatttttatacatgtaatttttttgaataagacaaatgattaaatatttaaaaaaagttaatggtatttcctccgtttcacaatgtaactcattctagcatttttcatatttatattgatattaatgaatatatatatatatatatatatatatatatatatatatatatatatatattgcgcgagagaaagagagaggattctggtagcatcagcgagacgtgagcatgcatggcactagcggggagggagcggcacagcgcggcgcggggtcccagctgagggcgcagcggacgacagggacggtgcgcgctggggcgagggggcggtggcggcgagtggtggacggcgacgcccaacccgatcgccacagcctcgtcagcgcacacgcgcttcacatgaatttttatgtcgcgcccgcggcccgcccagccaccgcaccgcatcactgagcccgaggcaaggagcagccgctgccggccacacgtggaaagaaataggtgataagagcaaaattaattggatagccaactacttgctctaattcatctatagccaatttaataattcatttatataatagttacatactatactattaatacctggtcccgcctgttatacacatactgtgtcttagagtccgtgctatagccgactacaaatttgtagcccgttgctcttctctcttcttatttatctccttaaaatatgtttgcagctggtttatagcctgttattgtacctgctctaatcctcctgagtggttgggaatttgggtttgtttggtttagtgtggtatattttgaagggtagtattttaagtgggtgtgtttagattatcaaaatttatgttatggtggagaaaattttagaatggtgccaaattaaccataggcattaccattcacttggctctaaactaaaccattacatttactactccatccgtcccattttaaatgcaaccattagtttctgtgcccatctttgatcgtcctgtcttatttgaattttttttataattagtatttttgttgttataagatgataaaacatgaataatattttatgcgtgacttatgttctatttttttaaaaaaaaatttcaaataagacggacgatcaaagttgggtacggaaaatcatgggtacacttataatgagacggagagagcactattaaaaaaaaagggttgttcaaattgtagccaaaataagacttaccaaatttttacattttggcaatattgtcaaattttgtatttcttatatatttaacaaagtttggtaaaaaaaaataaatggatgcaattttttagaattttactaaaaattagtatatgatttaaaatgacattaatctgaacaacctctaaagaaaatggtaagacataatttgacaacaatccaaaataacattttttttcctttgaattgacaatctttttcaccggtccggtgattatcttccaatggttactccttgacttattacttcttagaatttactgtgggctaagatgttgtggatattttagctaattttctgtggaaggtgaaaaagggccggtctttgtcattgctttgtcatctgaggacgaagaaaattgtatccgtttggactgcttttgataactaaaaaaggcgaactttcttttctcagcaggggacagaggtgataaaaaaaatcgaagaacaactccacttggagtgataatgaaactgatcttcatataagaatatgaaccttttcttttcaagtaaaacatgaactgaacttgtttcaacttcatgcagctcagctctacagtaaatcaaacagtaatcacactccaaacaaaaacaaagtgtttcttgggtgcccatctcaaaacaaaatgaacgtctatcgccgggccgaaacaaaatcaactttggaacgagcaacttcgcagatcctaccagtttactccagcttcttaacttcttgatactgactcacaatctgttcgaacaaactctctgtcctccaaacgtggtccaaaaccaaatgccctccttttctcctgatcaagtattccaaccaacacgatcaaggaaaacctcataaaaatgcaagctttctcctcttccttcaattaaaaacgcacaaactttctccaggtcagtacgtaagccacttgatccatccaatcaatctccagtagtattgtactaatctctcacactattacaggcttacagcacggtcctgaaactccgaaattcgccgaaaattctggacctcaagctcacgactctcaagtactccgaattatctcatccttcttctccctcctcccgtccgcgccgcgacgatgcgagcgcaaccacgtttgactcagccgacggcgaccggccgcgtagtacgcgtgtcatcgtcgagctcgagcccatccatccacgtgttcctcctccttcctcgcggcgacgccgacgacggctataaataacccgcgcccccatcccgaccaccgctcctccgcctccgcctctcatatttttcccatttttcacctgccttaattcgccctcctcccataaccgtagtagtaatcgtactcctccattctcgccggaatccagagcgaagctgtaggaaattgttgggaggaggagcaatgccttactgcgaggtggacaggtaccagaacggcgacgagtgggacggcgtccgcctcttctaccgccgcttcggccgcggcgccaccaaggtgctcctcgtcatcggtatgtccgtacgccgtcgatgaacccatcgcctttgccggcgatcgaaaattttctgcgttttttttttgcctttttgttttcttggttctgatttgagaaatggtgggtgtggttgggggcgtgaaggattggcggggacgcacgactcgtggggcccgcagatcaaggggctgaccgggtcgctggagccggccgccgacgacgaggagtccggcgacgccgcggcggcggagggggacgacggcgatggcatcgaggtctgctgcttcgacaaccgcggcgtcggccggagctccgtgctcccgcacaaatcctactactcgtgagtttctctacttcctcctctcatcgtcgtcttctagatccaaatctccaccttgtctcatgatcgaggaggcaaaatcgttcgtcgtgaggtgtagaagcatcgcgcccaatcttgagagagatctggaggagggtaaagattggcgtctcatgtagctttcgatgagaataaatccacgttctactcgattccagccgcgattgctttccacgagaaaatatgtgacggagaggaaaaggacggagatataattttcctcgaacgcacgacgcggctgtgcgggaaaagtcagacgagtggcggcaatggcggtgtactggtgttagttactgtctgaccatgtgaatgtttccattgtcttgacaggacggtgatcatggcgagggacgctctggccttgatggaccatctggggtggaagaaagctcatgtattcggccattccatgggtgagttcatgagtctccatctctgcgacgctgaatgatgatcatcagaattttggcggattgacttcttttgaggggaattgtgtagtaagtaggagtttctgtaagcattgccattgatgttgggtggtctttgcaacacaggcgcgatgatatcctgcaagctggcagccatggcgccgcacaggatttgctcgttggcgttgcttaatgttactggaggtggcttccagtgcttcccgaaggtaccggaatggagaattctgcttgtttatacctggaattttgcagaccttgcaggactgtcgactctaatttcctctgtagttctcatcaatgaagcttgtctgcatttgcagttagatgggcagatgctctcgcttgcattccgtttcttaagggcaagaactccagaagaaagagctctggtagatttggaaacccattatacaaaggtgaaaatgcatccatttgtcatatgccaattgatgtaatttttttcccttgacattttgagtgttaacatccaatgcaccatgctgcgatgcaggaatatcttgatgagaaagttggatcatgcacgaggagaacaatcctctatcaagtgagtttaaaagtgtttgttgttgatggtgtatcacctagatttaaatcttcatcataacttatgtagcaccaaagtccaaaattgtgggaggaggagcttcccaggatttaattttgggaggtggtgagtactaaggagaacagtatgttgttcagctggcaggagctgcaaggagcaagccgctggccagggtttgatccttggtactcattacctcccgacattaaattctgggcaggattaagtccaaaattgatttggacaaaattagttgcgtgtacacatagaatgattcctctatgtctgttcttttgaactgtataaactgtaaagtattacagtcacaagatcacagcattacaactaggcctttgtaccggaaaaaaaaacaaagctttacttatttcattgatgtaccaaatttcaattattctgtactatgtattttcaggaatatgtgaagggcatatcatcgacagggatgcagtctaactgtgggtttgaaggtcaagttaatgcatgctggactcacaatatgacaactaaagaactagatacaattcggtctgccggttttctagtttcagttattcatgggaggttagtggcgacttgagaaaagcacacatcccttccccacagttcgcaagcacactgtgtgtttgtttctcatcacttggtttaaaaatgatgcaggtctgacattattgcgcaattatgtcatgcgagacgacttgcagaaaggcttattcctgttgctagaatggtcgaacttcatggtgcgcatctagtaagccatgaaagaccagaggaggtaagcatggactttgacaaaatgctatattgttaggcagctgaaattatgctggaatgctgaaaatattcctaaatagctgaccgagcgaggcaatattagaaatcatggttccctgcaagcatcaaactctaacatagatgcactaatgggcatgtaacttttgagcccaaacttggaagaatgcttttgcttataccagttagaacgttactagatgcttgtgctgttgcaacttgcacaaattcttccaaagttgccaaaccgaactaaaggcaggccgttctctgaaagcatcattcaccacctaaactgtacaagggaagatgctacttttgaagaaaattgtttggccaactctgaaactgctttttaggcaccaatgaaatggttatcccaaacctgagatggaatcataaacatgtaacttacagagttattttaaggcttataccttctccaaatcgctgttcttttctctcattatttcatcacgcttacagagttgcaggaaattgtaagttgactcatctgagtatttctctattgcaggtcaacaatgcactaatggaattaataaaagccacaaaatctatgatgaaacctgaggaatggtcatcccagccagagaattcatcaggtgagcttagaaaggccaaacacccccgaaatctctttcgaaggctatgttccaaggcacacttcttacgctacgtctttatcagaaaccggggctcttatttctgcaagacctgtttccgtcacaatacgaacagatgatgggggaaatgccgcaatagcagtctataacttacttgccaagctgcaactaagctttctttatgtcataggagtgatactgatggggtttgagcatatgaggaacattgtaaaagtaatgaagccagtaagggtcgcagcaatcgaatcataaggtaggtttcaagaactacatcaaaataccatccagagtgtttctgaaattgtagcaaacacttaaccgagctatgttgctttaatctgcagaaacaaaactcatgtaaattactctcagagccgtcgaggagacctggtattttcatgtctcctcagtactgtggagatgatggttttagaatagcatctccgaagacttcctgagaaaacttctgctctaagcagaataagtgaacaatacggaagaaaattgatgaggtatttggtgcgcgccttggacagaagcgtcccagggcagaaatgcacaaactgatgtacccgtatgagtgtaaatgttgttaccgtatcacggccttatgctgtcgccattcttttgtatcagcatgaaatgtgattattcccatcaataataaacctggttccctgcatgatatatgtatgtaattataagtaacagtaatatgtgtaaacgcccactgaacgacacaaaaagctataaaagagtgcataaatcgtatcataattaactggtctaacaaaacaagaacagtaaccttttcattcattgccaattcacccgatcggtctggcaaacaatctgtatatgaaaaggtttggactaacttgttcctgatccctctttggaacacaaggattggtggatctccttgtctatgattaagcccaaagagcctaaagttaccaaatcttcacaatgtgcaacgtatggctggagagaaacatcttccaggttacataaaagcatgtcggcgaatcaggtggcttttatctgattttcgaaaggatggaccagcaaaaattcatttttgaacctccctaagctgtaatctgaattttttttgtacttctgattatcttcttaacttcaaaggactacgggcctgtttggtttggggactaaagttaccatgcctaaagtaagccgcacttgtggcggagaaaaagaacgccacagatctggcaaaaaaaaaaagacacagcgaacttgcagaaacatgcctatcaagttagggcaagcctatggttagtagaaaagcaaataccaacctaagtacttgctgcaggtctaagcttaggtttggcaaaacgtggccaagaaccaaacagaccctacgtcgtgtaaaagctctgctatggacccttctacaaatttcggcagagcttttgccgccttaccgtttcaaaaaaccaaaaacaagataaaactagaacaggaacttcgcaaatttgtaaactcgatgcaaaatccatgttcattagttagcaatattgtgacgccaaggttgtcaaccggaatctcaaggcaaatttctacgaaaagcccctcatcaccatccagaccacatgtacccaatcggacggctcgtacttttcaatcgctacacgaactgatctgaccaggataataaaaacagtccctttattatttgtatgccatttaaatgattatgaaaaaattaaaaaaatcaacgagataaattaatatatgataaataactttacaacatcaaatttaacttctacaagttacaacgaaaataataaatttaactatgaatatatatattaactagccatagtttaatttgttttttattacaactagtagaaattgaattttaacttacatgttgatagagtgatctatcacatattaatccatcttgttaaatttattatcattctttttataataatttaaatgacatgcaaacatcgagggattagaattcactctccatatagtagtataaagggtttatactctaaacgtacctctaaaatctcaactgttcccaatctgaaccgcgcgtatccgatcggacggtgtaggtgacctcgccgccgctgccgctttgccggcctgccggggtttgccgccgccgccgtgtctcactctcacgtaaaatgtggcctctccaggaatttctagttcaatttttcaactcgaaaaactgctgccggattctatataattatctcatgacctgaagtacgcaaatattaggaaatgacaaaatatcaaataattagaaggggtaaggatttaatctcaggttgtctagcccaccaccttataaaactagccggaatacctctggacgtttctcctccatggcatgaagtctgaactctgaagttgcaaattgtcccaaatttgaatgtggaaaggctgttccaggtgacgtgtgtcacagattaagaggacatcattaacttccacactcgagtggattaatcgaagccaataataatggattcatcattaaaatcgatcctcatccacagcgcctcgctgctcttccaacaagaagttcagaacacactctgacatggctcagtaattctttactgttcgctcaaattgctacatattatacagattgcagatcaaagtaagaaacgctgcagaaacaaactgaaagtttccggcgaaagcacgggagactaacctggacaaaacaatcgatcatggcaaacacgcacggttaatttctcccggcttcgacgacgaggagacatctgaaaacgaagctgagacggaggcaagcgtacaccaccaatggaggaagaagaggggtggagactggagacgacgatgggtggccgtgcgtgcagagcgaggcaaagcgaagaagagtacaaagattcgcacttcgcggcaaaatattcctaccgcgcgagcgaatattcctccgagcgatgctggatatgccctatacgtttccctttcacgaaggcgtcaaatcgttcgaccacgtgatccactggactctctctccatccaaggcccaatttaccgcctacaaaggcccatatttgaatgggccctaaattttgatcggccttaggtgggcctcgcttatgagagcttcgagagggcccacgtgtccactctctctctctctctctacagcgacggcggcggcggcggcgaggtgagaggaaggagaaggggatcgaggaggaggaggcaagcgcagccaccatgggagtgatggagaagctcaagatcttcgcggtgaaggagcccgtcgtcaccgcctcctgcctcatcgccggattcggtgcgcttccctttctctctcgatcctgccgtggccgaaaccctagtagtggcctggtcgtgattcctcgcccccattgaggacgctggtgttgccttgcactgggcgcctctgtttagctcgaattcggtgaccgaggattgattctaggactctctgggctggggtggatgggttcagaacgccttgatgtgattttttcgcttgctaattttctgttggatctagggttctcaaatcgcttcagaggtgttcttctttgcaagccagtagctctgcctgttccccatgctgcgtggctcaagatctcaagtagtctcatagttcatactccataagctatacttttttttttttgggaaagataagatccaattgttccttcccagccaaacagtctggtctgttgaatgccacaagtgttaagcagtgtgttttgttcaaacaatttcattctttagctcagctaaatggagttggcctgtgtaagaactaagatgcaccttgtcgatttggattaaaaaaaagaaggatattctatcagctgcattttttcttcactggtatttactagtaatatatgtctctacgttgtaatgcgccaggcccatataagtagggatgggttataacgagattagggataaaacattggatccggtggttacctatgaacgctactcgtgtaagcggtgcgtgcagtgggaggagggggcagattggcagaaggacttaggaggacgactctgcttttaaggttgtagagaaataggttggtaataatgactgataaaggtcctttgaatctcgtgctgaaatgtagtatccctggggttccctggtaactctgaattggtgttgaaacgcttgcttagtttgcattatgctgccaggggtgaaacttgaaacggtgttgaaaaggttgagggtcttcctttgtctgaactaactaaagtctcttcctaaataccagcactggatgccttctattaatcactggcttgcagaaaatggttgatgcataggaatacattgaggccacatgaacaatgagttgctttgtggcttgggaaagtgaactagctagattccatgtggttttgttctatttgaaaattacaatgattagcaatttttaagttcaatactttgcccgatgtatgggcacactaaattttctttaggaaaccctgattgtgcaaagtatcattcagaatttttttttgaggcaaagtatcattcagaatttcagaaacatgtctggagctttcccgtataatagtaaaattttaatattatgaaagtgctcttaatgtaaaatctaagtatataatttgacgtagccagtttagatagttctacatgtatttggtgatcaagctttagggatgttgagaatggaagcattaatcagtcgatttcctgaaattgcctttaaggcttcaagtttttgtctagttttgttttttgagaaaaaaatttgattagctcttagtatctttctgcttgtatttaccagaatttctgcctttggttagctggtttgtacttcgtatcgcgccttcattgaagttcctcagtagcgcattgttatttctatgttttaggtcttctctgatttgcttcctttagcaagattgtaatattcttccctgagacttttctcagtactcttcatgctagaaatgagtgtgtagaacatccattttgttgcattaagccattaaccagactgctttaatgttagttaaacatttgaacaagaaactagagcaaatttgattcctgagattttctggtatgattggattggtctatggaattattgctcatcagaggagcactctgcatgcttctatcaaataggttcagctgatcttattatttgcaatttcaggtctttttcttccagcagttgtcagaccaatgttggattcttgggagacagcaaaacaagttcctccacctgcgctgaatgatgtatgtgattcctctctgttttttagtacatcagaatgatctgcaaccatatcttagtttctgaccacatcatttatcatgtccttattttgtcatgttcataatgtgccacccaagatatgtgcaagcactagacagtcttatgaaaattatgaagtaaacttattctttgggcgttgttattatttggggcaattgcaaatttaccactactttgaatcgttattgcaaaactgccactagaaaattgcaaaaatgccattagaactgtcattcgagtggcatccttgcaatattaaaaaaaccagtggtaaatttgcaattgccccttacttattatttcaagtaggctgtaaaattccaggattgagcactctgaatattcgactggcaacctagactgaattgcacaggacctttaaaagattgtgccatgttaccgattcctttgttgacgactttgccatgcttcacctggttatctccagattcacattattgaagtactggaatatcaaccccgctccattgagaacaccagtatttaattccttctatttttggtacttctgcaggttgttgcaggcgtcaccggcaagaaaaaggagtgacttggcatcttttccacttgctaatgttgtcgcaacgatttctctttgttttgactccggatgggaagcctctcccagtccagatgattaggatcatccattcatatgtccagcacagtgtgaaaacagtactacatgtgatcggcaaaataatcgtgttgtacctgaacttactttcaacataatgaaattaatgctgcaattttcagctttgagcttgcaagcaaagcgtgtggattgattggtagccttaacctatatcgtaaaattgctggtgccgattggttctgtgaagatttacaccagcagattagttgtggcaaacattctcttgtgtgcagcactatcgtcagtggccacgcttgcttgagcaagctgtgaagtcagtactggcttggaagcaaagccttggagcatcagggaagaaaccgtcgtgccagactcttttgatgacgtgcggagcatcgtcgttgtcgcgaggtataagagccagcgagacgccggcatagcttgtacacggtggctgatcggagctccggccaatgtccggcgaccagatgggctcagaaccaccgcgtgtcgccgccggcgatgcgcccaagacggaggggcgcattggcagcttcagccgcctcttgtccgggctcgacgccggcggcgtgctcagggacgtcgagccggagaagatgaaggacgagatccggcggtgggccaagtccgtcgtgtcgctggtgcggcagctcagcttcggcgcgccgccgccggaggatcatcgcagcagcaactcgatagttcacaccagctagctgaagtagcttactcttgttttcttatttaaatttaacattttttattgtagatgaaagatcatttcatctacaattcccctggtttctggcgatggaagaaatactgcaaatctgttagcatgcttccctaactactacatttttttcaaaaaaacctataacttaattaatcatgtgttaattttaaaaattcttcccgaactactactacctttttttcattctgtaacttaattattcatgtgttaatttaaaaattctataacttaattaatcatgtgttaataagccactttgctattcgtgccgaagaggaaaaattttgaacttccttgttcgatcacattattagtgcaacgacgactgcttatggaaatatataagtttgtcgtgatgcaaagtttgatcacgatagcgcgacgcaatatacaagtttgaatacgttaaaaaaaaccatgagaatttgttatagtgtacaatattcctagtggtttaatttattatgtttctttctaatattaatttattattgtatcatcacgcacgggttgatatatttagggggaaacttatattgttattggataatgctctagatctactcatatatagagggttcgagttaaacatagggttaaactgaaatctagagagggtttttacctctcttttttaatcactactcctgtaagcatttgttgtgtaatttagaagaggtaaaaagaggtaacattcactactagtggttttgctatttctattatcaatagtcctgaatttgttgtgtatacagtggtcatgactctctatattgcatgagtgcatgaccttatgggtcttggtttagtaaatcactagaaacgttatatgtgttgtttggttaattttatgaatgttttgaactgaggatatatctcaggacaattgtatttggattttggaggtacaataattggctttaagatattttttgccgttttgtttgtcttacacaatcacccatacagtccaacacaagtaattcatctaattgtgtacaggaggcgcgcccatgatctttcttgccgttttgtttgtcttacataattagttgaattatatgttgtgcctccacgtcacaggtggcatgttgtagcctgagtgaaatgtcatatccaatatactctgttaaaaattgactaggagacctttatactctcaattgtcaaaaaaaaaaaaaaaatcaacctagtattggatttgatgttttctatattcagattctttgtactagaaaacgtctcatccaatactagattgatttttttttgggacgaagggagtaagttattatgcggattatatattctctctccgtcctataatataagagattttgagtggatatgatatatcctaggacaataaatctgtacatgagattttgagtggatgtgatacatcttaggacaatgaatcattgtactacttcctccgtccccaaaataagtacagccatggttttccgcacccaactttaaccgttcgtcttatttaaattttttttgaaaaaaaattaaaaacataagtcatgagtaaagtactattcatgttttatcatctcataacaacaaaaatgctaattataaaaaatttcgaataagacggacaatcaaagttggacgcggaaactcatggctgcatttattttgggacggaggtagtataagatgtgtcacatccgcacaatatctcttatattataaaacagagggagtaggatctagacagagttaggatagaatacaatagaccaggggtgtgtttgagtagaaggagatcggggagattggaaagatacgcaaaacgaggtgagccattagcgcatgattaattgagtattaactattttaaatttcaaaaatagattaatatgattttttaaaacaacttttctatagaaattttttgcaaaaaatacactgtttagtagtttgggaagtgtgcgcgcgaaaaacgaggcgctttctcaccctatatcacacaaacgaaagcagcctaggagaccttatgcgataatacaagaaaaccagtctagcaatcaacgtgcaattttgtacaaatactctcctccaacccttgggctcaattagtggtaactgggctgggcctccgtgggccgcctatttcgcaacagtccagttagtctggtgtttcagcccattcagtaatacatgggccaaggcagattagagcagggtccaataaggtccataaagacccgagcaaacctagggtttatgagcacggagcgtataaaagcgagcctccacgccgccgtccctccctgcagccaccaccaccacccccacaccggagcacagcgaggcggcgccgcagccccatcttctccggtgagtcttcgtccctcaccctcgccttctcttacggaaccctaaaaccgtatgatctctactagtacgatggatggatggatagctcttagttttggtcagttcgatggcatttgctcgttctgctcgttgtctaatatcttctacgatcctatccggctgttggtccagtagtattactgcaagaactgtaagcttagttcgagatttttcttgtagacgatttgttacctacttagattttgtttactagcgggttatttgtttcgctcggttagatctggtaatataaaacgagccatgtagcgattttgatgtgtgggggcacgaactgttcttgtcacgagaaaggttgtaccccagatttcatttgcaatcgatgccaattctgggcaaatgttgcgttataataatcatatatatgggtcactttttcctgctgatcattagttacaggatcttacagtaggttgttggttttggttatgtaggcgaagcgaaatggcgacggttccggagcctttgatctgggagattgtcaagaagaacaactgcttcctggtgaagcagttcgggaatagcaatgccaaggtgcagttcaccaaggagcccaacaacctgtacaatgtccactcctacaagcactctggtcagtagtcgcttcttgcaacattgctggctttttgatggaaaccaagcatttcattcagcatctgcaaagtgctgacttgggtgatgatgtgttttgtaaggcttggcgaacaagaagaccgtgacgatccagccatcaggcgtgaaggacgcggccgtggtcctctccacaaccaagaccaagaagcagaatgccccagcgaagctctaccacaagtctgtgatgcgcaaggagttccgcaaaatggctaaggctgtcaagaaccaggtattagcacgtgaaactacttctttgcatagcttcttgtccttgttatgccttgcgatgctagaagctttaaatgcactgctatgaacataaagcatcctatattttggcttcattactcttttcttatttactgctgtgatgagccgtaacacataaggaggccaaccgatcaattggttcttcaatgaaatactcttgttacgcttggcttctgagcattttgtattgtcttgatatgttgaagtggctctcatttgtggggttcagacgttaggatggaactgtgagatcttcatacggaacaattaaaactcatacaatgttttttacagaagttggtataacttgctgttaaaaaaacagttaggtgtcaatgaactgcaagttagtttgtgagaattcctgtttttcgttttcagaaccatctttttttccctgtttttgttacattgctaattctaactgctgctgtgataagccgtaacacataagaaggccaaccgatcaattggttctttgatgaaatactcttgttacacttggcttctgagcgacttatactggcatcctgcctttttgatatgttgaagtgcctgatctgtgaaaaccttcagattttcaaatggaacattttgatacttaaaacaccagttttagcagcagttgatacaactttatctgaaaattcaggtatttgacaatgaattgcaagttagattttaagtatttgctttttaataaccaagtttttgccctatctgagttaaattgataatgcaagatgcagctgtgatgagacgtaacacataagaaggccaaaccgatcaattggttcttcgatgaaatatatttgttacgcttggcttctgagctgaatctgcctctagtatttcttctctatacggcagctttcctttatgtaccttactgaacaatcatcagtagtttgttctttaatttgctgttattctgcccttcaggtgagtgacaactactacaggcctgacctgaccaagccggctcttgcgaggcttagctcagtgtaccgcagcctccaggtttccaagtctggtgccaagaagaagaacaggcagccaactaagctgtaaatcgcttaaagctcgcttttttttttgtcaaggggcctcgtggtgttcatgtttccagctacctctgttcgtaacagtgattgagacttgaattgatatctatgctagaattggatcaactatgctacaaatctactctagtttgtactcgctacaattttggtctgctgtgtcattgttcacgttgcacttgataatagcagctaagctaatgtcatcaaattgctggtgccgttttgctttgtacacatccccgtgtagcttctgcgaccagattacctatttttgatcaagctgtgtagggttgtggcatgatggcatcaatgtgctgttgccatttgacaaatcattctgcttattacatcaagcacttcatacgttagtgagagcggggcgaggatcttttaccatagggaaaattggttctatgccatcaaaagttttcaagttttgctttataccatcgaaagttccttttcaagttttgctttatacctcgaaagttcctggtgattttcctaccataatgttacatgggtcatatctttatactccctcgtatttgaccgttcgtcttattaaaaaaatttatgaaatatataaaactatatgtgtacttgaaattatatttaacaacgaatcaaatgatataaaaagaataaataattacttaaatttttttgaataagacgaatagtcaaacacgtactaaaaagtcaatagtgtcaaatattttgaagtatttgcaatgataatgttattatggtagagaatgtgaacccgtgagggagatgattttgcattgtgagtttctgacaagcggaagctctagaaagttctgccactctgtgagagtgcaaagctgttgtgatgttgcacttgcacctgctgctgctgctgaggcccgaagcgttgccggaccgagcggtacgccatgagcccgagcttgtgcgccttctcgtacatggtctccggccgcagcggcgcgacgtgcaggccgacggcgtcgagctgccggccgctcctcccccagaacccgacgatggcgccgccgtccaccgggaacgcgaacggcgtgccctccgccgcgccgccgcctaacggcccgtactccctccggttggtcctgaacgccagccacctgatcaccgccggcgcgccgccctgcgccaccgccgcgtagtgcccgctcaccgccgtcaggtactcctccgggaagcccagcttgatctacgtcccagccaaacagactcagggggtatttagatacatggatgtaaaatttttgcatgtctcatcggatatacggatacacatttgaagtattaaacgtataataataataaagcaaattacagatttcgtttgtaaaccgcgagacgaatttattaagcctaattaatccgtaattagtaaatatttattgtagcaccacattatctaataatgaaacaattagggttaaaagattcgtctcgcaatttacacgaaatttgtataattagttatttttttcgtttatatttaatacttcatacatgtgtttaaatatttgatgtgatatgttgaaaatttttgccagggatctaaacaggccctcagctatggctgtgccaagaacattacaaggtgcagatggtattgggtgtgcacctgggtggtctggttgccgccggcgccgccgtgccgctcgccggcgacggcgacgccgttccggtcatactcgacggcgatggagtcgatgcaccggtcgtacgacagggtgatgctacgaacgccggtgtgaccgccgtcgtcccaggggctccctccggtgccgccccatggcccaaccttcatgatcttcttggacacaaccatcttcttctgaggttgctgctcctgcaaaaaaaaaagggatatcctgtataattgaagtgtatgagttgctcactgaacttttggatagaaaaattcagatgatttttctgttctgcaagactgaaaatgaagtgcatgacttgcataccatgtttggttcagatatgttaagaactacaccaagtagtaaggtgagcagctaaacttattcagagaacaagtgcgctaacagataaaaatggatagggatttttttttgtttgcaggaaacaaccagatggaagaacagaaatattaggatatataggaaaaataccacacagtggcaattgggtgataagtgggaatcagaaccggatgctgtaatggcagtacgctgctttctggaaagctaagcatattgtacaggaagtttttgttctccaagagtccaagtataaattccggtaacatgatcctgccaatacctagttttcagttcaatgttaccactcctggtgattttttatttacatatcgcagagctttagtgtagtacaagttttttagggaaaagaaatcaaagtttgatattttggaaaataaagccttcatgttatttttgttcttcttcttatatggaaggatatgcagctctcctgtctattcgagaaaaaaaaagaaaaaatgccttcatgttgaatcatgaattgctcacttaaactccaagttcataagcatttgcacgttaacatcagataaagacctgaaacaaatgttgtacctcatgtcattacagtgctttgaaaaacagaaatgaagatgtagacagtggactcatactcataggtaactcctagaacttagttcgttccaaattcgtctgtccccagtccccactgaacaactcaatcctttgaattttctggaaataaactcagtccaaattggacgcatgaaattcgcataacacaatttatctcacatattattacatgcctattacgcagggttggtgcccagaaataccattcatggccagttgggattgagtactactactgctgaaccaatgttcaatacaaccttgtttgacagcatccagaaagtctgaaaacacaaccagcagttgtcgttttctaacttcagatgtgggcttcacagcatttgcaaattgcaacaatgatgttctctgtgacttcaagaaagtagtatttctgtatacatcaaacacttgtctgaagacaaatgattgaagtgtttgtgataaggcctccgatcaagacttgcatctcatctccataaaaagaaaaagaaaaagagaagtgaaatacaattcaagacttgcatcagtgctgctagtagcacaaatggttcatctcttgccaaccatctactgcacaacaagattcctgaagtggttcggctgtgcaattcatcatcttctcctgaatcctggcctatcagtcagagccggtgcttacactacaaacaattgcattctcttcaactcctgacccaataaaatggcaatttgcagagaagcaagtacaacagcagtggcaaccacattccattggcaatttggcatacattgtagtagcagcagtattgatcttaggtgtacagccacctaaagcttttgctgatctgtcctgagctaatcaaagagctaatcaagttcaagcaacccaaatgacagtgagtcccacaataacaacttgacaggtgtgtatgctgtgtctgggccctgtttggaccatgctgcatctttttcttgcattggctgtcaagtgttaaaagcatactaaaccccaattgcttaattgcttttgcttctttttttttgagctaatgcgccaaattatgaactgctaattatagctttggtatgcatgattaagtgattaacagttagcagtctcctgtctttaagctatggttagaatccacttattgttgcaaatctacaatgagctgtctgatttgaatgtggggcccacagccagtctcctcctctcctatataaag

SEQ ID NO: 82693 - DNA, 20313 bp, Oryza sativa
tatgagctgtggaactacaaggatgggaggaaggccaccctgcgtgagtgtgttgagtacgtttgcaatcaagtgaagcaactcacagtgaccaagcgcaggaagtctcgcaggtacaatgtccatggattataattgctgattgatctcatatatttactgcttcggtagcaattgtttttatagtaacaaaatgtgggatacaaaatcattgctactggtggttaactgattgtatcatcactcatcagggtggtcaacaatctttctagcactgatcagaaattcacaagtagatggcagttttacattttacaactagcagatggaagttttaatttttgaaaattagcataatggtactttcatgttttttttttagttttaggcctttagctcgctttgattatgtttagtcaccttagaagctgaaacctaccgccattcttttaccatcaagtgttcgacgagtgaatgctacgtcaaacattgcagcctatatgaaacactttccttcacccccataaaatcttataaggaaaaatgcttgtgtgactgcaggggaagttgacctgctggtggcaccacaacaacacaagggtatattgcaagaatgaacttgtaaacttcacttcaatttcttactgcgtgatgttgtgaattttactacctttttctttctacgaataaaatccttgactctcactttttctggtagtaactagaaatgggactgctcattcttcaacttatgctattggagtacccacactctccagtacctttgccttgatgttcattttagttcccacaaatcagttctcaagaacatgttattgtcaatgtatatgcatttatatttttaagaatatttatacgttgagctcatttcgccatattgttgtttttgcaggtggtgagggctgagttttgggggcagtgtaggactaatccatgaagttcctgagcaagaatggaagtcttagcttgcttatgtcttttgtaaaaatgtcatgactaggaagtaggaatcctgaagaacctgatcgtatgaagcaacggatggaaaactatgaactactactactactactactagtacatctattttgtgttttgtaaaaccaagttgtggcttatgaccactgtactgcttgtgcacccagctcattacatgctatagtatgtatttacatgagacctatagttaatgtctgagtgctttgatgttaagtaagtgtttgtagttgatggcctgaagaacagcagtttccagcaacattgatgcctgaattattctaccctgatcagagggtcgttgtgactgttagcgctcaacttggacgaaaattttttgaaattatactgtttatcaattgattgtgcaaaaatataccggatagcgaacgatttgcggaaataaaccattagtatcgctttttggaatagcgataccgatgttcgctcgttgaaagtgcgatagcgtggcgaaatcgcgatctgacagagcgatagcgaagttgagctggcgctctcgcgcaagcgagacgcgagaccgcagcggtatcgcttttcccacgagtgagagcgccacgtggagaaatccccacgactacctcgggcggagccatcgctctcgcactttcgttgcgcgagaccgaggccggtttcgtaatatgaaaccgcgagaccagttatgacgcgacggggaagacgtgggcacgcggtatcgcgctttgcgtgtgcgagactgctgacgcggcatgcgcgcgagagagaaagcctgggggagggcagtgggcccgcggcgtcgcgctttgggagcgcgagaccgaacacggtgtcgctatacgcgtgcgcgagagcgaggagcgaggtggggcagcgctgtcgcgctttgagggcgcgagaccgcttgcggtctcgctctacgcgtgcgcgagagcgagtgcatcgagggcgcgacagtaggctcggtatcgcggtacgcacgcgcgagaccgccctcggtatcacgctccgcatgcgcgagagcgtcgccgcttttcgccaccgacacctttgtttcccatctctatttcttttttgctttttacacggattctgcctctgactgatgaagaaatctgctgtccaggaagctctagatacatacatgttattagtagttgctactacttgctcatctattggatggtttcagtgtggagtctgaatctgtttgtgatgctggaagaaccctaattaagtatggtgatatggcttagttgatcagtgcatcagtagttaagagttcatggttgatcatcactctaaaaatctgaacttttcttttgggtcatgtgatgatggtgttggaacttggaagaaatctaaacatgctattgatggcttaattagtacggagttatactactaatcctgcacccctaattttgtttcacttctgtcattcagtgatgcttagcaatgatcagctgctagctaaagctgcattttaatattactgcttgttctatgcattttgcggcttactaatgtgatatgtgaaaaagttggagctgcgactatttgatctactatgctgaaatatgagtaccagttgataacttgacatatctatatatatatatttgctggatatggttatgatggagcaatgtactccaataatccctgtatccctccctgtagtgcttgtttgaatgtgttagcttaaaacctgaaccctttggtttgagtttgacagtaatttcatttttttcagattgggggtaatcgtcatctatccatgcatgcatatgctgattactactacccctgtatacacttttgcagggacaaattgaatccatgcatgtttctttcaatttcatcttaaaaccatcagttgctttccatgtcaattcatcaaaacggatttgaatcaagcatatcatatttcacattctcaatctgagcattctaattcacggatattgctgctactgtgccacgtggcgttacaaacacactatgttggttaattgcttggtttactgaccatttccacttggaaaactaaaataaaaacaaggtctcttcatgatctctttgctgaagatatcaactgacttttatgactgcaataatcttcacatcttttccatggaacaataaccaatctccaaaattttaaattttaattaaaacctaacttacaagttttatatagcagttgacggttgacgtacagaccaaatcgaaaaaaaaaaccctgtaaattctgaataacaaactatagatcattcaagtcacaacgaatgaattcataaccaaaacgcaatccaaacacaaaaatggtttcaagaaacatgcctaacctgcacccaaccatcatgcataatgatcccataattagcactgccaattcgtacgcttgcatgcgtctcaaaccttagaaaagcactccaaactgcaacgattatatcaataaaataaaataaattaactgtgtaaggtctgatcatattttcttcttaaaatgggatatcttctttttatatatataaaacgtcagcaacggcatgaccattcgaaaataaaaaaataaaatcaaaattgggtggctaaccagtaaccacgtgtttaccatgaaacgcctatacgaaatcatgtacggaaaaaaagatttaatccaaaatggaaattgatggaggatgatctgcaattagaaagaagaaatcgcgttgaattcgatcagtttgtcgaacagctaacacgtacgatgagcggctcgccggcaacgccggcgacgcatgcgtgatcggcggccggcgagggcggttcccgccgccgccatggatggctcgcatggatcggcggcggcgctccgggcgacggggcggtgcctcgcgccgctgatcatcccggcgtcctgcgtcgtgtgggtgctcttcttcttcccctcgccgtcgccggacgtcgccgtccgccgcgacggcttcctcccggccgtcacattgccggtgcaacgcgccggcgacacgccgccaccgccgccgatcattgacgcgtcacctccaccaccgtcgacgtcgccgccgccgccgccgccgcgtcgagggcgtccggcgaggagggacaggtgcgccgggaggtacgtgtacatgcacgagctgccgagccggttcaactccgacctcctccgcgactgccggacgctgtcggagtggacggacatgtgccgccacgtcgccaacggcgggatcgggccgcggctgccgccggcggcgcgcggcggcgtgctcccggcgaccgggtggtacgacaccaaccagttcaccctcgaggtgatcttccacgcgcggatgaggcggtacggctgcctcaccgccgacgcgtcgcgcgccgccgcggtgtacgtgccctactacccgggcctcgacgtcggccgctacctgtgggggttcagcaacggcgtccgcgacctgctcgccgaggacctcgccgagtggctccgcgggacgccggcgtgggcggcgcacggcgggcgcgaccacttcctcgtcggcggccgcatcgcgtgggacttccgccgcgaggacggcggcggcgaggggagccagtgggggagccgcctcctcctcctcccggaggcgatgaacatgacggcgctcgtcatcgaggcgagcccgtggcaccgccgcaccgacgtcgccgtgccgtacccgacctacttccacccgtggcgcccctccgacgtgtcgtcctggcagcgcgacgcgcgccgcgcgcgccgcccgtggctgttcgcgttcgccggcgccgggcgtggcaacggcgacgaccacgaccgacaccacggcggcggcgtcgtgcgcgaccgcgtcatcgcccagtgcgcgcggtcgcggcggtgcgggctgctccggtgcggggcgcgcgggaggcgcgacgactgctacgacccggggaacgtgatgcggctgttcaagagcgctgccttctgcctccagccgcggggggactcgtacacgcggcggtcggtgttcgacgccatcctcgccggctgcgtgccggtgttcttccacccgggctccgcctacacccagtaccggtggcacctgccgcgggaccacgccgcctactcggtgttcgtcccggaggacggcgtgcgcaacggcacggtgaggctggaggacgtgctccggcgggtgagcgcggcgagggtggcggcgatgagggagcaggtgatcaggatgatacccaccgtcgtgtacagggacccccgggcgccgtcggcccgcgggttcacggacgcaatcgacgtcgccgtcgacggcgtcatcgagagggtcaggaggatcaagcaagggctccctcccggaggcgacgacgacgacgaccaccggtgggatgcctacttcgacacgcagtgaatgatgcgttgctcgattttttttttttggtttgattttgtaggcagagaggaggatgaaactgaaatggtagagaattttagaattttttgtttggaaacaaatcgatgtagttcaaaaagaaagtttaagaggatttcaattcaaaacagagcaatttttgggcctatccaaatacttatattcatgtcattacaaatcataccattattaaataaaaaataataattatgtggttgtatttagtttgttgccgaatattggtaatgtctattaaattttgataaccctagcctatcttacggaaacttaacaatgttgataatttgtcgaaattttgggaagtgttatttttaccttgtaaaactcccgaatggggtgaaaaatatgaccgttggatctagcaccaacggtacggacgttggccgcgcgccggagatccacccacggcggcgcccctccacagccacgccggacgggaggcggaggcggcggcattgggcgctcctgggccggcgaggccgagggcgagggcctcttcggcgacgacagcgccgccgccccggtgacggcgggggccgagcgtcgacgagggcgaaggcaccggcctcatcccgctgcgcggaggcggaggaggccggcctcgtccccgccggtcggcccggaggatgccgcggcggcgcaacgacggcgacgcttcgtttccctacggtgagaaagaccgtcgccaaatgcactacttatattgagtataatcatcaaagagaatttggaaagcttttcatttcgcataaggaatcaagaatgtgtgtgagaccggatgctgaaagaaattgggaagaggggttagttagggtatatatgaacttcaaaacttgctgctggctgctacttcctgtcaatatttccttctttgggaaacgattcaaacattttgtatgaattttggctgcagttgactagctgaagagatcaagaagactttgtatggtttctaaaaaggaaaaaaaaaaggcatgtgaggtaatattgctgttccacactaatcttgccaagacagtttacaaatcaaatatttagtattcttttttattaaattcgggtttatcagaatcaaattcaaggggaaaaagaatacaaatccatgctccagccgaaagtagagtatactacctgctcttttcaaggattgaaaagttccacctagctgataccaatgaatatgcatacacaaatcttctttttaaacattctaacaaaattcaactttgaccttcaagaggaatctgacatacacaactgaaatgcaaagaaatcacccaacggacttagcatgccttacaccttcaatctatgaacaattgcaagatatacatggaatgctccctgtctgaaaccaagtcacatcatcctggaatgatagatcaagcaagcagaacggttctgatcctaatttcctgaacacattaaaaaaattcatgaacgcctggaactgagtgtgttctggaaagatgcaacacaaaacattacaacagatcatccaacgacaaacttcaattgaattttacccacaagaaagagcagcacgctccagcggtagcagattaaaacaacaaaaagacatgcttaaacatctaaaccacagaaacacccagagataaagctaaacagaatccatcttacttaaatagtactgaatttacaaaaaagagtgccattatagatagatagtggacattacatggcatatatagtgtaagcttgccaaaatgggagggaacacactcctcatcacaagcttacagaagcatgtccatcaagcattcgagagaacatatttctaagcaaaaagagcactcctcaagcttgcaggagtgagcgcacctaaccgagtagcctgttagctcatcccacgagcgcagcaaaatcgaaggagagtgaactgatctctccttcagattgtgggactgtttgctttattctatatagtaatgtaagttctggtattactgtatcagggaagtaagcctactcaacaaaacttgaagtgctcaatcatgcagccacaagtggtgcagcccttgagtaatgttactgaagccaggaagcatcctcgacatgcgatgctgtgcatacagggggaacatctgacaatcgcctcagctccacggcagaccaccatcagctggcacctttgatctgatgcacgctccatgactccctgcatatcagatgatcgatcagacatcagacacattcaatcataaactctggtcaagtaaaaacagcagtaagcatcctgatcctttgctagtttctaacagtctgaaaaaatatcccattgaaacacagtagataaatatatatcaaacaatttttcaaaagggaacatcagaagaaattccactgtttggagataattattaccacatattggtatcttgcatcctgtgcaggggaagacttgactccacttacagcagtgccacaggtcatgcatgccctgacattgcatctcatcatgcaggcaacacaaatcttatgaaggcatgggacaagctgcatcacagcatcataggatcgacagatgatgcagtaatcactcttgggatatggagcctaaagtagaaagaaccaagttaggcatagttctcagtccaagcaactaagcaatgtaaatctcacaagatcacttaccaggaacctgtcccattgtgattggaagaaagagaatctcatatcagcctcacagttgcttggagttactgctggcctttcaactggacagtcaacgaagcatgttgttggtctggaaccaatcaaaccaatcctccttgcaagtccagattcaaacaaatcagtcttcctcataggctcagaaacaatcttctgagtaagagatgcaggctcaatgacagttggttttcttgtaggcaaaggctcagtcacaattggttttcttgtaggcacaggctcaatcacaattggtttccttgtaggaacaggctcaatcacaattggttttcttgtaggcacaacaggctcaattgccattggttttcttgtaggcacgggctcaatcacacttggttttcttgtaggcacaggctcaatcacaattggttttcttgtaggttcagtcacaatcaaatcaggttttcttgtagtgactgtgtcaatcagatgaggttttcttgtaggtacaagctcaatcaaatcagactttcctgtaggtatggactcaatggaatcaggctttggggtactgacagtaacttcacccagtaagctaccattgtcagtggaagcactatcctgctggctttcagtgttgctcccgcagcactcatcgccctgatggctctgcacattgctctcactgcaagtatcaccctgctgactgtctgtgttatgaggggagtcctcggtgatattagtggtaagtggagacctcggggactgatgatctgacactgattctgggagctcatcatgatcaaaagagaatggttccagcaagggtacatacttcggtcgcgagaccggtggaaggaggaccatgtgtgtggcaggaccacttcctacagggactacacacattctgcagataccaggaagggaacgcatgaaatcactgagcttaggataaccaagtgtgccatgatcaagctccattctgcaaattgctctgaaatcacccttcagggagctcaatgggtacctatctccaagtcgttcggtagcatctgcaagaaatcctggcaaccacttcctgaatataaagaaccaagatggaagacacttctctggcaagggccggcgcttcctaatgtaatgttcctcctttagctcaccatccaacagatggtgagttacctttggaacctcctggctgtggtgcctgaatggagcaattttctggatttctgcaggcaaggatcctctagcaacagcatcctttacctccactctcttcccaagcatgtacacatgatgagtttcctttgcacttatcacatcctcttctcttttgaactttacaaaaccaaatcctcgagattgcacccgatcacccatccttatcccaatgactactgcttcctccacaggtccaaattcagcagtgaagaactcagtgaggtactctgccaggaagaacaaaacaaggtaagtgttagaacttagaaacacattagttctaactttattaagtacaagtagttcaggattctgaagtttaccagcgcccacagaaggtgggaggcccccaacaaaaattttccgagtgtagtcgtgcttcggccaatgattaggctaaaagaaaatcttataagaggcagaccatgtgaagaaaaagggaattggttaatataggcagagtatgtttgtttacccgaggcacaaacttggaaccttgcttgggagcacaatggttcttactcttgcccccttgggcagaaccattactagaccggaaatcccgatggcttgctgatgttttaagcccagtaaagctgccacattatcaaaataaatatattagtttgaaacgtaggatgagaagcaaaggttctagtatgcaaaagaatggaagatctaatataaatcatgcagtatgcaccggacatacctttcatttaaatcatcactgtcataatcaccaaaatcttccaggaactctttgcagctttccttattcgtcacacttttttttggatgtgagctacggttccctacaaacagaatatatttcagttgaaaaggtatttgccgcgtattgatcgttatgcagtaaaaccaacaggaaaccaatcttgaaatctttttcattgaatcgaacactgctaattgtatgcactactacaaatatttttgtgatttcagttgataaatatctttaaatgtcagaaaatatcttacatggagccacatttgcagaggtaagaatgaaacgcatatcttgggacgttgccacgtctattggtctttgctttctgtttaatgtcaaaggatcaaaggatggtaagtgcatcaagtcgtcaaacagaagcatattcttcttaaatccaaatattacccaccttaggttctggactttggtgctagccccagaacgcaggagaagctttacacagtccaaagaaccattcttcactgctaagaacaatggggtttctttggtcttggaaggagtatcaacacaatcttgagcatgaagcagaagtgacttacagagcaaacaaacatactatcaattagttataagctcaaaaaatgccatcgtgtgagtagaagttacaaaaggctacctgaagagctttataatttcccttagctgcagcgctgtgtactggtgtaagaccaagtttgttcccctggaaaactctggcaccattcttcagcaggagccacacaatcctgcacaaatacagaagacaactaagtaaagagaatgcaaatagcagtaagaactagtatgttgtattttaacagttgatagaacaaaattctaatagcataccttggctcctgtgtgcttgagctaccactaaggcaccagtgaagtgccgtgttcccttcaggatcggcttcattgacatcaacatcccccatcaggagcatctttgtgacatttacatctccaacctacagtagaaaggtcagtcagaagaaagtcttctggtgtatatacagttgtagcactaaaaactttaccttaagcatagcacattttaagcattcttgcatggaccataattggagaaaaatcagttttgaaattgggcagggcatgaaaatgactcaaaagctcagcttacatggtattaattgtaactcatcagtatgcataccatataaagtgtcaagcaaggaaattctgaaatagctctgtgaactgtcaacaagaacagcaatatgaacagaggtaccttggcagctttaagcagagggggcaagcttctcttgtcaatgttgcgatctctccataacgctgccccaaattggttaagtagctgaatctcactgagcagggcctttctcctctcattgctgtcccgggctggagcatccccaatggacagagcctcatccacaatagagtagtagattgatttctttgtcctgacgccctctataactacactgactggtgccgatatcttctcttcagccaccagaagcagcattgccaacacagtaacacgaccttccatggcatatctgtaggccacctccccaacctctctggttttctctgccaggagcctcactgcattcagatcctacacatggaacaaggtgacatttttgtgtgagaagatctatggaccaattatgagacagtgaatgaacattagtagtactagtaaccatacaaaccttttcttgcagagatgacagaagatcttcaatggagttgtccagtgaccatttaacttgagctctggataagaacatcagtcagaaaaacagccattgcatggagagaacttgagaagtgagctcagtggtcaccatcaccttctgcttaagagagcgatctcgagcgcgacaagagggcggccatcgaccagcttgaggtcggtgcgcgcgttcttggagagcagcagctcgatgcaccgggccgagtgcgcctcggcggcgacctggagcggcgtccgcgtgagctggtccctggcgtccacgggcgacgccgtgatgccgtgccctccctcgaggaggagcctggcgcactgcacggcgtcgtgcttgcaggcgaggtggagcagcctcgtggacatctcctggtccagcatccgcgacgcgtcggagcccttccggagacggcccatcgcctccttcctgaagcttcccaccgccgcgagcagcagcgcggtgtcgtcctccgcgacggcgcgggacacggcggtctccttccccgtcgccgccgccgccgccttgtcctcgcgcgccgctgccttggcgcgatccatgctcccggtctcttcactcgcgccctgacaaaatcaaaccacaaaacgaactcttcaaacacagatgaacacaacgaacacataaataaatttcgctcaagtttgcatcaaccgaaaattcataggcacatataaacgaaatcaacaaactaaatatcatctctgtaccgaaagaaacccacgaaactcgagccatcgccgcactgtacgctaaacattttcaaacaaaagcagcaagcggaagaagcaggagatgggactgaaactgcagacagatacacaagaatggaattccacgaatccatcagtcgcctcggcttttaagcaggcacgacaaggtgcaagaaaacaagcaggaaagggaccaaaatttgatgagcgccattgcaatttcctttcgcttccaaagacaaaagccctcgtaaaatcacggggaatcgaatcgaaagctcagagaatcacatgatgtcgcagacagaaacgaatgacacgtcgtgacgtgtgacaagacgcccgagattgaaacgaagctacggaagatggggaaacaccagcaaggaaggtttgctcgatacgaggaggaacttggaatctcgctcggattgcaaaaaaaaaaaacgtgggaaaaaacaaaacacacgtcgaatcgcaggctcgcagcaaaaaaaacaaacgaaacagtatgaaaccacaaaaacttttcaaaaacgcgctgaaatttcgcacgcccgctgaaattggtcgaatcgtggcaccacaaataggtggaatacacacgaatgcacatcatcacaaaaacccaaatctccacgaaaaaaaaagaggaaaataaggcatgaagccatgagccatcaacgaacagcacctaaaaccctagcactggtcaatccaagttccagaagctccaaaacactggacgacgcatattagcagtacgcatggatgacttgtgcatcggacaaatccgaatggaagttctgaaaaagaaaaaaaaatgatgaagcattcccctactttgcacgggaaagggtcaaaaatccttgtcaaatgaggcaaaatcaatccaaaatccagaaatcaaaccgcacgatcaaagcatccgcaagccagtcacaaattttcccaaacccgcacaaaacgcaaaaagcacaagcgaaaaaaaaaagagagaggcagggataaacaaaccgtcatcatcgcaatatacataacggcaagtttaattcacgaggattcgtcaaaccctaacatctcacgacgaaaccaccagaattggagcaccatttcctcccccctctcgtcgcctcggcgagcaacagaggcaacgtacgccatgctcgcgagagctccgaggaaacaaaacgaaactcccagaaaaggccaaaaccacacggatcccagcgaaaatcctcgaaaaacccaaccaaaatcagacgaatcttcccctcaaaaaaaaataaatcagacgaatcggagaaacaacgcaaccaaaaccccccaaaccgaatcaacatcaaaccaaatgctctctcaagcgaaaaaccatcccctcgatcgatcgctggacgcggccgcctcacctctcccatccgcgctagcttctccccgaaccgcacccagcactgcaccaacctcctcctcctcctcctctccaatctcaaatactcctctcctcctcctccaccaactcaccacggggaagaaggagacaaaccaaacaaaagcgaagtactcgctgtctgctccacccctctctctcgtcctctctctgttcgtgtgtctgatccgctgcgactacccactcctgccgctgcaaggaatcagcttttgcatcccctctctctcgagagaaaaaagttttgtagctttgccgtttcgggcaagctaggctcgcagcggtgatcatggcggacacgggaacgccaaaaccaaacccaaccccccacccgcgtttgaaatccccgatgagtcactgccaggtgggcccaaccctcctccgctgtgtcgctggcaggtggggccaacgagcaccctccttgtctcttgtggcgctgcgcgttgtcagaggcagaggggacagcccgctgccacggagcagaaggggaggggggtttgtttgctttgcttacgtggggttggtttgggtgatgtggctgacgtatggggccgggtggtggggctggaggggtggggcctaggtgtcagtgggggttgggtgatggattggtgcgtgtgggaggtgggttgggggttgtggggtgggtcccatgcgtatcgttcttgggggttgtgaaggtgaggaggaggttgggatggcgcgtacggatgaggttgaggtggaggatgacgacgatgatgcatcccctatttgtcactttctgctcttcatgtctacagtactcctagtttagtttcagccgttacatgtcttccttaaaattgtttgtaatttagtgagtactgaaatattgcattcactattaaatgatgaaaattgtagtttgtgacattttttattttgagaattgtgataagctagtcggcagttactatattagcatgtattttctcttctattgttttatgaaggtatagtcgtgtagcttacttattgaataataagtatataatacatgtggatcacattttattttctttgtttcaactaggtatagtattgtgtaacttaacaattaaatggaagtataattacacgattgcatgccgacgcacatttttctttgaaaggaatacaataaatgaagtagtcaagttgtcacgaatagtctctaccctgtatcctaacgcctattttcctttttgaggaagtgacaagtggtaaccaagttgatctaccctacaacaaagtgagaatattactactagtattactaacaaaagatatatgtttatactttttagtaacaaaaaaatgctataagaatttcagagcagaagcacacacggtttaatgatcacaaaaatatgttaggcgttcgcgcgcactcgatgtccaagtccaacgcacgcggcacagcatatattacgtacgtgcaacgcgcacggtgcagttgtgcccgtgcaggggctagagactagagaggcccggtttgggtgaaacggatcagacacgacgtggcgtggcgtgcgtgatgcgtgtgtgggcgattcgggcgcgcgggcagacaaaggctgcgttgccctgcggcatctgcatgcagcagacgaggcaggcaggagcaggacgacgtccaaccacactagctacacagggcaaagagagagagagaggctatagtacacagtacctgcacgactgcactgcacttatttgcccatgcgaattccaccgcatttccaaaatacccagacgcatcaggcaatcaatcaaagcgatgtaaagtagcggaatgctagagcttgagttcagtggaaccgaaggtccgtgtaacttgtgaatttaattatttgtcacttctataatttgtgtttctctaaatgccacttttatatttatctttagaaatttgacatcagtgggagaaattttcttgatatttttctttacatttctgctgatgtggcatgacaactaggacaatctgtatggccgagtgataagtaattttcattttctccctctccaagtctggcacaaaccatcgccaccgcaataccaccgactttgccacgtcgactcaagcccgacccaacaacacacgcacatgacgcactcgaccttcccttcccactcccaagtggtagaaaaaaaattcattgaggaagcaaagtgaaatcgtgatggatgctaggtaggatgactacgagagacggcgccggtggcatcgatgatgtatcgctgcagaaggtctggtcctagacaaagccaccacgccaccaacctctccagacctagcatgcataggcgacgataatggttgtggagatcgacagggaagaggcatgtccactgaccgttgtaacaatggttgtcaccacctcgagctaccctctccagcagttgaggaaggcaactcgctgttgccgccttctcgatcccccgagcctcctcctccctcctacattcttcgttacttacctctaggatctcaagtcgcattgccttatcctcgagcatcaacgattccatgactgttggcgagaaaaaatccatggccaaatcgaccacaatatgcattgccgctagatccccttcggccaccgtcggtctgccgtggcccactaccggtcggcaagcggtcattgggacttaatgctcatcctttccctagccctagcagcaagcgctccttatcctaaggccctatgtacagtggttgaggacgaaatagagaggatgacttgtgggatccactaggtgcaaaatggagattccgcctttgcattccacgctggacatccataggtcaagccacgctacacaaaaacttaagaagtatgaggtgtttggatggtgaccacactttgtcacaactttgaccaacttaacctagtgttttgtttgattaccacatgattgtcatgccacacttttttgttttgtgtccccacaagccataggcacatctctttgccaaagcttgcctaacttgtggttaaggatttctcagccacatcaagtgtggcatgccacatcttagctgtaaaaagtttgacagactgaaacaagcatcccctaggaaaaaaccataagaacgattctagaagtgacatttgaagagcggatgtttcttagattggcaaatagttgaatccctccatgcaagatgagtactacctccatattttaatgtatgacaccgttgactttttgtctaacgtttaaccattcgtcttattcaaaaattttatgtaattatcatttattttattatgacttgattcgtcatcaaatgttctttagcatgaaataaatatttttatatttgcacaaaaattttgaataaaacgaatggtcaaacgttggtcgaaaagtcaacggtgtcatacattcaaatacggagggagtacttcaaagcgaatatatttgtctacggttaaattgacctcgtttttactgtatatataatatttgacaaaaaataacatcgtaaaaaaactgtcaaatataaatataatatagtaatagtataatttcaatgtgatcagtatataatcataatataagtaggatataactggtatgtaacaataagaaaaatgtggtttgctcagtggtatcggccactgcatgcacatatgttatttgttgttcccctgtcgctcacgaatctcggggccaatctcaaacaacatcctcaatggtaaaaagagtgcaagatttagcagtgaaatttccgagtcaacaaataattagcaattctgtccttttctttttgcgagcaactatggtttaatcaatcgatcctgaacgtgtgtgtactcacacgatcgatcgatcgatcaaatttatggatccatttgaccatctctaactctaaaggtttgtacacaaacttttggacatttttgcaccatttctctggattgtcaggcctaattaacctaacaggctatacgtgcaacgtgctagatatatttggcccatccggataacggcccacggcccacgtccaaacaaacgggtcgtgctccgctgcgccaagctctatttttacgtgtctcccttctgaaagcgtactttggtggtttacgtattcacgcggcggaagcttttctgttttcccccaaatttgcgcttccctccctcttctcgaaccttccgaccgccaccgttgtcgccatcgccgccggcgccgaattccgccgcgatctcgcctgctccccccagtggtaagagattcgatcggtctcgtagtaactccggctcgctcgggcaccttaggtgcgccggttcctgctcgattcgagctaccggctgccgactttgccggcggaacgtaatcggctgcgctgtcgcagtcggcggcgtgcttaaccgctcccggaattctgcttagctatggcgatgattcgatgtgccctccttcgtgctaggaaatcttgtgctgtgattttcaggcttcaactcgtttgatgcgtctatttttggaagttattagcagtagcagtgtgttcgtgtcctgcaattgacctagcctgcgcaatctgttgcttgctgctaaatgtgtgggttttttccccctagccattaaattcaaacaactagtagacaactcgttattgccgaagtacagtttggaatcatttgggtttgactgttcgttcaataaaagaaaaaaagaagggtttcagagtgtctgctagctttaaatttttgcacggtcagattaaggaaattttaattttacttgttggttgttttatttctcaacctcccattaattgctcccagttaaggtattttcagttggaacattagttatgatttgtacaatcacagatgggatttacagatgaaatagtacaagtagatgtgttagaaaggcacttgttggctggtttatcaccggatgattataagggaataagtgaggatgagatcctctatgatgcatcatttgaggcaactgaagacaagtttgtcaagtatcagattacttggtggattctgctgtcagtattgttgatcttagcttggggagtaggactcctcatgctgctttacttgccaatttggatatatgtgtgccggaaggacttccgctcaaggaagttgtgtttgactccacatgctattgtctataaggtatctgcatgttggataggagatggaaactctatttgttttctctcttaggttcttactaatatatctaacacccctgctcataatccaggtaactaggcctgccacttttccttgttttggtgttttgaggaatgagaagcatgttgtccttcattcagtttctgatattgttgtcgaacaaggtaagctgaaaataatgcagaacaaacttgttcgtgacgattcatttaaaaagactgtttgtgacttgttactaaactattaaagcgcttttgctaggacttggttatgagagatatatatatattttcattttccatctttttgttgagttagtgcaaatccagttctttccttggttgtgaaaagctatgttaacttgttaagaagtttgttcttgttttttttaaataaatgagtgacactcttggtgcaatatgcttagttatctactgtactcatgtgatatctgtaggttatctccaatcactttttggtatatattcaatcagatttgagaacattggtgtccgaaagccttctagtgatgacataaagataactggaattagtcatccacatgatttcaggaaggtactaaacattttgatttatctatctcagtctatctcgagtttttgtctcattcagacatgctttcttcaggctgttcttgtccatcttttgaatacaagcaatctgaatctcagtagaaaagcttatgtacacgatgatcagcagagcacgagttctaaacctataactatgtcttcggtatgtctatttcttaatggtaccttttaatagtttaaactgtaaagatcctttgcatttagcaagccctggagctatgagatccaacctttctgaatgtgcgatagttataaaactaagaacaagcatatattttgtatatcgaggttctgtttgtataataccttaggaagtattgtattgtagatatatagcttctaacaacatacatggttttgctaagtcaagattgtatttccatattaccctattaaacttggctaatgttttcattttacagaccattttcactgatccccgtgttttgcatgatatatatacaacacattgaatttttcaggttcctcctcttggagatttgatacttgagaag

SEQ ID NO: 82694 - DNA, 2090 bp, Oryza sativa
aaagaaaatagcgataaaaataaaaaaaagtccgactcctcgttgctattccctctcagaaaaaaaaagtccgactctagatccgagtcccactcctctcggtttgagtccgagatactacgcaccgcttctctcggttttaatctctaccgtgatattccatacatcttggtgaaaaaaattgatgtgtcggattgaagatctgtttgcaaaaacggaacctacatgtcaagagcattccatttttatatgattttaatttttggatttgtacatttgcatttgagtccctataatttttatatttatatttgagtccctgtaatcttgcaataaggtgcttttggtcttttttttaaaaaaacaataaataaaagggatagaacaaaggcagaaagctgcataaaaagaaaaagccacacaaaaaaaaataaacaaaaaacaacaacaacaaaagtctatttcccctaagtggcaaaaaaaaactgtagatgcaaacggaaaaaaaatccgattcctataaaaggcaaaaaaaaaagtggtgaaaaaaaacgctagatccgattccattaaaaatgaaaaaaaagtctaattcctgtaaaggcgaaaaaaatccgaaaaaacatctaaaaaggttcgtccgattcactaagaaagtggcaaaaaaatggttcgtaaaaaataaaaagctggttcgtataaaataaataatgcacgcgagaaaaaaaagaaaatggcaaaacaaagtccaatttctaatcagtataaatctcttctctatctctaatctaatctaactatttaaaaataaaaaatgcacgagaaaataaaaacgataaaaaaaaacgtgtgagaaaaaaagtcagaaaaaagcgtaaaacacgctaaaaaggtttttccatcttcttaaaaaaaataaaaaaacaagtgagaaaaattatttccattgtcggcaaaaactttttaaaaaaacatgcgaggaaaagactgtcagaaaaaatgcaccatttctaaaaaaaatggtatgaaaaaaccacgcaagaaaaaaaacactatctatataaaaaaatcgctctgaaaaaactattagaaaaaagttgatggacgcttgagtcggataggatccatcaattttttaccatgtactacacggcttttatttcgtcatatattctcatgtatgggaaaaaagcaaaaaataacattcagaaaaaacaggcaaaaaaaaccacgtgagaaagtaattgtaaaaaaaaggcaaaacacacgcgagaaaagcaaaacaaaaaaggggagaaaaatatggttttctgcatccactgtggtttgaaagaagagcttgttcatttccttactgttctcaaccattccatacctaaatttgataatgaaccaaactaaacatatcactaccaacacaaccttgtcaaattttgtatttttataactttatactcacaagactactctcaatatttagttaggaatcaaactaaatactacccatcttcatcttatcttaccaaaatttgataatgccaaaatttggcaatgccaaagattgataaggatttttctttttctttttctttttttggtaatgaagtgaacaagcccgaagtttatgtgataaacaagatacagactacatgctagagttatacattcatgatagctgatttcgaattagctctattcattgtagctaaagtcttatcatctacatcacaccatgcctttcatgccattggcttccatttcaattagtctcttgttcatcaatattgaggacttagtgacaattttttttcgtaccaacgatgcagtgacaatgtgatagacatggatatgaggacaaaatgtaagtattttaccaattcagttttcaagtagacaatttgacaaaactaatatagagatgaacatggaacattttacatctaaaatatatatttaacagggctatctaaggatgtaagtgggttgacctagcccaaaaggtggatagcccatgggtcctataagtgtatttgtgggtcgatttacttacccttaatctatgctgtattgctgtctaaccgggtaattcc

SEQ ID NO: 82695 - DNA, 38883 bp, Oryza sativa
  unsure (1)..(38883): unsure at all n locations
aagtatgcaggacacccccaccccacccccccccccccaccccccaaaaaaaaaaactgtggagttaacatatgtaggttcgatcaatgcctggtgtaaagcaatgttagaacctcacttactgattaccttgtaggagcctgtggggggaactgccagcatgttccaatcaatatcatcaatgtatttcttacgctctctatatactgctttggcactgttaaactttggctgatactccgataacaaaccttttgcctggaatacagattgataatcaacaactccatatgaatcaaatgtaacccagttacattgttttagatttgataatattaattttgaaaacaaagtaaaagatgaaacctgctaacagaaatactagaactattgatacaatgaggatgcactgaatctgcaagtgtcatgttcatgaagaactacagcaccatatgttttaccagacagcgattagagtcgtttgctagctaattttcacaaagatcaaagattcaaatggaaactacaattaccaaggtgcggctaacagaattctcaaaattctcataatccttccatagctgctccacatgattagttggaactaaaattgccttctgatatactttccgtacagtagtcatacgatgtgattcttcctgcggtgtcacaacctgaagagtatgcaaagaaatatttacacagaataatagaagggatgaatgttaacatggggaaggacaggaaacaagaaggaagaaaacaaaccggcattgacttcaagaaagcaatataatccatccaaacagggccagaagcaacatcattgcctggaaagtttaagtgtccaagttaaagaaaaaacaaagagggattatctatacttatggcaccacatttttcaccaaaaaacagtcaaacctttcagccagtatttacactgtaaattccatatcttgcaatgtaattttcatatatttacagtgtaattttcaaatcttacactctatatttttatcattccctatataagagaactacgaaaaaggttgatcatctatttgaatcattgaaaaaggtactagtgcaaattaacacataagtagaaggacaaacacaaaagtcaataagaaagagagatgagaaatacaagtatagttacatgtaatataaagggtagttatcaataatgcagtgaaaaaaaagtgactgaaatcaagccaaatatgtgacgccatattttttttagcaaaattatgttaaaaaaatgtacttaggaagtcacatcatcaccaggcactagatataattaagtgcctacttaccaacatagttcagcatgaaatcaaaagcctttttggtctcttccaaaccatcagaaccccttttatcgttcactctcctgataaagttgatgtaacaacgcctgcaaattacacccagacaaatagggaaatgttaatgatgcacttgaaaacatactaatactagatccaagggaataggcaaaactaagagcaacaaaaacaaggcagacaatcacaaatgagatcacataacagggaactagtggctaatgagaccatcaggttaaatgagcagagactgcttaggaatttgatgatttacatgcatgatttgacacagaagttcaatcccaaaccacacatatcacggtaggaatatagttcagtgacacaaccagcgataacaatgataattcacataatgacagtaaagcaatttattcaacacatcccacatatgcatactacaacgtgtgcctaatgtacaatctccaaatatggcctccactcaccagagattaatctgaaggcaactgagcaagcatctgctgaatatctgcttggtggcctcatcatccttcgcggacatgtaagcttcgacatactgcttccagtacttcgcctgcacatacacatatagcaggtgaagccaagtgaaatggcatcactagatgaaccagacgaacctatatatagatatacgatgcaaccccaaagcaagcaaaacatcgagtcgaaatcgaactggactcacggcagtggggaaagttgacagcagcttctcgtagatgggagcggcctcgccgattgggagcagctggagacaaggaaggagcggagcggagcgcaagcgcgcaacaccgtggtgagctcgtcagtgcaacccagctcaagtgaactcggtcgcgaagcgaggcgaatcggggggaggggggagagctcacctgggcctcgttggcgaggatctcggcggcctcgacattgtagatgtccatcgcctccaactccgccgccgccgccgccagcgagggcgccggattcctgttcaccgcagagcaattcgggtttggattacctcaccgcgaagaagaggattgggagagcggattcggagcgagctagggcttcctcaccgggggaaaggagtcggtcgggatggataggggggatctccaccccacgccagtccactgtaggggaggaggaagcggaggaggacggcggcgggaagaacggcgagttcacggcggcggagagcttactccggcggaaggcggcgcgagcgaacggagaaatcagggggcgccggagtgatgtgtttggaagaaattttagatgaattttactgaaatgtttggatttcttttttaaaaaaaattccaaggaccagcgtatctgtagctcgaggatacatacgtcgtatgggtagttttcatgttattagaaaaattatttctcaatacttggtccattacccttcctcttgtattatatttttattgagaaaattcgatctataacatagaaaacatgtcggtatccaaaaaatagcacacaaaattcccaccttcgatcagaagtatattccacttgtttttattttatccgttgtatttccgtcacaactacaggtctaatcaaagtttttcgccatgagtagggacagagaaagatcaatttgtccatattattctctgcatttacacatgactaggttgggcacttgcgctagagcacttggactagaggctgcgcacgccatgaaaatagcgacgacggcaggcttgcgcgaccatgcgccgcaactgctatttcaatgttgttgacaacgatggctggtggttgcttgaagatggcgactggctgagggttagggaatacgagtagctagcagcttgtttaagccgtcgagctcaacgctggcagtggccgacttgcttgcaacggctgctagggcttattgctaggtgaagatgtgagcatgaccaaaaattgcaaggaccatatactccttaaaaactaatcaatttcaacttcaataaccaccatacacatgtaagataaaaacttaaattttacaaattggaccttgcctatgcgtggtgtctcggtcatgcataagagacaagaggcaagcgatgaacaggggaagaggtatgcagtgagggactggaaggaggaggaagaagaaattgacctaagggttttctttttggtctttttagtggacggaagtgctaaattttagaaatctctaacagagctgtgctttcaggcgaagaaacaagtttcttgtgctattattttactcggacaatacctatgctaccaatcgaattttctcatatttatttattattatatattgctcccttcatccagcaatataagatttatagcgtttaaatttttacctttgttgttcagcagttaattgtaaaaaacatcagtcaattacattagccattgaatttcggggagggggtggggatttaagggacgactagcagtggatggcgatgcactagcggtgccgccagaacccaccaataccatggggctggaggagtgcgttggatcaatgttggagacagaggtgattcgtcggagtggctagcaagcggtgggcagctatgcaccagcggtgccactatagcccaacattgccatggggatagaggagtgcgttgagtcgatgttggagacggagacgattcatcggagtggctagtagacgtgtggcacatgagctgccagatacaggggggataggtgaggcgagataaggcatataaattaaagatgatggtggtgaaattagggaggctcgtggacatgaaagcaccaaagagtataaaaaataatagccaagcatccgagggaagtgaaagaagatagatacattgagagaaaatcaactgacaaaacaaaacagaatcaaatcatatgccattgtttcttacattttattataaatgctacatttcgagtgggattttcccctactagtaaatgctaaacattattctctgctaaagctcatataaatgcttatatttgtgggggaatgtatcgtatatacacataaatttacacactatgtacccaccagataatatatatcataaaaaattatataaacaatatacatgtattttcaatagtattgcatacacatataaattaagtaccaacttcatatttgttatgttttagccataaaaaaagtaacatatctattagaattttatcttgctaaaatataatgaaattgaaattatactttatagatagatgtaatattattgaaattgaaagtacgtgcaaaatattctctcaaagttttagtgaaacccgccatgttagttggtgtatacggaacttgcataataaaattgtatatggtacttctatttgtggacgaactaacaacatctatattgtttcacgatgctaccgactgtattggagtatcctagcaatataaccattcgaccatgccttgaaaggaaacgattgaacagggcccgagaatacacgaggatgaagttgagacaatctaaggatatcactttaggtaattttacgatccatgtatgttataatacaacatttcataccttaaatattagatatctaaatatttctattataaatttagataactcaagatattttaccaaatatcataacatctattctttctataaagctaaggccatgtacaaagttagagtcagatataagctctacgttatctaaagactagcatcctacaacagttagagacagtatggtctctaatcattaatgtattcaaatattttttcttactcttctttccttcctttcaccaccatgcaataaaatttgctctaataaatgctaagagtcgactctgagctgttgtcatgcataacaactatactcatttctctttcttccatgtcatcaaatttacttgtatggcaatagagagagactactaataaagaccgttgtacatgccctaatgaccactaagcacataaagctcaacatgcaagcatagtatttattagcattcctaaaacctacatgcaaggatgccacatcaatctattaaatacataaagctcaacatgtaagcatatagtaatcatatcagcaatttatttcattgtaaaactaaacatacacatgctaaatcaccattcgcaaatcattttcataatatttcaatccaaatcatttcatcatttctccattatataacatatatcccgcagcaaagcgcgggacatcatctagtttctaaaacaatttagacacttgaccagagttgacatgaacatcactctcatttattacattggcacacgtatgatggcacgtgcttactccctctgtcaaaaaaaacctaacttaaataagatatgatatatacaatgaatgtgaacagatggttgttcagattcattgtattaggttatatcatcttaatctaggttggacatttttttttacgaagggagtacacgtgaagtgagcatgagcacaggggcggagctatgtatagctgggggtgtccaggaacctggttaaaaaaatattaactatagtttatctatttttaccatatataccctgttagtttaaacttcactcgtattaagctaaatttgatttaaacgagagtaaagcaaacgactggaacccctccattttattatagctctgcccctgcatgagcttggcgtcaatgccgctcctgtacgcgcacgactgggtgtaggcctccccatgcttcttgccggtgcagcttgcttaattacctaagcaatgcataagcatgcgtcaagagaaactattcttggggattgttttcaaatggttatatattttttcaaaaaaaattaacaacataaattaatactatataatagataactctacaaacataaaaaaatcaaattaaattatacaagttgcaaaaagaaacaaatttaactacaaatatacgttaactagttataatttaatttatctttttattgtaaattgtagaagtcgacttttagcttgtatgattatagagtgatatatcacatattaatctatactactaatttttcttataactatttaaataacacgtaaagagcaaagagacatcccgtggggcgtttaaaatccatgccccatgcttcgatcatgccctgatcaccagtggcagcgcacgataaataattttgtggcgatgatgatgatcatatttgcgagtgctacacttgaactaccggagccactagctgtctagcttctacaaaagttaatataagactggcatgccccttgtgcatatggaatgtgtgtggtaccaacaaacgattggaccaaattaatcttggtgattgatttccacttaatgtattttacttagtttttgaaccttaatcgagctatagtcaattattacttggattccagacaagaacattggaacaacatcaaacaccgatcgaaactgaaactctgaaaactgcatggggtcttatgctgaactgctgaaattaaactcccctccagtgtgacttggtctagaaaaaaagaaatactgaagttaaacaggaaccgcctctgccaaatccagtttaattaatcttccaatctactccctccatcccaaaatatttaacgccattgactttttaaaaatgtttgaccgttcgtcttatttaaaaaatttaagtaattattattttttcctattatttgatttattgttaaacatacttttatgtatacgtatagttttacacatttcataaaagtttttgaataagacgaacggtcaaacatatttaaaaaagtcaacggtgttaaacatttagggaatgagggagtataattaagactctgttaaggattactgcacttggctgacttatgcatgacacaggactggcgcatacaagctagtggctacagtacgatcgacttcatggcttccattaacaagctcgatctcaagctcctttggaccatctagcaggagtggccagccttgtcatcaattagccattttgcttagggctttagtgcactagcaaatagcatttactttagggctaaagatatacatatatcaactatcgttgtgtttagttgcaaaatttttcttcaaacttccaacttttttatcacatcaaaactttcctacacatacaaactttcaacttttccgtcacatcgttccaatttcaaccaaacttctaattttaatgtgaagtaaacacaccctatatagtttatagagttctctcaataaaaagggaactatatagagttgcttccaatggctgcttagttctcacagacctgcacaacgcacatgcaggattttcagagggtgtcttcaaagggaccgtatgctccttttatttttttttcaaaatataagtgttttttaagagttttagcagaaattaagacaccctctgacttgcacgtttgtatatattcatagcattacaatctatataaccaacttttctttcagattttatttgatccacatgcaagtctcgtcatgcctcagcagtatcacgatcggttttggagaaaggggagatttccaactgagcacttaaaatgttgaggtttgctagttttcactatagtatctggcctcctcttgaatttgggctcaacctccgccattgtgaggggtggaggtagagtatatattagggggtgcccaggaactcggttaagaaaattttttagctgtacctaatttatttttattatgtgtgcaccactcttaatacaaatggcctgtttggtacagttccaactcctaaatataactccaggagttgagttgtggagttgtctaaacccagctccacaactctagtacattttgtgagagctccacccaactccactcctagttttggtggaactgaaattgtttggctgagcttcagctccaggaggggtggagctggagctggagctgtgccaaacaggccctaaattagacacccgtatcagcttaaactcaatataaagtaaagtaaattaagtaagtggcaccctccactattctgttctagccccgcccattgttgcattggtagatcgtaaggcagccgggggtgtagggcgtgccgccgttggcggcgcacgtcttgtccggcgggcagaaaggctgatccctcttcagcccgtcgaaatacgagccgtgcccgtcgccgacgacgaggcccaccgggaagaactccggcgccacctcgtcctccaccgccgccgccgccgccagcgccatttcggcgccgtgcatggcgccgccggcgtatgatccccaagatgatgaggtggtggtcgcgcgtgcagacgacgcgtacatgttgcctgcagcctccacgccgccggtggcgacggcggcggcgagggccgccgcaaggatcacgacagcgcgcggcggcggcgatggcaggtcaagccgccgcatcacgcgcgccggccggcgatgagcaatttcgatggcccgtcgtcgttgcttgctactagctagcttccgttctggtttgctgctgtcctgccgcgactttgctgcgtgtgatatcactcctataaatagcgatggaagggctgatcgagcttcctgaatatggttccatcgtttcgctccggaggcaggccggagtgtagtggtaccctaccccaccctcccttacgataggagttttttttttctttatcttatctttttttatctgtttttttttcttgacccctggcaatggccttttgacagtgtgcgttgtgtaatcaaattttgttctctttttctaacatatatattgacgtgtaatctttttgcgccttcgcgaaaaaaatgtgtttattggtacggtttattaaaatgtatctctactattatgaaaattgaaaatattttcatcggaattttggtacgtcatccgtgtttgaatcggttttaattttatgtttctgtcaaatcatttcctttttttcttacgccgctatgacgcgcgcaaattaattgggccagcatcttttcacacgctccttgccgtacgcagtgattgggctcgcgacagagtctgttttccacacgcgcctttgtgcgccgctgtgattggacccgcaacaccctcgctctcgtgattttcaacatgtccgattgggcctgcgatgccctcgtgagtgtaatttgccttgccacatgtccgagtgggactgcgtcgccctcgccagcgattcaaaaattgaatgttttttttgtcaaaactatggtacgtaatccgtatccgattcccgtcacgcgtaacattcattgcaaagtcgcacccacgagcaaactgtgaaacagagaccgtacgatgtggataccaagctgtcggtgacatgggaccgggagtatcatgactagaggcttgggcagccgcggtcacccacgtggcctgaccccctcggggggtcgggcccgagggagacgtgcccaccccctcctctgtctccccgaggggtcgggccgctcctgtttcggcccctagggctggggcgccccgaccccctgtggtattggcgccacgtgtgtgggttaggtgggcacagcggcgctcaccaaaccacatttattgcggaatggacaagcgcgccacgccgcatttaatgcagcacggcgcacgcatatccggtccgtgaccggtcgcagtgtgtgaccggtcacagaccggtcagatcgcgggttaggtggcagcaggcggcctgtcacacgcctcgccccgtcccgtcgaaatgatgagagcctcttggcactcgtccctagctggagccggcgtggtaactcctggagttagcacgtcagtcccggctcgattcatgccaggcttcatcgcaaccattgcaaggaagtcactgtatgaagaagggcagatgtgcggcatgctaaactgacgcgtggtggagaagaatgaccggtctgtgactgggctgatgccggtcacgtcatcggcagacaaccgtgctcccgcgttgcatctgcttccggcggagtggaggtaggtatgacccatcccatcggagggtcattcagacagcggccattgcagatctcctcccattaatgaagaaatgacagggtgatcccctgtgtccgacgagtgacggcgctgggcatcactcaaggacaagcggtgatttagcttccaggcggaggcgcgagtgaatatttggtcaagatagggtgggtccccacccaaaagaagagtagatagaagtagtgcatgtggtatccccttgagatataaaaggaggactttgcccacctaagaagagaaaaaaagaggggggagagagaaaaagaactagaggagaaggaagagggggagatcgagggagaaaaagaaccagaggagaaggaaaaagagggattctagagcttgaactctcttgctctccatttgctctgtaactccttcacacacagatccaccagaacacaggagtagggtattacgcttctcagcggcccgaacctgtatacatcgcccgtgtcttgtgcatttgctctctcgcgaacgttccatagatcgagggtgaagaatctcactcagcgcccccggccgaaccggcaaaggggggcctgcgcggtctcccggtgaggagccccacgctccgtcacaagcgaatgaaacttgcagagttcgtgcggatatcacgtacgtcgttttgcatagatcatccgattctattcgtattacatggcacgattccttagacatgttagcatgatttcaagttagtctccacacatgctcgtacatattatcaggataccgttacaaataatccataagaatcaattttactttcaaaaagaatatgccaactgaaataaaggatgatcgaagctgctgattccgtccatcatcatttcttgcccgatttgaagtaaagctggacgacaattcgagctcgtgtttgaagtctcgttatttggcttatgcttattcctataagccaaagtttaaattttagaacttaattttgaatttgaatttttggttttcttattgtactttattttaaagcatttgcttttgagtcgctaagaatatgtatataaaagatttgcacataaatagtcttttatttgataataacttattcggataagcacatgaataaataaaataatgagctatgattatttatctactgacatatatgtataaattaaattggccctaccccttacaacgcacaaacatcttttctagtctacttaaaaaaatacgcaagtattcctgtagaaattcttgtacgttgtcctacactcgatccgtatccaatcgctccaccacgtttgttcattgagggcgaaaccatcctataccaagcggttgaatcggactcactgttccgggcgaaaacctgcttgacttaatgtaacaccccaggtaaccacgtacctagagtgccacaccaaacatacactcaaaccgctaactcccaaaattattagaaattttggcagagtctcccctgtaaatatggacatccacgacaggcaattataagttaaactaataacaatatcattcccacaatacgatccatccttataatccatggggaagaaactattaaaaatctaaaagattattacaagaccgaaccatgatatagtttaagtatcattatggacctaagcaatatagtttgatagtatacagataaatgtgtatataagggtgctacttcccgcccatgcatgtcggtctcaatatgtacctaaaaccaattaaaacacaatagtgagtataaaaatactcaacaagtacaatatggagctagaaaacacatatacacattattgacaataaagcgtaaacagaaggctttctttctttaataggaaacacattttcaaacaccaagtcaaagaagatagtagttcccatcccgggcaggcatgaattaaaatagtagtttccatcccggacaatagtgaatacatcctagcatttgccggcaaagccgagtaagcgtgatcaacgcttacccacaggaacttgaataaagaaccaaattgcactcccatgactacgcatggtacttgaataattgaaaccggaatcaaagaaccaaattgaaaccatattgcacattcatggcaaacagggaacttgaattatttacccagaaccagaatccggaatattgaaacaagaataacatcgtaaacataggataaacatgaaaacctaaatggcgcgaataacaatatgaatataagcggtcacatgtcacatagaaatatatcggaaataaatagatagagcaaacaatccatcaatcacacacttagttcgtcatgcacttgccttcaatgaagggttggtatcatacacgatctgaaggaccaccacctaatcacaaataaaacctcagcaaacacattcaaacatgcatataaaacaatgaaaaaggtgaacctactgccccatcctatcaaaacgcaataacaaggaacgccgcttgcactataaacaatattgttgcttcaaacctttatatcttgaaatatgaaaaggctatgaccgcaaataaatatattttggaaatctacagaacaatgcctacaactcttatgtggaaattatatttttattatgccattaaaatggtctaatttgcgcttgaaagcaggcttcacaatctgtccagaaaattcagactatccgcactaaaacaatcataactggagttctacttgcccaatcagagtgtactttaccaatatggaaagctaagaaaaatctctacaactttgtctataggagtcttggctgttccactgtttagcccatccaaaaacagttcaatctactactatccagattatggcataaaaacaacagttatactcaaaaattcgtatcgtctaaaccacttgagataaaatcgcgcccttcggtcagaagatagatataaatattatctacaactttctagttatacactttcgcagaaaatatcatttagctctccgaaacttcaaaaaaccgaaacactgtaaatctgccaacatgcagaacagccaattcgaaccacaacaaacaaaactccttctctaaccttccttatccacaaattaaaccactaaaaccaccctagaacaactgatataacaaggggaaaaacctcacctataatttctttagagaacttgtgaggagacaataggggagactctgatctaatccctccttttactcctctcctcctcctcgttccatttttctatttcgctttttgatccaagctatgaaggtggagatctagggagggcaatttgttgtagaggggagagatgcgaacataggagaaggggaggaaggaggcgccggccagggagaggggtggcggcactatgaggggaggtgggagtcggttcccctctctcttggttttagggagaactaatgggctgggtttatgggccttctcatgttggcccacttctaaagatatttttcttttatttatttctgttaacatctttattttaacaagttaacccaaactaaaaaaactaaatatcttttaatatacggggtattacacttaaatacttaattaaggagatcgagctatagcacattactccatatatatgtggggctagctggccatttgtagtgtgatcgatgaagatgatagagacgatcgagatgcctaacttgctgttgctaattaattaacatgcatacacatatataatctaatctaactctacttaagaaaacactatgattgcgtggctctcccgcacctggcacacatacatgggaatggtacggaacaaagataaaaaacaagtcaagcaacggctctaatttcgagcgtgcatcaaatgcattaaccgagcaaaccacccaatcacgaaacaatacgtgatattgtgatatatgaccttgattttcctgaggacaacaaacggtgtaagcgggtgcttgaggccgggctggagagggcggcagtgttgggtgcactttatagggaggccactgattctcttggctacaactccatctgctgaggtggggggggggggggggggacaactgcaaggggagagccaatggcgatggtggtggcgcgacaacgaaggagggcgcggtaacaacgacgagcttagataggccacgccgcccctgatccatgtgcgggtggaaggggagagccgggggcgtggagaaagaggaagaatgggataattcagtggaaggggagagctgccgccgtgtccctctcccgtcgccgccatgttcctcctccggcgccgcgacttcaatctggacccttgcgctaccgccgcctggacgtcaactctatcgtcgctaggaacaatgacttgaaccctttctcatcttttctctcccgatcctacccatcccagacttaacggttagatgtgttttggtacctagcggtaccataaagatgctccatggtacgagcgtgatatgacaagtagtagtactagtacagtccatggtacattgagattcaattacaacaatcaattataatgagtaattaaacaactatataaacaatattatagtatactacatgataagatcgatagctctatagcaagctagcttactgcttgcaattatttctgtagatgcagccatggccggtgtagggcatggcgaacgcggcgcacgagtgaccctgcaggcagacttgcttgttcgccgtgagcccgctgaaggacccgccctgctgcagctgctcagctccgacgaccgccatcgccgccgggaacaccacctcgtcctccagctgctgccgccgccgccgcggaagcagcagcatcgcgcctgcagccgcgtacctgtcgacggccacttcgctgccgccgccgccggcgacgacgacgacggtgacggcgtggaggaggaggaggaggaggagggcggctgccagctgggcggaaacggccgccgccgccgggacgacgcggcggcgcatcgtgcacccgcgctttatatattttttcctcctctggccgatcgatatactaattgcgcgagcgagcttatggtggtagtagctgtgaacgcttggagtagaacaattattggaggttaagttgttgctgtcttacaaaatgtctccaagtgccaacaacagacatgtgagtccgtgactaactagcagtatactccatttgggtgcattgggaattggattttcatccctggatggacatccctcatttctgctatactctctccgtactcgtaaagtaagttgtttagaacagcgacacagtcttcaaaacataattttgactccttatttttataaaaatatttattgaaaagtgatatatgtatacttttatgaaagtatttttcaaagacaaatctattcatataatttttatattttcaattgagggttattcatgatttatattttcaaggtttgatttaaacattgtcctaaacgatttcctttacgggtacggagggagtatcatctaaatagttataaaaaaagtttgatgcaatttaataatatggattaatagaaattatatcattacacaaacatgcaagactaaattcaactttcacagaaaaaagaacaaattaacttcacaattatatttgttatttttgttccaacttgtagaagctaaatttgaacttacatatttgtggagtgatatattttatattaatctatcttatcatttttttaaaaaaatttattactatttagatgacatgcatgcaagaaataaggggatatcttctcaaagaaattgaaacactttcccggtgcatcgatcaaacacaaagaaatagtaataaaaaaaaaggccccatcaaaattggcaaaattcagaaatttcagggaaaaatggctacctttgagccaaatttctaataagcattaagaaaaactagcatattgtccgtgaagaaaattaacattaccatgttattatcatatcttaattgttgtagatatttgttactcatatgtggacatttttagctcacactgttttttccttcccacaaaaattaaaaactgatgaaagtagttgacatatggactctctagccctaaatatcatttatttatttattttaaaagttgggaattggtagtaatgttggtagcaaaaccaccaccatcactagctattctcttttataaaaagtatatatatggtgggtgaaagtgggaggtcaatagacttgtctgaagctgcaccaaaatgaacgaaattcgccgaatgtcgaccaatgcagtccgattcccaaaatactgtcctacgcagaacagtcccgctacagaaaggaacaatagaaacgctcgaaaaactcagctttcctatggttatgacgaagatacttgcagtgtgttgtgcgctgcttggtggctaaacagaatggcggcctagggatcaagaacgtgcctagacaaagtttatcagtaatttagtaatatttacaatatcaatcaataattaaatatattttcataataaatttgtcttaagttaaaaacgttactattttttcgataaaattaattgatcaaacttaaacttaaaataatatgactttgatcaaaataaaaacggcctattacctgaaatagagggagtacataataatacaggcatgtggagtaaataattaattaatacatgcatgcaattatcacaaatcgagctagcaggcaccaggcagatatgtgtgcttgcagctgctaattatcttttgcaaatgcagccatggcttagcttggccggaagcaggtgttgccgtacgtgcacggccgggtgtacgcccctcctggctgcttgccggcgcagccgccgcgggggcacgccggctggttcgcctccaaggcgccgtagccgcccccgccgccgcccgcaccaaccacgagaccgcccgggatgaggagctcctcctccggcgccaccacgtcctccaggcgttgccgccccagcgccgccgccatcatgccggcgagatcgtcgacgacgacgcggcggtgagcggtggcggtggcgccgctgccgctgctcttcttcccggcgacgatgaccaccctggcgctgtacccgccgccggccgccggcgccgccgcggccacggtggtgaggaggaggatgagaagggcggcgagggtgatgaggagcagctgcgccacgaggccggccggtcgccggtcgctcccgagcattatcgtcgtcgtcctggcggcgctcgatccagtttctctccgggcactttgggcgcgtgcttatatatatacgcacacataatgttactccctccgtttgaggttacaaagatgttttgatttggtcataggtcaaactactttaaatttaattaagtttatacacaaacacaaatataataatatttataatactaaattagttttattaaatcaataatcgaatatattttcataataaatttatgttgagttaaaaatattattattatttttacaacttgattaaatttgaaatagtttgaccttgatcaaaatcaaaaatcaaaacgtcttgtaacctgaaacgaatagggtaattagttagtgctactaattaatgagtaagtttatgaagttatatattgtcagttttttttcatgaaacacagtcacagtacagacgtatatgctcatatattaattatacacgtgcacgcactgctacaatgaacacatgcacacgtacacgttgagcaccttcgaaaactggaccaatatatatttagattgacaaagccactacatatatctcgtcgtcaactatacgtgcacttagtccccaatgaaacactttctagtccaacgagtctaggcagagagtttcatcggggatttggtacgtaacaatgttttaagacggatgaagtattaactaaatatatatgagcacacgtgctaaatttaaaactttatcctagctttatgtcgccgttgcaagtgaccgtgtttgcttaatactctctccgtccttaaatgtaagggattttgatgggatatgatacatcctagtacaacgaatctgtacatgcctctgtttagggacggagggagtataagcaatgcatcagcatatgttttgatcaactggaacgtacagtggtgctaatcgatcatgatcatcagtgccagcgcacgataaatatttcgtggcgatgatgattatatcccaagtcctactacacttgaactaccggagccactagcctctacgaaaactataagattggcaccttgaatatggtcatgtggtacccacgattgcaccaattttggtgatatttcaattccacctaaattaaaattaccgaaccccagttctacaaatcctgctctcttttagaagaaaatgcaacattaattttttactggttacaaacttacaattacttggactccagataggggaacgacagcaagactgaaactctgaaaattgcacaaaggttttaattaattaattaaacagaaccgggtctactcaatactcccttcgtactcataaaggaagttatttaggacagcgacacggtctccaaaacacaactttgacttcttatttatataaaaatatttattgaaaagtgatatatgtatacttttatgaaagtatttttcaagacaaatctattcatataatttttacattttcaaactcaacaacttgagagctattcatgatttatattcccaaggtttgacttaaacattgtcctaaacgacttcttttacgagtacggagggagtacagtttaatctaccctgttacgaatggattactgtttggatgacttatgcatgatacaagcctggcgcatacaagctagccactgttatatatgggctatacgcacgcttccattattaacaaagctctctctcaagctgctttggacacaactactactagtacatatataggagaccaggaatggcctcccattttattgagggctatagtacattaacacatatggcactttagtgctaaaactaagccacaaatatcaaccactcatatagttgcttcaaattcatggctacccgatagttacctcaatcttcttcttcttctttttttccaaaaccacaagagggagggaattttctactttatattaagaagaaaaaaaaagggagttgaatagtcccttgggcttgaaaaattggataaaaaaatcttacatctaaaaaccgataaaaacccatacgaagagcgaataaaaaagactgcattgacatagctattgtgactcctcacaagtcatcgttgtcaagctgacctagttatcttaattcttagaggccgacgatctcatacatatatcttcagtttttccatagggtatcttcagaagagaacataggctgtgcacataagtttcacgtgcacactccatacacaccaacaaataaatgtcactataagttctagaaaaaattgtgcatatactttcaatagtaatacatgctagaatctctattgtaaattatcttatacatgctccctttaacaagcttgatcttaagccttttggatccacccactggtacacaggagagctttggtagtgaccatcaggccacgaatgtagtttggtccttgagtgcagtagcatattagggctaaaagctagtgagtgcggaaactattctgatccctcaaggggatatcccctcgttatttacatgtcactcaaatagttatgaaaaagatttaaaaaaattgagaagatgtattaacatgtgatatatcgctctacaaatatacaagtttaaattcaacttttatatctcgcaaccaaaaagactgccaccgctactctggggaagcgagtcggggactaggggagaagagaacacgagtatggatggggagtgggggatttatggtttagttttgggctgggcttgtggccttttaggctgaactttgcgagtctatttttcagtttttctgccgctaagtgcagctatcttcggctattatagcggctatctccagctaagtgtagctattagcggccgataaatcgtagcgtcaaaattggtatatcctagctattctcctccccatccactctctccagagatttagaacattgctcccagtgcatcacgcataaagtgggtacgaataataatgtttgctttaattatacagttcccttgattctcagaaatggtttacatctccgatttctatctaagatacacattcataaatttattcgacatataaaaaaagatgataggtaatatgacaaacccctttaactcctctttattaccaactggtcttaaaccatatagatttagccatcaattctaattaacaccgaattaacacataaatgatcagagaactcgcagagccacactgaatattaaaccttcaccctcctccgtaaaaaagattaactcgtgatttttattcttagacgggagagagatctagtactacgccctttaaacaacaggagtagattaattaattactgcattagcaaatgcaagtacatacgttaatttgcaccaccgccggtttaccgtcatcatcaccgatgtgtcgcgtatacggcggcggccggatcgatcgatcacggccggcggtggccgcagcggttgccgtacgtgcacggccgtgtgtagggccgccctctggcggcgcacccgccggcgcgcgggcacgccggcctcgcccggctgaggcagccgtaggagaagccgccgccgccgccgtagtgtcgccttgctcggacggcgaggccgccgccgccgccgtcgaccaccgggagctccgtttccaccaccacctcatcctccagccgccgccgccgctggggatgatgatcgtgatccatcagcgccgcagccacgtcgacgtcgtcgtcgacgccgaccacgcggcagtggcggcggccagcagcgtcgtccgtagctgtcccggcgccggcggcgacaatgagtacgccggcgacgaggacgaagagcggcaatacaccgtactgcatcgttgtcgtcgtcatcatcacacatataactcggagaactatacacgtagtaactatatattgagttatctatatagacatgcaattgaataatatactcgctaaatatatgacgcctgaatttttaaataatatttgataatttttttattcaaaattttcacgtaaatataaaaatatttatatcatgcttaaagattatttgatgataagtcaagtcataataaaataaatgatagttatataatttttttaagaagacaaatagtctaacgttaataaaaaattaacggtgtcatatattaaaatataaaagtagtacatatccagcagatacgtacaacgatcacgtgaagacgtgattcatccctcatcgccatcgatcaaccacaacacgacgatcgatggagttacgatgcaaaacaccgaaacgccgctactacaccaggtggcaccatacgtacacatacgacacatgcaacggacacacgtcagatactcggatcacagtcaacacgaagaagaggcccagcagcccacagacaatttagttagcgcaaggcccacaaaactgtgcggctcggcccacatctcgacgccgagtttgaatttacgcccttcatacgcaataccagaaatagcgcgtcactcaacctacaaaaccaatatacttaaggtcttaggatagtatatatagtgtccaattttagatgatgcgataagtgagaccaacatatcagcgaccacatgtggcaagaaggaattagtggtggagggggctcggggtgtgtggtggcaaagtgagaggaagatgatggagcggctaccttgctcggctatttggtcaccagctactccctccgtctcaaaatgtttgacagcgttgacttttttaaacatgtttgaccgttcgtcttattcaaaaaattttacgaaatacataaaactatatgtatacataaaaatatatttaacaatgaatcaaatgataggaaaagaattaaaaaatacttaaatttttttgaataaaacgaacggtcaaacattttgggacggagggagtatatgaatattatgagatgttttgagtattttcttttcataattattgtatggtatttgaagaagcgacaagatcgtcgttgtccctcaagggggattaaatgggtaatttcccccaagtcacattcagcttattatacacaacgccaagcaaagcataagcggtcgtggtaatttaatcaatttcaaaatctctcggatataagtgctcataagaataaggtgtacgcacgtgtgtttataagggtaagtatacgaagtgttgtgagcgtcaacttttgcactgtactactccctccattcctaaatgtctgacgccgttgatttttttaaacatgttttaccgttcgtcttattcaaaaattttaagtaattattaattatttacctatcatttgattcattgttaaatatacttttatgtatacatataattttacatatttcacaaaagtttttgaataagatgaacggtcaaacatgtttagaaaagtcaacggcgtcaaacatttagggaaggagtgagtatttcttaggggaaaaaaaagcatgcatatatatggtagatcgagaggcatcgagagatcaaagtgcagtgagaagtgagaattaacccgatcgaagcacagtgaaacacacacacacgcgtgtgtgtgtatatatatatatatatatataacagtcgactgatgatcaaatcacgctttaacatggagtacgtagttgtacagctacagcttaatttgcacgattattcgattaatttgtttggtcgatctcgtcatctcatgcgtgcgtgcgtgcggcgcccggccggccggcggcggcgggcggcgccgccgcatcgcgataccatatcacggccgccgccccttcatgcacccgttggcatacgtgcacggccgggtgtaggcgtccgccccacgcccacgggcggcgcagccgcgcgggcacgccggccggtcggggatgagcgaccccgtggcgccgcgcggcggcggcggcttggtggcgaggctgccgcccaccaccgccggccggaggaggagctgatcgtccggcgccgccacctcctgcagcagctgccgcggcggcagcggcagcacggcggcgtggacgacgccgcctcctgcacccgcgtatccgtcgtcgccggcgacgaggacgacgtggatgaggaagaggaggaggacggcggcggccgggacagcaaggcggtggtggcgcatcgtgtagctgctggctagctagctagttcttgctagtgttgtgcgtgcacagtgctcatggctagctcaggattccatatatttctagggcttagattaattatgaatcaatgcatggctgagaaaaccgttgatagatatattgtactaagttgttgcagaattatatgttaatgctacttaggttgtgtttggatccatggactaaagtttagtccctgtcacatcggatgtttggacgctaatttggagtattaaacatagactaattacaaaactaattgcattaatgagagctaattcgcgagacaaatttttaagcctaattaattagcattacatccataattagcacatgttaactgtagcgttacatatgttaatcatggattaattaggctcaatagatttgtctcgcgaattagtccagagttatatggaatgggttttgtcattagtctacgtttaatatttttaattagtgtccaaacatccgatataacagggactaaagttttagtccttgatccaaacagtgccttagagcaatcaagattgaaatcgggagaaattaatttcaatcaccgaggttaatttaatttgatcgatcgatcgatcgttggtttgaattattctcagaaaacacttaatgttctcttaataattaattaaaataagaaaactaaatagtatactacgaacgctaattttaactataattaatatttgggacaaaggttctagtcataaaaatgacataatctcatgcacgtttattataacaaaatatttcataatgttaagtattttatttatagtttgtgcatgtctcaattgaattatcaaattaagttgtatcttaaagactttaaaaaaaatagatccaaagcatcattgtttcatggctggaggaatacacctcaatttgtgccaaagatgacaatatatactcttttcgattttgatttttaatgcatgacgtcgttgaatttaaatacacatttaaccatttttgttattcataggtattattttgtgcaaatataaaaaatataattcagaccgaatacctttattgataaaaaaatctaaaacatatgataataacgtatttttacaaaataagacaaattccaaacgaaacatatgcttaaaagtcaactcaattatatgttaaaaacgggtgggacgtagatgtcttcaagccaagaacaacatacagttcgatagttggtacattaggaaagtaggaataatgggcacataccatatagttagggcattatggcagtagaattttaggtctaaaagctacatcaaacattaaattgcttggagttaattaacgagtacttcatacatatacatacagctaggaataccttatatttggggcaacataacgtacttgcagtacagttgcagttccctgtatcttcagttaaaggttactcctcattgcaccttaattaatttggtctcaattgttcagttcaaaaatcaaaagtcctagtaaaaggaaagtgaacaattcacacgtcaggcaaatcaactttgttaatacttggagctgagtgggctttccatcagtgggccggcctttattgatactttcctgggcttctgacagaattaggtgcttcttagccttcctatacggacagaaaagatgtccaacttaataattacactattcttgttcatctcaaagaaaaaggaaaaaaagaaagaaaagggaattgtccaactcttctcggctgaacctacactctcaattttaagaaaatctccttttaaaacgaacaattgcttttcacaggttgctgtttatagttgaatttgttctcaggttttggttaatatattgacacgcaaagcttttaaagaaaaaatccgacaggtcctcttcttgcattctaaaagagaaccactgataaaatcatggcaaagttaactgttccactgacagtcaaattacgagatcacatttagttatggcaaagttaattaactgttcctaataagagaccctgtgaccatcctacctgtagttagtagtaagctatcatgggagctcacatgcagtcatggttacaggcaagcagcagcacatggacacaggtcttgccgcacatgaaaccgaactgatgaactcgacgcaatgcagccattggtatcctatactactcatgaagttaatctttattagtattatacttgttcttccaaggaaccaagaaaaaaatgtgctttttttttgtgtgtgtcctgatactgggaatctgcaatctacatacccccagatctgggtacagtaactgaatttgtatgttcagttcaggccatgcaggttttttttttttttcagttcagagttgcagttgcaggacatgctgattgatttagtttggtgatgctaatgtaatgttaatgttgatggagatggacaggagtcagggtgataaacaaaaggaaagagacagagactgcagcaacagcttaggtgtaatctctgatatgatacattccagttgcaatgtcatggatttgataattaggttgatcaggtagggtaggaactgtgctaaactagaactgctgataactttaaaaccaaagcaaatagacaagttcattagtttgatgcaggatacactcagacagaaaaacaagtttattagttaagtgtgatgcaggatatatatgatatgcagacagaacaagttcagattcttcagaaaaccaaaaagtttgaagaaaaatctcttgtcagcaatactttttcagtgcacactcaaatgtgattccctataaaaggcagacattataacaaaaagaagatgtggataaagagaatatcataaatcatatgtcacctcacatcacataaataaaagaaaaggagaagaagaaaaaaaatattaatttaattcttttttgctctcttttaactcctctgaccagtgacccaccctcaccttcttcaagctccctcctctgaagcctcttcttcttcctctgattcctctctccttccatcagcttaaacctctctctctctctctctctgttgtgtcagtgtgtgtgcgtggcttcgaagagcaagaagctagagcttggcgagcgttgacaatggcggagcataaggcggcgaagagcaagtccaagtcaaagagcggcggccatggccatgacgcggcggcggcgtccaagaagtcgaaaggcggcaaggccaaggcgaacaacgccgcggcggcggcgccggcgacgtcgctggacgcgctgttcaggccgtgcggcgacgtgaaggggctccggttcggcgcccagctcgtcacccgcgcgctcaccgtgcgccgcgccgcgccgctcgagctcccgcacctcctccgcgtcgccgacgagaggcagcgggaggcgccgctggcgttcgcgccgacgacgacggcgtacatcccgaccaacttcgccatcctggcgcaccacgcgtggcacaccctcacgctgggcctcggcaccaggaactccaaggccgcggtgttcgtcttcgagtccgccgccatgaaggccgccgccgacgccgcgtggccgcaggtcgtcccgctcggcgacgccgggaggcgcctcatccgcgcggcgcccggcgcgccggagatggcgaggttcaagttccgcaagggctgcgtcaccttctacgtctacgccgcgcgcaccgccggcgcccgcggcttcgcccgcgccgacgagctcagggccgtcgtcgaggccgtcgccaagctcaaggacttcctggaccacaccgccatgctcgcgctgccggggcagaggagcatcgacgtcgccgccgccgccgacgccgcggcggcggcgccggtgggcgtcgtgcattaatgcattgatgcatttcggctgcttttgtgacgaactgtgaatagagcttttatttttctttttctttttcttttggtgtgtaataattaattaattgattgatttcttgatgtgagttttttggttgagatgttgagcaaattcctttgattatgccttgtcaattgctgcattggcatgagcagatgtcaagtaattatactagcttgtaataagctgataaatttagaagttttcaggtagaaaactggaaactgatctttgcatttttttttaaattttgactcctttttgtttagttttcatgctgtgatgacttgtgtatttgagctgtataattttgtcagagctctgttcttgaatctgatttactccctctggacggaggtagtattttgtattatgtgggaagccatggctcaagacacaaatttttgcaaatttatgtgcaatcatggctcagaagtgctcagctgattgtgcattatgaattgaatcttccaacagagatgctttaggtggggagagcatccatgttgaattgaaccgaactgaactgaactctctaattgcttcaagttgagctgtactttacagccatgagattctaattctacggtcactataaataattgctttaccaatgtgaattatgtgatttgcaaggttgaaaactcgaagtctgtcattcttgctgtcgattccagggcaacatttgtgtgaccatcatggatgaatgggagacctggacagctgcggggttgattccaatagagtgatctgtggttggggcggccctgtttaaggaggggttttagtagctttttctctgcttttctgctcctggagttctgttcctggggcgttaggaaataatgtacattctcgctttctttcttaatatactttggccggcaagttttgccagctcggcgaaaaaaaagaaatacacagctcatctaaacaaaagctggagtccagcagtgagggccattgatgctttggaaacacagatccaagcatcaagaatgacaacctgtccatccaaaaggcagaggaaaaaagaacagatcaagaaccaaatcagtaatccgaagtacagaaagttcagacaggcaagctcaaaagggccaggaagcatcactccaatcttgatgccaaacattactaactacttacacaatgatgtatgcattgatgacacttgtgaaaaaaccacacatttcagagcaagcaggctcacaatgtcatgccaccgacaatgccacaaaattccaatctgtctttgctacttcatcaccacacaatgccatcacatgtagaacaattgcacaaccagattggagaagaaacagcaggtagtgggcagaaggtgaccaacctgccaacactggcgtgcacactgccaatgaccaatgctccaaaccatgagatgccaaagggagaaggtgatcatgtccaaacacattggaagcatccaatgattagggttgggtagctcaatctgggacgtcgatttcgcgatctgacgatcagaagcgtttcaactgtgttgtggttagtactatactgaagcaggtctaagttcattgacaaggtgaagagggttgatggaggattgcaagtatggtggcaaagcggttgtgctctacaaggaggttacatgtgcagcaattcactagccaatattgtaatactgatgaaaaaggacatgacatgatagctgatacatcaataatttgtagagaaagaacagtgagagatcttgcagtttggtggtgctgatggcatgatgagttcatgtgcatggtcctatattctttgctctcaatcaaagcagatgtctagagagagggcaagggaaaaggtgcctttacagatggtggatactattatatgtgaatcaagaccattgaacacagcaatggtaaaaaaatgtacttaaggttcctgtaacctcaggatatgaaattagacataacagaattagattacacgatataccataaaaatattcagaaatatggctcttctcaatagctaccaatatgggaatttaatataaatttattcaacttgatacccagcagtcgcccatcggtttaagaggaaaacatgatgtctctcgtatcctcaagtactcaaatatttaaggattacagattttatgctgacaaaattgccaacgttagaaaccaaacccaattgattagtcaggtgtggcaacaccctggttaagctcagcaaatctcatgccaaccctcatggagtgcttcaggaacttctcagcgcagcggcggacgcaggattcctcttgcttgtcgagggtcttccggcggaaagtgtccacgcagtctgtgaagcatcgttccacgagggagttgtacattctcaaactgtgcgttgacaacccaaaaaagtcagcatctttcagttgtaatttgacaagtgaaaggcaaatcaaagagttgatcagaatttacacatcaagaatgattgaatgaatgacataactttcatgaacacgggagaaagcaacggtaagattgcacagtgatgaggtagctgattgaaaaagcatcaaagaacacatgaaacatactaaagaagattgttttactgagctattttattgtactctatcttcagaaccatcctgtttattgactccattggttttgcctatgtcatgcatggtgacaaaccagctaaaaagacaatattccaagttccaacctatgtggttagttatcatgtacatgaacttaatggaaccatcccatcaatagacttcaacatagatttcgcaagctctgcaacaacaacaaaacattgaaaaataacatctacatttacatttctggccacagcatacagaccatgaacagaacttagctatcagaagagacataggtgtagaactagccatcaaatgaatactgccaaaccagcccaaaataaagtgcttctactcgcagaatacacttggtcacaacagcaactaggcatcagtatataatactccatactttcctattagagattatgatcaccatggctaatttgagaaatatgcaagtaaatgaaaagcatccttagctgatactacaatcagacgggcaaataccaaacccaagcaagaaaactgggaccgaacacacaaggatgcatctttcagccgcactacagtaataaccaacatacataatcctcactacaatcaatctctaaccgcacagctgaaaaattgtagaatcctaaaactaaatccccgtggatttggagtgtgtaagttcaccaagatcacacaaatctgtcagaattttccgcacgcacaacacaaacctcacctcgcaccgtatagtataatcgcgcgcacaagaaagtagccgcaaatcggccatcccgatcactcccatccatcgaggccgcaaaaaaaaactaaggaggcaccgccgaacgaatcccacatgcaagcagagcagccgcaatcgaaagaattcattcgttaattaacatgtagtgagggggcgcgggtggacctatcgcggatctggagctggtcgaccatggccgccatgcgcatcttgtcctcctccgggagaccgtcgaggtcgccgagcatgctcttgtccatcgccgccgccgccgccgggagaggaggaggaaggctagggttttggaggaagagaggagaggaagcgagatctaaaacctcgggaaattcctttttattttctttttattgatgtaatgggcttgttttaattgggccgggccacatgggcttcgaaattaagcccagtatgagaagtgtgaggcccatttgggatggaatcccacaagtttgtgtacaactcgaatgaattcttgcagataaaaaaaacgattctagtatatatttgttgacaaattttcttctaaaaattttgtcaaatgtaaatgtagtataattgtagcttacatttaactacaatgtaacttggttgtaactttcgtatgatattaaatcgtttgatttgcttcatgatttgtgcgagcgaggaagaaaaaagatcatggcatgcatatagctgaagcgatttggtcatatgacctccacttcgtggaatagtgtattactgtatataattgtgggatttttaaaagttgcatataaattatattatagttacatgctagttacaatataattacaatatgactgtattattttcttttttagataatggaataaacagactgtattatatttacatcaaacaaacatttatcgacaaatatatggacagtcttaaaaaaattactataatagaatggtgagtgcaagagaaaaatgagagagtaaaattcacatacacaaaacaatatttatatttcacaaacaacatttacataaagctagaaaccacatggatttccagccacgatttttgacacctgattcacacatggttgacacaaacacacacacacactgatggattcagtcacactcacacaggcatgagccatcacactggatggactctttatttattcatcatgtagacaggctggtgcattggcaattcagtcatagatcgccttggccttagcagttgcaggggttgcacctgcagctggagccacagctgcagccatgggcagcctcgccagattcagctgccttgccaaccccctcagagtgcctgcaaatcaacaaggcaaattcagaaacgaacagtttcaggcatggaaagatgtagatcacagcatattgttcatgtctgaatctcaggtaggattttttttacttcagtgaagttttttatcagtgaaaagattcagagatatcataccccttctcaggtgcaacacctaggacagtggttgcagtagtggtggtggtggtgatcttctcagccaggtcagggtacatctttctgaaccaagaaaacaaaaaacagaacgcaaaattcagtaactagaaatgacaactttttttttgtcttatggatggcttcaactgaatataacttcaaatcaattgtaagcagaactattggggctaacatagtattcttctatgatggaaagtacatcaaaatcatcaaagcttatgacagtttatgttgacaaatacatagcaaacatattcagaatcaatagctgaagatcgaacgtacccgcagccaccgccgcatccgcaggaaccgcagttgcaacttccaccgcacgacatcttgatcgtctgggtctcttgtaaactcttgaacttgtatagttggatgaaatgagagattgaaagcttgatatgaactcagttcagatatgcccccctatttatagtagtagtacgcttgagaataagctgcacaattatttcaagcattatcatgccagaaagatgtagctggttgaaatggccttgaaaaatcattatcattcattgacgtcagttttctatatgcatttcccggagttttaaaaaagcatatttgtttggggtgcaattgcgtcattcttagttgaagatagtattgataagtgccctaaaatataaaaatattgacgatttttatatacgccctccgtcccataaaaaacgaatctaatactagatgtgacataatctagtacgatgaatctggacatatgtatgtccagattcataatactaggatgtgtcacatctggtactagattggttttttatggaacggagggagtagttgcttacgtgcaaaggttgcattattttaattactgttaatctgaaccaagtttctggacaaatgtgatccaagttttggccaggttcaaatttgctttcacaccatgatgtcaacctttgcttaaggtcgacgccttgttgctcatatttaaatcaaacaatctgaataagtttcttgtatgaactggatttaaactttcatcacgaaaaaccgttgaatttgatcaagttcttagctgtttcaatcatgcatcagtactatgatgcagaccctttgcttaagatagatgcattattgcacagcttgaaattgaatacgtttcttgtatgagttgaattcaaatttcttgcttgaaccacgctggatttgattaagttccccaaaagtcaaacttataccagttccacccccaaaaggcacactcatcatcgtgcaaatgtcaatttaaatgagctaagagtatgaattgaaatatgcaaattcagttcccttgcatgaattgaattcaatggtttacacgaattgaaatataaaactgatgtgtcttgtattttttgaactcaagtttatcatacgccaagaattcagatccctcaagctactgaccaaatcatcgttccttcaaatccacggcgctagctagctacaccagacacgtacttaaacatatcttgtacacatcaaatttgattaacttgctgtacgaattcaatttaaatttattgcatgacctagactgcatttgagtttgatgattttatgaccaaatcaaacctgctctgaacatgttcatgtatcaactgaatttgaaatacgtgcctttaatcaaaccacaaatacatatacctcactgaatttgaagttgttgggatcgatatctcacagcatcgtatcagggtttacaatttcagatctaattttctgaaatttcgttattacccgtgggtgcctgtaggaggttcttccggacggattttttttaatttagcaaacaaaatcaaatttagtaattttcaatgctattcatttgaaatttctgatatttcggaatttcagtccctccggtaggcttcctgatggtagcgtgaaaatttcaggtcaaatgaacagaatttagaaatacacatagaccacactaatataataacaggctaagatcaggtaaagcagccatctgaccaagcaatgggaatctgtaatttctaccatagaatggtaaaaacaagagataatgagagaggaaaattcataaacaagccatcttatatttcactgaacaacattacacagggcacactggcaagatgatgaccagtaattcacacagccaaacatacagtgattgaacccatcacactggatggcctattttatttatttgttcatcacagataggcatgctggtgcatgctacggtcactaatcccttgatcttagcagttgcaggggttgcacttgcagctggagccgcagctgcagccatggtcggcctcaccggagccggcagcagcctcgaacaccgcttcgccgcgcctgcgtaagaaagaagcagacaaattcaggcatagaaagaatgttgtggtctgattcaaatctgaagctcagctggtactaatgagattcttcagttcagtttctttaagatgaaatataagctagatggctataccccttttcaggtgcaacaccgaggatcatggtatctgaggtggtgatggtggtgttcttctctgccagatcagggtacatctttctgaaccaagaaaaaaagcaggacataaaatgaatgtaaagtaactgataatgaattagtgataatctcttctcatcttacatgtaactttatctgaacaaactttgaactttgaagcaatggaaatagcatgttttttttatcatggaaagtacgttaaaatcaaccaaactttttgagcgaaaaaaaaatcaacaaaacgaagtaactgctatttctgaaagcttatttcagtttattttgataaatcagcatatgaaaaaagtacccgcagccgcagcttaaaccgcagttgcaacttccaccgcacgacatcttgattttttaggtctcttgtttaactcttcaggaaattgtgtgcaatgaagtgttgagaaagcttgaggtgagtttagtgcaattgcctagcagagcacatatgtccctctatttatagcttgcacaatatgtcaagcatgatcatgtcaggatgatctaagcaggtcgggaaggcaatttgtattgaattgaattcaaattttcttaccgatagatgcattgaatttgaggaaattcttagctgtttccatcttgcttcaatactatgatgctgacctttttgtttaagatagttgcattattgtgcaatttgaaattgatcacttttcgtgtacgtgttggattcaaattgctggcataaaacaagctgaatttaattaagtttccaaaaagtcaaatttgtaccacgcctaagtagatctagatccgtgtccgtccttgtgcaaatttaatttgaatgggtaaaagtaaaactcgattttcatactaagataacaccttttcttgtacgaatttgatttgaaaattcatgtgcaaattgaaatatagaacctgaagtttcttggacaacctgaattcttgggcacatgcacagcaaacttgattttattgattccacacaacatttgacacacaaggatacttgtggcttggaatcctcaggtttctgatcaggtgatcagaaattcagaacacacacatgttaggctttgctctaggattacctaggttagatctagttgggtggatctattggtttgatgtttgaactataaagattgaaaacgggagagggtttgatgtttgatgttttggttaccctccacccgcgtgaagtgtgtgagagagaacaacgacgacggcgatgacggctgtggcaatgacggtcgtagatgtcccggcgatgaggcgtggcacggaggtggcgtttcccgtcactggctgcaccccctctcaatcggattagggtttgtggggtggagttggcggcggcagcgaacctcgnacngtgnnccgccccggcctccacccccttttatatggcgcagtgtgacgggggcccaccagccattgggctggacgcccccgatcagggcgcgggtcaaggcccgactcaaggggagggagatccatctaacattctcccccttgatctcactatttcttttagcctttttctattccatcacagatttgcacatatagcatgtttcatcgtcacgctcaatcaccgatggattcgacagccactatacacatctctattcagaaacagatacttttacttttgggccctgtagtccaggattcataaggcttcccttaaacccatgccggctacatgttccttgaacacgttgggtggtaggcctttcgtgagcggatccgcgagctccttctgttttaatgtgctcgagactgattgtttgatcccggactttgtcttcacaacatagtactttatgtcaatgtgtttggcagcaccacttgactgattgttgtgagcgtacattactgcgggttcgttgtcgcagtataactttagtggtttctcaatactgtcaaccacctttaaactaggtatgaacttctttagccagttcacctgccccgttgcctcatagcatgctataaactcggcatacatagtagaccctacagtgatagtctgttttgagcttttccatgaaatagctcctcctgccagggtgaacacatatccccgatgttgactttgtattatcttttgcaaaatcagaatctgaataccccactatctagagcgattctgatcttctgtaagacagcatgaggccttttattccttgcaaataacgcaagactttctttaccaatttccagtgctctgggcctggattactctgaaatctgccaagtaacctgataacaaatgccaagtcaggtcgtgtgcacacttacgcgtactgtaggcttcctacagctgacgcatatggctttgttttcatttcattgagctcatattgatttctgggacattgcgatgccccatacttttcccctttgactataggagcaggtgtagcactgcatctgttcatgttgaatttcttcaacaccttttctatatgtcttttgagaaagtcccaatgcatactttgttttatctcggtgaatctctatgcccaaaacatatgaagcttcaccgagatctttcatgtcaaagtttgaggacaagaatttctttgtttcctgcagtagactgacatcactactagccagtagaatgtcatccacatacagaattaggaaaataaatctcccattcttaaactttgaataaatacagttgtcctcgacattctcttgaaacccaaatttctttattgtcccatcaaacttcaagtaccactgtctcgaagcttgctttaatccataaatggatcttttagacggcatcccatattttcgtttcctttcatgacaaaacctttcggttgcgccatgtatactttttcctccaaatctccatttagaaatgtcgtttttacatccatctgatgtaattccaaatcataatgtgccactagtgccattataatcctgaaggaatctttacaagagactggagaaaatgtttcattgtaattaatcccctctcgttgcgtgaagccttttgccacaagtcacgctttaaacttttctatattccctctggagtcatatttggttttgtagacccacttacagcctactattttcgctcctttaggaatttcttctaaatcccaaacatcgtttagtttcattgatttcatttcatctttcatggcttccaaccattcagacaagcgagcgcttctcatggcctcttcatatgaggtgggatcatcctccatatgtgactcttctatgttataaactttatagtcatcacggatagccgatcttctgactctttcagaccttctaggggcctccacatttggcacatcctatacctgaggctcttgttgagtctcctgtactggcacattatctgtttgaggctgttgcagctcctcctctggtgtggcaaccatttctattgaatcttgtataacaggttcctcattttcatttattgttgccacaggagaggtaacaacaggtgctggtaccacaatgacaggcattgcaggcacaccatcagcaggtagagagaagaaaggttcctgagtcgacggagcgggtacagacacccgcctctcctcaagatcaatttctcgaactactgagctccccctaatcatttcgccttccaagaagacggcatgtctcgtttctacaaactttgtataactatttggacagtagaacgatagccctttgatctttcaggatagccaataaaatggcagctgactgttttggatccaacttcccaatatttgggttaaatactttgtacaggactcccccacacacggaggtgagctagcg

SEQ ID NO: 82696 - DNA, 4698 bp, Oryza sativa
  unsure (1)..(4698): unsure at all n locations
cagccggagaatcaagcaatcaagttagtagctttctcgattgaacaccgtgatttcagcaacatatcctctccggattgcacccggaaacgcatctaatcaagaacccggacaccctccaagcagaagcaagtcaagcatcggcaaacaagacagagctcacctcacctgtggatcttggttgggccttcggggtggttgcggatgaggaggacgaacagaggcgagcgttgtggaagggagggagagagagagagagagagagagagagagagagagagagatcttggatgctttcttggtgttgcctttgcttgctcgcctcagctgctctttgttcttcttccggggaaggagagaaggggattgtgttgcgtagggggattagcagagcaggcaggcttagcgtgtgatgtttggcattattggggaaaacaaaacgggtttattactattaccccgttaaaatatagcaacatttaaacggacgccaaatactataaatctgaacgagcagtaatctctctgtcccataaaaaaccaaccagaattcatagtacacatgaactatccagatttattatacaacaaaacgttatctgtgttcatcatatcatattttaagttgtgtttattggatgaagcgaatattttttttccttttagtgttacccattacttataatttactgcttaacgtttttggcacgaagttaaaatgtagggctgtttttttttatttttctttgcatgtccacgttgttttgtgctacatatggctgagtagctgaataatttatgattattgttaacagttataaatgaatgattaaattataaagtgaaatggatttaaacaatattgtaagaaattcacatgtatatatatatttttaaaataattataccatttatgagttcaaaaaacatgtggtttaacatgttattcatactataaaaaacatgttatgtctacttatttatcacgttttgtattatccaacccgtcaaaatcctaaaactcggttttttcttcttctctttccatgtcctctttctctgctttttaaagcttggttttgcgatgactcacctctagttggagaagaaaacgaaatagataacatagaaggaaaaaaaagattgatgagaggagagcatatataccaataaaaaaaatctttgatataaaatttgatatttaatatttaggataatctttaggataaagttctcgtagaaatttaatattcaggacaatatttggtatacaatttaaaactttgaccataatctcacatgcttaagttcatataaaaaatgtgatttgccacaatgtcatacccttcttaaaattttacaaaatatttttacaaatattgatgactatcaaatctttaggaaagccagcaaagtacagcaaactacaggcaaatatagccgttcattttccattttccattggccatcgcatttgtgaagaaaaaaaaataaaaaaaaaataaaaatccccttgccctattccccacccaccaccagctcgccgctcctcgccgccgccgccgcggggcgtcattctctccggtgcgccgccgccgcgtcgggccccgaaatccgcctccccccaccactgttcttcgagagaggcctcccgttaactcgacggctgcgcccgcccagtcggagatgaagcaggtgagtttcaaccaaacctcgagccgttcggagatgggcggattggagatccgttcgggatttgacgatcggtttcattccctccaactaacccgtccaatttcgtcttgattttgctcctcttcgggggaaatttcgtctccccagtttaggtgccccctgcttgtgtagggctacaaatgttcctctcgcaatttcgtagtgcttagagtactttttggtatattatgcaagtgatttcagcatgcagctaactgtatctctttttaaaaggaaacggattatgtttggttaagagtttgagtttgtaaccatgccaaatctccgctgtatcagacatagcatcagaatatggttgaatgtgccttttaggattgtatgcatcaaagttgtctttaatatatatatactgacttaatcatacttattaacaagtctgaagtataatctgttcatcgaagtccctgccttgcgtattcctgagcttcattgttactatactactcaaagaggtggactgcgcgttttttgtttcgtgctcgtgttatgtaaccagctaatcattttttttttgcaggtgtcctgtagtgttgtaaataaatgttggcctacaatccatgcctctcaagaaactactatcaacggtctcataccgtgaagttgcaaagatcacaagctggccagataattttgcctcgcaaattgaggaaatctacgctatggcagaccaacttcactcagaggcagattgcaacgcattgttcctctgacctgagtacctcctgcagagaagaattgcccagctatttaacagttaatgttttgaaagatcagtcatgtgcaagacaaggaatctttcgtaaagtgattgtcatcttgaatcctaattctggatttcgcagctctcgtgaagttttctaccagaaagtacaaccaacattggaggtaaatgttcctgtttttcatttccagaaagttctttcagttgaactcgcaagaaaagggttttatttcaagtgcaacctgaaaattttaatttccttgaaatccagtggaaagcattgaagtttgtaatacgtgtgattttagatggaggggaagacattttagaacctttaatgtgttatttatatatttttgcatntgaattttgatttggtgcagctttcaggctttatgatgcaagttgttgaaacagcgtatgctggtcatgcacatgctcttgcttctactgttgatctcagcacatgtcctgatggtaatatcaattttgtatctgtatttgcagttacgtattgtacccttctatttcactatttgatttattattattttattgtttacaggtatcatatgtgttggaggtgatggaattgtgaatgaggttatcctctttcctatgcttctttctttccacaatctgatctgctgctctggtagcttattttgcgttattgctcctaggtgtaccttgtacttgttatttgcagtcaatacatataaattcatatttgttaaatgggcctgttgccactgctcttacaaaatttagcacttttagctcataattgcatttccatactgctaattagatattctttataattagtacaggttttgaatggtctacttggtagagatgatttggaagaggctattcaactgccaattgggataattccggctggttctgagaactcgttagtgtggactgttcttggtatcagagatcctgtttccgctgcaactactttagccaaggtaatttggtaatgttatattcaaatttgtgcgacatattaatatgtaaggctattattggaataaagtttcacacaggcaccgttcgaatccactgaaaagagtggattaaattttggattaaagtggcatgcttttcaaactgataaacggtgcgtttcgtgcgaaaactttttatatgaaagttgttctaaaatatcagattaatccatttttcaagtttgtaatgattaaaactcaattaatcacacgttattaccaccttcttttgcgtgaaacacttaatcttcatcttcaggagattcaaacaccaccacaatgtgcaaattagagagggtatacttaaattatgtactccaagaaaactcgttttaaggcagagataaatatagtgcatcattaccatatgcttttaatttggatttgttttggacagtccagtttatgtcatcacatattttggcagtagaaggtcctgcatgatacttaccatattttctctttatttctttccgctcccatcggatggcccaataagccaaagaataagccaaattttgaattttcaaacttaattttgagattgattttgagatatttttaacgtagttttttttcagcattggcttttaagttacaaagaacacatatataaaagttttacctacaaatttatttttattccctaataagccgttttggcttattagaaaaaaagccaaccgatgggggccttcatttattatatatctgtattcttctgagcatgtgcaccattgattttcaagctagaaagtttacgacctaaacaatagtataaaaaatattttatatttttaaagttcactactgggataaggattttcgtttggtctcacataggaaatgaatctcattctgtagggtggtatcactccaatagacgtgttctctgtcaaacggacccaagctggaattactcatttcggtttgacagcttcctactatggttttgtggctgatggtaagtcttcattcttctgcacaactgcacatgtaattcttgaagtgatacatttgaatttgataccttcattctattttagataattcaatcattagatgatgttactctatgtaagaaatgagctagacaatcgtatgcaagctagggcctacatgaattcactgtagattatgttagtaagaaaggaagaaaggtgaaaatagcgaatacttataatcatgcaatctatttaggat

SEQ ID NO: 82697 - DNA, 3332 bp, Oryza sativa
  unsure (1)..(3332): unsure at all n locations
gtatttttaggatttaagtgtattccaaaatagttgtcacaatagagtattaattgtctcatcaatcaattctcattcaaatttttttctattctacccttaaccactcttacctatatttcatttaatgagtggcatcgtaatctttttttaaaaccttaatatatgatagtaacctaaaattacaattattttagtatggaggtagtatttatttttttctttgagaaacacagtacaaacgtaaacactcacaacgtgcgtaaatgcacgcatgcacgccgtatccctattagcaccttttcggaaatttcggtctcctgatgggaactaaaaacacaatttttttaattaagaaaaaatattcatatgtttttaccggaaaatatacttttgagtccaaaaatattaatatgtggccaaaatcagttcaattgaaccttttccgtccaaaattccgagttttgtttccattgttgcctggagatatatatatttttagtggagtgccggaaatattttggatttcccacatagagccctcactacatgggtccaataggttgttaaaaattcctaatttgttcgaattcggtaaacataattgttcaaattcagccaaaacatgctcaagttcaaaaactgcagcaaaacatcattcaaaatttccgaaatttaccaaaatttcatctttttttttcttgcaataggctgcggcggagttcatcggcacgttcatcctggtcttcacggtgctgtccaccgtcgtgatggacgcgcggcacggcggcgccgagaccctcgtcggcgtggcggcgtcggcggggctggccgtcgtcgccgtcgtcctctccgtggtgcacatctcgggctcccacctcaacccggcggtgagcctcgccatggccgcgctcggccacctcccgccggcccacctcctcccctacgcggcggtgcagacggcggcctccctcgccgccgcgttcctcgccaagggcgtgtaccggccggcgcggccggccgtcatggcgaccgtgccggccgccggcgtcggcgccggcgaggcgttcgtcgtcgaggtggcgctcaccttcgtgctcgtgttcgtcatcaccgccgtcgccactgacccgagctcggcaagtgctcaatctttaatatttttcatcttttaccgtgcaattgaagagaattttggtcggataatttcaaatttggagatatttggaatttactctatttgagtaaattgcgctttgcaccaggtaaagtgcatctagtttcactgtatgaaacaaatcgaaattttatcaaattttataaaatatggatgaaactgtatgaaacgcggtctaaattaaaaaaaatcacaagtttctctcatggtttataagatttttcaatagttatatgacacaatcttgtgcaaaatggaaattattttgatatacttggtgcaaagtgaaaatctatattactaaagctaaacgggtgattgaatcgtactcacattgggagggagaaccggagatgttctagagaatacgggaaaaaaaaaacttcaggtgggcacacacctagccctgacaccccattcgcgtgcgcctgtccatggcatcgctaaccacaagcgggtccagctgaagcccaggagccccgatagccacctgggccttttgaccatagctaggtttgctagcaacctagcttacgcacacgcatgcatatatgcaatatatgagaaagaaataatgaactgaaaaacagaaatcttaagtgggagttaaaaaattagcacacgccccagttaacacccttccaaattttgtgtttacaaggaatgtcttttattccctttgagagcaatatttgacatctcctattctaatagagaactgctacatataccatgaaacctcttacgatcaacgtatgatgcatgtggcaaatgtggggcccagcatgtttccatagcccaatcatacgcatgcaagacatgatcgtaaaaaaatcgtacctattctatcgtatgcatagcaatttccattctaatattattgtcatccattcattattgttttctccgtatttaaatatatgacattgctaagatatgggcataatattaaacaatccggcactaaagaaaaactataaatactttattcttaaatattctatatgcgaccacacataaaagactattaagtacttcttccgtttcacgatgtaagtcattacattgtgaaacggagggagtagtatatacaggctataaaatagaaagcgtgtcaggcacgctaactttctagtatatattaaacctggtgcaaaatgaaacaagaatacattctacccggtgtaaagtggaatttactcaattttgtttgaatttgtgcagagcaaggagctggtggccattgcgattgctgcagcgatcatgatgaacgctctcgtcggagggtacgtacgtgagaatgacaaattaatcataattttaagctcattacatttgctttatttggatcaagaagaaatgctaataatatttgggaattattcaggccgtcgacggggccgtcgatgaacccggcgaggacgatcggggcggcggtggcgacgggcgagtacaggcaaatgtggatctacctcgtcgcgccgccgctcggcgccatcgccggagcagccacttacactctcatcaagccctaatctcatcttaatttcttctcatttcttcttgtagatggtggtgaatgtgttcttgtgtagtattaatattaaattagttgtattttttcgattgattctagtattatgaatggttggattcttacatttcagcataacattgatgagctagttagtggtgatatgataattacatgcataaccaatctcataatgcatgcatttataatcttgtggttgttatttctggagattgggaactaccagatggtgatttgtcagtgtgagagacagacaaactgatctttcaaaaccaggaaacaaaacattatcgcaacatgagaacatgagagtgttaataacaacactttgaatcgcatagattcagtgagttgcagttgtacgtttaaaagaagcagaaggatagatgtattaaacacatcaagttgctagttgatggacaacgcaaatatttccttaaaaaatagagtaaatttcacaaaactacatgttttatagtccaaattatagaaaactatatacatattgacacgtggcactcaagtacatatattttggtagtgtagttncacaaaaccacactatccatgaacagattcacatgtaagatgacataattg

SEQ ID NO: 82698 - DNA, 5119 bp, Oryza sativa
gtgcgatggctggtaataggatgccacgttcttgttctaagtggaacacccacgtcatatcacggctgaatccattaattgatagtgtggttttgtgaaactatactaccaaaatatacgtacttaagcgccaagtgtcaaagtgtgtgtggttttctacaatttggaccacaaaacatatagttttgtgaaatttactctaaaaaaatgaatgtacaaatatcagaccaacccaaaattaaaattacattggtggcatctgcactacagcatttcctaacatgccacttggtcatgaataaaaagaatttgatgtatttacatttggctgaaattcatcgatcggtaagttccaagaaccatggaactcctgctgcaaaagtactccctccgtcccagaatataagaagttttagggttgggtatgattattaagaaagtaggcttcttatagggttggatacgattattaagaaagtaagtagaaatgagtggtagagggttatgattggatgagtagtggaggtaggtgtaaaaagtgaatgatggaggatggtgatggatggtgattgattagaaagagaatgttgatggacaatttgttatattttgggacaaatcctgagggctaaaagttattatattttgagacagagggagtacatcgtttcggttagtcacaagtatatatatatacagacatatatgtacctagaagaaataaatttagtaatttgcatgaatctctccataatttttgttctacgtgtttgtaactaaagtttattccaacatatgccccagtgccagcaattgatttgatggcaaccctgttgctctcgcttggctccattgtcggcacaccaactgctgcaacactaccattgctttccttctcttccctactcatctcaaaggccatgagcaatgtctgaatttccgaacttggatcagtggtgtggttgatgtttggatgaacagcacggtgcagtgaactgtactatatactgttatatgacactgttgattttcgcacaaacgtttgacccattcgtattattaaaaaatttagtacaaatatgttaaagtataagttaggattatactctatttaatgataaaataagtcactacaaaataaattatatttatataattttattaataagaccaatgattaaacgttatgtaaaaagttaacggcatcatacattttaaaatgcacggagtatatttgtgccttgacttccgcgcactaagagcgagccgtgtgtggcatgcatggtgctaactgttaatagttgataccatcaaagatcagaatttgcagcggcaggcagacaccggctccggatcatcgtctgtctgcaattctgcatccatggtttttggaaaggcaggatttggcaaggtcaacgcatgcatcctcttggccttgagttcttgcatagaagcttcaagctgctgctggaaaattatccctctaacagcaaggtttaactaataattatggttgtatcaactctctaatccagctttggtttgcagggattgatcaattaatataacaagatcaaaagagaaaaattaacacgttttttctgctaaaccaacaggtcaaacaatctcatctacagctaactgcagaatattaattcaaacgttaatcaattaattctgtcttaaccagagatcaattcagagctgacgacaacacacaagaagaaatactataattatttgacagatatactacaacaactggtgcttctcatttggtgctcgaatactcgagaagagggtaagttgacattttaatttgaacaattaattaattaattaattatatacttaactaatcacattgctcttcttccccgcggcatcccaattccatttccgcttttccgaaatccatggatagattgattcagcaggtgcttcggcggccacagcctccccgtgcaaattttcagagttcattggtttcaaagattcaaatcttttttttgcgcatgcgtacaccgagctgtatttcataggcctatatatacagcatccctcatgcagcatgccatgctcatctcatccaagattcagacaaaaacattcttttgtctacaacaagatcaagaaacccaaaagctaagcattagctcatccatcttaatccatcagagttgattagctagtagttgagagttgattagtagcttgcctttgaacatggaagggggcaagatgagcagcatgggcatggatgctgcttcagcttctgttactgtccctcccatgcagatgcaggcaggtgatcagagcaacaggatcgccatcatcatctctccaagagccgggagctccaagatcctgccattcgagcttgtcaatggtgccgccaatgccggctcgcaacggcacgctgatccagcagaatccactcctgaagctcatcatcatctatggcatccagtagacctcccaaagataaaaccaccagttcctcttgtcaagaaggtactgaaactttgacagaaaacatttcttcagttcagagtatttatgttcttcagatgaagaagctctgaatttgtgacaatattgttgcttcaactttcaggtgggtgcagagttctttggcacattcacactgatcttcacagtgctgtccaccatcatcatggatgaacaacacaaaggtgtagagtccctcctcggcatcgcgacatcggcaggattagcagtgacagtactggttctgtcactcatccacatttcaggctgccacctgaacccggctgtcagcattgccatgactgtctttggtcatcttcctcctgctcatcttcttccttacattgctgcacaaatcctcggctcgatcaccgcatcgttcgccgtcaaagggatgtatcatccggtgaaccccgggattgtgacggtgccaaaggttgggacagtggaagcattcttcctggagtttgttacaacgtttgtcctactgttcatcatcactgctcttgccactgaccccaatgcagtaagtaaatttcctagctacttttatcacattttattcctttttcttgtatctctttgtctgaatttatgttgtgctcgtgtgctgatgatgttcaaataatgtttgttcaggttaaagagctgatagcagtggcagtcggagcaacaatcatgatgaacgctcttgtcgcagggtatgtacacatagatcgattattattcagaaatgatccgcatactaaacatgcagttgttttctaaaaaaatattaaacatgcagttgaacacttgttaaactttttttttaaaattaataaaaacacttgttaaagtagccgtgctaattaattaggttggctcatttttctctttttgtatagttaattcctaagcttaattgtttctgttttgaatatttttggaacaggccatcgacaggagcatcaatgaatccagcaagaacacttggcccggccattgcaacagggagatacacacagatttgggtttatttggttgctaccccacttggtgctgtagctggagaagggttttattttgcaatcaagctgtagttaccttcaggcaagaacaatattcaatcgtagaactagtgtaaaatcggtgtgtgtgtatttgtatgtgcagttataacataaaaaaatgttttcctttttgcagggaaaaaaaagtgatcattggagcatgttaaactacctgaacttaaatacagcacattctttacaaattcatgatattgatcaagcagcatgttaggactgcctaagatgtagatgtatacacaaagtagtagtgatgatgaattggtggtctctcttgtactgaaattgtacagttcattttttttcattttaatgtataaataataaaatatatacagttcaatttgaattgctagtattcatattcctccagtggtgggcagtttatgttttgaaatgtactccctttctctaaaaatataatgtgtgtatgcttttattaaaaatcagcatctgcaacttttgattagtgatcgaactaacaaaatgtttggtgccgcgcatactattggatttttgtacgacattaattccgcaattgtcaatgatccaagaattacaatgttacaggccctactaaaagctaatacgtcttatatttggagaaggaggaagcatcgaatggggtgggcccacttcaattcatgggtattcaaatgaatacccaagatttttgcacaaaaaatacatatatgaagtatatattccatatgcatatatgaaaaaaagggaaaaaggcctacctattcaaaagaagcccaactaaaaacgatttctatccctcccaccatctttctccccactatttcaggcccattggccaaataaagaaaagcccaaacatctaaccctatctctccacctcaccaccatccaactctcccctcccccgtgacagccgccaggctgaggcgtcagccgcccgactgcccggaggagacgacgcgccggcgcgccgccactcgctggtccgcgctccgccgccggcccgcccgaggagacgacgtgccggctgcctctgccctccagcctccagcagtccagccgtcggccgccgcgtaggcgcgcacggcgccgtcggcgccttggcggctcgggcgctcggcgcatccggcatccccctgcggcgcccgtctccatgctccagccgccgccgcccgccggtgcggcgccgcggcgacgagttgccgcctggcgcctgcctgcctgcctacgctccaccgaggcaccgaccacggcagcctgccagcccgcaatcgcaggggcgcagggcgccgcgccgcgtcgccgccaccggccaccgacctgccgttgccgtcgacgacgaggtgacgaagtcggtacctcactgagacaatgactcactaactcttccctagttggctaagtaggaactttggattagaaatttatgatttaattcatacttgaatgactgaatgtctgaatctagcatggatattgttcatacatttttgatttaaaatttgaatctaggaatgatttatggttatcaactgaaccgctatattagtgat

SEQ ID NO: 82699 - DNA, 7270 bp, Oryza sativa
  unsure (1)..(7270): unsure at all n locations
cttttgaagttgcttatagagtaagacgtgcatgtgtacgttcaatagagtgaggatgtgtacgctgtgaacacctgcgatgcattgtactgtgtttcttaaaaaaaatgttattacttggacgacaggtaatgtaaaaacgaagccaggcctactgatactaacgatcacggcccatcaacgcacgtcgatgcccattcgaggccatcaacacggcccacccagaaacggccgcatcaatccgggcacgaatctcgaggcagagccccaccgccttccgcttcgcttcgagagccgcgtagcgagagacaaaaacccctctcgtcctcctcccgccgccgccgtctcgacctcgcagcctagggtttgcccccctctcctccttccagaagcttctagacgctcgtggggggagcatccgccgccgcagcagccatggcgtccaccaaggtccagcgtatcatgacccagcccatcgtacgctcctctctttctcccctcttcctcttcttccccctttggtctcagaagccatggattgtttcagctgtatttttcctaatatgtttgctaatcttttttttggtgtttttctccttgtgattttggcgggcgtcgtcggtggcggcagaacctcatcttccggttcctccagagcgtaagtgaattgggaaatttcggtgttttttttcttcttttttttgactgtcgacgtgtggttggtttgaaattaaccaaatttgatttggtggtgcagaaagcgcgcatccagatctggctgttcgagcagaaggatctccggattgagggccggatcattgtgagttcctaagctgatctcttattcagaattttagattttagtgctattcctctagttgaacacacaataagcaatggaagtgcgtgtagtatgaagattatgaatggggaattcttgtaggggatgagttacatagatatatatatttttgaggttaatgttgcaacttaaatcctaaagagcctaaccagtagagaacaaataagagaaccctatagtaagtgcggagcacatcttttggtctgttttgttgaaaccaaacatgcaaatgcatctccgcaaattgtgattccttgggaatccatatgagcattatcgaatcttctgctgatgttatcagtcggaggctactagtaagctcttaatttgatcgctaactgatggcatgagctcagtacactagaagggtctcaacttaagctagatagatgttattagacaggccaatttcaaaagctgaaacatatcgagattcagattttgaaaattaacaaacaactatgcttatatgagttattgtccttccacttgaaccccggaaaaacacacctttttccatataaaagctaacttttgtctcatcagataatgattgaatttccgcaagatgtcatcagataatgattgaatttccgcaagatgttttctataatgtgtccatgtagggtcataggcattatctgagtttggaagagctaggtttatatttactttgattgccattcagactagaaggaaaggttttacagtgaatgccaatcatattgtttatacttatttggtgtttcagtgtttgcaatagaattagaaatgcagtaatgaccagtagctgtattatgtcattgctgaattttctattgtcctagatgaaatagtcctatgggcaaacggttatcccaaatctggcgccacttgcaggacctactttgtagcttctagtgttggctaaatatttgttcttcagtgcagtactcgctgattaatctatcatttgacgttaagctcatgagtaacttggatcaacctgaaccattgggccactattacataggattatctaacaatactatgtacagctccaggaaccttaaaaagctcatttgttttactacttgttacattcttacccttcacctttttatataaccattttagatgacagtataatgcttatgctatgtgcttggttgccttcctgttgtttcatggtttgctgatgtggcgtatacatattttttcaatttctttcgtggtttgctgatcatttctttccatgtctgaattgcattgaaataccattctgcgaataaatttaaatttagaattcgagctaaagatgtggcttgttctttgtgagtgttactgtacgttcaagagccatattcagtttgaatgctttctcagtatgtctgtgctggtttgcatgcatatatggagtatttacgctagctgtatatgtttggcagggctttgatgagtacatgaatttggtccttgatgatgctgaggaaatcaacgttaagaaggatactaggaaatcattgggtcagttaatttgcaacaatatttgttactatttttaattaattagatggaacattctgactataatattgttggaaatgatttgcaggtaggatactattgaaaggcgataacataactctgatgatgaacacgtaaggattatcattaaactcaatatctgaactcctgtaattgcatgtgacgtgttctctaacatctgcaatttcaacttctgcagtgggaagtgaattttctccccaaggttggcgtttgtgactttgtgtcgattagtcccgtgatactttgtactccatctagataatcagagaatgaaatgcatgtagcatgtcatcgtcatcgtcctcaattgaggatatgtaacggctgttagcaacctatgaactctgtgaactctaggcaaggttgttgagataatgagttgctcacttgtgtgtttaagattcctgatcccgtgaatcaatcctgctcacttataacacggacaattggagcaattcttgttgtacctcgtcttcttcccgtatctatgttatagatagtcttgagcatgaatgcatgatcgtgaattactaaaatgcaggatgaacacatgataaacatatgttatgcacagttctattagggacatggcattactgccatattgcttgaaaaggaaatctcatggagatcttgttgatgtcttctgtttatatactgtgttgctagagatatggtgagttgttaagggaataatccatatcgtttaccccctaaagctcaataaaaaccaataaaaaccttatggtgtgggttgatatttcggatctgtgaaataatcaaagtttttctctcacactctctacatgactacacaaattagtgaattaccgtggatctaccattgtgaacttgaactgtgttagataaacatcacgatcatcatctattattgaatataaatctaaattcgcacgaattttgaaatcagagctcaaaaacgtaccctaaacatgtgtacaaaatcacaattgtatatcacatggtaaaaaacattcagaacgccagagtacaaacaagctaggatcaaaagagggagaaccacttggttttagacttgttcttgctcatcatctccttcctcttcctctccctctccttctcaagtttttcttcttcttcctcctcctcgtcctcgctactgacgctgctgctcgtctgatccttctcttcctcctcctcgtcgtcatccttcttggtggatttcgccttgccggcgccggccgtggcgacgtcgaaccgcgcggcgtccatcgcccaccgcatcaccttgtccacctcgtcgtcctcgtcctcgtccgactccccgcccagatcctccagcctcaccctcgtctccttctccggcnccgccgcccccttcagcgctgcgaaacgcgcctccagctcgtccatcccgccggcggctgcggcggagggagcatcgggttgcttcggcttcggatccggcgggcggtgagacctgagcgcgtcgaagcggcgggcgaggtcggcgtcgaggggatctgcggcggcggcggcggcggggtggtcgagcgagggaggaagattcggagcggtggccgaggacgacgaggagacgaggtgggagttcgcctgcagcttgagcatcaccgcgtcctgcgccgcgcggaggagcgcttccacctccgcctcttcgccgccggtgacggccgccttccggccgccgccgccgccgctcatcgtggtggactcgtgggtgggggacttttttctaatttttctccactttgtttgctgctttaatgacagtatggtgggcccaaaaattgtactaggccaacatgagtagagcccaatttagtgatcaatgggccgggccgattttacggcccacgatgccaagctattattaatcccagcctaattctaatccctaccttaattaaaccatttttccccacagaaaaaaaatattattaactaaacaaaaaccatcctgctccactgtgcctttcaatccacgcgtccgtcgccgtcgccgcctcgcgcgcatggaccaccacccgccgccgccgtcgccgccgcgggactccggcggcagcctcgaggtgcgcctcttctacgtccgcctctcgccgcgggggcccaccccaccgccccgcctcgcgctcgcgctgcgcagcagccgcggcggcgacgaggaggaggccccgacgcccctttccctcccgctccgcctcgatcgccgggacccggcctccggcgaggccacctacgtgtccaccgcgttcgcccgcctccccccaccctcggcggccttcgaggtcgccgaccaccgcggcgccgcgctgctccgcggctctcttcgccggtgccctgatgccaagcccgattcctcccccgcctgggcaatcgactgcatccccgccgcgggggcggaggcggagacctccgcgttcgaggtctacgtcgccggatgctgcgccggcgagcccgccgtcctcacgtgcgctcttcggctagccacccccgaagaacagaaagctgccggcgggttggtccgccgccgatcgccgacttcgaacgtgagtatattttaattaaggttatgatgcttgattttatccattagtatgacttgttaacgaaatatctgtgatggacaaacaattatagcaacagaattgggtttctaatatgtttataattgtgtagacttcagaatgtggctgtgtggcgtgaggtcacaagcaaagcttatcataacacaaattggtggacttttgtcctaattcttggctgtgtgaaaatgtttgtttcaatcctgcttatgtattttgcttgtaggttcaaagttactcttaattagcaggggaaccttgttgttatctatactgttgctgtcagcagaggagttaggaaatttttcaagcccgggcaaactcaaatatacctaatatttgctacaatatttctaactttaatcctttgaaaaaaaaataaaaattcaatggtgtatttgacggcgagcctgggcggctgcctgtgcaggccgggtggtggctccgccactggttgctgtgtatagtatggtggttatggttggtaatagtagagctatctaatgttaacatgcttttccatattattaaaagaattatcttgactatttgtgtactacaactatagctttcttgtgttaaagacttaaaatacataatcgaactgttgaacaagacctgattcatacttctaagtttgacattcatactgtagaatatacaatgcttacaacaagcttcaactcagcctttggttgtctgtgctgatttttaaattgtgttaaaaaggttgtgaaaaaactatcattctatttggtaaatcagcgtaagatagataattgtttttcctagaaaagtataacaagtggcatatattatgtatgaacggtataattgtggttttgaagtgcttgtctggaagttgaaataggtattgttatacgaggtttcgacatttcacatttgctgataacacaccagttacagttagtaccttaggtttgtaaaatcagtctcttagttcaaatgccacaataggtaatgctggttttggttgatccttgttggttcttcatgaattatatgtggattgtggagttttcttttgacaatgcttgccaagttatggtcaagctagacagaggtcattatcatagcctcatatgcatgctaatgtcagggatgtttggttttatcttctatgactggatgctcagtgacatttgaaatgacaagacattggaaagttagggggtaattagactttcttatagcaaatgcgataatgtttgctttgatcctttgcttgttggatgaccgaaacaagatggtttacgaataaacatgtgctgtttaagcttataattcagacgttatgctcaaattcctattaattagtataaactgctttggcaggctgctggtgatgaagatgtcaatggaagtatacagcatccagaaggttggtactccgacgatgatgacgggcaactcacatggttcaatgctggtgttagagttggtgttgggattggcctgggagtttgtgtgggtgttggtataggtgttggcctcctcatgagctcataccaagcaacagccagaagcctgaagaggcgattcttctaacgccgttgcgttgaatacacaaacttttgatggccggtagcagtatagagttggtttggttctgtttcaaagggcagaaatatcattgtatagttggtggatgtgttgtttatgtgtgaggtgttgtgttgcttttgcttgtgcagtttttgagcccctgtgcatccctctcagttctatgtgaactgtgaatgtcctctgacatgtgaaaatgttctcaactttcaacaaggagaaactgatgaatgggaatgatggattgccaattcagtcatctacgtttgcataaggctggaaactactggaggtattatttctctctctctttgtaatataatgatcagatattgtgaacgaaatggaagtactttagtgaacaactttctactagtacttactagtatttgccagcaccatataattattaacacttctttttttttttgcgcatttcttgtgtttttttaatctgtgcagttaaacactgtttagcaatggcagaatgtcaggattatatatatatatatatatatatatatatatatatatatatatatatatatatatatatatatatatatatatatatatatatatatatatatatattatataaactgaaacaaccactcactgaatattttggttttccgtaggaaattttgtggcaatcgtgtatcacgctgaaatataatagaaaatggaa

SEQ ID NO: 82700 - DNA, 113790 bp, Oryza sativa
caaatgaagagttaggattaaatggaagagggaaaataaacggttaggatttaaaaatatcttttggtgggtggaaaatcatttccttttctcgttagccaaacactgccttcacttacagagatacattagcaatctaccatgtgcacagccgagtggacacaactaaagatgctctcattttttttggggggcccaaagtggctacctgctttgtttctcgatgcctgtttaactgtagaatagtaatgaagctagaatatccctaccagctggctacctctaaatgataaaattggaaccaacagaactgcttcagtgcttcgctatatctagattattgctcatctcgtgtcaagattcgcagatttcaaatagattagagtgccaacatttcaatagtcacaaattgcagattataattatgatatggcagtgacaatatgacatggtatttgacaaaaccatgaagtatgtagcggtactagatcaaccactggtaataaaacatgtctaggctctagaatcctataaatgtaacggaagattaccggcctctgccatgttccttcaggcattcttgaaaaatattcaggcgactgaaaccatagtacaaacaacaagcagcagagggacgtcaaaatctcaggtaacaatgtagcaaagtttccagcaatttcaatcctcaatctttcgagttttcatgaagcaaaacatactcccggctgcaaaaaaacaataaaacatttgtcagattttagatgaacggggttagtaaggaggcatatagaagcagaggctgatcatcattatattatatttacttttgggcaactagactcaaaagggccctaaatatggattagaaatagtaccatccatctaagaacaaaaagatgaggcttctgaaggatgaaaaccgtatgaactaggaaggggcactgtgtgcaaacttcaaaatctccacagctccgaacatatgttatacatttatacatgattgagcttgcaagtcaaggctccataaaggaaaattatgtttccataatgtagacattttgagattccttgatatttataaacattaatataccacctaaagattcatttggaaattgtattgagaaaaacaattaggcgtagtttacaaagatattacttagattattggagaaaaaatgtttatcccaagagtaccacaaatcaaaataaaagctctaattaaagagaatgccaaaagccagactgtcactttcataataagttgttaatttaagtcatcacataccaaagatacatatacattgagcaatatacaaataaacaaaaaagtgatgctttctttaattgatcatacctactattgccaaacttaatggtatccttttcaaagagttcataataacggctgggctcaatacgattctcctgaaaaaaaaatcaaaacataaatattgactgggtagaaaatattattagaaatgcgactagtgtatctgattagtagtaaaagtatcactggaggacttacattaatgaaagttccattggtactaccaagatccatcagataaggcctatcaaacaaagcagcaaaaaacatcataatctagactagcatacagaactaagataatcatgaattattagtacttgttattaaaaaaaatatatgcgttactagcaaggagtacctcacttgctttgacatcatgccatctggctgctccttctctacaagtctgaaaaggcaaagagatgggtgaatcacaatattatttctcaatatatactccttttaaaagggagcagtggtgatggtgagtggtgaatctgccaccaccccaccaccagctccctagtttttttggaatagaaaaggggggcctacatgtcaaccacccctaccaccaacttcctactttttgtgagaagaaaataggacagtgcacatgtcagtaacaaatatatacataaattaaggggcgatatacacagaaaatgatgataataatgagttaatgataattttctttatttaaaatcctgttgccacgcacaggcaatatgctagtaaaggcaaaaaacaataagattgctatgcttacctatattgaagaactgcatgttgcttactgcaggagggatgatctatggggatgtctgcaactttccgttcccttccaaaaaggtagctgctcatccggtgaacatataatggttctgatcaatcaagatagcatcataagacacagtcaaacaagaagagcaaaactgaagtatttaatcactaacgtaagcatgtgaatttttttaccaccctacacatttaatttataccactataatgcccaacctttaacttgctgttcatcacaataaacttcatcacttcagttatttcacttccgttcaaaactaaaactaatgagctatccatacgataccaatgctcaaacagtatcattggatatattcacaagccagtgtatactgtatcgtaaggaactgaacaatagcaaagcactaggcaggcttcattattacaaaccaatggaacaaaaagatgaggcttctgaaggatgaaaaccgtatgaactaggaaggggcactgtgtgcacacttcaaaatctccacagctccgaacatatgttatgcagtaggctggaccaaactggcaaacaattgcatggatacataatgcatagtttgcttatcagaatcaaatgctctgaataaggatgattctatgaaaaagtcataccgttaatctcacttgaggttaaggtgatgaaaaggttctataatgatgtaattttttactctctggagttttcagtctctcgcatagctttggtcaaacctgataaagcaagaggggtagaggatgttcttctgagagctgctcagtccggtggaatatctgaaaaggtaatagaggcgggtagcataatctttactgtgtcaagagactcagaagaaaggtttatctgaaagctgactttctttggggggaattttctggctttcaggtgtctgaagaaaggcttatctcacttctggagcaaatcaatacccacactagcaaacagacgaaagttacggtatgataaacgtggaaacttctatcagtttttgacataccatgtgcacttaactaaacaaacctaccatgcttccaatagtggttttgggtagcttcactacaactaatttagtttggtttgtaaagattctcgtttgttgtgattctttccaagtcactgattgtacatcatcaaaaaaaggaagagaaaatgatgctaatataggctagtctgtgaagggaaagcatccaatacacaactgattctttttactatgttttatttcgcagattcagaggcgccggagcgtccttgacgacgatgactagctgcatgtgtgttgtgtgtacgatgagctggtggaggagtctgccgtagcgcaaaactgcttgctaaaaatgatgattatcaaacgctatatcaacaaccatcaaaacttgagcgactatttgatggatatttggccgtatatgaattaattcgagtttggtttggcttgttccactgatgacattcaaactttcgacttctccgaagtgtgtatccatcatatcatgagtatgttagttgctcctgtctgatgttttgtcggtagatgaattccggtagcgggggcaaatccaggccccgagcaaagctaggccaggtctggggcctgggataaaattaaaggtccattgaaaaccttgatttttcaccaagtaaacttatcttaattaggccgaaacttttatggggcggttctaactcatatatcagcaccaagcgtgtcagtagtaatcaaatctatcttctcgaaggtcttctttttctgaccaatatttaacatggacagacgttaactatatcaaatgatggacaaatattgatagattacagttaatgggcgctctcagcttatctaagatgcgtttgtctgtactcattatcatatattatgaactcggatgttcgattggtaggcctaacttttggctgcaagctataattaattagtggactctaaacaaagacacgtcgtcaattaaaagtcaaggatcgtcgtatgacatggagtactaggacagtttttcaaaactcgtcttgagttgaatttgttgattaattattactagtatatacttataatttatatataaccggtaatatgctaatggcaagcacggataattagttaaaaataattagtagtgctagagctataccataccggcagatttttgtgaaccactcccttctgaattcttatggttgttagcctttcgttgttacagggtttggttaatttatgtgctttgttcattatataagtacactacagcgcatgattgctgtttatgattttatttttcccccctggatcctgttttgtatcggttagagctttttccggctagaaactgtccggtcttgttatcttgaatggcctgggcagatagatcagaaacagttttttgcaaagattatgatgctgtgtaattataatttaaatactactccattacaagtgtcctgttgttcatgaatattacgtatatactggtggagtttcaatagaaaatcaatgagatcggtgatatatcattaatttccgtttattagagcatatgttagctgacacattcacggagtgtgagtagttgcgtgtgcgcatgtttctaccatgtaattgaaaaaaaaactcactgttaattaattagggtccaaatatacacgtcagaggcccagtttagtttcaaagtttttttttctaaacttcaaacttttcatcacatcaaacctttcatacacacgtaacttttctatcacatcgtatcaattttaaccaaactttcaaacttcagtgtgaaccacaaccagaccgacgaattcaacagcttgagtagctaccaacatgcatgcaactgtctgatctcgtttactcagctagcctcttagctaggcttacaactgtacactgtatactaatacaaatacaataatacatacatacgagtatacgactatacagttggtatacgttaattaatacgtaagtacttgcctttcttcagcatgcgtacaaatcaaatatacgtataattctcggatctctcgtatcttcttctcggtctcgatggatatcaggctccgagttcgccgaccatgtattcgacggcgtcgcggatcacgcggagtagcaaaccggccatgtcgtcgtccgccggcagccggcggggaggacgatcggtgcgtcgacggtgggtgttgggcggcgggtttcccatcggcggcggcggcgcgagctgccgcggccgcccgtcgccgccggagagcggctgcaccggggtgttcgggtcaggcggcggcgggggagcaggccactgcctccccgacacgccgccgtcgtcgtcggagatcatcagcggcctcgtcgacgatctcccggccgacgacgacacgccgccggagagcggccccacatggccacctggaccaggtggcggcggaccgcgtcctggcggcctcctcagcacgccgccgccgccgccgtcggcgagcggcgtcacccggccatgcggacgaggcgatggcggggcgttacccgacctgccgccctcgacctcgacggcgcctccgacgaccacgccgtcgctcggcaacatcagcggcggcagcacgtgcagacgccgtgcttcgagcagcggagcgaggaggacgacgggaagaagaagcagcagcagcagctttggagaagacgaagacgaacccgccatggcgggaaggaaaaacaatgaatcgatcgatcgagaattcgagatgttgcaagcggcagcgcgcgcgaagaacgacatggccgcgtgagctcttatatatataggcaaagattagaattgcttatgacggctagaaagttgacaagtcaactgtttcttcttaatccataaaatgctacatgacaatatcccattcgaacgatatgatatttctaagctattatctgatatgatacgtgttagatatcggtttataactatttaaactggataatatctctaagtgatacatatctattgatttttatatatcaggtgatacccctgagatattatcccgttcgaataggatagtagcattttcaaaaagaatcttcgatatactagttaatgggtctgtttggtggagttttatattctgagaagcagttgtttggtagccagcttctgagaatctggaaaagctctgaaacccagcttctggcttcttagttcatttttcagaacctgtacctacagattctcagaagctgtatactgtttggggcagcttctagcagaagcagcttttaggaaaagctgcagctggaacaagttccccaaacagagccaatatttaacttgaaaagaacacgaatagcagtgtataaatgtgcgtaaatcgtcagttagttgctgcaaatagctagctgttggaaccgctaccgggcgaagattttcgctacgagctaaggttgcggtcaaagttgaccattcaacagacaagaaacaaccgcgacagacaacagccaccgcgtgagtcaaaacaacttttgttcacggagagaaaccgtgatggcaacatggagcccggccaagctagtgtgtttggctgcctgggcctttcatacttgtgctgtttttcttttcttttttttcttttccttgttaattagcttagataaattgtaggactaatagatttggatgtctcttattttagtggcctgatcaagtgcacaccttgcacctgccaggggatatgatcctgatgtgcggcacacctttcttcgttttatactgtaaatatgtaaatcgttttagttttattctaaatcaaatatatatattctgtatctatttaatatttttattttcgatgtatcgatgatgtcaaaccatccaacgctcatttgtcagtgtctctggtaccgtggaacatcatatatatatctataaagtttatctagtgtagttaagggaaactatatattctagaaaaaaatgataagatggattactactccctatttagtgtagtacgtgatagattacttcacaagcatgtaaggtctgtaactttaaaaaaaaattggctgtgaatatatgttaactagttgtagtttaatttttttttaacttgtattagttggatttttaacttgtattagttggatttttaaattgcatgtttgtgggggtgatatatcacatattagtacatcttctcaatttttttaatttttttcataactatttgaatggcataaaaacaacaaaggaatgtttgccgaagactttaaaatccactgtcacatgttatttctactaatatcatataaaattctagcagcaacacgtgggatttcatctatttttttcttgatgctttatggatccgtggtgcaaaaagtatccggtgttgtcccctgtaactaatgtttgaaatttcaattgcaaaccaaatatggtgggttgatacagaggatgtatttttatctttttttttaacaaaaaagatttagactttaaatctatcctctgatttcagccggattcaccaccgtgtatatatatatgcatatactgcgccaattggccacagagagattataattactgcatctccatttttcgtagttgagcgacgcaacaacgtgcagctactagccagctagtctttttgctcagctggtgtctacttacctagactctgctacgacacttataattaaataaaaaacgactatacaatatatacgattatacagtcgttataccgtatacatacttgcctatagctttgcttctgtatgcgtacaaatatacacgtacaagtacaactctctcgtatatatctcttcttctcggtgtcgagctctcgatcgtttcaggctccgagtccgccgccgaccatgtactgcacggcgtcgcggatcacccggagaaaagcggcgcaggggatcggcggcgcgagcgcgacggcgacgttggtttcacccggcgggtttccggccggcgtcggcggagcgggtcctggccggccgcaacaccgcgacacgccgtagttggagagcggctgcaccggcggcgtgttcgggtcaggcggcgggggagccttaggccacggcctcccaagcaatccgccgacgccgccgtcgtcgccgccggcgagctgcgtctgcgtcggcacaccggggtgccaaggagacggcggagtggggccgcccggcctcctcagcaatccgccgtcatcgtcggcggcgagctgcgtcggagtcggcacaacggggtgcgaaggaggcggcggagtggggccgaccggcctccccaccagccatccgccggcgagcgtgatcggcccgccaggcgcaaaaggtgacggtgggatgtgatcctccggccgcccgacacctccgacgacctcgccgccgtcgctcggcaacattagcggcgccaccaccacctgatgaccgagtggccgtgcttggagcagcggcgcgaacgcgagcaggacgacgtgaagaagaagaagaagaagaagcttgcaaggagacgacgaggcctccatggcgggaaggaaagggatcacaagctaattaagctagaaattagccgatcgatagatgagatgaaactctgatgcaagctactaggctgcagctagccacacccacatgagctctgttatataggcaggatttggtacggcgctcgtgtggtcgtcgtggactcgcgtggtgtgcatgtgtgatgactgagtcaacggttttttgcctaattaatccatcaaaagaaagaaaatgctcggattgatttgttaatggtttgacacggaaggaaaaacaagttaatggtttgacacggaaggaacaggaactgtataaaaaaacacctaaaatgggatgaatttctatctaaatgttttttaaatttattgtattatattatatcatatttcgtttataggttatgtttttttagaacggcgaaagtagtccggggtgtgaagcctccgccctaaaccgcaccaagtggagcaccatcctacctagctggctaaatgggtgccacgtacgcgtacacgtacatgtatcctcaccaatcttaaagcatgatagatctgtaaagtatttttgatttttttccacgtcgtattcctgtggtatatgtaggacgacgtgcattgtattcgaaataaatttcaaaatatactgttaatttgttttttcttaaaaatattcaggatgcaagcttattggtagaaatatacatcgacctcacataatcgttgcgcgagacataacgaaacagcaataccgaacagtatcgcataagaaacagcataccgaatctctggtccaaaattagtgattaattaccataattagttattatttaatgataactaagattaattagttgctaatcaatgtgattaaaacattaatcattcagccatgccgtgcggtctcgcgtattggttgtgcgagaccgtacgctttcgtggaattcccttgcaaaaccttggcgcgtcgttactccacgtcattctcgtgcggtggttatgtgatagcgaggtatatttctaaccaaaaaaaattgaagaaagaaataatatattttcaaaattaattacatcgtattctacccgcaccaccatcgctccgctgccagtgcacgtaggacacaaacaccaagacatacggagttacggacgacgaggaatcgacggcaaccatgggatatatcgacgaccacacatgcatcgagacattgagatgaactggaagtttcataattcatatatcgttttagattttctgagaacatacttgctccttttctaaatatttgacgtcattaacttttttaaacatatttgaccgtttgttttattcaaaacttttgtgaaatatgtaaaactatatgtatacattaaggtatatttaacaataaatcaaatgataggaaaagaattaataattacttattttttttaataagatgaacggtcaaacatttaaaaaaaaatcagcggcatcaaatattttgagatggaggaagtatattgttttagattgaattcggaattttgtctatgtatgtccgccgcgtgtttcggtcatatcatcgtcaattattaacgcgtacatggccggactgtcaaaccaacgctttcacgctggtgtgaaagggtgttttattttttcttttaggaaattaaggagtgcaaaactgtaagtatatgtttgtcgtgacgttacacacacgttcgttttgaagtactggccttgtttagtttccaatttttttccccaaaacatcacataaactgtgtttgtgtttagttccatgttaaaattagaagtttgaaaaaattgaaacgatatgacggaaatgttgaaaatttgtgtgtagaaaagtttgatgtgacggaaaagttggaagtttgaagaaaaaaatagagccatagaatctctggacacatgcatgaagcattaaatataaataaaatgaaaaactaatcgcacagtttacatggaaatcgcgagacgaatcttttgagactaattagtccatgattagtcataagtgctacactaaccacaagtgctaatgatagattaattaagcttaataaattcgtttcgcggtttccaggcgagttatgaaattagtttttttattcgtgtccgaaaatcttttccgacatctggtcaaacgttcgatgtgacatctaaaatctgttcgtgaactaaacaagcctgatggacaatggattgatagttaaaaattgagtttatggtaacagttttgatagttaacacgagcacacacacaaaagaacggtcgatagttcacacatgagtacacaacataagaaaacgggcttgtgatcaggaaatgaaacagtgactctgtgactcgtaaacatcaaggttggactcagtgcagtggagtactaatcattgacattaataacatatgatctcgtgctcatatgtcagcgagcagtacaacacctcgaattgatcaaagattacgacctcgtaactaagccgtgtacactgccgggcggcttggggagagcacaggttggccaacgacatctcctgcaaacggaggaggaggagcagccgccgccggccacctcgccggcgcgccatctccgtcatgccagcgcggcgttggcgaatgtgatgacctcggcggcggcggagcgcgcggcgacgacttcgccagcgcgccaccgtcggcatccgcgctgctccacagccgcaacgccgccgccgacgacgacgacgcatgtacgtgtggttggtatgcgtctcctggatggacagaaacagcacaagaaattttctcggtgaatgacaaattactagctatcaaacccagtaacccactattctaggccagattagcaatcaaaaccattctttttcacatgatcaatgcgactgaaaggaaccaatgcaattctgcgtgctgttgtgttgcctacctagtgttcgtgcatccaaaagatgagcaaagatgatgatgaaatgggcgaggacaagaagcagtgaagtagacagtgatctgtccatggccgatcgagaatactatgcaaggagagcaaaatgaaagctaatagctgaatgtgctcttagcttgttgtagatcgattggtacatggatgaagaaattaaaggtttgggaacattagcatttatagtggctgaaactgcacttctgttgtcgaaatggtttttctttaagaccagaggacgacctctggtctatggtgtagttcaaggattccaggcttccagcattggcatgtgtacagcccagtagacaatacctaaagatgctcatacttccatgtgattagctcttctgtcacctctctactcattttcctgcacccaaattgggttacctgctttgtctctaacttatttgtttgcacccaaaatgcataattgtagtatagtactgaacctacagcttagaaccttatctctacctctgtatgataaaattcgagctaactgcttggcactagattatttcttatctcataacaagattctcgggacttcaacaatttaaaatgttgacatatatatcattagtcacaaattgtccatttataatcatgcatgttatgataataacaagacatggggccggcgaaaaacccaatacaacctggtattttggacaaaccatgaattcaatagtgatagtagatcaaccaccgaagaaaacagccccatcgtttggctgttgagaggaataagcaaaacaacatatttacaaataaaaaataatttatgaaaaaacttttatacacgtgtttttaacgatataaaagcaaaagcagaaaagtaaactacaatgattaaaccccaaaatcaactccaaatttaaagttgaaaatttaaattttggctaataagtataagtataagcgaaaaaatggggccgcaagcctatcatcctacggatgtaatggaagattgctctttgtcatattttggtcgcttgcccatagtcccgtcaactttggtggcttgaactctcggccattgggcaaggcagatgcctatgatgaatgaaaactctttctatctatgtgtcacgccccgaattagtcccgaccggaactaacccgtgacgctccaaattaacctgttaatcgataccagtcccaggaaacagtgctggtatcacagggagacagaatatcacagcaacagaagcctctttattatagagtagaagtacagtcatgttgggctgtggacagatcccgagctcacaactgcattacaaaaggaaagcggaagccaggacttggaccaaacaatcacaggcgcgacttgggaactaggccgaaaccctaaaactcatcgtagccgacttgctcctggaagaactcctcatcagcaggatccgcttcatcttcttcagcaactggggggggagatatttatatagagcaagggtgagtacgggagtactcagcaagccaggggaaataagtgtttaatgcaggcttcaaggaaaggctgttgtttttgcaattgattttatttgaactcttttctaaaagcaactgtattctttttattaattcttttaccccttcgtcgtctttctgggcctcccggatttgcgactctagggtaggctgtactgtcaagctggctgggactcctgactgtaccacggtcagccttaacttctccaattctctgcacagatgatcttggtcaggccgtatttgagctacattgcaataggccttgcgacttagcgcatcagcgaccacgttggctttaccaggatgatagtggattccaagatcgtaatccttgattagttccaaccatcttctctgcctcatatttaactcggtctgtgtgaagatatatttaagacttttgtgatcggtgtatacttcacatctgttcccgattaaatagtgcctccagatcttaagagcatgaaccacggctgccaactcgagatcatgggtgggataattgacttcatgaggcctgagctgcctggatgcgtaggccacaaccttacgttcttgcattaggacacatcctaagccttgtcttgatgcgtcacagaagatctcgaaatcttttcggatatctggcaaggtaagaactggggcagtggtcagccttttcttcatttcttgaaagctgtcttcacaggctacagaccattgaaatttcttttccttctttaacagctcggtcataggtctggctagcttagagaatccttcaatgaatcttcgataatatcccgctaagccaaggaagctgcgaatctctgacacattcttgggcgggttccaagcaagtacagcttcaaccttgctgggatctacttcgacaccgttggaggagatcacgtgtccaagaaatgctactcggtccaaccagaattcacacttcgagaatttagcgaatagttgatgatctctgagcttttccattatcagcctcaggtgttcagcatgttcttcctcgttcttagagtatatcaggatgtcatcgatgaataccacgacaaactggtccaggtattccataaagattttgttcattaagttcatgaagaatgctggagcattggtgagtccgaaggacattactgtgaactcatatagaccataacgcgtcgagaaagcggtcttcggaatatcttcagatctgattttcagttggtggtaacctgacctcaagtcaatttttgagaagactcttgctcctttaagttgatcgaataagtcgtcaatccgtggcaacgggtacttgttctttatagttacttcattcagggctctatagtcgattaccattctctcagagccatcctttttcttaaccaggagcactggggctccccaaagggatgagctaggtcgcacataacctttactccctaactcttcgatttgtcttttgacttctgctaactcattagctgccattcggtagggtctttttgcaattggagctgtgcttggagccagttctatggtgaactcgatctctcggtctggtggcattcttgttaattcttccggaaatacgtcgggatattcacagactatgggcaccgactccaaggaggtgacttgcaaacaggttaggatagaccgacttgcggtaggggtgttaggggtaaagcggacttgctttcctccaggtccttgcaaggtgatggacttttcggcacaatctatctgtcctttatgcttagccaaccaatccatccctaggatgatgtccaagctttgcgagtctaggactatcggtttggctaggaagtcaacttcctcaggggcgtaccgagccaacttgttgaactgacttaggtactcattgacactgttgttgccttgtttaagtctgttgaattcttctttcttcatgtcaatagtgctttcgggcacatgagctgcacggaaagccgtagcgaactcatcccaagcaatgttagtgggttcagggtgtgcattgcggtaattctcccaccaatctgcggcaggtcctcttagctggtgagaggcgtagagcgtcttctcaaccggagtacactgcactaagttgagttttctatcaacatctttcaaccaatcgtcagcctcgacgggctcgacggtctgagagaactctggcggacgtgacctcagaaagtctgtcagcttggatctattgttgcccacgtgagggtggccatttccatgcgcattatgctgaaagctggctatggctgtggttagtccttgcaagatttgtgtctgaactgccattatgtgttgcatgttgttttccacatgaggtggggaagggaggcgttcttctccagaattgtgactggcagtgcggtgagagcggtgagactgctccagctctgcatcacgggaaactgtgcgatgcgagcggctactgcggcgaggttgctcaacctctgcgttgcggggaacagtacggtgcgaacggttgctgtggtgagaatgctcattagctggttcgtgatttgcttctgcttcaactctaccatcttcaaaaccaaagcgggctggtgcacgagctgtacgacgggggcggctagccatctaaactcccagaaaaggggcggggtaagagtcagataagcacttaggagggcaaggagcaaagcaaatagcaactcagatagcacacactaggcataaactggatttttcaaatcataaaaacacctgatacaacgggtgtggacaagtcacagagctacgccgagcttgactgtgcacacaccacctaggagaaccagactaccaaacaacacccacaacaaacacacgcacgcactacctcgccacgactccaaaagagttggcggcggaacaaaaggggcctatcacacggacggctgctgaagactgcctcctctactcctcgtcggcctggctgcctcctgtagtcggctcctcagttgaagaaacgtcgatcggctggcgcgaagggaccggcgggacctgtcgagggccggcagcagcacgggccgctggcggtgggggagctgggtggcggaaacggaacacggtggaagaaccaacaacacgcttccgcgcagtgcggataaagcgtgggccacggcgggaggaagcaactggggtgtgtccgggggtgtaggaagggctaactgggtgtgggtagggggagtacactggtgagtacggcgcacgcgagctgggggagcgcgggccactgggagtgcgagcagagccgcgggagctgtgggaggacaggtggctagcgtggcagagacggcctgagtcccaagagatagtgtcaactgaggtgacaccctcctcggccagacgggcctccaaagcggcgtagcggcgggcaagggagcggtaagcctcaaggagtaggtcgtgctgagtggcctgagcctccgaaagctcgaccatgcgagtcagcactggctgagactcgctgtacggacaagggtacctggcgtctgagtggccagagggaagacgtggaagctgccggaaggcggagcctccgagacggtggctgtagtcgtgggccaggcgacgaagcgcagtccaggagaggtcctggtacgcgatctggagagtgggcctggccacagtgaagtggtgggggcgaaggccagctccgtgtatacctccacgagggtaaaggtacacagagagcttacagtgagggggaacacggtccacggagtaccccgtgtactcgggacacgagaagccaaggaaacgggagaggtcacgaagctgagcgacgtggtgaccctcaccaaaaccgtgggaactgaagctggcgttcactgccatctacaattttgaaagagggagaaagatcagtaaccattttagaaacaaactattgaaaataaagaaaacaaaagaaaccttagcttttcgcaagtagttttgaacttagtatccttagggtcatcctaagcgtcgggtttcgccctagggccaagcctgtgctctgataccatctcttgtcacgccccgaattagtcccgaccggaactaacccgtgacgctccaaattaacctgttaatcgataccagtcccaggaaacagtgctggtatcacagggagacagaatatcacagcaacagaagcctctttattatagagtagaagtacagtcatgttgggctgcggacagatcccgagctcacaactgcattacaaaaggaaagcggaagccaggacttggaccaaacaatcacaggcgcgacttgggaactaggccgaaaccctaaaactcatcatagccgacttgctcctggaagaacttctcatcagcaggatccgcttcatcttcttcagcaactgggggggagatatttatatagagcaagggtgagtacgggagtactcagcaagccaggggaaataagtgtttaatgcaggcttcaaggaaaggctgttgtttttgcaattgattttatttgaactcttttctaaaagcaactaagtgagtgcttctcaaacgacacggttgagacagtgcgtctcgtccggtcggagtatgtgcaatgtatcagtctttagatcctgaaacaaggttggcacccggccaaaagctttttgaacgaccacccgggccaactcttttcaaacggccacccgggcccacaacttttaaactgccacccgggcctagctgatcccgtcagctgcaggttttccaaacatcgaacccagtttcacaacagcaatttcacaagcagtagtcaaacaaaactacgctaggaatcacctcacatccgcccatgaccgtgggcacggctgttcgaacagtttaatgacctctgcagagggggtacactttacccacacgacattactaacccgggtcacccagcccgtggggatcagccacgtcgggagacctccaagctttcatgacaaggcatttcgaaagccgatgcaggtttaccatatgccgacgagaggggtcctagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacacccggtacgttccccggtccgcggttttggaaaattcatttagttcgcagacatcgacccaagtgtcgggtttttccaagtcttttgtaaagctccagttttacccaagttgttactcagattttaactttgaaggcgaccgtcgatactcgcacagagtgcacgagtatcgaggcgcaactggatggttacaaggggacatggcatagcaattaacaatggaaggatcaaatgcgacaagttaggtaagtccgccaatctgcttcgcagacgggacaacagattaagtgtgatcctatcaatgcataatactttgcaagcaacataattaaatttcaaatataggctcaaggtgttcaaaggtggcttgccttgctcgagatctggagcttgatcctcgaaatcctcgcactgcgggtcttcgggctccggaactacacgcgaaacggaacaactcaacaaacggcgaaaataaagccctattaatgacctctaagcatgccattagatagatctcgagatttgaggaattttggaagttgaacggagtcaatcggatttacggttgggaagatattgaatttctaagattattggatttctggtctaacggaaaaaggattaaattaaatcctttttggaaaagaaaaagaaaagaaaagagggagggattatagacttttcctcgggcggctaaggcgcggcccaagggaattggaacggaccggccgaactaaatgggccggccgtcccaagcgcgcgcgtgcgcgggggaggggagagagagtccggtggaccgggctcaccacacgcggtcccgggtgggacccgcttgtcagcggctcggctcaccgtgcggagggcgcacgcgcgcgggcggggaggaacgcggtgcacgcacgcggtccgcggcggacgcagatgcgacgggcccacgcgcagcctcacggcttgcggtggaacgcgcgcacggggagggaccgaccggggtcggctcgacccggtctaagctgagctggcgccgacgtggcgcctacgtggctgccacgcaggacggcgggaggtagacgacgacccggccgcgaatggacggcgggcggcggcggcgagcggcggagcgaaccacggtgatacgggcaaaagcgagcacaccgggcggttgttcgtgacagggggaggcgagccaacggctcggattcgccggaggtcgctcgatggcggcggattgcggcggcggcaaccggcggcggaagaagagggaaacggcgacgaggccacgaggggtcgattcccgtcggtgagagcacctacgcggcttcgggaactcgacgctagcgtcggattgggcggaactacgccgagcgaggccggcgacgagcgggtgctacggagctcgggcggcgacggcggcgagcacacggcgagcgaaggcgacggttggggcggcgccggctagctacggggggtctactcgagctactaccgaaagctagggggaggagttggagcgaggaggaagaacggagagagacatcaccgagaagaggaggggcgctgtgacgagaggccgacggcgcgggagtaatctctccggcctcgggccggggaaggggaaggagagggcgcggccgaagtccccttccgcgtcctcgaatgcaccggctctcccggcgctcggcgaaggacggcggaggtgagacagagcacggggcggcggctatggcgcggagacgaatggaagaggagggggggtaaggggaggccgggggtttaaaggggacggcaatgtcggtttgagaaccgacttgcgcggtcaaggcgcgagctggcgctccggctagcgaccaaattggcgacagggaggatgacgccggcgggaggaaaagggaaaaaggagggggagaaagggggcttgcccctttgccggatcgggaaaaggaggagggagcggggggggcgatgacgacggcgatgacggcggcggtttggagcggagcggcgacactggcggcaggcgcgggcaggcgctgacgacggcggcgaccgggcggtcggccattcggcacgcgcgcgcgggaaaacaacaggaggcgcggcggcacacgcgctcacgcgcgcgcggcgtgcgggcggggcggagcggagggaggagaggcgctcggggcgactctcgcacgcgcgagcagcgcgcgggcgaggctgagcggggggggaggagcgcgccggggggggagagagagagagaaagagagctcgggagagagagagagagatgggccgagcggaattcggcccatcgaaccccgggggaggcaaactaaactttgcggagggaatcgatttgaaaggatttggattcggatttgaactcgacgatagatcggggattgagatcttgagatggcacggacactagacaacaagcaaggaaacaaatttcgcaattagggtttttaagaattaattttcctgctaggcgccacgacggaacgggcactacactatggctctgcgatagccgcaagaaggtcgacaaggctcataggcgaggctctgacaccgttgcaactcttgtgacgtgtacaatctagaaagaaagaaacaatagagtgtgcaacaaacaacagcgaacatagcccaaggtggccaaggcgatggcagccgatgcgacgctttggcgtctgcccaatgcgttggtgccggtgttaagtccttagccactagagcggctggtcgccaaatgttgagtcaggaataggcttcggtttcttagtctttaatgtttcccgcttcccttctccttttattttttttgggtttgtttgtaaaattttatttcttttaattaaaaaatacgctccctgcatattccaaaaaaaaaaaaaagctctttgcaatgttcagagttcagacattcttgtggtgctccaaggagaaatatattcaggcgactgcaaccatagtacagacaacaggcagcatgctgagggatgtcaaaatctgaggtaacaatgtaccacagtaccagcaatttcaatcctcattcttaatttccagttctcatatgaagcgaaacatactcccgccagcagcaaaaacaatagaacatttgccaccatttagttgaacggagttagtaagttgttttaaaggacaaatatagaagcagagacatccatcacatcattatttctaccctataatcattaatttgttgggtaactgggcgcaaaagggaacataggattaatgacatataatgccatttaggagtacctaagaataaaattatcagggtactcaaggatgaaaactctatgaactagaaattgcattgcgagacttcaaaatttccgctgcactgtacttccaatctatctgttgacagctaaatttgacactaaggaagaaatataataaagtttgaccaaatttgaaaagaagctcgagccttctatacaaagccgttctattctgtaaaaaaaaaaaagaattcctagccacaagtcttctataggattggtcttttttttttggacggaggggcaccgaccagtgaccgttgtaaatcgttgtggtgacaaaagcatcaacactatattttatacttatactaattgaatactcaaaacttctaatgttaacctgaaaatggaaaatttagtcgtggattagatagatagcactatcctatttcaaaaagtttaattacatggtctttagatgagaccttctgctagaaaaatagccacaatgtataccgttagcactatgacttctctctcctctaggatcccctctaaaaaccaacaatgaatatgctcttattacatcagcctgcagtgtaatacggaatcttggaactatcatgccctgcaacaaattctgtcccatatggatgcttgatacggtcactacatgagtgacaacgctcatagtcctgattcctcgtcattacataatcaattctcctgttgatctcatggcatccacctacaattaaagcaacatcaacatatcaaataaatcgctgagaaggtcctacaatcacacgtacaaacatcaataaccttacagtaattacaaataagcaagcatattaatcagaatacagtcaattggtcgacaataataaacataccaaaacaagaaccctggaggttgtggatagagacgacacacatgggctcgatatcatcagcacatccaacaatattaggatcaaggctcaactctgcaaagcgttccatcctctttgccagaagatccggattcaatttgagctctgcaaagtacaggctcttcttagcctgatcatcattctgagccctggcagtaaagttgacatgggcgtatgtggacccacagacctcatgaaaacagtttgataaaagaacagtacaaagctcaatcttaacctgaacaaacaaaaaatagaaaggttagtagtttacaacattaagacttatcatgtcatggaaagcaaaaaaaggaaaagggctattacaatgttcttctcaatattgttgtaatggttaattgctaaattggcgaagcgatgagcttggggacaaactttcttgccagcgagctctgcctccatctcttctgcggtcaaatgttgctcactgcaatatattcaaaagagtaatagattcaacagtgtgttggacaaaaccaattttaggtattcacttaaaagtttaatttcacttcaactattgcattctgtatttctgttgcatatacaggacttcaattgttaatgcgttctatctctgaccaccagctaaatgaatcaactgaagttattttataatttaactgttttagtaaccaagaatggaaatgcagcttaaaaaaaatccacatttcttattaattaaaatggttgcaggttctaatatcagtttacccatttacaggatcgtgcaggattcatctccaaagtaactttggcttttctgtctccacctcttccttgtgtccttaggagatctattctaagctgaattatcgatgtcttgtttgctgtgatcactactgttttataagtgataaaaaaacaatgatagtttttcacatgaattttgtactgaggaatataatgggtgcgcaatttcacgtgtgttaggatctacgaaaggaaagttctatttgtatgatgttttcttagtgatgtagttgacatacccatgagcaaaaaaaaaaaacaagaagaagaagaagaagaagaagaagaagaagaaagaagaaggggtttaacatacggtgtatcggagaggacgcggggtcggaagatttgttcgattttgttcttctcgatgtcgatcatcctctgatagaacctggccatctgcgccttggactcgcggaaagcgggcttatcctcctccctgaagcagtgagccttatcgctcatgtccaagctgtccgcgagaagctcctcccatgtcatgggcctctttctcaggcaaggatggggtagcgtgcgagggatcctcctccacctccctggcgtcctcttcttcctcgccggggcctcgcatgcagaccccgccgccgccggcaggaaggtggaggaattggcccccgattgcgacggcgacggcggcggcggcggcggcagagagtccagccattcccgcgcggtgatcgggacggtggatccctgacgaacctggaacatggagtaggtcgccagtttctcttctatggtgggccttctcatctccgcccgccgaatcgcagtctagggttagggttcttcctcctcgcgaactcgatgggagaaagaaagtggtcctgatatatatatatcgatgcgaaaagaaatttatgcatatgtcacggaaatcaacacacgtacatttggctcctgctcagctgatcctataccatataacgatacaaataaacatattgaaattaaaacaaggaaattatacttctgacagatcaggctccgagtccgccgaccatatgtattgcacggcgtcgcggatcacccggagaaaagcggcggccggcagccggcgcagacgacggcgacgttgtgtccacgcggcgggtttcccggccgctggcgtcggcggagcgtgctgccggccgtcccaccgcgacacgcgcgccatcggagggcggttgcaccggggtgtcgggggccatgccactgcctcctcggcaagccgccaccgtcgtcggcgagctgcatgtgcgtcgcggcacaccggggtaccaaggttgacggcggcggaggagagcggcgcggcctccccagcacgccgtcgtcgtcggccagactgatcggcacggcggaggagagcggctcttcttcgtcctcagcaagccgtcgtcgtcggtcggcagcattataaccggcggcgactcctgcagacgtagtccgccgtgtccgagcggccgtgcttggagcagcggaggggcgagccggacgacgtgaagcatcagcagcagcaacagtgcaaggagatcgagacgaactctccatggcgggaagccgggaaggagaaggaagccaatcgagagatgtgatgtgtacgtgtgttgcaagctgcagcgcttcgttttgggtatatcaccgggaaagtattttctacacatggtacctaggtgtatacatgtaatttaaacagtcatataaaagttttataaaatttaataagataggctatgttaatataaaacactatacaaacatacaagtctaaatttaatcgacatacaaagaaaaaaaataacaaattttatctgcactgtacagggactagtcactgtctgattttattatttttgtttctttagttatagatcaaatttagtcatgcatgtttgtgtatagacttatatcatcacaattgatgttactattttttttttaattttttctataactatttgagtatactctacaaatctcgtcaacgagtatagcccgtcgacaataagcattaatcccaaattctataaagttatcaaaactgaaaatattataattgtgagacccaaactaagtacaaccggatattattaattacaaattttgaaatttattaaatcatggcaaacttataattaagacaccaatctgaatacaacttagtttttattgattcagaatttcagacttattgaaacatcgaaaagatacatgttaattaaggtcgaaatactaccatgaggatcgatagatatatatgctagcctacttagctagtgacgaaattaacatgcatgcaaaataaatatacacatgtgctcgtctacttaagctagacatatattcatacagttggtaattaatggtacagtttatataacttcatcttcttcctcggtctcgatcgatcaggcttcgagttcgccgatcacgtattcgacggcgtcgcggatcaggcggagcaaaccggcggcatcatccgccggcgccggcggccggagcgggggatccgtgcttgttcggagacgtggagacgtgataggcggcttgtttccctgcggcgacggcggagcgatccccagcggcggcttcccgtcgtcgtcggagagcggcttcgtcgacccacccggctgaggcgacggcggagtattggtcggcgccctcccccccgacacgccgccgtcgaccccggccagcggcgtcaccggccgatttgactgaggcggcggcggcgccccgccggatcgtcccagctgtcccggcacatccagtcccggcgaggcggcggccacggcctcgccgtcgtcggtcggcagcattataaccggcggcgacgactccagcagacgatgtccatgtccgagcgcgagcggccgagcttggagcagcggaggagcgagcaggacgacgtgaagcatcagcatcggcagcagcttgcaaatgcagggagatcgagacgaactctccatggcgggaatgaaggagatcagaaggaagctgatcgattcgatcgatggatcgagagatgtatgcatgtgtgtttgcaagatgcagcgctcgcggcgagctctttacataggtagggtttaattgcgtacggcgcttgtacttgtcgacaatgtgtgtggcgattggtgagtcaacggttttgttagttaggctgtgtttagatcgttgtaaagtttggaaaaggactgaaattggagatgatgtgactgaaaagttgtgtgtgtatgacaggttgatgtgatggaaaatgactgaagtttggatccaaactttggatctaaacacagccttagtattgctgaaccatcaaaaaatatatatttaatttggatcaactagtcgtcgttaatgtttagtactccctgtaccataatatatataccataatatgagagattttgagtttttacttgcaacgtttgaccacttgtcttatttaaaaaaatttaaaattattatttattttattcgtgacttactttattatctacagtactttaagcacaacttttcgttttttatatttgcaaaataaaattgaataagacgagtggtgaaacgtagtatggaaaaactcaaaatccgggacggagggagtagtaacaggaaaggagcacgaatgacagtatgttgtcagttagttgctaccgtacgcattttttctctgcgagctaaggttgctagcaacataactgttcaacagctattagttacaaaagagaaaaaaaaatgttcaacagcaaggaagcaaccgcgaaaacccacgtgcgtgaatgaccggagctagtgtcaaacttctgcgctcactcgatcgcgatcgatctggccgtgaattggtgagatttttggcttgcagtcacatgaatcttaatgcgagcattcaaaccatcaaaccatgcgagcattcaacgattttttatgcacttaccacaaaccggttgctagttgctacaggctacagccagtcactagcaggttttggaagcctgatggcgaggagctgacagttttgataattgacaacataatcagccaatcaggccatgtttaagggagcttcttgtaactgcaatttcatcttcggctcttcaaacaatctagcttttcatctagattctaagggtctgtttggaggagcttctagtagctgcaacttctcctagaatctccagttgccaaaaactccctcaaacagtccagttttttacccagattctgaaaatctgtagttgtagaatctgaaaaatgaactaggggtctgtttgagggagcttaagattctgagaaacagctggctggttgccagcttctaagaatctgaaaaaactgggtttcccagcttctagctttttattttctggattctacaactacagcttcttataatttagaccaaaagctagactgtttaggggagcttctgattctgggagaagctgcagtagctaaaaactcccccaaacaggccctaagaataagtagaatttagcttgtttttcgtattctcacccgatggctctcaaatttcccaaacaaaacggcattccaatcacacgaatggcagtgactaccttgtaacatcaaggttacaacaaataactaaacgtctaaaccgtgtatactgccgggcttgggggacgctgtcgcggtgcaggttggccatcatcgtgtcctgccaacggcggagcaacagcaaccggccgccacatcggcggcggcgcgccacctccgccgtgttgatgcggcgctgggtgcttcggcgacggcgggatgtacggcgacggcctcaccagcgcaccaccgtcatccgtgctgacgctgctccgccacgccgacgcacgaagatgtggatgggaggagtaggcttctcctgaagcgacaaaaacagcaggagaaatttcgtcagtgaagaacagacagacaaattagctatcaaaccatttgttatacgtagtatttttcacatggtcaatgcgtgatgcgtttggtcagtgaatgacaaattactagctaccaaatgcactcctctctctctcttttttcacatgatgcatgcgagtgaaagcgtctatgttgcctacctagcatccgtgcttgcaacggctgagcgaagaggaggtagcagaggagaaggagaagactatgagacggtgatctatccatgatcgatagatgcaggagcaagctgaagcttgctgcagatcaatcggtacacggatggagaaaggttttgggaacacggtcagtatatatagcggctagaaaccactgaccttgtgtagttgacgagttgtcgaggtttcgagcattatacactagcaatctaccatgtgcacagtcgaaagatgctctctttttttttttgggcccaaagtgggctacctgctttgtttctcgatgcctgcttaactgtagaatagtaatgaagctagagtatcccctacctggctacctctaaatgataaaatctgagccaacagaactgcttcagtgcttggctatatcagattattgctcatctcgtgtcaagattctcagacttcaaatagattagagtgccaacatttcactagtcacaaattgcagattataattatgatatggcagtgacaatatgacattatatttgacaaaaccatgaagtcagtagcggtactagatcaaccactggataataaaacaagtctaggctctagaatcctataaatgtaacggaagattaccggcctctgccatgttccttcaggcattcttgaaaaatattcaggcgactgaaaccatagtacaaacaacaagcagcagagggacgtcaaaatctcaggtaacaatggagcaaagtttccagcaatttcaatcctcaatctttcgagttttcatgaagcaaaacatactcccggctgcaaaaaaaacaataaaacatttgtcagattttagatgaacggggttagtaaggaggcatatagaagcagaggctgatcatcattatattatatttacttttgggcaactagactcaaaagggccctaaatatggattagaaatagtaccatccatctaagaacaaaaagatgaggcttctgaaggatgaaaaccgtatgaactaggaaggggcactgtgtgcaaacttcaaaatctccacagctccgaacatatgttatacatttatacatgattgagcttgcaagtcaaggctccataaaggaaaattatgtttccataatgtagacattttgagattccttgatatttataaacattaatataccacctaaagattcatttggaaattgtattgagaaaaacaattaggcgtagtttacaaagatattacttagattattggagaaaaaatgtttatcccaagagtaccacaaatcaaaataaaagctctaattaaagagaatgccaaaagccagactgtcactttcataataagttgttaatttaagtcatcacataccaaagatacatatacattgagcaatatacaaataaacaaaaaagtgatgctttctttaattgatcatacctactattgccaaacttaatggtatccttttcaaagagttcataataacggctgggctcaatacgattctcctgaaaaaaaaatcaaaacataaatattgactgggtagaaaatattattagaaatgcgactagtgtatctgattagtagtaaaagtatcactggaggacttacattaatgaaagttccattggtactaccaagatccatcagataaggcctatcaaacaaagcagcaaaaaacatcataatctagactagcatacagaactaagataatcatgaattattagtacttgttattaaaaaaaatatatgcgttactagcaaggagtacctcacttgctttgacatcatgccatctggctgctccttctctacaagtctgaaaaggcaaagagatgagtgaatcacaatattatttctcaatctatactccttttaaaagggagcagtggtgatggtgagtggtgaatctgccaccaccccaccaccagctccctagtttttttggaatagaaaaggggggcctacatgtcaaccacccctaccaccaacttcctactttttgtgagaagaaaataggacagtgcacatgtcagtaacaaatatatacataaattaaggggcgatatacacagaaaatgatgataataatgagttaatgataattttctttatttaaaatcctgttgccacgcacaggcaatatgctagtaaaggcaaaaaacaataagattgctatgcttacctatattgaagaactgcatgttgcttactgcaggagggatgatctgtggggatgtctgcaactttccgttcccttccaaaaaggtagctgctcatccggtgaacatataatggttctgttcaatcaagatagcatcacaagacacagtcaaacaagaagagcaaaactgaagtatttaatcactaatgtaagcacgtgaatttttttaccaccgtacacatttaatttataccactataatgcccaacctttaacttgctgttcatcacaataaacttcattacttcagttatttcacttccgttcaaaactaaaactagtgagctatccatacaataccaatgctcaaacagtatcattggatatattcacaagccagtgtatcgtaaggaactgaacaatagcaaagcactaggcaggcttcattattacaaaccaatggtcctgtgtttgatccatcgattgaacaaaggttctctttcctttccccagggctagacaactaagccacagataagggcatgtttagttctcaaagcatgtgaacaccttttatgagatctagacctccactctagttaggcacgtgcacacacgcatgcatttaacttgggtggctgtgccgtgtacacatatcgaccttactctagaaaagaaagagcccttttactccccggggaaaatgtaaataatgatactgattcaatgcaagctcatatcatagtgacccactcgttagtgcctttgctcacgttaaatggttcgttccaaaactctccgaaattaagctagttcgaaaatgtttttatgttccatactcgcttcatcacagtcagttaagcttactgcttttaacagaacctacttttggtttggccatgttgggaagggaaatagagaaacagctgttgaactagacaagaacatgcctctacagactggcaaatccaaaaaatgtttttttcttctatttattaaaaactattaactcgaacagatagcatgacaaaaggaaaaaagttagcttcatatatagagtaacaagtcaagaataactaccttcgagtggttcaccacccttgaagacgtagagtctccatctaatatctgacttgcgagcctctggaggttctgaatgcaacagatttacacctgaaatggaagtaaattgcaaactctgaggacaatgcaatacagcaaagaacaaggaattacaaattctcattggtggttaaacaaacattaatgtaaagtgtaacatttaggttcatgaccaaaaagaaagatatagggcttcaaaacagcacctgcaactctgttagtctcctcagcaagctttccagacaattcaaatgatggtttttgctgcaaaacaccaatgaaattattaaaatactagtgtatgacaaatgaagagaaaggttaaataaaaagaaagctgacatggcaagtattttgtatctgcgaaaacagcaagcatcatataaataaactgtacacaacaaaaggaagattgttattattttaaatttcatcatggagtatgccctaccttttcttttgcttccagagcttctgcagtagcattcatcttcaccaaagaatcaggatcaacactcctggccaaaatagtatcaaatataatattttcagttctaaaatttcaggtacaaaaacattgcgctcatgtagctggtcaaatatacatttgtttgttttaggtactactgctacagttgcttaacggatatgctgatatgcatcaaaagttcaaaaccattccagcaagagggtatgacacccataacacgcgtagccccattgatacaacaagaaaacaattgcaagcaatgcttctactaaaaatttacaattcgtattgaatatagagttttgcatgcttaccgtgacgctgcatctgttacagagcttgtatcctgaaataaatcaaaacaaagtttaggttgcaactaacgggccatatatgatagcaaacatgaaaagaaaccaaattggtatgaaatgaaaaggatagcgggcaactaattatatcctctagaatctgaactctgaagcaagaagggtttacatggaatacagacccacaagtttagtgtcaacaatgctgataacaaggcgtactccctctgtactcgtaaaggaagtcgttttggacagcgacacggtctccaaaacataactttgacttcttgtttctataaaaatatttaatgaaaagtgatatatgtatacttttataaaagtatttttcaagacaaatctattcgtataatttttacattttcaaactcaacttgagagttattcatgatttatattcccaaggtttgacttaaacattgtcctaaactacttcctttacaagtacggaggtagtaattttttttcacttctattcatttgggtgcaggttatcagacaaagaacagaaacaagggacaatcatgaaacaaaagaacacactacgccaactaacaggtggatatgtataagaaaagggtcagatatcattacacacctcaccatgtgctgcacttctagatgacctcggtgactggcgggattcacgtctacccctatgcctatgctcttctggagacactgatcgcccacgcctagatgatctccctgattcaccattgctctcatcccggtctgcccttctctctcttgcagaatcccttctatcatcatgatctgccctttgctccctggaattgacttttcgatcatccccatcagaccttctaccccttgaatcacgcctttcatcatctcggcttgaccatgtctcccttgaagcacccgaccgatcagaccttctatctcttgagtgatccctatcatcatcatgatccagtttcctgtccttaaaagagcccctactatcctccctctcagtctttctatcccttgacacatcctttccctcatcacgctccctgtacctccccgagtcccgctcttccctgctggtggtcttccgacggtcaccctcagtagcatctgcaccttcccgctcactctgagcccttctcaatcgtttgctccgtggtgagggcgaccgagactcccgtttcctggcaggtgacggagaccgtgaccgtgactgagcttgtttcggcgacctgacctgctccttcaccctatctctctgtggcgacctcccaatactcctaacaggagacctcctaggtgagccattcctccgaacaggcgacctctccctatgtgagctagtagtcttaacaggagacctcctcctaggcgagcgactcctcggagccggtgacctctccctccgagcaggcgggctccgcctgcgcggcggcgagccacggtccctcgccggcgagcgcgacctcgagcgccccgacctccgcgaatgctccctccgctccaccgccgaagccattccccacctggagcagcatcacccccaaaccaaaccgattcagaacagcactacgaagaaaaatcgcggaatcgctagggttttgtgcggcctcagtccgaggagccgccaaaaaaaaaaagagggagggagggagggaggaaggggagcgtaccgggtgcggcggaagcggatgcggagtcgtcggcggcgaggttatcgccggtggcgaccggccagcggcgaccgcgaaccgagggtttcttctctgtgagggctcggcttcagagaacaatccggaaccggaggcggagtccgggaaggctgtacaatatcaagacgaccgcgaaagcccaatagagagcccaagttgctaagcgacggcggcccagttagatgagggcccatatggaagactctgtggtggcccatagggaataagttcatctagggtcccttaacttgtcaaggaatccgattttcgtccttcaaccgtaaaaccagatactatgggtccctgaactatcaaaaccgatgcatattaggtccctcggcggtttcgatggtggttttggctgacgtggcacctacgtggctaatttgactcgatcacgatctgacgtggcactgatgtggcaatttgatccggaaaaataataaattccgtgggacctaaatatcagtttcacacacaaattaataaaagaatggcggggtccacgtgaccccacatgtcagtcaaaatcacccctcctcttctgcttccggcttgccgctcgccgcgacgacgacgacgaccgtggatgcggcgccggcgctggcctcgacgtccttgctggccggcgtcgtcgtcgtcgacgacgactcgtcggaggacgaggtgccgtcgacgtacatcccgatggcggccttcctgacctcgagcacgaacagcagcagtgtgagccagacgatggcctagaagacggagagctggacaacgagctgctgcgccccctcaccgtacatggaaggccgtgaagatcgagagggcaacggccatgaaccaccagctccaccgctgctttgtatccacgagcaccggcaccaattgcgggtcccacgccagccgccgggtctgctcctccgcctgccggcacgcgtcgttgtcgggcatcaggaactggatcagcaggaggtccagcgactgcgccgtccctccctgttgccagcggcagcttcctcctccctttaccttgctgcaatcgcccggcaccggcggcgggggtgagcaggcagcaaccacccgccggcgctacccgcctccgcgccgtctcgccgtcaccgacaccgcccgcgccggcggaggcgttcgggtccgatgccctcaaggagactttctccgttgacgtggtggcggccgaggcgcggccgctgaacgtgcccctggccgcgcccttcaccatcgcgtcgtcgcggctggagaccgtgtcctacgtcgccgttcgggtggagctccgcagcggcgcggtcgagtggggggaggcgcctgtgctgccctccgtcaccgccgaggaccagcccggccgcctttggtgcccatcccatccgcatctggcgcaagagagatgaagagaggggagctggggagaggaggaagatgggaaggggtgagttagcctgacatgtggggcccacatgggtcccattgttttttattcttttgtgtgaaactgacacgtgggtcccataggttttattttttttctggatcaaattgccacgtaagcgccacgtcaatgccacatcagatgaagaccgagttaaactagccacgtagacgccacgtcagccaaaaccgccatcgaaaccgccgagggacctaatccgcaccggttttgatagttcagggacccattgtacctggttttatggttgaaggatgaaaatcggattcgttgacaagttaagggacctaagatgaacttattcccacccccataattttgaagaggaaaaagttcactttgggtccctctatttgtcgccccgtccgattttcgtcccttgaccgcaaaaccgggtactacccatcccccaacttacgaaaccgggcaaacaaggtccctcggtgattttggatgacgtggtgcctacgtggcttgtttgactaggtctccgtcccacgtgacattgacgtggcaattaaacctgaaaaataaataaaccttgtgggacccacatgtcagttttacacagaaattataaaaaaggtggggcccacgtgggcccacatgtcattctctcccccttttcctccaccccatgttccaccgcattctcgccgcccgcgcccaccgacgacacgaccccagccgccaccgcagcccggcgaccggtggcgccgcccacctccctgactcgccgtggccgctcggggtaaggcggttcccctgttgccgctcccgctcccgctcccgccgtgccgacgcaagagaggaccgcgcccgcccggctgtcgacaccccatcggtggaggaagtcggccaactgcagcagccacggcacccggcagctccgcccgcctcggcggcgctaccgcggacagcgacgcacctgacgacgacgccgcggccgctccccccaccgccgagtcaacgctcctctgcacacgctcgcctgcagagcgcgacgcccgtgggctcaacgactgcggcagccagggccacctcccaccaccccttcctctcctgccggccgccgcgcgccgagcaccactgcctctccaccgcgagagagaggggagaaagagagctgaagagagggagatgtggatagaggagaaagaaggtggggctgaggatgacatgtggggcccatgtgggccccacctttttattatctgacttgtgggccccgctattttaaaattatttttttgtgtgtagctgataggtgggcccatggtttttattattttttcaagatataattgccacgtaagcgccacgtcaaatgccacgtgggacagagaactagtcaaacaagtcatgtaggtgccacatcagccaaaaccgcctttaaaaccgcagagggacctcgtttgcccagttttcgtaagttgggggacgggtcgtatccggttttgcggtcaagggacgaaaatcggaccgggcgacaaatagagggacccaaagtgaacttattccttttgaagagaaaatccaagaaatgacaagcaccaaatttcaaaaaaaataccatcaataaatacgagttctatgaaatatcatcgtacaagtgaattcgtcctagaaatgtcatcaccgttaaggttccgttagcagtccatcctgcagcattagatgtgttgtttatcctatagcatttaacgggaggctactaacagaatcttaatggctatagcatttctaggataatcctcttgtacgatgatattttatggaacatacactcatatatcgtatttcttggatttggttgattgtcggtggtatttcttggattttctcaaccacaaactagtccagcccaacacttttggcagtgcctctccttttttttttcttttccttttttgcgggtaatgcaacttttcattttatttcactagggaaaggaagaatttgagacacttaacccgtcagatacactgttctttttggactatggaacgtggggacttcataagaaatgtttttttcaaaacagtcaaaattcattatggattattgagtctacatcttatgttaaatatatataatgaaatcagtttatactgtaattgtcaatcactaccagaactcaccatcaccatgtcccctactgttttttctgctagggaacagcctgaaactagtagggaaacagtttccctacactttttcgtagggaaaccttccatgggaacatattcgtggggaaataaaagtgccctacgatttcagctataaaagctagattcctaggatatgaaatggtagggaacattgcttacatggcatttgtgatccacattacatggcatttgtgatccacatgtaaagtgacttcccctatgtttctaaaactgtagggactttttatttaatatatttctcctagctgtgccatcacacaattatttccttttaaaatgttcaaatagtagggatatttttatatgcaatatatatctgaatattgcaccaaataggcgattcactcaaattaaaaataattaaataggtaatatatatcactaatcttacaaaccaaatcaacacgagctctcacaaatcttccatgaataatcattacttagataagcataaagatcactgagacactaatagaatcagttacatagttacataggccgtgtttagttcgcgccaaatttagaagtttagttgaaattgaaacgatgtgatggaaaagttagaagtttgtctgtatagaaaagttttgatgtgatgaaaaagttggaagttcgaagaaaaactttgaaactaaacacggcctatagtgaatcacaaggtttggcaaaaggtttgcaagcagtaaacacaagattccagatttgcccatatttaatgctgccttaatgccaatcacacagacaaccatcacatgtattcaggtcacaaaacatgatggtcaatcccacagctgctgttgcttcacaaaatacaatcatccagatgcagagggagggctggcagtgaacctagtgcttcggcttctgctgttgctgttggtgctcccatacaacaacaagaacatggcatacataatcacagcaaaaaagtgaaaccacaattattcatgcaataggaaccgaaaaaatgttctcaaacatacacagcagtcgcaagcattacagtacataaccatgtttgtgctttacaaacaactttcaagaacggttaaccaaacaaagtgcaatggaatcatgaaatgcattcatcggatcgcaatcatcaaacacttcttctgtctcaggctgatcggcagtagcttgtgagggcacatagttctcatcacggtcacaacgatcaaagtgcttatcccgtatgccactaaccctaatgaagttatggagagcacagcatgcaactatgattttggcctgtttattaggagcataactagagacctttttccaacatgcgccacttcattttcaaaactccaaatgatctttcaatgacattcctaagagatgagtgtgcatagttgaatttttcttccttaccttgaggttcagggctgtctcgatactcctgtagatgatatttggttcccttgtaaggtgcaaggtaacctggccggttagggtagccggagtccacaaggtaatactttcctacagcaagaaacatcagttagtgccacattctacaactaacaaatcaaaatgaagtacaatgcaacactatacctgtaggaggatgtggaaacacatggttgtatgttgagtgtgcatcatcaaatactctcatgtcatgtaccgaaccaggcccatccagatagtacaaatgtaaacctcatgtcgaagtcacatgcagccatgacattttgtgtggtcatgcccttgcggcacaagtactgcatgaacttgttgtttggcaccacgcaagggacatgagtcccatctatagcccctatgcaatccttgaagtagggatagaacctacggttcctcagtcttgggtgcattgttctgaattgcgggtccacaggctttatgacatcaacagcaagcttgaccacagactgcaacactttgttaaacaagctacttacagtccccatggacctctcaaatctgtcctcagcttgcctaactgattgtggggtgccaaccatccaaagaaacatcgcaagagcttctaccgaggtggatttgctactagattttaggccataggactgaaccaataggtcatgcaggaggaggaacatagttggactcattctaaacatgttataacatgcctttctatccccaagcttattatgtacccattacaacccagtcaaggcaggttgcctatactcactctagtcaaatgcttgtcaatgtggatggcatactgaaacataacgtggaagaaaccttcgtcatcatcgtccaacaagtccaacatcatcttgtttaagtcttcatccatgcgctgtcttcgagcacgacgattgtgggatgctgacaacgaccacgacgagaatgacgagaataacgacgaccgcgacgagaatgatgacgacaacgactgccctgcatcctgtcaaagcaaacaatgagttatgttagtaaagaataacaaaacatttgcaaataaatctcagccatgcagcacatagttcaaatcagcaatgtattaaaagtgcatcacacttagtaccataacaatgttcatataacagacatcacaaccatagtacacacatacataatcatacacaggattgaacaaacagacaataatacatgaacttaaaattaatgacacaacagaacatgagatggactagttgtcgacctcaacatatttcttgatgatgagcatccttcctgctggacaggtgtgaatgaatgcatccatcgcgctaccattctgggtaatgttgaccacgcccatgaacagctttgggcttccttctggagtgaccccacactccggccatctcgagtacctttttaatcttcatctcatgagcgttggcttgagcttcggcggctatcatatgggcttccgcggctctcctttcggcttcggcggctttccgtttggcttcggcgacatcctgcataacttgcaacatggattgcattaggctgattttgctcctttgaaggtcattgtactccctcatgttgctaaccattgccctcactgctggactcttggactttttacttggactcgtccttttgttgccaacactaagaggggtcagctcgtcctcttgctcatcaccatccgcttcgtcagagctatcacactctataggctcctcggcagtggccacaaacgatgcggaaccatccacagcaacaccctcaaacattcggtccatttcaggcaaatattccggcaagcctggcctaaacttcttccaatcagaatgtccctgcacaaagaagtcatatggcatgaagtcctgaaacaaatcaaatacaaagtttaggttgcaacttacgggccacatatgatagcaaacatgaaaagaaaccacattagtatgaaatgaaaaggatagcgggtaactaattatatcctctagaatctgaactctgaagcaagaagggtttacatggaatacagacccacaagtttagtgtcaacaatgctgataacaaggcataatttttttcactttctattcatttgggtgcaggttatcagacaaagaacagcaacaagggacaaacatgaaacaaaagaacatagtatgccaactaacaggtggatatgtataagaaaagggtcagatatcattacacacctcaccacgtgctgcacttctagatgacctcggtgactggtgggattgggattcatgtctacccctatgcctatgctcttctggagacactgatcgcccacgcctagatgatctccctgattcaccattgctctcatcccggtctgcccttctctctcttgcagaatcctttctatcatcatgatctgccctttgctccctgcaaatgcctttttgatcatccccatcagaccttctaccccttgaatcacgcccttcataatctcggcttgaccatgtctcccttgaagcacccgaccgatcagaccttctatctcttgagtgatccctatcatcatcgcaatccagtttcctgtccttaaaagagccctcctccctctcagcctttctatcccttgacacatcctttccctcatcacgctccctggtggtcttccggcggtcaccctcagtagcatctgcaccttcccgctcactctgagcccttctcagccgtttgctctgcggcgatggcgaccaagactcccgtttcctggcaggtgacggagaccgtgaccatgactgtttcggtgacctgacctgctccttcaccctatctctttgtggcgacctcccaatactcctaacaggagacctcctaggtgagccattcctccgaacaggcgacctctccctatgtgagctagtagacttaacaggagacctcctcctaggcgaccgactcctcgcagccggcgacctctccctcctgcgcggcggcgagccccggtccctcgccggcgagcgcgacctcgagcgccccgacctccgggaatgctccctccgctccaccgccgaagccattccccacctggagcagcatcacccccaaaccaaaccgattcagaacagcactacgaagaaaaatcgcggaatcgctagggttttgtgcggcctcagtccgaggagccgccaaaaaaaagagagagggagggaggaaggggagcgtaccgggtgcggcggactgcggcggaagcggatgcggagtcgtcggcggcgaggttatcgccggtggcggccggccagccgcgccggcgaagcggcgaagcgagggtttcttctctatctgtgagggctcggcttcgcagagcaatccggaaccggagtccgcgaaggctctacaatatcaaggcgacgcgaaagcccaatagagagcccaagttgctaagagacggtggcccagttagatgagagcccatatgggagattctgtggtggcacattttactagcgtcaccacataattttgtagagaaaaatccaagaaaaaccattgacaaacacccaaatctaaagaaatgtcatcgacgagtgcaagtttaataaaatatcatcgtacaaatgattttgtcccaaaaatactatcgtcgttagggttccgtccatcctgtgacgttaaatgtattgtttatcctatatcactaaaggaaagctgctaacagatccctagcggcgataccatttttgtgacaaatacgcttatacaatgatattttatgtaactcgtacttgttgatagcatttcttggaattatgtgattgttaatggcatttcttaaatttttctcaacctcaaactagtccggcacagtacttttggcagcgcctccccttttctctttttttttccttttttgcggttaatgcaactttttatttcattaacccgtcagatacgctgttctttttggactttggaacgtggggacttcataagaatttttttttcaaaacagtcaaaattcaatatggattattgagtctacatcttgtgttaaatataatgaaatcagtttatactgtaattgtcaaattatggactactaagagacaatgttccacttgtttaagcacggactgttcttgtgaaatatccttggtaaaaaagggaaaaagatcatgatatctccagcattccacagtcaaaagttcatcctactatcctatataggggtggacaaaaaagcttgggctcgtgagcaggctcgggcttggctcgagctcgcaaaagctcggctcggcttgaaacctaaacaagccgagctcaagccgcctgcgcagctcgtttctaaatcaagccgcgcccaagctagcttgcaagccgctcgttcagctcgtcaagcttttgcataaaaatggcctagcccattattgtcgctggtgtggcccaaggcccatcaaaaatcctaagtccctaacctattcccccaatctcccacccaccccacgcataggcagccgttcttctccccttcccaccacgcgagacagcgagtccgccactgaagcctttcaacgagtccgcccgcctccttcaacacgaagtcgcgccgcgactgcatgaggaactgagggagtgaggacatcgaggcactgcgctgtgtcgtctcctgcctcccctgcggcgcctcttccctccgctacaccgccggtctgctgcctccctcccctatggcgccgcctccatcccagcgccgacagcccaccatctccctcccctgtgtggctgcgccgcggccttgctccccaacggcgtcgcctccatccccagcggccaacaccgccggtctaccgcctccatccccagcgccaccggtccaccgcctccctcccctacggtgtcgatgccatccatcgcctcgctgcctgtatctgaaccaagctagctcgagctttgaaacgagccgagccgagccgctattttagctcgtttcattaatcaagccgagcctattctttgtcaagctttcacgagccgagccaagtctggctcggctcggtttggctcggctcggctcgatttcacccctaatcctatacgcccacttgttatgcgaactttctatcgactattgaccttcagtgtaaggcaataactgcttccaccgaacaagatacagtgcttagcaccaccaatctgacaaaatcagttacttgattactcatctcaagaagagaaaaacacttgatcttcagaggtagagacgctgagtgtgagtggttagccaactgccttatccaacatcccaatgtgacaacggtttaatgccagtgcgactggccggaatcaattcagaattacgattggatgaaagattttggtggagttggccaaaagcccatgtatacgcttctctactgcattcctgtttcgtcaatcaaatgatcacccacaatcacattgatgctgatacaattattcccctaaagaacgtagatatacaatatcaaatggcatcttttcactttggtcaacttcttcatcgaataaactatatctgcagcctcatcaaaagtcaacatccattgcctaaagactgaagttcgaggtgcccttttccctgtacctcctctttttgggacggctgttgaccccctttatttcagaataagaataactcggacgttgactctgccagtatctgaaacaccaagtaaagcacgcagacatttttcgtcgactgcgcatcgttgtcaagcaacagatgttgacaaatccctcaaaagcataatctttcagctcaccttcgtcagagatcagagtgaggcataacacaagtacacagcatatgtaccttctgctcttgcgagccacaagaaataaaccaagaattcacggtcgaaaatccgagctgaaaacgaagctgaaaccacagcacaattcagagagtgatcaccaatgatcggtgaaatgcagtgctaaacggcaaaaaggatggaacagatcgtccaaagtggcactctgctggcattggtgtcacttgtccgtacacacggttcatactactttcagagctcgtgtccatcactttcttatctgctcatccctaccgatctcgcagatcaaaccggacgcacaatggccgatctctcgtatccctgtccgatccatcactcgtcaactgcaaagttttcgcgttcatgcctgcacatctgcttttggtcaaatggcaaactgagttcttgtgcacttggataagaccagttgaaacgagttcttctttcagagcggttgacctgctacagagctggagccggtgtaacgaaaaggggcccttcaacttttggcatgattgtaacaggcgcaatagtggattaaacaagtggaatgcccaatggaattgcactgggactggaaggaatttttctacaagaaaatacttcgatgcaatcattggttgatgagccttgatgtcctgtaccgtaagagcaggtacaatagcaaggctattagccagctataaacatattttaataagataaaagatgagatattttaatgagataaaagatgagagagaagagtagcgggctacagatctgtagccagctgtaggaaggactccaagacgcaatgtgtatatgacatgtgagatcatatgttaatagtgtagtaagcaactattgtatgaattggctattagatcggctatagataaattggagctagtagtgggctatactattaaacttgctctaagaaacaagaaactgtaatgaaaggttgacctgtagtggtgagagtattgctggatttttcacattttggtgcttttaaaaaacttatttcgcaaatagacccctgaaaaaacttatcccagaaatggtcctttttggggcgccagagcgggacggcgccagcctctctggcgtcgtcctcctgccaccgtggcgcacgcgaaccgacgtggcaggaggagggcgccagccatgctggcgccgccccagggaggagggcgccagcatggctggcgccgccgcctccattcctgtttctctgtatggagttgcaacggtgtcatttttattttattttttcggatgttttttcacactcaggatcacgatacaacaaaccacaaaaaaaatttaaactcgaactaccacttagtctgaaaatatctagcataccacttaatctactttgcaccttcactaaaattagaccataactcttttaataaaaccctttgatcagcatgttaaacataatgcactctaccactatatgaaattacttaatctaattcaaaatataaccacatgaaatgacatatataagttaaacagtacatagagatgcaattttttatttttattttatttttttgatattttttttatacttaggagaacataggaaccaaccgtataaaaaataaactcaaacggacaaaatatgtgacatgtagaattttccaaaactctaccgaaacggacaaaatatgtcatctattaaaataggcgtaactttctcatacggactcggaatcaggcaagtaatatatgcacggacatctacagaaaaagttacatccgattctccctgcttcgccgggttcggcgatattaaaacctccaaattccgcttgcaagattgtattttcgaggagagaagtttttcggtagagctttggaaaattccacatgttatatatttcgtccgtttgagtttattttttatatggttggttcctgtgagttcctaagtgtgaaaaaaatatcaaaaaataaaataaaaataaaaaagttgcacatctctctcctctgcactagttcggagagagaggagaggagaggagaggaaaaattctacatgtcacatattacgttcatttgagttcaatttttctatggttggtttttgtgtgtccctaagcgtgaaaaaaatatcaaacaaataaaacaagaataaaaaatttcggggggtggcgccagccactctgacgcactccccctagccacctcagcatcgccccgccacgtcggcagggggacggcgtcaaagaggctggcaccatcctgttgaacgacggcgccagccactctggcgcccaaaaaggaccatttttagaagaagtttttcttggggtctatttacgaaataatttttttaaaaggaccaaaatgtgaaaaatccaggagagtattgccatccttgctgtttgacttcggcgaagcaaaggcaggtttttttggatcccaaaatgttcagttttcatgggcacgagccgtctgaacaacgccgctagcttttttcacaccgtgagatctgacgcgcttgcagctctgcaaaggcttcgagcagctgccgctgccagcaccggcgctagctgcatcctactcatcgtataatctgtgtgctatatactcactgatcatgcaagcctgaatcagaatcaggatatcccgatcagcgtctttgtcttgtaaaagagaaaaaaaaacatatatagattttcagttcccggcacgacatgatccgtgaacagtagctacatagccgcggctgtatttttttttcctctcttgggaacaaacggtgtgccatggcatggtggtttgtagaatccaccgaaaacggtagaattttcggcaatctgtatcgtgaacgacggcaaaattaaaggggttggattcttgcttttgcttggctcggcggtgaagtggagtggagtgagagggaatcaaccgaccgcggcgaaaaggggagggaccgggccaccgatcgacgcaaggcaggcggcggcaagggaggacaagcacgcgcgctggtgatctcacgctggacaagcaagcaaacgcatctgactcctcacacgcgacgacgagccgtccaccccatccatccgcttggccgccccgcgccgcaaagcgccgcgctctcgctcgcaccactttcggtcggcgcgcaggcgcagggcatgggccacgccacggtgcccccccccccccccccccccacacacacacacacacgctcgctcgctcgctcgaagcgccacttgtcccggccctgcgctcgacgtggccagcgacaccgagccagcgcgagtacacgtcgacgacgtcgtcgtctgtccctgtccggccccgcctcggcgtcgtcggctcgtcgcagcggaattcctgcctgcgtgcgcgcgccgtggcgtgttagtgcactaccaaggctgtgtttaattcacgccgaagttggaagtttggttgaaagttggaacgatatgattgaaagtttacgtgtgtaggacaggttaatatgatggaaaaagttagcgcatgtctagattcgtagtactagtaaatgtctcatccaatcctagattattatattatgggacggagggagtaggcaaagactgtatttagattcaaaattttttcttcaaacttctaacttttccgtcacatcaaatgtttgcacaatgcatagagcattaaatgtggaaaaaaaccaattacactgtttgcatgtaaatcggagacgaatcttttaagcctaattacgtcataatttgacaatgtgatgctacaataaacatttgctaatgacgaattaattatgcttaataaattcgtctcgcagtttacatgcagaatctgtaatttattttgttattagtttacgtttaatacatcaaatgtgtgtccgtatactttaaaaaaaatttggcacacgaactaaacacagccaaaaattgatcacaatccaaataatatcaaagtgactatttgaaactaccatattttgacatggcacaaattggcactaaggttatgtacaatggtttttgttagcggtctctctttattgtcatgcaagaatatttggtgacgtgaaaaagagaggaagaaggaaagagaaagatggttgctacgcatgacaacggcgtagagtcgagtcttaatatttattaggaaatttttttgttgcgttgagtctaataaaggaaagatgactagtaagaaagtattttggtatattaatggttagagaccgtattgtcctaactattgtaacgtgatagcctctaattaacgtagtccatatcgatctctatttttgtacttgccctaatccaaacatgctctgcgttacgttggtgcagtgaacatgcatgccgcggctggtggatggatagcttgtgcatcgtgcataaactgcatatgcagcgaacgggtgcgggaatatgcatgtgtgcgcgcggcgcacatgccgccgaggagaagcaggggaatttattactcatccgatgatcaggagttaaaaatatgaatattatactactactccggtcgaggagccgccgacgtgagaagctttttacgggtgaatttaatgaacgtactgtagtattgaatactggtaactgtcacagtactccttcacaaccgtgtccttgattctggaacaagacacggagtacgtatatctagctgatgtatctcggtgcgtttacctttttttgtggaaacgaatttcatcttccaagtctttgcaaaaaaacggtttctagatacgaacaagctgttggaatttggatggaggttggaagaaacctggtgttggtggcgctagaccataaaaaaaacaatcctgtggtggactcgcaacaggccacagtgtcaagccacccaccgtggcccccccgaagagcatcctgcatccaacacccacagcgccgcgcctttcaggtgcacccgctgacttcgaccatcaaaattcgtttatacccgtaggtctccgcttcccatcccaaatcaccaattgcatttcaccaaaaaaaaaacctgtattcgaacgaacgacccaggactttgacaagtaaattcccagtgacctaaaaaaacgccaaagaaaatttcagaacacttgaaccagtagcgagacggaggaggaggtgagattgacgcggagggagacggacggaagaagccgcgcgttcccacggcacaacggagtcgacgctcgtccatccatccatccacaccgcgagcaaccgcgtgcgcgaaaaaatcccccttgcttcccacgctttcttttccttcttccgtattttcccataatccccctcactttttacacacgccaaaacgaatttcccccatgttccaaacttccaaagcttcccaaataaatccacaagcacaagtctcccctgccctatatttctccccctctccctatatataactctcacccgccacaaaacaggtaaacaactcgccacaagttagctcaagctcgagacaaagagggaaccaacagaaaccaccacggcggcggcggcgcgacacatcaccggagagatggcggtggcggtggcggcggcggcggcggtgagcaggcaatggacgagggtgcggacgctggggcgcggggcgtccggggcggaggtgttcctggcggcggacgacgcgtcgggggagctgttcgccgtcaagtccgtgggcgcggcgggcgcggcggcgctgaggcgggagcagggggtgatggccgggctgagctcgccgcacgtcgtcccctgcatcggcggacgcgtggggcgcgacgggtcgtaccagatgttcctcgagttcgcccccggcgggtcgctcgccgacgtggcggcgaggtgcggcgggcggatggaggagtgcgccgtcggggagtacgcggtggacgtggccagggggctcgcgtacctccacgggatggggctggtgcacggggacgtcaaggcgaggaatgtcgtgatcggcggcgacggccgggcgaagctcgcggacttcgggtgcgcgaggtgggcggattcgggccggccgatcggcggcacgccggcgttcatggcgcccgaggtcgcgcgcggggaggagcagagcccagccgccgacgtctgggcgctcggctgcacggtcatcgagatggccaccggccgcgcgccgtggagcgacatggacgacgtgctcgcggcggtgcaccggattggctacacggaggccgtccccgaggtccccggttggctgtccgccgacgcgaaggacttcttggccaggtgcttgcaacggcgccccattgaccggagcacggcggcgcagctgctagaacacccgttcgtcgcctccgccgccggcgacggcaagccggaggccgcgaagtccaaatgggtgtcccccaagagcaccctggacgccgcattgtgggagtccgacaccgacgaggaggaagacgacgagctgtcgcagagcacggccgagaggatcggttcactggcctgcgccgcctcgtcgctgccggattgggactccgacgacggctggatcgatgtgatctccacccctaccgaagaatcctgcgagaccaccacctcgccggccgacgaggagacgacgactgacctcaacggcgacatcagaaccgcagaattcgagcttccccacattgacgtggacagcggcaatggcaacaccacccacaatgtgggagaagccaatgctcagcacattatttccccttcgaatttagttttcgatcaagtactatgtaaaacaccattttgtaacaaacacattgcaattgaattcataccatgttttctcctcacaaatgtttttctccccctttcgctgctctgttcatacgctcctcacccttagtctctgccctcctcctatcgcgccacgtgtccgcgaatttaccggccaaaattaactgcggtgaccaatacgtgcgggagtgaaactgcgcggcagcttgcttgctctgcaagtgcaacactgcgcccgcgtagtaggaatgagaaatcgatcagcttcagcagttcagcttccccaccacggcacatacacacgcccgaagcttcgcttccgacgcgaaagggatcgagtcgagtcgacacggaaagcgcatcgcagcagcgcagcgtcagggcggacgcagaaagggggccgcgcgcgcgcgcggtcaatagccttcggcctctcgtggcgccgcggcagcacagacagcagcatatgggcccgtgtccattcagcaaaggcgagagagagcgagccgacggtgaaaggcgcacaaggggaagaaccgaagaaaaggagttaacaaaaggtgcccattttacaagtaagcgtcgcgtcctactactgcgagcgagcgtgcgtgcgtgcgtcgttgcggttgcttccaccggtggggatccggcatgggaacgggatatgctactactgccaacttcggtgtgacggtgtcacggtccgattcgtgattcgtccccccgttgtttttttcctctctctctctacgtgcaattcaccgcggcgcggactcctcctcgatcccgtcgtgcgcttctggatggcgtacgtgtcgggtgcgggatgaggcggagtcggtgttccggtgggtttaacggttgacgcccatatgcttttagcttttccgatgtttgcaagactgcgaaaaggctccgtgtagattttattattagtcgacgcgatgacacgacgcgtacgggacgccgccgcccgttttatcacaaaagcgagcgatttgagcggaagtcctatgcccgtcatttttggcgggtagaagtagaacagtgatcgattggattagcatgagagcatggatgaacattacacatgctcatcgtgcctggaccgccgtcagcaattgaaatcaacgatgcaacactctccctctggttttttaatttgtagtgatgttgacttttgcatttatatttaaccaaacattttattaaaaaaattatatgtaaaataaaaaaataatgcttaaaatttttttagtgataaaataaatcacaacaaaacaaatatatgataattatgtaatttttgatatgatgaatggttaaacatatttctaaagtaaatgttaccgtgcattaaaaatcaaggagagtacttcttacgacttacaagtaattacagataagattgttaaatcgcagattctaaatcaaattaacataaggtgtcatggtgcttaccagctgatgattatatagtactcccaggcgatacatttaactacagagaggtagttgcatatcagacgtttgatagattgcccctctcgttaattaaccacccgcaatgcaaacgtaagagccagcgtcatccacgcataacgcatacgtcgatcgaaatcgcccggtttggatttggtcggcgtctccgcaagcgcgtcaacacaatcccggtcgccaccgcgagccgtacaaccctgaaagctgtggacgccatcacgccatcgagctgggcgcctgggccacagtgccacttcccccgcaccggcaccgcggcgccacgacggagtacgtacgtgcgtgtggagtccacgcgcagccgagcgcgcggcgcggcgtggcgttgcgcatctcaccgccaccaccaccgcgcctcctcgccgtgcgtgctcatcatctcgttctcatccggttgccgagacggacgagatgccgagccgccaacccgagcagcgcagtgcgatgcgaggcgcggcccgggctttcggttgctgatttatttattatttttttcgtttttcttttcctccgggagggtgtgcgggtgccgctttctggacgctttgtgcttttctgttgctttcgccgccattctcctccctttcaagcaacggggccgcccgatcgatcgatcgatcgagtgaaggaatcttaaaggtccggagagatcttccggaccatcggatgtgcatatcgatcgctgtcctggctgcgcaattaaaaccagctcatggaattggcgtaataatgactgattagagagagagagagagctcttttacgcggaggggttatctcacatgacatgacaggatcatcaccacagatattttattgttccaggctgtagccaaaatcttcttgggagccaagcaaaaccaagtactactactagtactagacctgtagtggtagtgcatctgatagaatattcccttagcttaaacatgattggggcaaatgacagttgtgatttatactatctcttgtgcaagatgagttaggtatgcggcaaaacggtggtgacaattgttgggcacgcacagtcggactgggatgggtttggttggcagccggttggcactagttagttaagcttgcttggtgtgtagttatctgaacaaacccaagtcaaaaattacgttgtaatattctaacttgaccggtaattgatcgagctagatacaaatatccaaaccccaaattgatgtcccaatacaggccttccaatcattagaccccatgataccaccgaactaattaaccaaaataatcaccagctcagcctaattaagttcggtggcgtcaaaatatggcagccaacatagatcagcaatataatagtggtactactagtagtatactcacgcgacgagccaaagccaaacggccaatcatgaggcggcgaaccgggccgcgccatgtgtgcgcggtcgatcgcttgtgcaacccaccaaaaccgcgcgtttttcatctggaatttttttgccgtttctccgtaggatttgccgtttgtccccaccgtctcgctctcgcgtgcgcgatcgttaggccaccggcgcgcgcggtgccggcgtgccaactggataggcattggctacgtgtatcgcaccgtctcgtttcgtctcgtctcagccagccagatggtcattattgctctccgttgcagctgttcgggcagaaaccaaccgatcgagcgagattttgctaaggacttgactcggctgggctgacttcacactggcgaccctggctggctggctggctcccattgtttaattagccgggggaatttgattactcgctggtcaaaaatcaaattcgttattgtttttaaaacgagagaccatcgatcgtaggtcagaggagatacaccgacaaagacacaaagtgtttaggacatgtgctactacttctcagaagcactcctataaactattcttactgtgtgtactgtgttggtcaatgatcttatgcgttctctttgaagcccacagcttcgcgtttctgatcttccagtcgtactacctcctacctcgcgtgcttccggcatgataattgcaggatgttgctattcatttcttgcaatgcctaatattttccacgaggatgatgcgaaggacaaatgtgaattatactagtctactactatggcctgtttagatttaaaatattttctttaaactttaaatttttccgtcacatcaaatgttttaacacatacatagagtattaaatgtagacgaaaaaaaatcaattgcacagtttatatgtaaatcatgagacgaatcttttgaacctaattacgtcatgatttgacaatgtgattctacggtaaacatttgctaatgacggattaattagccttaatagattcgtctcgcagtttacagacggaatctataatttattttactattagtttatgtttaatattttaaatatgggtccatatactttaaaaaaattggcacaccaccaaaacacacggtatatgagaaaggaaaacagtgagcagcaacaaacaatcgctgcagcttcttcacacttgtcaggaccccagcaagaagatccgtgaactgatgaacctaccaacctgcactttgcccgcgtacaggcacaggtgccacgttcaagaagagagagagagagagagacagagagagagagagttagatgggaaccgaaggaacgtgagccagatggcagaaatgcagccaagtgatcggtccagaaaacaaaagagatatagctggggcggtagcgaggttggatcaactacgctggtgcatacttgcataatctgagaaaattgacaagagttgtataccatttgatggaagcagatccgaaaagcaactcaattttagtgggtaatgcaatgaacatgattttatcattttaagtttgttcacttcgctaccatttttaactctatcaattttgacattactaaattttagtaaggcaacaaatcaaacacatttttgccattgctaccatgccaaaattagaaaacccagaagctcttactctcaaaacctcaatcaatatttggtaagactttaaactaaacgttgataccaaaatttagtaacaccaaaacgtgctaaatattagtaacattgaaaataacaataaaatgaacaaagcatttacttcgttgttaaaagcattgggtaggataaattaagcactgttatttcaagattttaaattcaaccattaatagagtagtatcatttgacagtcccacctcgaataaaatcacacaatcccgtcaattcaattgaaggattaaatttctcattttatgtaaaaggattaacttagagcatcgaaactcatatgattattgaggatttggggcgtctccacgtatacacattatggccaatgaaattgtaaatttctaatacaccacatatacacattatgacctacatgttagctctatactttcatgtttcgtatacttgccaagaaatttatgactaggtgtcaatattttttcgcacctccacgtaacttcatgatccttataccaaaattaggtatgtttggctgcactacttcagctgtgacatagcaatattgcacactactttgtgtcactacaagcagttgtgtggctgtgtggtagcggctgcaaaacgtgcatccgaacacacctatcaaggtgaaaataaataaataaaaatcttatatagaattctttaactaaattgattgtttataacattccaaagaggagataacttttgcgatactatatttgccttttagatagtctccacgcagtatatctatcttcaagcaaaactgcatgcaatttctctgtacacaagggtatatacttcttcacccaatcaccaaaactgcatggatccttccactttcaactggcatttcccggctcattcttctccttctagagtacaccgccagtccgcaaccctcacacccaacatttttttaaaaaattacacagttccatgtttgtttattttttctaatgaaatcaatttcatatttcgagtttcgactatcatttccttgctgattcttcgtatattctccagtacacagccaccgttgcatagttgcacccaacatccgatttttttgttagttgctgtcatgctaatccaattgccaaacccagatacccaagatttgtgtagtagtagtaacatctgtccatagtaaagagccccgatccgtcaatgcaagcaacacgtttcccccaatccaccagagtttttgggcgaaaaaaccccaaaccgacacgccgaatccctcctcgtgctgcaattctccctcgttttccacttgcctcgcgcgcaaatcccacgttccgttccacccaaagccaccaccacgtggcccccccgcgatcaggatggccccacacgccagtgtctctaccccgcacgaggcttcgctcacgtgcttttcccgcgcccatgcgtccggcgcgccacaactcgcgccgaactcgcgtataagtagcgcgcgctcggctgcggccatggccaggcaaaaaacaaaaaaaaattccgagacatacatagccagaggaggaaatcaatcgatagtgggcatggatgcggcggggatgatcatcggcggcggcgggcggcggaggctgacgagggtgaggacgctcgggcgcggggcgtcgggggccgtggtgtcgctgttcgcggcgggggacgacgagctgctcgccgtgaagtcggcggcggggccggcgggggcggcgcagctgcggcgggaggcgggcatcctcgcctcgctctgctcgccgcacgtgctcccctgcttcgggttcggcgccgtcgccggcggggagtacgggctgcttctcgagttcgcccccggtgggtcgctcgccgacgaggttgcgaggaatgggggccgcctcgaggaggacgatgtccgggcttacgcggcggatgtcgcgagcgggctcgcgtacctccatggggtgggcatggtgcatggggatgtgaaggggaggaacgtggtgatcggcgccaacgggcgcgccaagctcgcggacttcgggtgcgcgaggcgcgccgactcggctgggccgatcggcggcacgccggcgttcatggcgccggaggtggcgcgcggggaggagcaggggccggcggccgacgtctgggcgctgggctgcaccgtcatcgagatggccaccggccgcgccccctggagcggcgtggacgacgtggtcgccgccgtgcgcctgatcgggttcaccgacgccgtgccggagccccccgagtggctgtcgccggaggcgaacgacttcctggacaagtgcctcaggcgccgcgccggcgagcggtggacagccgcgcagctgctggagcatccgttcttggcgctcgccggatgccgcgccgtggccgccgaggagacgaagcccaagtgggtctctcccaagagcacgctggatgccgcattttgggagtcggacgccgacgacgaggacgacgacatgccggagagctgggccgagaggatcatggcgctggccgtcccctgctctgccgtgccggattgggaatcagacgatggctggatcgacgtcatgagcagccaatccgaacttcccatcgcggcggctgaaacgccggccgagcagacgcgcagcgaagtttctgaatcgccggtggcttcgccggctttggagacgacgagctacgcgagtgcttgggatgaaagatcggaagctgtaatggatgctgacgtggacgatgacgatgatgagctcgtgcacaatgtacgaactgttgatacctttgtggatgaacagctccgccaagatatttatttagattttactactagtgacccaattgtacttcatgttgatgtttctgatgaaagaaaagtaaaattattgcctccaattcctgactgcctctgttcctccccttctctttcttttttcgattttattcactcaaatctgataacactacaaactcaaactacaaatctgaaacttcaaacctccaaaaatgtgaaatcgagggcagcggcatcagcattaattcttcagaacgatggaacgtagacctaaacctctgaattttcagaaccagtgataaccatttcagttactgctggaactgagacgtgttcgttggaactcatgaaaatgacagcctctgtagccgtgacccccctttatgacaactcaccacaaaaccaattcgttcaaccacatctcctcatctactacccgtatacacaacaatctcaaactcaaagcaacagcaacaaaagctgcataatcccattccaatggcaacctttttcatccaattgccgccaaatgtggcaaccaactgaactcaatctagacatgaatccaattcaccgtctctgcagcaacatcactgtctcctcctgctgctgccgtcggtacaagtggcggcggcggcggccgaggagaagtgcttctgctgcaatgctgttgctccggcgacgatgtggtggtagtgtgcacgtttgctggcaggttggtggtggctgcaggaaagctggggagatgaagatgatgcagatcaggggtgacacttggccaaaatctctggattacctcaccccggacaggtgtacactggatggatagatagatttccctagctgcctaccgtcttggagtggagtgtttgctcttgtttctagatccctacaattgtttgtggagtacttgaactaccacaacattttttttacttggcaccaaattaatcatatatatttctctatgatcttgtgcatgaattactacagaattagtagtttagtactagtggtacagttcttaagaacaccacttgactagctaaaattttcagctgcaataattttcagctgtaatggtagaacatgtgttcatacatgtactggtcaaacttttttttttatgttccattacataattattacagagtgcctctcaagaaaaataagggcatcactgcatctacacttctactacatctgagagtagtagtagattcagtaattcggttgccagctcaacatctgataaaaactgtcaaaagcatcgccatgtgtcattgtcacttataccttgatgctatgaacaaccttgtagttgtagtactacttggcatgaactttctccatgtttcttgaagagcaagggagataggagttatagtagtggccatgccagctgcataattctagagagatatccaggtgtacaagttgccagtatgccacagagcccagaggcaggaacacctaactaaactgtattcgctgggttacctccatgatccattttaaagtcagcatcctgctgcagaaaaagaaaatggataatgagatcttctatttgacgaaaactatcaccctaaatttgacttctagaagttagttgagtttccacaattaatttatctgaataagttctggactggtggaagtctgcatgccaaagactccagttttcagagagagttctgaagacaacaattcgaattccaggtctctcgagagaagattcaggcttctcgaacaactagatgttttggcacgaagctgcgtggtgcgtcagcgcttaattcgattgcacgcagggcaggcttcgtcgttgacgacggctgtgacgcactgcagctaccacctgcaggtcaggtgtatcatcatcttcttcttcttcctttcagaattttccaagtcagcccctcccgtttcagaactttccaagtcattcttggaaggtaacaatagcagtagcagtattattctctggtggaggcttcagaaattcagacaaagccgcctcctccgatccacgcagtggtgcaccagcggtaataaaatgatgaactgaattgactcatactcgcaagtggataaaggaaaaaaaaacaaaaaacaaagaacatatttcgacaaacgcaattccaagtcagcacaacttgcacagaagtgagatctttctatagtctatttaaactgtacagcactactgttcagcaaagtacatatgaacatatccaaagaaccaaacggagtcaagctactagaaagattatattaatgttgtaagctcgtgcttaatagtaatagaccatggatctgtgccatgttctcgtctacggaagctcgaaactttttacacgatagcaaattagcaagtggaagctgcaggcgagcttcagttagcagttggtgagcgcaggggaaagctcaaaaaacggcgacccgagtgagtcaaatgccaagtgcggggctgcgtgccgttttggtggccggcgacggaggcaacacgggctcgtcgactcggcgaagcgccctcgcgcgagctcacatttagttctcattggcattgaccggagacattcagcctcatcgtttggctgataaagatgagaaagcgaaaccgctgataaagatgaaaaagtgaaacagtatatttacaaatggaaagtattttgtgtatattcacaatttgatcagctaggcttaggcaaaaatagaagatttgacgttctgatcttaaagctgcttcctttgtggacttgttttctttgctttatctctagcttgtttggctatgccagcagcactagtcctccttttattttgaactgtgttgcttcttgtaaagctggaaaccccagcattctgtactctctgttatgctttatgaaaagctgggcgtctgccttttctctaaaagtattttgtgaatgagacttttatatatgtgttcttaacgaattaaaagcaaaagctgaaaatgaactatgatgaaaaaaaataattccaaaatctactctaaatttaaggttgaaaatttaatttttggctgataagtaaagatgaggcttttgtacgagttgacgataactcttagaatattcctgatcatagcttccagatcatttttttaaaaagagtaacagatgtgccataaaacaaacaagatttctcttggattaaaacttacgtcagcctgatgtcaaaatggcccattaagtttcagttcgcgtttcctccagcactggatcacagagaaattattgaaggaaaatgtgcaaaccaaggttctgaaatataaacatgcgggcaatagtggttcagattatggagcaatgtgcgtggttctcttctcacctccagtttctcagggagggctgaaagtttaagcctgtgaaaatccaattgtaagctctgctgcggaaatggtactgctccaatagcaatagccaacattggtggtgtttgaatcttctcaagatgaagatgaagataaagattaagtgtttcacgcaaaatgaggtggtaataacgtgcgattaattaagttttaattattacaaacttgaaaaatggattaatctaatattttagaacaactttcatatataaagttttcacacaaaacacactgtttagcagtttgaaaagcgtgccacgagtatccaaaagtttatctaacttttgtgcaacagagtcacctgatatacacacagtccatgagattatagcagctgcagcttccagtcgtctgaactttggctctccaaacaatttagattctcacccaacttttgataatctgtagctaacaatctagaaaattaattagaaaacaaaggctgagaaaccaagcttttcttctggattcctaaaagttgattgccaaacaattgatttttaaaatcttaaacttttcaaacagggtctatgctagctctatatagattatggtgctccatcagcatcttcttagaaacactgaatgttctgtgtgcacgtgcaaacaaaacaaaaaccgtgtaagagcaacccattgttgttgattcataaaaggaggattggttctcggaagatcatcacaataaagcaatgtgatggcttagtcaatctcaaaatatataccggttcaatctattggaggtacatgtgcttatagggcacatcatacatgcatgaaccatgctggtttaaaatttaatgattttcagttggagtaaactgtcatgggattacctagatatttgttgataatatttctctcagaaaattgtgagatgtaaatataggacaatcacattgcaattacattgtaacctgcaactgcaatatagcttggatgtaacttttaaaaatcccatcataaaacgctatttctgcaatggcgtaggttggggaccaaatcccctcatccgtgcctgtgctatgtgatttttttccttctctgcttgcacaaatcttgaagagttcaaaccaaattatatgaaagtacatgcaaattacaacataattatactatttatatttgacaaattttaaggaaaaagttgtcggcgaatgtatagcaaaacaatacttcctttgtcccaaaatattgaacctatgatgagatttgattcatcttaggacaacgaatcaggatatactagattgtagttgtactccctccgtttcatattataagttgttttacttttttattagtcattttttatggctaagtttatagaaaaaattagcaacatttataataccaaattagtttcattaaatttaacattgaatatattttgataatatatttattttgtatagaaaatattaagtttgattattaaaaagtcaaacaacttataatataaaataaaagggagtaatattttaggatggagatgtcctaaagtatccagagtttcggactgttgtcagccatccatgatcaatccaaaggcaaaaagaaatggagaaggctatacgtcctagcattttcttactaaattcttactgatgtgtcatgctacaatcgaatcgtgaattggagaagtaatataagagaaaaaatagtttaaactttgctcgaataaacttaaaccaacctaattattgtttttctagtatggatgcatggcttccgatgcatgtagtgggctgcacctggtgcgtctgcatgcgtgggggatgcaggtcgtctgcagtacggtaggaaatctcaattgatgcgtgggtggaagctaaaatcggacgcccgatccgcagtcacttccaaaaaaaaaatagtacgtgtattaatgctcgaaagaaatctagcgccctgttggtgttggagttggagatgaacccaaccaacggtcacactcacacgccctcctctcctccatccatccatccatgcgtgaatgcatgatgcgtctcccgcgtccggcgccgctgaaccctcctctcctctctctcttccctcctgctggattgctttggtttctttcatttgttggctacgacttccttctgctcctcttttttcgtcgtcctcctctcaacgggaatccggtgatgcgcaatcatcgatcggcgacctcaccgccggcgaccggacacgggaacccacgcggccttcctccgccggagtatcctcctctcctaggcgccgccggctcggatcgttctcttctttgttggtaaggaacagtacgctgcccctcatgtccatcccatctgcagtagattcagcatttacatttcgttttgtgtatctgtggcgacgtgttcttggtgaaaaatatgtatcgttcaaatttcaagcaacccaacgaaatacatatcataagtttgaaatttttcacattaaaaaaacaaaaaaaatcccaaaacaggacgagcattttatccagcactaataatatgaagcaaaccggccgctacttgtcatttgatatcgagattgtgaaggttgtgtacatatacatcgcttgcagtgtttttcgttttgttgctgtctgaaatgctcttctagcaaacgggatgaaggatctctgtctccctgggcacaaaaaccacatcaactctctcatatatgtcattgaaaacaaaatccattattgtctctctgataactcagtgttagtttatctgcatagtttcaggtgatcaagagttgcaaatagaatgttgacctgttgctgtttagatgacaccagatgataatgtgagcttctacacaatgctttcctgtttcatttccctctattttgcctcaacacaaatttgtccgctaaagatttttttagtgttgatcctggctatttttcacattctctgaaatctgaaggcccttattactttaaagaaaggcagcaagcttatcaagtatagccggaagggaaaacccaagattcgtgagttcagactttctagtgtaagttcatatgtatgttcgtttgcaatcaatgtcagctctttgctacaggatgaaagtaacgatatttttttttatcgcaggacgaaaatacattagtttggtactcccacaacaaggaaaagtgcctcagactgtcttctgtgtctaaagttatacctggacagagaactgtaagttgaattgccaccggacagttaactgttggtggttaatttgctggtaaacatgaagcaagaaaaatatatgttgttggtgatactccaagagtaaactgtttcattttaaacatgcagcaagaaaaatatatcttgttggtgatactccgagagtaaattgtttcattttaatgaatttttacattttttttcgagccaaagaacttttacgttttaagttgtgatcttatggattttcaatttttaacaggctgtttttaggaggtttttacgccctgagaaggattacctatcattttcccttatatacaagaacggccaacgttcccttgatctggtaaaatataaattctttgtactcgttttcattaactggggttaaatgattttacccctaggtgctatagtttatggaacacaataattttcttacaggtttgcaaggatcaagctgaagtagaagtgtggttttcgacacttgagtcactgattacttcatgccgtctaaattttctgaatgatggtcaaactgatagagtatcattttctgaagtgagttattctcctttccccatttacattattttaatttatattaaagtcgagtacaaacaaaaattcaccttcattttctacaacaatttataatccaatccttgtacaaatgtggccatcccttttaaggatttgattggactgttggaggtttcagcttccttgagattccgatgagctaataaaaatataggatgcacaaaaaccatatttgagcatacaaaatcattattgttaaacaattatagagaattaatatacctagtaaatcacttctgtcattatgacaccgactaattctgtaatagttgtttgacttagctagaatatcatcaccttactgttcttgtttaacaaatgtttcttttttcaggacgtaacaatctatcaagatagcacttcctatgatacaacgctagatatcgcctcaagtattacacgtagttttaactcagctggttatagcacaccgaattcattgaattctattagagcagatgttggatcagaccgcgtaaatatgctaagagcaagtacaggagacaatagccgagttagtatttccagtgcccctagttcttccagtcaaagttctggactagatgacatcgaatccctcggcgatgtttatgtatggggtgaggtgtggactgaggtgctaccctctgaaggatcctccaactatttgtgcagcaaaacagattttttaattccaaaacctctagaatcagatgttgttttggatgttcagcaaatagcatgtggctctaggcacattggccttactactcggcaaggagaagtattcacttggggtgaagaacttggtggacggctaggccatggtactgatactgatatctgtcgtcccaaacttgtcgaatccttggcagtgtccaatgtggaatacattgcgtgtggggagtttcatacttgtgttgtaactgcatctggtgatctgtatgattggggtgatggatcatacaatgctggattacttgggcacggaactggagttagccattggcttccgaaaagagtttcagggcctctagaagggcttcaggtactctctgttgcatgtggctcatggcattcagcactgaccatgtcaagtggaaaacttttcacatttggtgatggcacatttggttctcttggtcatggagaccgtgaaagcgttgcatatccaaaggaggtagaagctttgagtggattcagagcaatgaaagttgcatgtggagtatggcattctgcagcaattgtggaaatcagtggtcaggcaagcacaaatgcaatgtcaagaaagctgtttacatggggagatggagataagaatcgcttgggccatggcgataaagaagcgaagctagttccaacatgtgttcaagcactcgttgaccataatttccatcaggtggcctgtggacatagcatgactgttgctcttgccacatctggccatgttttcacaatgggtagctctaacaatggccagcttgggaatccaaaagctgatggtaaacaaccatgtatggtgcaagataagttgggtaatgagttggttgaagagatctcatgtggctctaaccatgtagcagccttgacttcaagaagtgaagtatatacatggggcatgggagccaatggaaggttgggacatggtagtgttgaagacaaaaagaagccaactcttgttgacgcattgaaagatcgtcatgttaagagcatttcatgtggttcaaatttcactacatgcatttgcatacataagtgggtttcaggtgcagatcagtctgtttgctctggatgcaggcagccatttggtttcacaagaaagaggcacaattgctacaactgtggacttgtccattgtcatgcatgcagttctaggaaagtgctcaaggctgctttggcaccaactcctggcaagccacaccgtgtatgtgattcatgtttcatgaaactgaaagccgcggataccggcgttatcagttcatataacaaaaggaatgtcatcaccaggcgatccattgatatcaaagataagttagagagaccagaaataaggccttccagacttgcaacgacatcaccagcagagccagtcaagtatcaagaaacaaaaaatgttagaaatgagacaaaaccagccgatcctatgtccatgatgaaagcatcacaagttcctgccatgttgcagttcaaagatatggcttttgcaggaacatttggtacagttccaactaccgtaaaatctatgacaatgggaggtcaaatgcaaatgggcatgccaatgttttcaccatcgccaccgtcaaagaagccaagtccacctccagcgaccgcaagtcctctgatcggtaaagtggacaatgatggcttgaagaagactaacgagttgctgaatcaagacatttccaagttgcaatctcaggtatgaaagaacactctagattgttctatttcttcaatgtgattagctgaatttgttaaaaccattttttatgttgacaggttaataagttgaaacagaaatgtgaaactcaagatgagcaactacagaaagcagaaagaaaagctaaacaggctgcctctatggcttcagaagaatctgctaggcgcaatactgtcttggattttgttaagcatcttgacagtgaggtacattaaactactattactgtgcaactcttcatctattattatactttccatgatagtgtacgtatttgttctactgtatagtttggagtatagtagctctattgtgttccatttatattactgacacgtttctatagctcaatcaaaatacaataaagggcgcacgatataaaatcatgtttatcatgttatcctagtgtcttgtatgatcataattgcttcaaagttcatgtttatttatcattattagaggatatactcatgatatcacaaccctccattcttcagctcaaggttattgcagacagggtgcccggtgatgttgctgacaacttaaaaactttgcaaagccagtcggagagatttcttgcaggacaaagtagtaatctagtggagattactggccttactggacatgatatcggacaccataggtcaagtagcacgggtagcctgccagtgtctcaagatggcagttctggaaatgctagtggctcttccattgccatggctagtgactctccatgtcaccgtatcatggaaaacaacttgaaggctccaggtgacttcgcaccaaagtatggtactcatggagaagtgcagttgattgagcagtttgagccaggagtgtatgtgacgcttatccagctgagggatggcaccaaagtattcaagcgtgtcaggttcaggtattccatcctcaaatccttcttggatgtaaaatatatcttccaacttgattaatctatcaatagtccatctttcaaaaaacaacacttgcaccatccacacttttgaaggaaaaacttcgaagcttttgtttacaattgaagtgtgttcagttcaagatgtgcactgaaagcatagttctttctatgtttttgtttgaagcaacaactccaggtgatcatttatttatggttcattcttctacaatcttttttttttgtttagcaagaggaggtttgctgagcagcaggctgaggaatggtggagggaaaaccaagagagagtgttcaagaaatacaaccatccaactaactaggttccaaagaaatagcagtgaaagcaacaacccatgtgaaattacttgtcatttttagaatgagctactgggtaagaatcttgtttttctcttatgcttagtaaatttcttttcttttttaagataatggaagtataacttctggcctctagaccaattagcaatgcacacaaccatatttgtggatgaactttggtggatagagtcagatactaatgcctccacaaccacacggatggtgcctactgaattgctgatatacatcttgaagagtattgatgattgtccattcttttgttcgttcacagttttttatttgtattagtacatatacacactaagtacattagttattgtaagagaggaatctttgtaaacaaacagtgtgagttgtaactagtatttcatgaaggaagatcatcatttgatatttgtcaaccttaatgttcattaaattttgagtgaagtgtacaagcaatctctaaacttgtgcatgcgtatcgtctaggtccttcaactcttaaatatattttcggatccctgaacttgtcctaagtgtcatataagtccaaacgttctctaatccactttgtgcgctgacatgatatgccatggtgatgtctacatgttggtgggatccacaggtcagtcacatctggatcatccatcgatgaccagcagagccaccatggtgttagatgtttattttggctttatattcctttatttgtaaaggtttttttttctgcatatttgtatgcacatgtacctgtatatatttgggcttattgcccttagacgaatacaagtgctatctataacatggtatcgagagcaaaactagggttagactcttcttcttcccctagatgatcatttttttctctctacgtacgtcttcacttacgtgcatcaattcttctatctcgtacctcagtttttgttttacgttgtggtcacgggcctataactaccgtggcagttggttattgctgcctctttgccggctaccaccatcattgtcggttgccacctgttcgccgatgccgcccatccccggccactgcctgctgaccgccgctcattcttggctgcgccgcccttcgctggtcgtctctcgtcttcgcgtgcttgcttgttcgcgtgtcacttcttttttggtcggattctttttgaccgatcagatccgagtgaaaaaaaagttaaaaatttactttgggtcatgttttattgcaaaagtttcagtttggaccataatttgtccaatcattttattttggactagataactttatctttgttgcacaagtgaccaccccaagccacatctttagcacttcaatgacttcgagcaaattgttaatgacatgtcgacgaattttcatacctatatgcatgtcatacctttatcgagggagacactagacatgattagaaaatagagttagggtggtctattatgcaacaaaggtaaagttatctggtctaatgtgaaaagattaggtataggatggtccaagtaatattttggcaataaaacatggcccgaagtgcaattcactaaaaaaacgagcgactctcgtagttgcggtaatgcggtgcggtcttctccactgctgactcgtggtcttcttcttgaccgaggcttgttacttaaaaaaaaagaaaggaaaagatagaaagaaagacatttcctgcctctgcttgctgccactttatttttgcgctttctccgtcacccattgatctttgatgatgtcttctttgtcaagcacaatttcagtttctcattgcccggatatttttgatggtgtcaactacaatcactgggttcagcatatgcgtcatcacatgcatgataagaaacttcacatgagggggaacagtagtgcggtgtcgatctactcatgggtgaacactcaaacatatgatagtaaacttctccaggtagatgaacacctgacatcaatcatctggaaaactagttgacaccccgtgctttactgaggaatatgtggatgaatgcatgttatacattatagaaatgttagatgtgtatgtttaaataatgtgaaaatgatgtggagataatgagttgacattgcttacatattgagttctaaaaatacaataaaattttaaatgatatgtcatgtttgcatgatatttaaaatactctagataataattgctagtgggtgatgatctggtatacttgcatatgatttaaaatactctagataataattgctagtggatgatgatgtgatacacttgcatgttgagttttagaagttagtggacattaattttattataagataggattccctgtcaaaaaaaatcatatggaaaaattcagattcaggtactgaaaaggatttggaaagacactcccccttatttgcttggcctgattagtgggcgcttatccaacctcgctggcattccttccttctctggatgggttgggcctaattaattattttagccaattaatgtgtgtacatgctcggaaattcgaacataaatcagaactccgtatatgcttataggtcaagattgcgtcccatataaacaaacaaggccaaactctttttctttatttctttcttgttagatcgttccagatgcacagtcggcggaaccaaaccgaatcctgcatgtaagccaacgccacgcgatctgtaggtttgtttagtgatggacaacgacggcgacaacagtggagacataagaaatcacctcgattctgccgatgctacttacgctgctcttcacccgcttcccccttctccgccgctacaaaggcaatgcaaaaattctcgtctctaatatttttacaattcactggtatgatgtatgaaacgcttgacgatcttacttgtgtttttatgtgcaatagctttcaaatttgtttttaaatataggtattctcagagtgagtgtgatacagacgaagataatgttgtgcattccaactatttggtcgtagacagtttcacgaatgttgctacagaattagtccaaccaaatcaatcggatcatgatagtaatagtgactttgaggaggttcttcagtgtattttttatgtatatgtagagactgctctgaaacattacaacaatgatgagaaaaacaacgtaaattaagtttgtcaatgaagcattacaacaatgatgagaaaaacattacaataatgatcactatgctattatcgttaatttgtcaatggtagaaacattcatattcatatccgtgtatgagtcagttcttaagttcgttcgcttttgaaaatgcagatccatatttgagtcggttttaagttcgcttttggaaatacagaatgagtcgtataaaaaatctctttaaaaaactcgcatgctaacttgagatgatcgaactcctaattacatctcatgattttgtagagaaacataaatccaatcgaattctcatagtgaattttaccttaactaaaatgtataataataataagattaaaataagcttcacccgttgcaacgcacggacattttttctagtcattctagtaaataataaaagttaatagaaagagagaatagagagagacatattatatcatatatggtataggtaaaaccgactcgtattcttcctttttatctttagttttctacacttaacggtcgtactcgtattcttaagagtattgttttgtggtgaggagtcggagttgaagtcgtatttggatcgaacgttcagtcccttatattgagttgagttattattattcacgaatagctaagcaatgtctcttgtcaggccggccgtatcaaaattcgaaaccacaggaacttcacctagaaagcgagagcgagaggatgcggccttcgttgtcttcacctctagtaacgacggggtaaaacacaaatacgccattgtttttttttacaagttgtaacaaaacaaataaattaaactcaaattgtgcccatctgtgtttttcggatgactagcaacaaggtcttctttgtaactccggcccatcaaagcttgtaaaattacacatggatgggcctgaattgaggcccataaaaacgaggcctggccaacgtaagtccgtaaccaaacccgactccggacaggagggcagcggcgagggtgtcgttccgatgggggaggagcggccacaagcgtggctttgacaggagggcataattccccatcgttaatttatagcgatcccattactgggaagatagtggaacttcctcccttcccctatcgtcgttcgtaagaaaaaaaatcttatctgaattctccatttcatcattatcactaccaagcctgaaatgattgattgattgtggtagaaaacccgccaaagtcaaagtagatacccgaggtgtccctaaggccaatgtcaaagtaagctactacctctatcttaaaataagtataaccgtgggtatttgtgtccaacgttcgaccgtctatcttatttgaaaaaaatagtcacatataaattattgttcatattttatcatttagtaatcatgaaaatactaatcatgaaaaatattcaaataagacgaacgatcaaacgttaaacatgatcaatgtaaaattgtaattattttgggacggatggagtacacaatactacttcctccacctcatctcaaagggcaagcctcttgtcgtatatgtatgtgatggcgttgtgacagtagtaattagcttctcttcactgtctagttgtgctactagttcataaaaaccgtggttgcattaatgtctgaaccaaagtaacatcttttatcttatgatccctagccgtggtgaatccatgataatttaatgtctgaaccaaagtaacatcttctatcttatgatccctagccgtggtgaatccatgataatgatattggataggctcaaagcctaggctaagcctgaaactgaaacaaagttgcaaatcaaattcaatgtttacatgatctaaaacaaaacaaaacaaaacaaaggagtaccttgccagcaccaagttcactcttttaggtcttagcaaaaagtcaagtgagctgccacatgtatatacaaagtagtaaaattagtggcaaatcaatggcaatgttgagaaaactatttggaccttgaaacatttgaaacccaacatgttagaaatacttgcataattttctagtggtattcgttgtcctggattggcaaaaaaaatcattaggatcaaattatagatagttgaagcctcttttatcgatttgtgctctcatcatttggcaagtgtcaactgaactgtaagtaattaagcaatgttagaacttctccattgtgaatccaccaataaatcaaatatatttttcataaatctcaatatcccatcatctcgtattctcattcaatagacaaataccttctcttgccgtatatgcatgcatattctcattcaatacacttctcctgccgccatatatgcatgcataatctcattcaatagacttctcctgccatatatgcatgtatgtgattatccattaatctttgctatggtctcttgctgtatatgcatgtatgtgatggtgttgtgacagtagtagactaatagcttctctttactgtctagttgtgctattaattcataacactgtttgttatattaattgtgtgattttatgatgcttagatcctttgtttgatcattctgtattagtatcacccccttagtaattattcatgttcatcacggttataaaaagatggtgtttgcattactatggacactgttacacttaccaacttgattaataaaaacacttatttttcatcaccccgccatatttagatttattctccacctctatcacatcgaatgaatatcttcatgtcttcaccacctcttgatacacatacactaccactcatattgctagcaacaggagtgcaataattttcttttacacttctataatttctctggtatgtatgcttaaactacttgtatgcctaacttattcagattctttttaaatataggtatcatgagagcgagtctgatgcagaagaagacaatgatgtgtacttcaattatttggtaaacaagttcatcaatgttgctacaaatgtagtccaaccaaatcaatcggatgatgatagtgatggtgacttcgaggaggctcttcagcgtatttctaatgaatatgcagagagctctctgaaaaattataacaatgatgagaagaacaaaatatagtttagcttgtgttttttaggtaaaatgtgttcacttttttatttatgtttaatatttaaaaataattaaaacatatgcatcgataatttaaaatatttacatctttttttaccattcaatattcatatatgtggaattataaaaaaaaagttagaattgagtatataatctagacgagagcaaattatccacctacctaatgatttataataggactatgtttatattgtgctgcttttctagtatataatctgttgtttagtacttcctccatttcatattataagactttttagcattgtccatattcatatatgtgtgcctagattcattaatatctaaatgaatgtggacaatgctagaaagtcttataacctgaaacggatgtaatatttttttaactacttaagcccacatcaaaattatctattttgtttttttgtttgcaatatatcagattaaatacagtttaatcaaagctataatatttttcgctgaagtgtattgggactgtaacacatatgatatgataccacattgcatggtttgtctggaggggaaaaataatactggttagttctgaaaccttgagtccatagtatcttatagtgtgtatattttaattttattatagtattatattgctaacgaccacaacgtgacatctggtaatacaacaaagagattttcctccctaggaaggtagtgcaacaaaaggacaaatatatatagtataaagcacatatgtactaagaacatgcaggtgtgagaacaaagtcggtgttagtccaccctcaattttagataaaaatgccttacttttggatggagggagtattgtttgaatagaatacatagacatagattgacataaatttaataactatgtgtagcattttttttaaatgataaacatatttctcttatagagattattgtcgaaatacaactgcatcacatcgaagggcgtggttcactcagtgagttaatgaaataataaaagaaatatattaattggtaaaattttgttgggatcccccattacatggccctatgggcctatttatagtcttagtacgggctcataccctctagggtttagttagtacatgggaatttacatggatacccttatgatagggatattagtgtgggtacatagtgtcttttgtattcatgggctcttaggcggtctcgttgggccggcccattaatgatggccgaacctacgggccacaaggcctcccaggcctatggtcgaaggccccttctacccaggcgaaggcctcttgcttcgccttatggccttcgcccttagcggtgacttggccaagtggtgggcttgggggcggacccttcgttcttcgtcgttcggcttcgcccaaaacgcttcgccctggggttgtgagcctaggggcgaacccttcgatcttcatcgttcggcttcgccctatgactttgccccgggcacaccctctggacttagtcagtgtctagcggatttggtggtttcggcaggtccggtcgaaggcccttgtgacatacctccaacagagatctagaatatataacatgtgacaaatatattgaactaccataatatattttctaaatatactccttaataaataaataaataaatgttatttttcttttattattatatctcgtgaaacaaagtcataaatataaatacataatagtcttatataacaaacttatactttgccgttgcttgtagttcattagaccaagccaccataagatggggtcgtggcccatggttatgctgggcctaggcccacctaatgatcgaggtctcacataatggtgggccacaacccaccatatgcttgtttcttgttgtttatgatgtaataattaagcaggaatggtctcattagttcaacgtgctagaaatcacaaattatgtcatgtcggatccatgttgtcaagttgtcctgcgatgacaccggagcaggtggttctattgttttagtttgcctaatgatggttcagtgcgtcactaattcgtgacgacggaaaatcgttagagccatttgttggtatttttttttaagttgcacatggtaatttcagacggggcttctgcaacgacagtgtcatttcatcacaagattgtcaaagaatatggtttgtgacgagctttcgctatttattgatgaaagtgactcatcaagtaaggctagaccattgtagtgacttctagtaatatactccacgtctacaaattttcatatttctttcatgccaaaagacaaaatgtacctttttttagcaatttaacaatcaactaacgaagaagagattaaacccaaaattcaaagacacataaaggagtgtacaaaactcaaacacctagaaggtatactaacattttaggggcgtagaagtaattttctcttagcgaatataggagtaccaagaaacaatctaagtcaaattattagtatagtacgtgggtagtccctagcgtcgattgtttcttcaatctctattattataaaaactgaagatgttttttctggtactttagtatgttattcgtgtatgagtcagttcttaagttcgatcacttttgaaaatacaaatccgtatttattatataatgacttagaattttcatgtaaaacgatggatgaatgaaaaaaaattgcgaatatacctatttttttaataatttacgtttatataactacatgggatggatttaaaaaatacacccgtcctgcgggatgagaatgcgcgaccgctacggtcccgcaactccaaaacacgggacggtcggtcccgcgggacggtcacgccgcaccacgacggtcccgcagcttcaaaacatggaccgtcacggtcccacagctccaaaacacgccaccgcaatagacagcaaattaacattgtttgatctttaatccaattagatgtatgcattatatttattagggtgatctaaacgaaggggtaatattttttttattagattagtggttgttgtgccttatattttaggatacagggaatatctgaactcaacgcagataagatgatgagaagatgcatgattccaaggtgaagtccatttacaacgattttaactcacatttgtgctatatatgttacaagtcacaagattaattacaggcttaatttacagcagccaggaccctccagcacaagacgatgcatcgtctggattctgaatgaccagccaacaacacctcaaggtccaccttgtaactcacataccgataccgtggtgttattgttggattctcaatttgccatatgcacacttttaattttacactccaaactagctgcattcattcatattcgtggtgattaattgatccaaatatacacgaacagctctgtgtatggagaattaactcgtcgttgagctgctagaagcagaatttctttttctgcaaaggcatatataaaagaacagaattagatggctctgctgctcttatctcaatagcaagaaaaagagtgtaagaaagctgtaacgtacacgaaacttgatcatatcttgcttgtcaatgtacgcaagcagctcgtcctgccgcatcagggcttcatagagagcctgctcatgaaaattgaagtacttcatcaccttctttttataaggtagtaatatttttacatatacctaaaccaatatagtttatgccaagctgccaattcactcagaatgaagctgaaaaaggtaccatcttgagcaaaacaagcctaccttctttgtagagattaactcggcttctaatgcatccacacggcggacggctgcattcagcaattcctccttttcaaatggcatctcggatggcttcgtttcgagcgcctgcaccttctcctccaactcgcctagtcgtcttaccatagatgagaggacatccttttcagtataagacggagcaggagacggtggccggaattcttccttgtactctgcttcttgaggatactccacataggagtgatcatggtcagtggattggcttgagaatcttttagccatcctgcttgggacagagcgaaccatagcaaaaaggctcacgatcaagacagtcagccatgtgataacttgtgtccagaggccatcaaatgtgataggcaaacttctcgagggtgatgaacctggcgtgaatcatgtgaaagttcaggttcaggttcagcaaaaagaaaagttcagcgaataattattcaacagtttagcgaatatttctcaatcggttcattcagtataacaataaaaatggtcaacaacgatttgagtattaatttcaactttgaacgagattatggataagagaaacaaccaaattaagaatgtaaaagagctgaggaagaaattgccatactagctctaggactgccccatccatcatccacaaccttgtcaacaacaggaatgctttcttcaataatggaaggggaagcagatgtaaatccatgtgctgccaattttgactgaaatagcaaaatgagattacctattagcaatagctacatagtcagaaatgctgcatcattacaagaatgctgcagtaacccaaagatccttccatggttccttggattaaggatagcctacttacagaagcttgtataacaatgtaatggtgtaatgtaatgaaatataaaaatccacatgttattcacaaaaaaaatgtttcaatttgatggtcaatgattttttagtccatgtggtgctattattcaatttttagtcagtgtagattatgcagttatgctgacaaatatcatatttgcacttctcctattttataaggtaaactgcaatatgatcacagtgatacagcatggcaacttgcctcctcatgaacaggggtcaaaaggggatttgttatcaggttccttgatgccataggtgacgcgccatcttccacttcagacccagactccgctgagccatcacttccttttctctgcattggcatgacaacataacaataaatttcaatagaatagtttgaacacaatgctcctaaaaatctccacattaaccatgcttgtagacttactgttgggtattgtggcccagcataacgaattatttttccatcagtgcttgatatggtcacaatttgcctcccataatttgcttcgccattcaggaccctctggacaagccaaattcaaaatccatcatgttagatatatcaacaccaacgcaaagatagtgtgcatgtaataatacaccagcaagcatctattatttttctccctctttctattttcctttcagtaagcggtggactggtgatttggtttcaagatataacctttattatgttaggatccttccaaggacctttatctgattttttgcaacctccaaatgcctcgcacttgcattttccaccaaaaaactctggcaattcactgaatacatggagcggacagaaattaggatggaggatggcatgaacatgaaacatatatggacaagattgtagatactgacttctcatcaattatttcaagtaacttattttggtacttgcttcctagaaccttcaagagaaaaaaaaaatagaacatgaaagtcgttaactactaactatataacggtcaaaaatcttgattaagtatataacagattactcaataatcctacaataaaaaaaatatataattgacttacatgaatctttgaagcagttttaggatctaggaaagattttacagtgctccataacatcttgaagccttggccggcattaataatatacatgcggcgcaacgtctgtgagaggtttcaggatgcattaggcaattcagtgttgggacaacaagcaaaaggcatgcactatgccactactttggaaaataaggtacatgggggaatcacctacctctgggtagttgtcattgtcgatcttctgcagtcgtgtgattagatcccttgcagcttttgagaagttctttaaacccttgatattcatataatacaagtcaatcacagagtcataactatgtgctcagtgttaagagaaacatttggttatgaatacacataccacgccttgcacgtccagaatagtagtagatgaatctatgggcctttttgcagcaatcgagcaggcaggaaatctcatttggaagcatctctcaaactccttcacatgatatttcacatatcgctctatagtagttacttgcattagcttattcgcatcaacttttcctattaactctatgtagataggccttccttctttatccactccatggtaaaattgtggataatatttcataacctcatccgcctcggtgtagtcaaactcctgagagaaaggataaacaagtgtcatgatagaatggcatatttatattagatatgtttcttcaacgcaaccttttacctctatattgtcagccccaaattcctttctccatttaagcatatctgaccacatactctttgctttctcaacatcaaatttccgtgctttgaggaacctatatgtgaaggagataaaatgaaaatttcacacgaccagccaatcattttcttcagggtagcctcttaatgatttgctgctccaaagattgccactctagattttttccactcgatatctagctagcatgggggccttaggacccacaagacagacatcaagttgcaaatctagaattcacctcaatgaaatggcatatcctggatttcccaactataggtgatttatagtgaagccacatttccgggaaggaggcaaaacagatacacacagcctaaggccaaaagtaaaatatgagagaagccaagcttgtacctaagcattgtgtgataatcatcatgctgttgcggcaacaggtcctcatcaactaaacattgtcgaaatgcatcaacagcttgaagatcttgaacatcccttatgtcctcaatggaaccccgaggttcatttttctttttgcttcttctcctcagggaatgcctgaatttgttcccggcattaatcgcctttttcttgaaagaaccaattttagtcttcttctctccttcggagttgtctgcgtcagatctgatctctttcttttcatcattatgcgtaaaaccttcaaaacctgcaccagcaatagcatctcatgttatgacggtatgaactttttttcttaccggcaactgataggtggcttagccgcttagggagaatgacaaataatagagctttacagggaactaaacctagaacgtaaaattaacttagtttcagaaccaacagtaatgtgagtataggtgttcatttgaagattaagaagataaactttataaaaagaggacccatttgatcaattaatccagtgcctttgtgcaaggcaataccaacagcacatgaattattaaatggaatttaatgctttatacatgtgacatcaacatcaaaatgtgctgattctttgtgttggtttgtagctttcctttttgtggttattcttgaatgcataattagcttgaagcatcagcttccccgtaatttttttttttttgaaaaaacttgaagcataagctattatgccctctagtgagaccaacaaaaggaaaaaaaaatcgaagatgagcaagaaacttaaaaaacggagagtgaatggacttctgcatgattttttttttacaaacattcgattttgataggtaaccgttggtgttaactgaatggggaaatccccaaatcctataaacagtgcaatcgcatactctcacgaactcttttgccatatcctccattaagaattgatccaagaattcaaatatgaatatatttgaatcgtacaataccacatacacaggtaatcacaagataacccactaatttaagcccaataaatcgattcatcctggtcttaaatgcaaagaaatactctatttcctagtaattcgtactcacatggcctggcaaatcgatcgagtggtcctgacatcccctcctccgattccaaaatcaatcgcccgagcaaaagctccaacctaaaaatccacaagaactatcatgccaagaaagggaaaaaggaactaatccatcatctccgaacgataaaattgcatggcaaaatacttttttaaaattgtttttttcctcaacgaagatatttgggaaaccgataagtattcaaacaaactatttggataatatctcgaatttcatttacctcggattttgggcgatgattttggaccaaaaagagagggaagctcctgctgctgccgctatgggctttaatggtgggaagctctcgcgagggagacgagacgagacgaaaaggattctatcactctcggtgcatggacccggtccatagactcgaagcggttgacctgtgccgcgcgcacgtgctgggttcatggacccggtgcacgggtccatcgatagccgcccctgggtacgattgcctgggcccaccttgcgtgcgttaccagccgtcgattcgagcgattatagtagcttttatgggagaaacggacggctgtgatgggttctggttcatggaccgtgtccagggagatgtgttggtttatgtgacgcgtggaggggtttggctggccaggtcagactttggttggttagaggagttgggcaactcctcctccactccttttttatgctaagacaaaaattgatggatcaacaagattattagttggaggaaatgtctaagcacaactgattggataaaataactttattttattattgtttggtactcatggtttaaagctgcttaaatgcttagagatgtacttgctcagagatgttcaatcttcaacacacttacgatttctttctaagaatgttgaagggatgtcttttcgtctaaattttttagcttaaatgtttaaaattataaaaatgtgaactaaggctacgttgttaccaggagttaccaactccccctttctttttccgcgcgcacgtttttcaaactattaaacagtgtatcttttgcaaaaaaaatttctatacaaaagttgtttaaaaaaattatattgatctatttttaacaaatagctaatacttaattaatcacatgctaatgaacagctccgttttccgtgcgcagcagctgtgttgggaatgtggagtaatgagcgcagcctaattctgctggatatatatagtactagtttaccctaatttagtggccctcctcctcatgaacaaaacaaagtgtgtttgattgactatgttagtcacctaggatagatacttggttggcagtttgttcatagattgtttcaccctggtaattttgtcatgcatcaaaccaggcacaacagtcttgaaccctaaatggacacaagctggaccattccattaaattttaccagctaaaacccctgttataataccaggagctaattcttgttgagctgaacactacttaattagcactgtaaatgctactcaaccagaaggtacactaattagtagcctctgattcttctatccagaaaagaacaagaagctagggtccaagaatctattcaagcactcacagggtctcacactatccttgaaaaaataaatttatgtttgcaacttttgcatcaattaacacagtgacaaaacaaaatgggcaggcaggccaatgaagtgggcatcatcatcaaggacactttttgtccgtgtctatcccttgatttgttgttacattgatatactttgtctatgtttattagcttatgcttagttgttacactgattgcaatcatatccgtgaactgcggttaagctttttggatttcatcacaaggggaacagggtcgttaggccaaaaaaaaaaaattaaagcgagtctctggtgttagatgatcaaaaagtccaaagcacacgagtatagaaagaaacatatgctttattagataggagagtgtttcgtgagttcaatgaccaagcaagacatatatatgccttgtgatatatcacctaatctggcagacttatgtatgtgtttaaaaactttagaataataataatataaaacgtggaaaaggggtggaaacatagggaaatattagataatgaaatatcaaactctcatataaaatatcttgagtagtctcattgtttttttcctaatgatggagacataaacgacaaaactaatgttccaatcttcttcaatgtgatgtacatatggcaattttatttgctctatcacatccaaccagtcaacctgtttgatccacgcaatggtacaataatggaggaaatatgctacaatgacaagtcatctcttgatagcataatagaatatattcacacgtctgtcattaaccagccaaatccattgctaattgtcattaacaaagtgacacataattatataaacacgatggattccacactatcattttcaaatgtaaaagaataatccgctgtctgtcttatggcccattgcaaatacacaagcaagaagaccaggaatttttcaatgatgggtaggcaatactcaccgactcacacctgcatttgttcgccataaatatttgtagtgggattacatacatactccacttcgaaaatggaactagtataagaaaatggcctcatcagagaacagtataatttcttattaaacattctgtttactcttgattcagttaggttgtccctgttcgagcagttgctgaatctttctttgctgaagtgcaaatgtaaatgcctgatactgacaggagtgacatgggtactgcttctgaccttgcaatctcagggatgggagtgggtcagcaaaaaagccctgtaactgaggacagatgactattcccctggttcactttaatcaggtgaatgataattcagacatgtggtagtatagattgatgcttggcaaagcttgcaccatgtgttgaactttgccattgaaaatgctactactattcaccattcagcaacagtctcgtcgtttacatgccccatcatggcctgtgctattttcattctaaaataaacaaacttagggcctgtttagattgtagccaaaataaaccaaaaatttggtaagatgataatattgtcaaaattttggcaggatttcttatgcattgaccaaatttgacaacaaactaaatgtaaatattttttttgacaactttactaaaaaatgatatatttgaaaatggcattaaagtgaacatacacttaatatacgacataacatatcctatctcctgttcaaattcgtatctaggatgtattatatttcgtattagatttgtttattttgaagaaagtgagtatgaacatgcaacagtccatggacagatgtgcagcgatctttatctgatgatgtgagttctctgcattcaggcgttgatccctgaatatgcatatgcatcagaagcttgatcgaccacctacagaattataaccataataacggaagcaaatcaaatatggacacatatcctcatgccctatatgtcctcggcggtggcgacgaatccgtacgccggatgctggtggcaggtcgccggcggcgagaatcaacggcaggatgcggtgggccactagtcgctcggactcctgggccacgtccacgcatcaggcggcccacgcgtggccctagactcttctcccattttgttaaggacaaagtccactttgtgtccctcaattatggggtcagattggattcgcatccctgtgaactacaaaaactggagttccgattgttttcttaatgaaagtaaaaactaacgtaaaacacgaggaagtcgaatactagtagatatatagtgaaactaacacaaatatacggtagctagttaacaaccgactcgtatcgtattcttcattatctttaatttcatgtacttataattacttatgtcgtatatatacccgtttagtcgtatatatatagggaaaactattttaattcctcgagggaatgtttcctcgtttgctaaaaaaccatcttaacggttatgaaaaattctagaaaaatttgacaacattcatacaacatatatatacaactccacaaaatcttaaatccaaactcaactcacacgtcgagatataaaaaagacaaattcagcgtatgaatagtaatgtactgtttatatctaaatttgtcttttttttctcgatgtgtagattgaatttgaacacaaattttggtggactagtatgtatcattatactctacattgtcgatttttttaaagaaattttcataactatttgcatcgaatttggaagaaaaaggtatacgaggggatatccctcgagggattagaatccactcccgtatatatagttttatgtgttgagttactagtgtatttatttatttatttattcacgaatagctgatctctcttgtgaggccggtatgcacaagccgtcgtcgtcgtcgtcatcacctacagaaaaggatgcggccgtcgccgacttcacctgcggtaaccacgagcacacggtaaaaaaaaaacagcgacgctatttcctttcttcttttgttcttgtcgcggtggcgcgcgccggccagcaggagggttggcgttggggtgggggcggtgtttggctccgacaccggcggcgaggaatgcggcggccggcgttccgatgggaaccgagagtggagaggttgagaggggaaggggcaaaccagccctagttccgcgcccccgatggagaggagggtggcgttccggtggggcggagaggcgctgttggctccggcggcggcggcggcgttccgatcggtggggacgacgacgatggattgtgggggtaatcccaatcgaattactggtactagaaaattattccatcgaccgtggtactggccctgttcttgcgacccctgctgatatctcaggagcagcgaccgatatatcccacaaagatcaggattcaggaagactgccttcctctcatctccacaggtatccaaagcatacctctgtcccctcttctcttgccatcagatgaactaggataagaagagtagattaataagagggatagtgatttgattggtctaatagggaaaacaaagagtatgatttcttctcctccttgcaatttacactccctgcgtgatatggtgcttagaccaaaaatgcatgcatctcgcactcagtcatcctaattcaattaatcaagaggttttcaaaaataaataaagttaatgatttctttatatttgtggcaatgtatgttcctcccgatcacagttggtctttttggctcagagatttgtgccctggtaatgcactcgtgcagaattggttggcattgaaccattagtgctcctctgtgtttcttttcttgaaccctgtgttccagtcacagtactgcatttcttccttgagccatgtgtcccagccacaatactcatcttttctcaacacgggacgggagagagagagacctgtatggatggacatgactcaccagatacaatggtagaactgtgataaggagaagtgtttgatttagagagttaaatcagtaatagtaaattgttttttgcattggaaaaattagactgtcttttgccttattttgtgtcaaatgttacctagaatgttttgcgagtaatgatgttgctgggggctaattctccttatctttcttttttgcacctctagagtgaatatagttttactaagtatggattattacaacttttgcatttgtttttatatctaacgctttaaacttttgtttaaatcaggcaatctgagagctgggcaacacatggatcagacaaagaaaaggaagatgaagaagtggtgcaggctaaaaatgaagaagtggattccttcatcgctgcagcagaaaaaacaggtccaccacagcagaatatcgactgcacagcagctgcacgacgtcaggctaataactatgcaaaagttgctttggagcactacaacaaggatgaaaacaacaaggtaaagttctgctaatgctttttttaagttctgcaatacgcattatataatccctatactggttttagatggtgtatacatgcttttcatttaactttatactgaaatgtcttaattgtttcatcaactattttatttatttatatcttttttttgtctgcaatgtattagattcaatacaggttcatcaaggccctgaaaagttgcgctatccaaaccaacgaatcctatgggcatgtgaactttgtagcatcttcatcagattcaaaagaagagttcttttttgctgaagtttgttatgatcccaagagcaatggattggtaccaacatgcatggtatctttggaagaaaacaacagaattggttagtcctgcaacattgccactagctagttttagccgttcttttaccgaagtatttcttttttcaatcctaattacctatgtcattacaacaggaggacttcttggtgttggatttgtagggtgcccagatcttctgaatcctcctgtcgacaacgatcactgctatgcttgtgacgataggcttaagcacccaaaagatggaactctgtttaagggtgggcatgtagccgccacgggtttctatacgtcctactgagtttgtaacagacaaaaaaaaacttagttatctatcctgtgctatattttctagttgtcaattgactttttgtttatctctatttaagcacacttttagcaaacatcaccaatcaaactgtacaatctcaattgcactatcatattttaagttgtagctatctcaagagagcttaagattttttttcagtggttaacattttcatataggtaagggaaaaaaaggctagggaaagtagcgaacgaagcagctgctggacgtctttaagcttttttacataaaaattgttattgacattaattacttaaataactctgaataggcactggaattaattggaattaatttgatagcagctgtgacattgaagaagttgattggggaattttttttagaaaaataattattttagtgaaaaatacaaaaataaaagctgatcggctaaattgcaagtttaatactctgtcgaacaaccacagttcaacagatacttgtcgaactagagcatagcagggggcctatggaacaatgtttgatagcatgcagagttcgataggtccttcatgcacagtgctgcacaatagtgtacagtgtgcatagtgattgttctcttttttttattatgttttatcccatatcgaacaaccacagttcgacagggtatcgacaggggataaaaaataccatgtcaaactacagttgttcgatatgtaccctgttgaattttggctgttatatggttatatggtgtactaaacttgcaattttagtctatcaacctctatttttacaattctctattaaaataatattatttttaaaaaattcgttgattgggtggattttgcaatccctaagggtgctgtgcgtggccctttcctttcctttgtccatttgcagctttgtctctttgctattccctccgtcccaaaaaaaaaaagacaaatcctggtttccatgcccaatgtttgaccgtccgtcttgtttgaaaaaattatgaaaaaaaataaaaagacaagtcacgcataaaatattaatcatgttttatcatctaacaacaatgaaaatacgaattataaaaaaatttcatataagacagacagttaaaattggacacggaaaccagggtttgcctttttttttttgggacggagggagtacctcctactctcctattaacacctctattcaagacaatgcgtttgattgatgcagtccatatttttcaaagcgataggtaaatactaattatttatatgtagtaccaaggggtgagtggtgacaagaaagagttaaaatttcagaagagaataaatgctaatcttaactatatttggttggtgtaacgccccgatttctgcgtggcgttaaaagctaatttacaaaaaaccctaattgcgaaaattttgattccttgagtgctgagtctaagttgtgccaaagatctcaatttgaatccctcctttagtccatcttcctgctatcaaaaatcgtctccttaaatttccatcccaatgtaatctcgaagctcgattccttctattcagaattccctcctaaaaccccatccgtgaacttcgtcgaatgctcaaaccctaactcagtccaatgattcacctctgcatcctaaactctcccttgggttccttcaaaaaacaattctcaaattcgaattcaacctcgattcatctacctcctcctccttatatgtctgtctacctaccctaagtttctttccgattaatcaatctcaactcctatatttataatatctccctacctatcgctcaatcaccctttgaaatcatctccgagtatttgttccaaatcccaaggtatagatctatcctcgggataatacccgttccaaataatctcgtatgaacctttctattcatatttctcttcaaaatccttacctgcatatctcgtcgagtagtcaaactcaaactcccaagttacactctcttcctctaaattatccatctccctttaactcgtctccgaatattgtttccttcctttgactcctccctattctcccgagtccgagtatcaacttcgacattaaaacctagactccaactctaaacctctccaattaaacctctctgtgaaagtctaatttacccgcccatggtggtggattcccttctttcatttcctcccaggtccacctcttcctgctcttccggcccatatctctctccctctaaagtctagacctatcaaatctacctatttatttcgtccctctctctacattgatctacctagcgatctatctatctatctatctatctatctatctatcgatcgatccttttatctatctactatacctacctatatgtttatctatccatccgtcaatccatctgtctatccgtccctctacctatcgacctatctctctgtccacctatctatcaatctagcttatccatcgatctgcccgtctgcatatctatcgttgaactctttcccaaacaattgtcccaactccaagaatacgaggttccttttgaatccctctaaaataactcttgagccgcctaatacagatatattccagaaatatataattcccgcctttgaagcctttcctcgacccctccatatttttccgagttcaaaacatccgatttgaattcaaatcccaactcaaattctcaaaatactccttaaagaaatttcctggagaaagtctactcgccccccttgcggttttgggctgatttctccctccccagcccaacactcccttcggctcacaccctccacgtgcgccgcacgtgatacgcaccgaggacaccgccccctttcttctctctcgcgcacgcgtgcctccccgtctcgctctccgctcgccgcttttgatttccgccgcccgtcggcgatttgaatttcgtcaccgccattgccgctcccgcgcgcggcgccgctcatggccgaccgctgtggccgcgccaccgtcacccctgccgcgtcgaccgccttggtccgcgctcgccgccaaaccagccctcctcccttttcgctgtcatccgctgcgtcaccatggccccgcctccgcatgccacaagccgccaacgcggcgacgccaatcccacgcgcctccccagcctcgccgcccaaaaacggaaggagcaaggctccctttcctcctcctcctttcgctttttcccttgcgggcaaggccgcctcgctctctcccttgtcctggtgcgggagcggacacagggtgccgctgacgccgcctttgcgccctgtcgcgcccacgccaccaccgcgaccatgccagctcgccgcccccaccttgaccgcgctagcccgcgctcgcggtccgattcccaccgcacgatccaccgccttcgctgcccaatgcatccacgccgtcgccgctttcgcaccgcccacgaaaccgccgctgtcgccagccgagcgcctcttcgcctataaaatcccaaccccatgcccacaatcctttcccccttcaccccgtgctccttggaacggagtactgccgcctcctccctcgaccccggtcgccgtcgcgcggccaacccagagcaccgccgcctccttcgtcgtcacggccaagaacgccaccgccgcgaccaaggacgccgttcccgcacgcctccgtccccttccccggcgcgcccgcggcggcaccatgccacctcggcgtcgtgttcgtcgccgtgcgccgctgctcgtccatgcgccgccatcggccttcctccccttcccatcaccgaagtccggcgacgccgttccccgctcgacggtgagctcctcggctcctccctccccttggcaccccctttccttttccgcatcgtgtagctctcgccaccgccgcttggcgctgctcgcgcgagcagccgcggcgagcttcgtcgatgccgcacccggctgtgcgccgccgtcggtctccctctcttcgaacccgctcgccatcaccttcctcggggccccctcgacctccccaatccattcccctggccgccgacctccccttttgctctcgcgccgtgccgcccgactggcagccgcagcgcatggatgtgcgccgccgtcggccatcccctcgccgtatcctctcgcctccgccctcctggagcccccttggcccttcccagaccgccggcctccccaatcgctcccgcgccgtgccgccccttccgccgccgcatagcgccgccgcgcgcgcgtcgccggcgaccattgggttctgcgccacggcgtgtgcgtcgcaatacctttccacgtcagccgagcccgagcccgcgcgcccttcgctttcctcgcgcgcgaccacgtcggacatccggcgagcttcgcctccgccgccggccgccgtcgtacctcctctctcaaatccaaaccgttgaattcattccccttgtcctcctctcgccgccagtgctagccacttcctctggctcgccgccgttcgccggagcgcgccgagcgtcgccggccatccgatgaggttccggccccccctctctccccatccgacgtggctgcccacgtgggcgttgaccgggcccgcccctgcccagtcagccgtctccccctctctcctccccgctcttggtccaggcccatcggccaacccccctcctcggccaaaaggaacaaagtccactcttactccctccgtccgagcccagtgaacacactcttgaatcaaagttcatatttcgtccctccaccaaatcagctcccttacacaaaagtccacctatctcccttgttggctccacacgtcaatgagtgactaaacagaatattctcgggaatattcttttccataagttcaaaaaaatcatttccccttgctccataaatcatttcctatattccaaattccataaatcctttctcttaatcccaggatttcaataattcattcccttggtcccgcatgtcaagtgattgtcaataatattcttgagaatattatttctataaatttcataaatcaatttcccttgttccacaaatatttcccttaattcaaataaacttccaaaattcatatctcgcgatccgtaactccgtttgactccgttccacttccaataattccgtaaaattgtgatctatctaatggcactattaattagcctaaataggatcttttatttggtcttttgtttaggttttcattgtttgtgcctagttgcggttgcggattttcgtcgatcagggatttctcgaagattcgtgaagatcaagaccctgagcaaggcaagccacctttgaacatcttgagcctataattgaacttaattatattacttgcaaaatattatgcattgataggattgcacataatatgtttgccccgtctgcgaggcatattagtgggcatacctaacttgttgcatttgatccttccgttgttaaattgttatgtcatgtttccttgtaaccacctggtcgcgcctcagtattcttgcactcggtgcgagtatcgacggtcgccgtcaaacttaaaatatggtaaacatcttgggtaaaacttggtttacaaaacgattggaaaaccagacgcctgggtcggtgccttgtgaaagaaaatgagctttaaaaataaaactcgtgacacaaggccattcctaggcgggatgcttgtgcggtcgcatttaaggaccgattccttcggaattatatccaagcatatgatagtgcaaccacatgggtggaatgggacacccctggctgagtaattagctaatcaggggagccttgatgctgagagacaagtggattcgccggggtggtgtcggggaggacccctgggcttcctggcacagtatggtctgggacctaacctgttgttggtctgggacccctctcgtcagcatatggtaaacctgtgtcggctttggaaatgccttgtcatgaaagcttggaggtctcccgacgtggctgatccccacgagctgggtgatccgggttagtaatgtcgtgtgggtaaagtgtaccccctctgcagaggttaacaaactgttcgaacagccgtgcccacggtcatgagcggatgtgaggtgattccttagcgtagttttcatttttaccctgttttatgaaaaagtgatgaggtttgggaaacccgatatttggaaggcaagtggctgtcagggagacagcggaacagggagtccctaaaagtgactggttgtttggagacaaccaaaactctgaaagtctggaaaaattggtttggtttgggaaaccagctttgaggccaactctgggagttgtgcaaatcttgataaaataatattgttcactcctcacccccggccgagctgagacttgtctcgctctggtcgcggaatgcacacacttagattgtcaaaatgcttgcaaataaaactgattgaaaaataacagccttcccttgaagcttgcattaaccacctaagttcccttggcttgctgagtacgtaagtactcacccttgctctctatatatacatagttctgccagctctgaagatgaagttgaagcaaagattagggtttcgtcctagttcccagccttcgcctgtggtgttgggtgttagaccgttggttccgctgctgctgctgttgttggtgtttcctcgtccgcgtcgtcggttgcattctctggctgttctgagctgcaacctaagttaagataaataagtactctatttaatttaaggattgcaatgattcatatttgtcactgttggtaccagcgctatgtcctgggactggtactgagatcgcggtttcgtaggaagcggttcacgccgtttttcttacgacacgctgctgtcaggcgccgttgtacgacggtaccggattggggtgtgacagttggcatggctcgtaactcttgaagatttcattagctttcgtctacattttttttgttctgaacaggcactatcatatggtgcatcatgagccgaaactccatcaacagttctctgcaactgtttttttttttgaactggcaactgtttgatttactacaatagtgaagcgtttgatgacatagccgcagtaacaaataatgtttctatccagtttactgaacacatgacattaacatcacaattcatacaacaaaaataaacaatagtactccaacctcagttctggccatctgttcctacttcctatccgcagcacgtccacataacagaattggcccaacataggacggagatggcaatggggacctctaacccgtgactcgacgggtttttactctattagaagctaattgtgttctaactcttatacccatgggtctactaatgggcaaaactcttacccattgggtacgcgggtatggatctattctttacccacccatacccaccaacccgtgagtgaaaaaacccgttgattgagcctaaaactataagcaatataagtctcaacgactactaaatcagtatgaaactcctttcacatcttaagcattgttacattctagttatatgaaattattattcgatttcttgattatgtaatgtggttgtataatttttttacttgcctttaaacgctaatgttaatagattgttgctagagaaaatattgatggtttacaactctaatatggctaattatagtacaaaactataaatgctacaagttaactatatgggtatgggtacccgttggatacccgttacccgcacgggtgtgggtatggggcaagggaacccgattggtatgcactcgttgccatcgatgggctcgaggcggagcgagagagcgacccatcttcaaggtcaatggagaagcgcgaaagcgagtagcagcgggagttgtaacaatcggtgtggatgaattaggccctgtttagttcccaaaaactttttctcaaaaacatcaaatcgaatctttggatatatgcatggagtattaaatatagataaatttaaaaactaattatacagttaggggggaaatcgcgagatgaatctttcgagcctaattagtcattagccataagtgttacagtaacccacatgtgctaatgatagattaattaggctcaaaagatttgtctcgtggttttcaggcgagttatcaaattagttttttcatttcgtatccgaaaaccccttccaacatccggtcaaacatccgatgtgacacccaaaaatttccttttcgcgaactaactaggcccttaatataacatggattgaattatatttgctgaaaatattattattcgattgatatttgaatttacattcaaatggatattagggtgatcatatttaagggaaacactcatgtttgtagattataaaatatacccaaattttacttctactacaaaaatttactactactactagtcaacttgcatgcaacattaaagaaactggacttggacgagagtcagtcaataatatatctagctaactgaatcagactgatcgcataataaagccactagcaaggctatgtttagattttaacttttttttcttcaaactttcaacttttccaccacatcaaatatttagacatatgcatggagcattaaatgtagaagaaaaaaaaccaaatgtacagtttgcatgtaaattgcgagacgaatcttttgagtctaattacgtcatgattaatcataagtgctacagtaacccatatttgctaataacagattaattaggttcaaaagattcgtctcgtagtttacggtccaaatctataatttattttgctattagtctacgtttaatactttaaatgtgtgtccgtatacgttaaaaaaatttttagctctgaactaaacacggcctaacacgacaacctatgtgaatcccattaagatggatcatggatgcaagaagacttcgccgagtcataaagaataccctatccgtttccatattaattgacgttttagataaggttgaggttaaacttttataactttaaccatcaataactttaaaaatatttagtttaaaggaactagaacaacatgcatttatttattatatatatattataataaaaaaaaagatcacagatgcatcttgtataccgtgtcattgtccaaaacgtcaattaaaatggaaccggagggaatatggtcattgtatctagtgcgcataccacttgtttgtctttttcttttttttttttgaaagaaattaaaggcaagaagataccacttgttagtcataatgaggacctctacttgattgataatgaggacttcactgcgtcataaacaatgataatcaatgtacgtatgaatctgatttagtcccttcgattgcatagaggaattcaccacatgcacaaatcaaattaaatcaatgcatacggtttaaagaaacactgccacaaaatgaaatcaatataggaaatacttttaagactgcggtgtagcgtagatggcatggtgcagcactgcagccatacgttgtgctcttcgcgacctgcgttcaaatctggctgaacgtactcaccctctttcttaataaattcaacattgggtcttttccagtataatttttttttgttattttacgcacagaaaataaaaacaaaaagaagcgggcacacgcatttgtactttgtagagcatttggttagcacactgacactcctgtttgctctcctctagctacttcctcaatgccttactcaacggaaaggacaactcaattatcttagctaagtcatgggtggtatctgtgcacagatgtagctgtgcagtagcaatagccagtgcaaggatctgagaccttgggtccctttgcttgtactaataatgaagaggacttcacttggtcataaaaaatgatgggcgaggacagcctcaacctgtaaatcatactatatactccaacctgtatatcacctacagagggtgaagcgagtcagtgtgagcaagcagagaagagttttctaaaggaaggagatgggatcttcaagtgttgtgctatggtgggaagagtggcagctccgtatcctcgtcctcggcagcctcttcctgcagtgcttccttgcatttgctgcagttcaccgtaggcgctccatcccagcatccttgagattctttatttggttagcttaccttggaagcgatgctctagcgatatacgctctcgccacactattcaaccggcacaagaccgataatcaaggcggcagccatgtcctcgccaccctggtcagccctcaggggaagggcggtggcgatgacactggccttgaagtcttctgggctcctgtcctacttctccacctcgctggcccggactccatcacttcctacaacatcgaggacaatgagctatggaggaggcatgtcctgactgtgatttcccaggtgacagtatccctctatgtgttttgcaagtcttggtcgggtgagaacaagcttcttagagcagctgttctgttgttcattgctggaaccctcaaatgcattgataagccaatggctctcaagagcgctagcatatatggcctagtaacctcatctcctttccatgaccaaaagtcacaaaataatgaccaaggcgagaatagatcacttgaagcctacatacaagaagccaagggttatttttccaacctaaagatcaatgatgtttatactgagttggtagcagctgcccaaaacaaagacctacgggttatgccgttttggttattcgtagacctcgcatctaccttgtgtcatcgtcttagagtcttgcgtttcttcttggttcttgacaacaagagcgcggattcactgctacagacggcactgtgtggttcctttgttcgtctttacacaaagaaaagcatgctcctcagttatttttgggcaaaagataaaaggaatgctctcatatctacttattcccacctgaacaggctcttagcagtatgcctgactatttcagctgtcgcactattccaccagagccataaacaaggctacaataatagtgatgtcaaggtgacatataccttgctatggtgtaccgctgctctagaggtgtacgcacttttcggtcccaagtacaaatttttcacctggtgtaagaatgttgcccaatacaatctcgtaggattcttcgcccgggaccaaacgcccaccaggttgctcaagttggccagttgtttttggtgcaaggactatgtggaccagcactggtatgtcaaccaatgctcatcgtctttcgccatcacagagcttgtaattgaacaggttaaagccggatggaagaactacatagaagatacctccacctactggatgttcaacgatcgcagaggccaactaaccattcagcatgagctttgcgatgaagagctgtgcaagagcttagatgtgccattcgatgagagtatcattgtttggcacattgcaactgacatatgcttctatgagggtgcccctgcagctaatcatcatcatctcaaggctgccactcgatgcagagagatctccaactacatgttgtacctgttggtggttaacccggatatactaatgtcgggcaccagagcgaacatcctctccaatacatgcaaggagcttcgtagcatgtttgaggatgagaagccaccgtctgatgaaagtgaccttacaagggagatacacagaagggcccaaagctcgaatgtcgacgctgctgcaaccgaagaactgattccccgtgcatccaagcttgcgagccagttgttggccatggatggcgacaagaggtggaaggtgatgcaaggtgtgtgggtggagatgttgtgcttctccgcgagcagatgcagagggtacttgcacgccaagagcttaggccagggaggggagtacctctcctacgtgtggctcctcttgtggtacatgggcttggagagcgtggcagagaggcagcagagatcagatttcaggagtcacgtagaaagagtagccagcagacaactaccgtgtaccgaaactgagagctctcaggaaccgagattcaagaggaggaaggagcagttgtgccattgtttcaggagggaaacataggtgtggccgttagatcaaatgttgaagatgaggaagcaggagcagtcacattggaaattcaagatgatgaagaaacggcgacgactacacatgcttccaaagcaactgtcccgggggacaacaatgtctgaaattcgtgtggtttgtctttagtttgttgcatctccttgtttttatttttcaattgtcatgtttgttggtgttagtgttgttgctggactcttttatgttgttgctactaatacttctctagctttgtagccttataataataataataaaagactgtgtgtctgatgatcattgctacagtaagtgacctttactgttatttccaacttttcaccacaattgtgtgcatattagttgttgatataaatgtccacgctttttgtcattaaactcaacgaattgttctggggtgctatgaatgcaagctattcttgagtacctcaacctccggaccatcctgagatctttgaagcaacccactgatcaaccggattctctttcttgaaagtgggaaccatcgggggagtacacttcctggtcggcttaccaggtgctatatctggggagaatcccattccaaccaacgccaatttgatattccttggctcctccacgttgtcgctacttcgtttgggtgaccgttctgaacgggtgttgagcggccgaccgtttacgcgctcgagggttgccgcaccctgatcgttgtgtcctctgttatcagcatgagaagtcgatcacattttggtcatgtgtccggaatcccggcaactctagtggctcgtgctcacaacaaacggatagcccggttgcctgccaatgaatgaagactcctttcacctgtggatttgcaatagtcggaagaagattgataaagcccactgatgaggtttcaacaccattgcaactcttgtagtgtggacgatcgatctagaaggaaagaaataatcgggtcttcagtcaacaacagaaatctttgtccaaggtgacgtaggcgatagctgctgacgcagcactttggcgcttggccaatgcggtggcaccggcgataggattgtaactgcctagagcccatggtcgccaaatgcttttgtgagaataggctttggttgcttaggctgtgttcggcagccttggttgggaacccatgtcccgcgcacggaaaatagagtggtccattagcacataattaattaattattagctgtttttttaaaaaatggatcaatacgatttttttaagcaacttttgtatagaaactttttttttaaaaaaacacaccgtttaataatttgaaaaaacgtgcacgcgaaaacgagagggggagttgggaacctgggcaacgaacaaagccttagtcgttcctgtttcatgtctccttcctcttatttttcctttgaattaccttgtaattaaccttcatttcttttaatacatattccttgcgtactcccaaaatctttatgtgctctcacaaattgagaaatacaattttgaccaatctcgcccagacaagttctggtgagttaagtgtctgttggtctgacactaattgttcgtgagctcggaaccggcgtgtgttatgttttcattttctggatatagggaaaaaaattgcaaggcccagaaaactcagaacaggatcccgtgccttttccaagggacatggactatggtgaaaatctgacaaaaatcacgtgataattagttcaacaccatacctacggctgtgttcctagaacagtgcaagcacccactatgaggtaccacagggtgacccgtaggatgaagagttgcaaagacattttctccactgtgcaagcaccgataatgggacccacagatactactttaccaaatcccctcgtcagagcagcatcctccctcctcacattacgccctcacctcccccaactccactagctctccccttgcccctccgccggcgccggcgcccctcctccctccgccggcgccggctcgacgatgccgcctctcccctcccggccctgggcggcgagttgacgagctccccggccgccgcgccgtttctccctcctccccatccgtcggcgcacgatgcagaggagcgtggtggcctcggggacgagcggcggcggcggtctcggggccgagcggcggagctggcggcggcctcgggaacgagcggcggagcttggcgtcgaccttgatttgtgttaccgcgatttgtgttggcgatttttccaaatcccctcggagccgagcggcgagcggcgattttgttgccgcaattttggtgggcgtgttccttgatttgttgccgcgattttggtgggcgattttggggaaaacccttcaatgggcagcgcgagggcacgagcgggcggaggcgcggggcaacgcgctccacaacgtagaaaagctgtcaattcctcgcctggcatgggcctgcggcagggaggaatcgtgcttccctccgtgggagagaacgtctctgctggggcgcggaacctagcgccacgcaaagctcgattccgacgtggcgccccatagcgtcggtccacggtgttgcactgtgaagggccttaccccatgtttcataacctatctctctcgttttccgcgcacacgcttttcaaactgctaaataatacgtttttttaaaaagtttttatgcgaaagttgcttaaaaaaatcatatcgatccttttttaaacaatagctaagttaattaattacgtactaatgaaccgttcccttttcggtgcgcactgttttcgattgggaacacgctagaacacaaccctaacgtcatatactaatactcgtattctttgttagagagttttttttattattttaatggtgaggagtcgtactcgtactcgtattcggatcttgagttatttatcacgaacgtatagctagtacgcacgcacctgcggacctgcctcttgtgaaggccgtagagaaaccacaggaaccgggaggatcgccgccgcctacagacaggatgccgtcgtcgtcttctacgcctgcagtaacgataacgacgagggaaaggtaaactaaaagcaacgtatctccgttttaaaatccttgtgtttctcgttttatctcaagtcaaaatatttatatctttaatcattaattttgaaaaaattatatagtttaaaaccacataatttatgttttttagattcatcatgagaaacacatccataacacgtaattcacaagttgttaaactacataaattttaaaaacttgatgatcagagatagaagtactaagttcatggaaaaactagagcgtcaagtaatttgagaaacgaagcgattatttatttggttggctccgtcaaagtcgaaccagcagtgttataccaaattgttatggttatggataccacatacctaatagtagttgactaaacttagcagggtccaccacatactgtcttatacgaaaacaaacctcgtatacagaaagagtttcggataagaaaggacgaatagagttctatatggaaacaacaaggactactcgtattgtatctatattggtctccataggataagaaaggacgaatagagttctatatggaaacaacaaggactactcggattgtatccatattggtcttcctagttctatatggagaaggggacatctatgggtataaatacaagcccccctaggaggagaagggacaagtcacaagacataacacacacacaagccaacacacgccgccggatatcaacatcagaaataagcctagacataacccatccggtgcctacgtaggttatcccaaatattgtatttgcgtgatccagatgaataaagagcaacacctgcctacgtaggttatcccaaatattgtatttgtgtgatccagatgaataaagagcaacaccggctttggccaacaggatatatggctattacctatcagataagataaggggcccgaacctgtataaaaatcctcgtcttcatctcttttacctcaatcacgcatatactctggtaccaacgatccccataccatccaaataccgtagtcgcgatcccaaccgtcgacacaaatgatataaaatttatcaataaatataaatacaagtaatttaaagtattaccctaacaatcgtccctttttaaactttttttcttatctcaaacaacccctcctacttcaattcatcccttatttaatactccctccatcccttatttacgttctaaatctctactattataaaaattaaagacgtttctgccgttactttagtacgtcatctatgtatgagtcggtttttaagtttgtttatttttggaaatacatatctatatttgagactgtttttaaagttcattcgcttttagaaatacagaagaagtgaaatacagaaggagtcgtataagaaatctttctaaaaaaaactcgcatgctaacttgagacgaatggactcttatatatagctcatgattttataaaaaaatatatatccaagcaaattcccacagtaaattttaccttaactaaacaataaacaataataagattaaaatagtatccatctgttgtaacacatgggcattttttctagtataaaaaaatactccataagcaagggcttgtttgaatgaggtttttagctatgtgccattaaaaaagatgacccctgcctctatgccactaaaaagttctagcctcccagaatgccatcgtcgagctttatcgcgccctacacacccttccgtccgtttttggtcctaacggtgtcaaatggtgcagcgaaatgactattttgcccttagggtgaataggccattttaacatggtagtttccttgtgtgccattcggacggcacccacaggcctatttttttggcgccaaagacagggctggttggcgccaaaggcaaggcccttctccttctatatataactcttcccaatccatctccatctcattgtcctctcttcttctcctatcttcttctcacctctcttcttctgtagccatgtcccaagcatccaacagctatggtggtagggtgaagcgggtgctttgccccaactgcggtgtgcttgcaaaccggttcatgtcaacaacagagaagaacaacaaccgtgtctttcacaagtgcccttattttgcagtttgtgcttcattctttgctgacatcttgtattttggttgtttttttttgctctttgctcacaatgttttgatggtctggctttcagattgggggatgtcagtattatcagtgggaggatgagatggtggacagtgcagtgcaggcacttcatgcccttgcttcaatgcatgctgttcccatacaggcagtggcaccacctggtgcttttcctactacactgactagaggcaatgctcaagtggatgcagcagattaagtggcttgaaaagctggtctatgtttgcatttttcttgctatgtatgctattttcaagaagtaggtggctcagtagtcatggatggatgtatggatgcatgaatgaatgaatgaatgaatcaatgaatcaatgaatgaatttgcaatgatagtgtaattgcccagaatgtaagaaaatatcataattagctgtttcatcacatgacagcaccaaatgtgacagcaccaaatgtcagcaacagacattacatagaaactacttaagtggtggtttgcaatgttacagaccaaaagaacagaacaaaagatgtttgacatcacagaacaaaagatgacagaagtttttcgccatcacagaacaaaagagcccacagaatgttcagaatgctttactgcagctggagcttcctgctcctggtatttctggcggggctgtctgggcttgatggagtggctgcaacttgcggctgggtatcctgttcaatggtctcatcagggcaaggtgccacacattgtagtggaactggatcatttgaaccagttgcagaccttgtgctaaaacaaaagcatgatgcattaggtgacatggatggattatttgttctggtgagttgaagacttgtggcaaaaagaaaacaaacatgttggacacactgattggttctgaggttgtggttgtaattgtagtaatggcagatgacccctttttcttcttgttggcaccagatgaagaagaagtcttcctttttttgtgggttgcattggccactgcttcattggctggaaagaccatctgggagggattagccaacactatactggtatcagtgttacatggtacagctttcttcaacctcttctttggtagacctgtcacaccccaatctggcaccaccgtacagcggcacttgataggagtgtgtcgtaggaaaaacggcgcgaaccgattcctacgaaaccgcgatctcggtaccagtcccaggacatagtgctggtacccacggtgacaaatatgaatcattgcaaatccttaaaataaatagataacttatttaccttaacttaggttgtagctcagcacagcccgagaatgcaaccgacgacgcggacgaggaaacaccaacaacagcagcagcagtggaaccaacggtctaacacccaacaccacaggcgacggctgggaaccaggacgaaaccctattcttcacttcacttcatcttcacttcaaggtggaggaacaatatatatatttatatagagcaagggtgagtactttcgtacccagcaagtcacggaaatttaggtgtttgatgcaagcttggaagagaggcaaggttgttttgcaaatcctttattttgaaatcattttgaaatcactaagtagtttacttctttctaagtttgggccgagaagagacttgcgtctcgattcgactttaagagatgtttttcaacaactcaattggtaatgtaccgaccccccgggtcagatcactacttctcggctcccagagccatttcacttgattaagcggctcccagagccttttcattttctcggactcccagagtccaactacccagcagtacaacaatccgcttccattcgggaagcctagtctatgatgcccgtagacatcccgaatcacacagattcgtttcttgaccactcaggtcatccatctgccacgtaggctgattctggtaacgattcccacaccacaacaacttttcacaaagcacatgcaaacaaatctacactataggaaacacctcacatccgcccatgaccgcaggcacggctgttcgaacagttagttaacctctgcagagggggtactctttacccacacgacattactaacccggatcacccaacccgtgagatcagccacgtcgggagaccttaaggctttcatgacaaggcattttgaaagccgacacagggttgccatatgccaacgagaggggtcccagacagacaacaggttaggtcccagaccatactgtgccaggaagcccgagagttctacccgacaccaccccgttgaatccacatgtctcttggcatcaaggcttccctggtttgctatttactcagccaggggcatcccattgcacccgtgtggtcgcacttgttatatgctcggatgaatttcccacaggaatcggtccttatatgcgaatacgggagaatgccacataggcacaacccccgcatcgcgagttttcacaatttattttattttcaaacacgccgacaccatatgtcgtgtttttcaaggtttctcaaacccatttcccaaattatcgacaaacaacggtgtatgtggaatagttggtatacgcgctcagagagcacgaataccgaagtaccacaagggtggagcgacaaggaatcagggtagtacagcctacaggaattagtgcgactacttgggtaggtccgtcggtttggcacacaaaccgaggccaagcaagttagacgggtgattctaataatgcaagttgcagaaaataataatgtttttccaattataggagcaattggtcaaagggtgacttgccttgctcaaggtcttcacgaagcttcacgtatcttcgagaaaacccgcgatcgacgaaaatccggtaaccgcaagtatacgcaaacaattaaaaacctacacaagacccaaaataaagatcctatttagactaaataatagtgccattatatagatcacaattttagagaaaaactggaagtggaacggagtcaatcggaattacggatcgcgagatatgaattttggaagattaattgaaatttctggacaagggaagatattttgtggaacaaggggaaaatgattttttttaaatttatagaaataatattctcaagaatattattgacagtcattgacatgcgggaccaaggaaaatgattcatggaattttggaataaggaattgatttatggaacaagggtggaaaggaaatcaaggagggatatatactagacttgtttcgggtggcattggtgcggcccaaaggagattggcccattagagcccgggtggggagagagaggtggtccggtggaccaagttcacctcgcagggtcccgagtggggcccgcttgtcggtgagacggtccacggaagaatgggcgcacgcgggacgcgttgccttggatcgttggatgcggctcacacggtgtgcaccggttagacgggagagcggcggacccacgcgcagccattgggctcgccatggaccgcgcgcacgggggagagggatggagggggaggctgactaggcgccggcttgactcggtcaagcgggcccgggggctgaggtggcatccactgtcacgaccggaaataacccaacgggcgttccttatgtgcgtgtattattccttgtcccaggaggcaaggtacaccaaaagttgatacaattcagagtttaacaagcggaagcgtaagtaagtaatttattacatgggcggcgaaggcccagcacacaagaagacaaacgaaaaacatcggaagactagggcgacgaccacaggcgcttgacggcaggcacgagctagagatcaaagccttcatcttccaggaacttctcttctgggtttgggaaaaattgagcaagactgagtacaaccaccgtactcaacaagacacacccataagtgcagaataaatgcaagggagtacaagggggttataatataaggggttagtgtttgcggtaaacagctgtcacaccccgaagttctcctcccaagcctaaaatttaatttataagagaccctaagaaaataccggtgcaaagcaagagtaaacccttttaaatcaatgcaaataataatcggagtgggcatgtggaatttttcttgagttctacatgtcgaaattcactaacaggatttttagtggaattttcagagcgctcgaaataattttaaccaattaaaattgagcaagcaatattttaattccagggaaaattcttttctcctttttctttttctttttcccttccttttccgaatgggccgctggcccattctctcctttcctccccctcctccctgctgggccggccgcaggccgaggcccagccaggccgccccgccgcccttctctcccggggtcgccgacaggtggggcccacctgtcgggtccttccccaacctcccgccgctcccgccgcgccgccgcgcccgcaaccgccgccgcgcccacgtctccgcctcctccgggccacgtcgaccacgcccgcgcgtgcgccgcgttccccgcgcccactcccctctctctcccgctcgcgcccgcgcccgagatggccgagattcgattttcgaatcccgtctctctctcctcccccacttcccccacgttagccggcgaaatcccgcctctcccgggctatgtccgggcccccctctctccctatttaagctctgccgttgcccccttttggtttttccccaatttgcccaactcccttggggtccccattggttccgggccggggaaccaaccgccgccgccggtttcggtaattcggcgccggtaaccggccgctaggttggccgccgccccggccgttgccgccggtggggttggggggcccaagatccccaaggtcaaccctcctttgccgaacctcggccccggaagcgccattcccatcgtgcgacggtgagggttgccatgtccgccgccttcggccggcattcccgtctcctatggcccctctcttcctctctaatctatttcttttcgttctaaaggtcgtcccggtcgccgtccgccgcgtgtcgacctcctccgtcgctcctcttcgccggtcgccgccgtcccattcggtgaggactccctcccctttcctttccttccccgattccccgtgcgtcgccgccgcccgtgctcgccgtcgccttcggtcgttgccgccgtccgctgccgccgctgtcgcgtcgcttttgcgccgtcgcctccaccgccggatgccattaccggcaacgcattcgcgcgcgcgtgccatcgctgctagccctggccggccggtcggctttgatgccgagccaagcccggcggccgcctctatcgccgcccgtccgatcggcccaagggcgatctgggccgtcggtcccgtggaccggcggtggaccacctgcgtggtcccggtccacggtgaaccgcccccccctgagccgctgaccagtgggccccgcttgccggcgccgcaccccctccgtgctgacgtcagccctgggaattattgcgcaataaatgatttaaggtttttcttttatagtaataaacacagtgaatctcttaaaattcataataattcatccgagctccgtttaagcccatcaaagtctcagtaaatcaagaaaaaatgtgtagaatccattaaaaaa

SEQ ID NO: 82701 - DNA, 822 bp, Oryza sativa
attcctgcaccccttcagatgggccggtcaccaaatcaatatcaactgatgtgggtgatttttgaggcaagacagcttgagtctgactgctgcgtagttgctgacaactttcatgacctgcacaagcaaaagaaaggctcattgcactttttcaaaagtagagtaggtagagatacaatcgcagctaaacaatggcattgagttaacttcaattgagcagccatggcatatattattctttatatgcacaacagcatgtgcaagcaaatgactataaactcagactgttttgacactcaatagttggatattattttttgttaaactcaaattgtcgaatgcacggattatttaatactaatagtgcgaatggtgttcaatatgtgtttcctgaacacttggtagaagtgtattttttttattttttttcaattgtacaaaccaacatggtagggtacttctacagagaaactcaacagtatcaaatcaccaacaatattcacacatgcatgcgtgcgcgcgagcacagaaatgtgtgtgtggtgacggctaagtgctcaccatcagtagattccaatgctttgcagtgctttcggttcggaaccttcagtgctgcaccctgattcttacccctgcctttcctctgttttttctgagggctttcatctgaaattcaggtcaaatattcaaatgtgatatttctggcatgatatcacctgttgcgtgccagtcacaatgtatagtaaatacataacagaataatgaccagactggtgaagcacttaagaagttaatagaaatgataaaaagggctgcaggaat

SEQ ID NO: 82702 - DNA, 2741 bp, Oryza sativa
gccgcccgcccccgtgcgccgtgcccgcagccgcctccgatcggccgtcgccatgacgccgccgatccgtaagagagatagacgaggatgccacatgtacgctatgtagaccaaaaccactgcggattgggtcgaggggggtaattcgttcggtttgcatagttgggggtgataagaatgtccggttttttggttcggggggtaattcggacgaccgcgatagttcgaggagggtaattcgtactttttcctgtaaggaaaaacaaatgtacattagataatgaaattttagtccatcacccttttgcattcacacagatacattcatacacactgacttgattcaagaataggaaacaaaattatcatccgtgggtgatctaaactaacaggattatcatcaatcaaccaagaatacccatccacattacacgtctccccaagaacaccacaagaaaaattcttatgaaatgtgacagagttaggagttgggacaatagaaacttgggtggatttgcaatcttggccttggtctatttcatgggtttgactaggcatatcagtgttggttccatccacacacaggcgctaataagaccaaatcacattagtgctagtttgtgtttggaattaacactgatgtttatcattagtgtcggtctttttactaatgggttgtcacacttaacccagttggaaatttgactttgccttgttttactttgatcactccaattttataaataaaacttaatgagtattaaaatatatttcatatcattaaagtttgtttgttacacgataaatatatataattaaagttagtttgttacacgataaatataaacatataaatcatgttcattgttgtaaaaaaaggggtttaaacggtattaatgccaatggttaaactagagcaaagggctagtcaacattactgaatgagtaaatttcacaaaattgttggtattttgcacaatctatcataaaactataatgtttagccttgctcattagatgtagtcacctgacctatggtacccatctgcagtctcaggaagtgatatgtaattaggtattagatttttgcatttcgtagcttccgtaatcaagtgtagctatatgcacctacatgcttttgtgttacctcttctttgagtaaatatgtagtttcctgatattgtaggtaggtcccacatgtcaggtgacggtgaatctaatgtgcaaggcaaaaacctgtagttcgttataatggagaaactaaatatgttgttttgtaagacaagttattaaacctatagttttacgatagattgtgtaaagatttatgaaatttctcaatgtataaagtttttaaagacacttatatatacataattatttttttaaaaaaatcataccgtttagtggcttagaaagtgtgttcgccataatctagcatctagtaactgaaaacaacattgtctacatggtgtgttgcttcatagcatgtacataagaagccatgtactattgtaaactatattgcaatagattgcatcaaagttaaggcccgttctctttagataatagagatgcaaaatatgtgtcaccttttaaaaatacgatttctccatgatgtttgtacatcagaatttattacacaactttttctaagttatttaataactttatagtctataatatttattaatctatgtatttgtttatcggctaatagctgaacggaacatgcccatatagctgcttacttcaagtgtacagttgtacttgcctccaaactatctcatttcttatttcttatgtcacatattatcttacgatatgcaaattagacctacttatcagtgaggcaataaagaacttcacaaaatattcatatggctataaaggaatattattcgtccttcagatccattcgagataccttgactccaacaaacactatttctttatggaaacaccaacaaataaacattggacttggttgtacaccttggcatcactatcaaccggccagcttgtctatctaactttcctcggtacatatacaaatgttttttcttaatattttttaagtgtgtgaaagtgatataagtagttgatttttgtgttttttttctctaaagatggaattaggagggaaatatgaaaaaaggacgacgatggtcgtactaactggattgggatcagatgtagtcccaaatataactgcatgttagcgactgcactcaagtccatctaatttttcaatcgaaggtccaaattgaatgtaacagtagcctagctataatagttatatgatgaatgccctgaatgaacaatgttatataaaatttgggccttcggattacatcctatacatgagaccttatttggaaagcttaacatgctaagaatctgatagttggtagttagtttatgataatctaaaagaagaaagtggattcttcttacttcttttttttttctatattctataactacggattctcagaatttggatgacaaatataaattgtttaggggaaccgaagattttgtggtaggctacaactactagaagctctccaagcagaccatagtataattgcgtaggttaaaatcacactaaaaacaacattggaacccagtccgaagagagagaaagcaataaaatcccaaatgcatgatcccagaaattcagctcatacaagtcatggagcacgcatgtccaaattacacacgtggcgtgaaaattt

SEQ ID NO: 82703 - DNA, 7865 bp, Oryza sativa
aaaggaatctgatcgccgtagggccagacggacgtgggggaaaggtcaaaatttgagagatcttggcaaattccaagtcagtttgataagttttcctcatctccttccttgtcagacagtaaagtagttttgtctcataactaaccacctgcatcaatctctgcaatgtttgctgcaggatagcaagactcaagcactatggcctaaggcacagaaggttggaagcagaggtgggcaatctcagatagatcatttctttgggaagagatgatcctgctgcgcaagctatgctaatatataccactttcaaactcttgcctctgttgctgcggtcaaattctgtttggagaactatttgatgtcctgcatctgtacttgtgtaaaatccattgcacttaaggtgaaagctgaatccaaatttcgcagtgtcatcactattgggcctgaggggatagatagagcttgtaaacaatgagctgtgtaggaaacctgaattcctctgttcctcagaggctcaggtggtcatgtgtaccacattgctaaacattgtgtattgatagagctgaggagataacaggtggcttagctcacttgatccacatgcaaatacattgcaagctgccctttggctaagtctgaaacctatttgggtttcattgtactgccaactactccagcaaagcaaagctgggaatcacaagaaagttggacactgggttgaagaaaatgactgcaagttttccatctgccaaatgccaaatgttctttcatggtaggcactagagtagtatatatgttctggtgttatctggagtctggagactgcagaggctacacaacagctgagcaaaatccaatcatggtgagacaccaaacatgatacctcagtccctctatttaatttgtgtttgctactgctagtgttcaacctctagattcattggaaatgatgtttagtggtcagtggatagatggactactagctgctttgtctctctcccccctctcaaaagtacaagccaatttttctttctcaaattcaaaatagcatgaaactgttactcactcaccatacaaatatatatcagcaaacaagtgacgaatcttcgaatgctgatcttaccctcatatgaaacatagaaaacttttccaaatcttaaagaaaagaaatctctcttttcgaatataggcatctcaccaaaaactcctctgttccaaagatcaattttttttaaaaaaaaatcataactacattcaaaccatttacactcttctctgtaagaaaaagttaagagtagcacgcttcctaaacttctaaatagtatgatttattatataagagtttagacataaaagatcaccttagagaggtgccacaggaagaaaaccaaatgaattacagcattttgaggccggcgtacaatcattaaacagtttgggcatcttcatacgctttgcacatgttaataatggaatcgatcacctgcaatgcaacaccgtgccataatcaccattgaagattctagcatttctttgaagcaataccgtatgattttcttttaaaaaatattttttatatatcaattatttatcacaaaatcatccatccattctttagttcggcatgaagcaaaatacaatttcctagtagagcatatatatgcaaaagatccaaagaggagagaaaaaaaaaacaattcaattctcttctcaactcgacggccatcttcttctttctctctccactccgtcgccgccccttggcctccctcaacggccaccgcgcccctcctccgccgccaaatcgcacccaaccccttcccctttaaactattccacctataaggccgcgccgccgccgccgacgagagagacggccatgacctcaggttctccctcctctctccgcccccccgcaacttcctgaaattgcatctaggtccccctgacgcagcgattgttccctcccttggagaggtggccgtagctctccggcggaaggcggcggagatggcttccacggccgcggcggcgtcgtcgcaggggtgcatctcgtgggcgctgcggcagcgtgggcttggtggtggtggtgcgcgggctgtcccggtgcttccccgccggagattctgcgtctccgcggcggcgggtgcggggttcgacaacgagaatcgcgagtgggtgttttgctctctggttctttgatccgagcctgatttagtgtttttttttctctggttctttggagtgggtgggtgggtgggtggtgtgtccaagcccaagaagaaatgggatgctcatcaggtgtttgatgaattgccgaacccgagtcgcaggtatgtgatcgtgggtggaggcaacgcggccggttacgcggcgaggacgttcgtcgagcacggcatggctgatggccgcctttgcatcgtctccaaggaggttagtgcccaatctggttcagagtttcggaacacgaatttttgctactatgttgattagagaaccgggttaaaaggtttctgtgttcatgatatgaaaatgaatgcgttgtttggtcattgttctcatgtaactgcaatgtattgattggctgatttttttttttgagatttatgatggggtttgcttactgtaatgcaggcgtatccgccatatgagcgaccagcactgacaaagggctatcttttccctccagacaagaagcctgctcgtctacctgtaagtaatcaggacaacttaatgatgataagtagcatttgttcatgctatgctagtaggtgatggtgtgggtgtgcgctacctaaggccttgcctactgtaaatttctgtatgatggcttatttggacttcagtgaagtctgctccagtttgttggcattacactttctgtagtgttcttttagctgatatgagagatttgtacgcttcacactgaaccattaagggtacagcccaaagccacccatttaggcatatagactcaaattcttgagattcgtcttgttgcagggctttcatacctgtgttggatcaggtgggcagaggcagactgctgaatggtacaaggagaacggcatagaggtagtcttgacactattgttaaacattattcaatgtgtttgaaaatacagtatgacctctatctgaagccattgaactcttattaaggtattgtatgaggatccagttgtagcgtttgatggcaaaacacataccttaaaaacttcatcagggaaaattctgaagtatgggtcacttattatttctactggctgtgaagcttcaaggtaaccttcaaacagttgaaaatttatcttttgcaaggcccttatatgaattcatgattagaggtttcatgatttttttcactcagaattcttaagataaacttgtatgctatagtaatcaaatgaaaatttcttcactgagattgtatgcatggaatggatacaggctttatattaaacccagaagttgtttgttgccatctgtaatgttgatgcttcctttcaggttacctgctaagattggaggaaatttgcctggagttcactatatacgtgatgttgctgatgcggattctctagtatcttcattggtatgtcctgtcaacaaatagtgctagatgtttcatgtacaccagaactggattctctcatttgactttgaagaaataatctcaattttttccctgcatattctcaccttttaacatttattgctgaaatcatagtttgttttatctttatagggaaaagcaaagaaaattgttgttattggtgggggctatattggcatggaggtagcagcagcagcttgtggctggaatctcgacacaactgtaagccacagtgtttccttgttcagttttttatgaagactcttatttgtacaagcaattttctaattaaagctgcttatagattatattcccagaggaccacattatgccaagactctttacaccttcccttgctaagaagtatgaggaactgtatcagcaaaatggtgtcaaattcattaaggtaatagcttcgtcaagttcatttgtttaatttattttgtcaacatatttgagctcatgtatattttgttccaaccagggagctcttattgataaacttgaagctggctctgatggtagggtgtcatctgcagtacttgaagatggatctgtagttgaagctgatacagttacgaccttcttcttcttcttcttcttcttcttttgtgcaaatatcttgtttcatcatcttaattatttgttgctcaggatgaaagtatgttatcaaaaattgccttgaatatttgcatatgctgtggattatcaaatattgccttaatcatgagtcacatatgttgaggagtggtcaaatacttggcgagctgatgtaaactaagtgaagatcagctcattccaagcagcatcactgagacatttaaactagttttttttttgttatatttgatcatccgtgcagtcactgacacttctaaaattattttaacaagaacatttgtcaattcaggttattgttggtataggagcaagaccagttattggcccatttgaagctgttggggtcaacactaaagttggtggaatagaggtttgttttcaattattgatgataaagttaatgaatcttgttttattctcatattagtctgtagttgttttacttttgtactagtagtctgcattctgcaatgtgatctatggcagttattcctggaacaaaaaataaaaaaccactacattccccatgaaatttccgagcatctgtgcttgttttgatcttcatgtgcgaaacttgagtaggatcgattttacagcgcaccaactgactcatatagatgattttttcagttaaagccttggtattgtattctttttttgctttggacatgttaatatgttatcctacacgtgtttcatagatgtttggcatcctgataatcaattgctatatcttactttctccgtttcatattataagactttctagcattacccacattcatatatatgctaatgaatctagacatatatgtgtgcctagattcattaacatctatatgaatgtgagcaatgctagaaagtcttataacctgaaacggaggtagtatttcttaatagagctaattaagtacttcttttacaggttgattccttgtttagaactagtatacctggtatctttgctattggagatgtagcagcttttcccctcaaggtaggagctcactgcgtttatcttataatcatgaagaattggattccagaatatgatgttctgtcaaattctttggcagatgtatgatagaatgactcgagttgagcatgtggatcatgctcggaagtctgcacaccactgtgttgaagcactcctaacatcacacacaaagccgtaagttaatgggtagaaagtgtactgcattagttcatctgctagtgctgctttaatttgccattacgatgcaggtatgactaccttccatatttctattcaagagtttttgagtacgaaggaagttcaaggaaaatttggtggcaattttacggtgataatggtacagtatataacataagtaattcctactacataacgcatgtcctgttagacttcaaaatcacaaactcaataccctctctgttgtgctgagcagttggcgaaacaattgaagtgggaagctttgaaccaaagattgctaccttctggattgactctggtaatcagttgtctttcactctagagtatctttgtactctcatttgcacatcttattacctttgccttcttgtactgtgcagatagtcgactgaagggtgttttccttgagagtggtagctcagaggtaataaactactggcataacttctgtcataacaaaatactacctccgtgcccaacgtttgaccgtccgtcttatttaaaaattttgaaaatatttagtcacacataaagtattattcatgttttatcatctaatagcaataaaaatactaatcataaaaaaatttctaataagacgaacggtcaaacgttgaacgtgaatagtgcaaaactgcacttattttgggacggagggagtatttgcttatttggatctttcttttctgttcctttgaacttaattctgaactgcaagttatttgactataagcagcatacctagttctgatgaaacctccaccatatttcaggaattttcgcttcttcctcaactcgctaagtctcagcccgttgtagacaaagctaagctcaaaagtgcaacctctgtcgaggatgccttagagatcgcaagaagctctctccactctggttcttctgtttagctctcaagcatctagaaaaattcagtttgtgtcctgttacatcttttaaaacaccgagacttcaacaataattctccacaatcccacggcattcgtttatgcgggattgtaaaattcttagatgtacctacgttcgcatttccaatttgaaataaacttggttgccctttgaggggtttgataaagatatgataatgaaacccatggaatgttactttctctcattctctccaaactgttgttaccggttaaagaaggggtcactgtaagtggggtcagcatcctggtagaagtttaataacgggtctgcataccatggcttgtacgaaaggacgatttcgttttctgagcagtgcttcactgatattcttgtttatgcagtttatatatatatctaacctacacaaaaccaggaattgttgtcctagtagtattctctgtactagtttatgacaaggccaagcccaaatgatcaccatgacaacgtggtggaattattcttgtgtcatttatttaatcatggctcatgtatctgataaatacttgacttctcttattctgaatcatactactgcatttttttttgttctatgaaatggtcatgtactgcatgtgagcagagttgcaaatggaataaatcgtattcatgcgaacagagtttcaaatggaagtcaggcagccaataataaatcgcattcaaatggacttcgttgggttcatacatccaacggcttcatagtttaaagaccacaattaatcagtttgcttgttctgcagcctagctttgttttctgctgattattgtaaattaagaattattaatcacctgattctgttagtacaggcacaaataacgctgtcacccgcaggacttgaactgaaattgggattcaagtttttaagttacaaaacatagtaaactcgtattttcttcctttattataaggttatataatcacacgtgcttgatatatttttattctggtgttttcacaaatattgtttctgctggataggttatgggttggatgctgatatactagtaaaagagttgatttagataagaaagaaattacagtactctacaaacaggcaattcttgcaagttaaaacatgttgatcagttcatatgcatatgatccataattcaatataccattcaatatctatggcttggttcaagagaaagtgttgtgaaatttacactccaatacctccatacatgcaaaaatatgatgtgccatgaatcttccttacattactatcattttttaaaaaaaaaatccttggaatatgcacaagaatataatctatttgaatatatgccttcgtcacatccaatcaaactcttcctggcaggaggccacaagacaatgcaggtaaaacactgactcaccattaatctccttgttgatacactatctgattagcttttcatccagatattcctcatcatattctcctaggctctaggctcagacaaatgcttccaatgcagcactggactttggtgactccttgtttggactat

SEQ ID NO: 82704 - DNA, 6098 bp, Oryza sativa
aacatttgcagcagtacatccaccataaatggtggtcttttcgatccagtggcatctcatgttggtccatactagtggtacagtttaacaatagactgttgtataaacacagcagtatctgggacgatactcgagtaatacataaattctattctacatatatatctccatgccaagtattttcgaagactggcatagcgggcagaagctcagcttgctttcgcactccttgcaaaggcaaagatgccgacaaggcaacaatagcatgcaagcctcgcttgacttgcagactctacatgcggtcaaatctttggagtgtctgttctccttcggcattagttgcaaattggcggcaccaccattgcaacaggatgccgtgtcatccacctcgctatcaccacaaccttctttgaaatccttgctttgatgggcacatacctgttccaagttgtacttcagtgcgtttatcatgctctcattgtacttggccctttgctgccacgcaccaacttccactgccaactgtttaatctggtcctcaagttcagagttccttttgttaatgttctccacttctgcctctttatcccgtatttttctaagtatcttatcctcaacagaggccagcgcctcaaattgctttgcctgaactttctccaatatggactgcctaagccgctcactctgccaatttgacaaatttagttagcacaccaaaatattgtgaaatattaaacataagttacatcactaattgtaactgtatttaaacaaaccatccatccaatgcatagtcctatttgggaacatactgccaagtgtatctttttcttatcacagttcactaactcctttgcttcttctgatttcttttgaggaataaggatgggggttcatatcaccagcaccatttacgtggaataaaagaatgtagacagatatcatataatccggaagtcaatagtaacttatatcaagtcgtcaccaaaaagaaggctgacagctcagctgaagcacatgatcaaagttctccctttttgctttatatataatattgcccatgccctttttccctttctccccactttgattattaaaacatgttaagccagatatacattcctggtgcctagaaattagctgaattcactagcttaccgtaaatgtatgtggcatgggctaagaaacccaacgtacattaaataatactgtttagtgtccaaaggttaaatgaatgatccgaccaacattgaagatcaggtccattttgcaggtaaagcaattgtttaaaagttcaattgatggaagcaaatcaagaatagacaactgaaatttatccaatcaacagaagacaaaaggaactaagaacacaggtggtacacggatagaaccttctggttaattatttcatcaactgaaaatgcattgcagttttgtctttaagcaacagtgcctacaataatgtagcaggcagatcacattaactaagacaaaggataccagaaattctatcttttcgttccattttgtctaacaccgtggcttatcaggattcaggagtcacatagcagtcccatgtgtatactgatgggttagctgtaccaccaagtataatatgtaacacttgagggttcaaagacagtaacttcaggatgatcattttggttaaagaaagggttttagtccaatagagttgctaggcctgcataggcccatctagagtggtatctgggttgtaaaccaaacatagcctaatgttcacctttttgttaaaatttacatggttttcttcaggtggagtactgaaggaattccttgaaaaaagatggtctgctcatgtagagatacgctcataacgatcagcatggtgtcaatagcaattagcaaaggcggaaacctctaacattagcaaagaaaagaaactatctgtgtgtgcccttcacctgcaaaaactatatggcctgaaacagtgacgcttcactagttttccctaacaaaatgatcatgaatacctcatacaagtaacacatgctggtaaagtaataacatcattagttcatttttcgtattagctaatcccacaacgaaaaaggtttacgagtgcctgacctgggccttgatgaagcggtccatatctgcatcgagccgctgaacctcgcgagagatgtcatcatccaacatcgggagcaggagcaacggcgaatcgccggaggagttcccagccccagcgccgctgccaccgccatggcgtctgtcctccagagagagcgccagcccagtggacaccgcggagcccgtctgcaggaaatcgatggacgacatctgggagttctctcctagcagctcctgctccctaggctgcctccaccctagccccgccgcggccgtaagccccatcgcgtccaccactacacagtacggggcaaaagccctatgctatcagcgccaatcgaagcggaatttcaaccaggcgaagaggacgagggttcttcgcggtgggtggggagaaaatggaaactcacgtggtggctgcgcgggctggtcctggaaggccggcggcgggttgaagaagggaagaggcgccgggatctgcccatctaccggcaccggcagcgcgttcctgccatgaagcgcggaatccggcggggaatttttagcgcgaaaattcgtacgcacgaacgcgcagagaatggaattgagatcgcgtacctgaaggaagggggcaccggttgctgctgctgctgcggcggcggcggcggcggagcctgaggatgcggctgctggaggtggtgatgggagaagaacgccatggccgaggacggggaggaagtcgggggaaggagggagagaggggaaagggaaggtagagggaagagaggagagagaaggcgagacggggtctacagttacgaacattttggctcatcgagagttgtttaagcggctaacatgtggggtcacggtccgtggagcccacatgtcagtcacgtatttgttagctctctcatgttctgcatgcttttggaattttgggctgaaatattccgtgagagcccctaaacattgccagtatgttcagttcatggacaagttcttttttgggagaaatgttccgtaatggccccttaactttgctggatatgttcagcctcataagtttgttgatagtatgttcttggtcgttggacgtatggccttgcaaggaaacctcatgagcaggcactcaagattaatatgttagcagcctcttctccaatcagaatttgcaataatgctgaatacaacacacaattattttggtggagcgaggaggaaaagaataagagatacaagtctctagaagatactagaaggatctaggacagtgaaagaggagaggattacaaaagaaatcgataagtttgaagccagaaacagatcgctgccaagagcctcagctcaccatttcaccaattgatcaatcaactccacccacctagagttgtcgtcgttgcatatatttcttctcctaatgcctgcatggagttctcaaaaacgaaatgcttgcatgggctcggcttgaatcgtggccatttcagcccatgtataatattagtaaagcgttggaacatatatgccgtaaactaggccatatgctttaaatggctgacatgtgagccccacatctcatggttcgtatgtcagtgatctatgttagagggtagtattgggtggatctacaatatatgggacaacatcaaatgacatcgataaatttgggtaaaacatagggttatgttgtttatctatatattataacactatggtctaaaatcctgtttgtttcaacttaagattattgtaattcagattattgagtcggattactataagttggattataataatctatagtagagtaacttatgagttgtttgtttctccgaattattggaggaatggattattgggtttgaaagactaatgtctataatgccctcagctattgcagagtgagagaaggatgagatggcggtggcgacgtggcttggcaaaggagctaggacgcagggtgggggctcgggaaggatttgcgcgtagggttcaagcttggggaagcattcgcgcgcgactagggagagaggaagcggatgcacgcactgccagtggagacgtcggattcacacacgactgggaagagaggaaacggatgcgcgtgtggccgggggagtgagaaagcggatgtgctcgatcgattgggttcgatggcagtgctagataatttgcgtaaaattttaagggtagtgggtctttagccacccaataatctaaaaaaaatcatgtttagaggggattaccagattatactaatatagtttatagattataataatctatcatagtaatttaccaatttgtttcatattattactaataatttagattgtaataatcctaagctgaaacaaacatgatctaaatataattcgcataatatgacaccgaagatacattatgacaccaacaaaccaattttgcgatccaccactggcaatagttcaagagcttctgttagaagtgtaaggtgtgtacatgccaaggtgttttcggaggctctgttgcccaaacgccgcagcaattatacagcctcaagcacactacttgcactcgacgtcgggggctattcgattgttttgataggaggtcatcgtttggcttattataggaataagccaaataatatatttgtaaacgaaaaataaattgtgaacaaaacttttatatacgtgttcttggcgacctaaaagcaaaggctgaaaaataaacttcgatgaaaaaaaaccttaaaatcaactccaaatttaatgttgaaaattcaaattttggctaataagtataaacataagcgaaaagatgatagaaaatttagaataatattagtaaaaaagaaatgaatgaattaactattgcaaaaaagaatcaaaatgtttttttttataaaaactattactccctccgtcccgaaaaaaggaattaggatgaaatatgacatattctagtacaatgaatctggacaaaggtatatcaaaattcatcacatccaatactaggttggttttttatgggacagatggagtacctgagaaactaatacatagaaatttctttaaaaatcaaagtcaggaagcatgtctgataatccaatgatatgtaaagagagcaaaactgggcctaatgaagaacacaaatagaagttcccataaacagcatttcgcagttttgcgccccacgtcgcagcaatagcaccccttgatgagtacagcacaaccccgcacaagtgcgcaacaagcctttggaacgcaaaacgtagtagtattatctggcattggcttcacgaattcgtgcaggtccattgaaggacacatctttaactgactaaaaacatgcataaactcacaattacaagtgaacagatgaaggcaacgtggagatcacgtcagaaacaagttgcataatatgtgctgggtattacactcgtgttttgacaatgtcacaatgcatagatgatctttctaagcagaagatgtaacatgtaacaagtgttcttatatcctgcttaaccagcgaagattatatacgttctaaaattttcagaattcagacttgctcctaaaaaatgacatcaaaaggatcttagagtcgttcatagttcagcagtcacaatgacagatgtacaggttaaccgcagcaggatccacaagcagggagagaatctggaatttgaggttggttagtcttagatgtgccaaaaaaggccacagcaaagtaaaaactggaatttgactcagcacttactctgatcgttagatcggatgtcagatagtgtgcgaggacctcggaggccgcctccaccgccgcggccgcccccataagggccaccaccaggacctcccccaccaggcccaccatcccatttcttaccagagccataccctttcctatagctgtctgttttttcaatctgaaagatggaagtgcggaaatattacaatcttcctgagttgtgaccatatccattatggaagcacatggaacagaaggtaaatttagggatgtaa

SEQ ID NO: 82705 - DNA, 8623 bp, Oryza sativa
ggatgaacatacagacttctgaaagagtcaaccaggatatatcggttgtcatatatggcatgacccatcaatgcttaactttagcacatggcaaatgctgcatatatagcttaattagtgtgaaacaagtattttaattagcaactagtaaatcagtgtatattactgtatcgatttatcttgtgaagatcgatcgatccggccagagacattggcatggatctgatcgatcgaggtcgaattatatttgcgatctatctatctatcgtcgatggcgccaagaggaagagccaaatgtagccatgtgcgcgtgctgcccgtatatatcaatctatcctcgctagctccttgctatgcatgcgttgccggctatatatatcgaccctgatgatctctcttggcctaatatatatagctatcctagctaatctactctacctaacctagctaattggccggccatgcatgctgcagtagtacgaacgtgccagccttgggaaacaattttagtacctcgtgggatgttccctaacttatattcaaacatgtaaaggcctgcttatttggtgaaataaaaatatttaggtgtcacatcgtacgtttgaccggatatcagaaggggttttcagatacgaatgaaaaaactaatttcataactcgtctggaaaccgcgagacgaatcttttgagcctaattaatccgtcattagcacatccgggttactgtagcacttatggataatcatagactaattaggctcaaaagattcagttacgattttccccctaaatgtgtaattagtttccttaacttatatttattggtccatacatatgtccaaagattcgatgcgatgtttttgggaaaagtttttggggaactaaacagcccctaacaccatcaaatagttatagaaaaaaagaatcctctaatgttaaaatccaactcacacatttataaataatacttcctctgtcataaaatataagtatttttggacttcgatactgtcttcaaaatactatctactttgaccaacaatatctataaaaatagatgtgtcttaaataaaaagagctgcatactatgataatttgtttaacgataaacctagcaacatcaatttacaagattgatttttttattttttctattaatacttaaggttaaaaatatttgatttgtcaatattcaaaaataatgtaaggagtaaataataataataataagacaaatccaacattcacaactgaacttgtcttttgtttttttgtcttctcggtgtgtaaatcgagtttaaataggagtaatagataccatgcacttcaatacttcatattattatattttataaagtttttcactattattttaattaaaataaataaatatgaggagatacccgtcttgagatagcaacatccatgcatgcatgctatagcctgccgatcaagacaggctactagctagaagaagatttttcatctggacatcctttattttgttacatgccatctaagtagtcataaaaaaataaaaattaataacaagaatgattaatatatatacatggtaaaattcaactcctacaagttgtagaaaacaaattaacctgtatccatagtcatatttgttatttttattatattttatataaatcaaaattaaatatgtatatttgtatagtgatatgtgttatattaatctatcttgttaattttataaaaaatattataactattttcaatgatatataagaaatgatgaaatattttcccgtgggttgataacgctttcgcgtgctatagctactacgaaacctttgtcgaaactactggtggcccgtcactcaccgcacatcaatcacacatgaacagcaatctcgatcgctgcctgtctgcctgtctgtctgcatacgactatgccgccatatctgttcatcttcttactgcagcactactgctgcacaggagaaatcaacaacacgattagtgccacagtaccaaatgccgatcgatatctcatagaggttccaaactgcaagatccatcgatcgactaactttcgagcttaactaatgacctgtactcctagatagttagactgacaaaattcagtcgtccacaatggatgatatagccagtcaccgacagaagctgcagtcaatatgtacagaggaacacaacagccacacctggactgtcagcccggcctgaagttccttctgtagccttttttcgcccagcatcagtactgccctgcaaatgggacgcatgtcttcacagcttaatcatcggttaacttgttattaattaatgttaatacttctgcatgtgttgatcaaagcagactgaactaaagcagacacgacatgcatgccactaaccaaatgtatgcaggagtatagtataatgcacacacgacagactgtttatgagtgcaaatgattgcgtgcactgcaaattatttagttttgtcccattggtttatcttgcttgtcagaaaattgccaatcaatctgtgatttgatgtcacacaatcagcagtactactccctctgtcctataatataagggattttaagtttttatttgcaatgtttgaccactcgtcttatttaaatttttttgaaattattaattattttatttgtgatttaatttattatctacagtattttaagcataacttttcggtttttatatttgtaaaaaaaattgaataagacgagtggtcaaacgttgtaagtaaaaactgaaaatctcttatatcgtgggacggagggattagtaaccttcatccttctcctttttgtttaaaggcagtactaatcttcagaggaaaaaggaacagagaagaacagacgaacgtgccatgggctatgcagctatagcctactaataagtctatgactgggccatgtctctcatggaaaggaaaggtggtgccacagggaaaaggggtgatccatttgtgcccatttaaaaggaactcaagatgagtgtcaagattactactcaagctctagtctgtaatgtgagtgagactcctattaggttcaggatatgaagctcttgttccagtgtccctgctgctcatgcttctgcgtcatgaaggcaaagaagaacagcagccaaggcaaggaaggaggaggaggaggaggaagcaaattgcaagggggatcagtcatggtgaaaaactgaaaaccacagaccattagtagcttctgttgatccctgtcttaatttggaccatgtgcatgtccagttagtttcttcggttcatctctgttgctgcagcagtttggtagttagttttcatgtgctgttgattgctgctgccactcatctggccggccactgtcgatctccgatcttgatttttaagtctttatctagattttgttgatgtatctactatagtcaaataaaaaggcatcattatttaccttaattagagttttgtctggatttcatcccttgatttgtttcaagttactaccttgttatcccccctcccccagcgcattggtaaagctgtggttagctctgtatatttcttgtgctaattaaccagttcatggatgaacacttgcagaaaaattactgagcagctaggaggcgtaattaaagtagtgatgttttgtggatcagtttaaagtgttgtcatgctcaattagcagagcaaataggtgaagaaaagtgtgtatgctaattactgaaaggatgcatatgcatgggggacattggagcacgcctgcttaatttctgaaacattgatctgaacaattaaatttctgaaaaaatgatctgaacaacatgaccagatttcacataagtgctttctgtccgtgcatcatggatgccatgactgctattttcttgcccatgatgatctattaatgctgattctaggattcaaaaaaaaaaggattgctcacatacaatatttgcaacaaagaaagtggcacactagcacatataatggcatttggtttgtgcctaatcaagctagcctagtataatcacttcacaattccctatagtacgtagtttttggttacttgtcacaattgtttcttagcttcatggcttacatatggcgcgccaattattttactacacctacgtattttgtcttgatcttaatatactagtataaaacaaacgagtataaccatcacaagtttttccatagcaaacatcttagaaaatatataaacccaacgttaattaatactacattcatattttaatgtacgacgccgttgatttttttatccaacgtttaaccattcgtcttattcaaaaaatttatgtaattatcatttaatttattgtgccttgattcatcatcaaatgttctttaagcatgatataaatattttcatattttcacacaaattttaaataaaacgaatggtaaaacattggtcaaaaactcaataacctcatatattaaaatacggagggagtaattagaaaaaccaagtcctctactaggaatgggctgaggtgacggtccaagcactagacggcccacaggtcggcgcgccttagcccggcccattgatccacgccgcggacctaggtgagacggcccaaacgcggcccgtttaggtttggggtttttggcgtggggagttggggggcaaagcaagcgaagcaaagcagcggcgacacggcggcgatggctgcggcggcgaggaaggggacggcgacgccgctgggcgcggtgttctcgccggaggagacgaggagggccgtggcgcgggttgccgaggccgtcgccgaccgccgcgccgagctcggccgcctccagggcttctccgccgacaacgccgccctcgtctccctcgtccagaggctccccgacgaggtctcccacgacatcatggtaccccgcttccccttctcccttgctcctctctccgatgagcaccatggttgcgtgtaacgatgcatccgcgagccagtttggtgatgatgtttttttttgggtgttcccgtttgcaggttcccttcggtggcgcggcatttttccccggccgtttaatccacacgaatgaactactggtaagggttcccaccgttgggaatcggagcggctatggatttcgattgtgatggttgatttgtctaaatctcagcatgtaatggttgattgtgtctaggtgcttctaggggaggggtactatgtggagagatccgccaagcagaccaccgagatattgcacaggagggggatggagctggaagctcaagtggaagcgatgaaggcaactatctctgaccttgaagctgaggcgaagttcttcgaatcaactgccgccgaggcttctgtaaggctttcttttcttgtgttgtatgtttcgggcaggcagtggtatgttagtgtttaaataagttaaggtggctataaatctgcaatttcattcaatttgcttgaggtcacttgtaagagaaaaaaatgaatagtgttttgcaacaggccatcattgatatctatgaattcctcatttgcagcaccaatattgtactttgccagctaagctgtcacctcaggcttatcttaggtctttggtatcatgtttggatggtcaaactaaaacgcactaggcaagcagtcaagtggtgcttagcgcctgtatactgcataggcagcccaattgcaatcaggaagaatttggcatgtattcagacataccgtgacagatattaaaatagatgctcaatacacactttaattaatccccatttagttcaacagggaacatgaactattactaacccaaaatcaagcaaggtacttatcctgtaagctgtctagtgccctgtgcagcctgcctaggatcacctagcactgccaagggccacctagttcagccattttggcaaaaaaaaaaaaaaaaaggttctgcaggagggggcccttgctcacagagaacttaacatagtattttctggtgttatgtcttatggaattgtgaattgttcacaaattggcgttctctcttcattcttccgttttgagctttgtttctataaagatacttaatctcttttgcttatactggcaggaaggtcttattgaaataagggaagaatatgatgaagatacagaaataaattcatcaacattgggtaaccatttggaactttcttttcattagctactggtgttctgccttttctatcatatttcagattttcagtatctgtttgatctttcgtgaacccatagtatgttgagttgtaatgttaattcctaatatactattgttgtgagtccttatttggtctaatctcctaaattttatcaagttccaagtaatcttgtgcaagttgatcttctggtatttctccctcgttctacatgcaaatgctggctgttgacagcatcatatctattaagtttaacatatataattaaacattacatgaggacatcttgttgtgttgagatatcattatgatactccctacaagtttctcagtaaacattttgaacttgcatctagttggcaagttgcaacgtcttcttaggcatgactagtttctttactctcactcacagatgcttcaagttctgcttcaggcatgccagacaaagacagggaatatactcaaatcatggcaaggttagatgaacttgaaatggaagaaaatgatgctggtagtacttctgaagaagatggagaagatgatgaggatgacgaagatgatgaggaagatgctggaccaagtgaggatgataaggaagatgaggaagaagagaatattctaattgatgacaatgatcatcataatgctagtttgggtgcctcattttctggaagtggtggtaatgatcagagtcatgaaagtgcgcaggtacttgtttctcaaactgatgtgacatgatattgatgttatcttgatttagttagtgcgcttcattgcaattatcgcgttttaatgcttgcactaaatgactaatagctgaagagtgctctgaagaagccaggaggaagggaaatactgaaaagcgcttcttttgcaccctcagccagcacacctcactcggtttttccaggacagacttctgtaagctcttttttttttctctgtaccttctttattcctgagtgcatggcaatatggcatgcaattacagtgatatatcttccttagctattgtatcaatcactatgctttttgcatttggtgcagacaataaaccctggaattcagcttcctcttaaaaaaggttagttccgatactttcatatgacttactttgggtcacatgcttatttagattatcattgtcaaaagtatatgtttcctgtagttttttttttccatcttgtttctgtaatgttattggaggcagatgatacacattatcccagtctagaagcacctcattcccttgatgcttcatatgttacttttaagtaatataattaccctggtcatgtatgtgtaacccaaatttcctatttgcagctgtttcttttcaagatgataacaggcatacagttggtccatccaagtctcttccattgccacagggtccaaaacactcgagtccaatacttcaggtaccatttgcatgattttgacttcctagtgatgcccatgccttagattttgacatcatagtgatgcccatgctttggaatttttgtcccatagtaacaattatgataatttgatgggattactggttctcagacaatttttggttatatgcccatgccttagatcttcatatacaactgattttttaggaggaaaaagcctgctccatttgtcattaaaaaaggaaccagtttgtcaatctcagagaggttgatacaacgatccttacagttgcagaccctcaataaagtaccagttgcaagtgagaatatatctcagctagcacgtcacatgagtaaaattaaaataagacatgctagcattctaaaaacatactgctaaaattcaaaatgagatagacataaagtctaaaagccaactcccatggactcgtgtgattaggccattctactctggaggcaccagctgttgccctgttggtatgcatggttcatcttaatatcctatcatcagctggcgtgttttatacacaatcaaattgcttatttcatttggtagcattgtgtatttatgatgtgtgttaaatgtgttagctaaagtgacatggcacttgctttacatatttcttatgtcaactgaaatcaagcaccactctggatgcttgagtatgcattttgtccctaattacatgtggggtttatattattctttcagcaccactctggatgcttgagtatgcattttgtccctaattacatgtggggtttatattattctttcattgtgttggtaacgctgattcctgatctttcactcgacaggtttcttcagataaccctacatctcatgatcggaagataatgtcaagtggacaaaaggtcttttgcttttacagggatatatatgctgctatgtcgtttgaaattacgtttgaccttatcttatggctgctgcaggccttcacagggtctattattgaacatgatgataatatttcaacccttcaaccttcaaagagtgctgctttgcagaatgta

SEQ ID NO: 82706 - DNA, 2884 bp, Oryza sativa
ttcatgcccatttcgccccttgcccacaaatcctagcatgctccagcccaaaatagaactactagtactgagtaactagctgtggtaggtggctcaaccagtggtgaacccagaacagaaattacagggggtccttatgctcatctgacccatgcggtagccttctcaggtgtccaatgtaacttggttgggatatcccacatggtatagttataactgtaaaaaaataatttacatgtgtccaaggacccctgttgggccttagtaggtacgcccctgggctcaaccagcccaactacaggttattagagaagaaacaataagacattcccttggataatctgccaacactaccaaagagcgcatcagtataggctctggagcgacagtagtcacagtgtgatgccactatcatcggaaacttcactggttggtgacttggtgtcattaattgagacatgttccgccagcactcactatccttctctgcctgacacaattgggcctttttgtcatgcttgctcagattcgtctaccatcttcatcatcctcatctactcgccctttttttctcggtgctattttaaataagtctatttgaatttggattttttttctctcaattaagtccatttgaagctatgaacagtcatttttagactagtttgatagccatcaaaggatagtggttatacagtggttgcaaccttatatagtgattttttttgtcatcgataaacagataaagaattaaaaattgtgcacaacaccctaatttaatcatgtttctacctgagttatgtattgttttgacatgttctctccctaacaaaagtggcacactagacttatatgtcctttaaaagaactagttggaccaaccgaaattcaacccaacgggtgaatcagaacagtatggactaccgagaagacgcagacaacagctaaggtaggcaaaattcaagcaatgtaccttcttgccggcctctgatttccgcggccttcctctctttttcaccttctccggcgtcccatcgcccgcggccaggggagggagaccggcacctcctgcttctcctccgcctccgcccgccttgggaggtccccacgagagcttcgactgaacgcaccgccgcaaccgattcccgtccgcggaagcaggcgaaggagtcgccttcgccggggaaggggacggcgacggcgtcggcgtcggcgcctcgggatcagcagatccgcccatgggaacgagcgagaaggcgaggcggagaggaggggatcgactctagggtttgggtttttgtgaacgatggggggaagaagctcagagagagtcagagtgagcacagcgggagacgggggttggattagcttcacgtttcccgcgcggtgaggcgaaacgcgggcagatttgggcgcgccgcgcatatataccgcgcgtccgcgcgcgcgcggaggagctttggcgccgcggtcagagggcggaacgggatgctggagcctggaggccgaggagacggacactcgcgtctcgagtctctgctgacacgcggcagattatttgatactcgttttcatgtctctcttgattttgtgaagaaaactgtaatcagatttttttttgagagagagagtgcaatcagaaactattttatgtcacttccatcgtctgttgataagaaattatatatatcactagagagacagggcctattccactatttccagcttatcatgttggatcaattctgcctataaataggttgttaaaacgaaccaaccatgacagtataacaataaggcatcacgataattctgggcattttgattgtccatagcataacagagtttggatgcacaacacatagcaaggtttagtcccatgcaagcacaggttcaaaagaaatccacgaggcgatagtttagaggaagataacagctaaatatgtgaccatggagcttatcctctcaaccacgtgttcctgtaagatgagttatcccgcagtgaagcatcatgtggtttgtactccatcagatagctgtgtggcagcttcagatgcctcttaattgaatctcttaatgtcatcacagcctgcacgacagaagaaagaaagtgagtacaagtctagagttcaaacataatagctattgtagcatttgtgttgtcccaaacctggtggtcagatgcattacggttccagacacttagaatgtcctcattgaaacgaacactgagtacaacgccacaaacatcatcactataatcaagttgatcacccactagcaccaacacctgagatataagcacaataagcaaaaggagttactaaaattcaagctaccatacatgtgcaccataaagaacagtttggtgaagcattgaagagcatctacaagttaatagcagaactggacaagcctcctgagaaaagtacatattattctgaaaacttttacatgcatatggctggtctcatgcatcattagtcattggaaccttgaaagaaccatttagcagtttgaaatcattctcaaggtgacttctgcgaaggtaaagaaaactgaatgtggaacatgctagtcccagatcatggcatgaaacaagccatcagaaaaggtttgaagatgctaaaggttatacagtatctggcatagacctaaatatagttgtgtaccatactgtgatgtgacaatgattcctatgaaagtcgggccctttgattcaaaggaaatttataggaatttcagagggtttcattcctataggattttttttcctatataacctttgaataaaaggaatcaatcctacgaaattcctatggaatgcatgttcccatacaagttttggaggaaatttagggccccttggaatcgcaggaatgag

SEQ ID NO: 82707 - DNA, 1570 bp, Oryza sativa
ctgcgccccaatgctaggttattttttcaacaaggaaagttgcttattaccatctatagcatcatgagaagttgggctactgcattgcgaccaatccagaactgaagccgttcttcagcaatgtcttcctcaatgccatgagttttagctcttctccagaagtatataagccatgcctgcattcaatatatattccataaatcacacgtaataaatggatgaatttgatagttcacatcgctgaaaggtttacctgcttaaagctaacatcttctgcctcttcatggctaagatctgcaataggtcaaaaagttcaaatttaatttaaactcatagaaacaggatgaaatgtttacatacaacacaagctcaagctgttagtggaagttttgcataaatctattagacaaagggaagaaccattaccaaacgcctccaagaatttaggttcaccaggtgatttaaaatctgcataagagaagaatttatacctttcttagtttttttttatgagtgaaggcagcaccaatgaagaaatcatattacgcatgtaagttaaacaagaatgatatgaaatgataaaagaagtgcaaacctgatgtgaattgccgaactatactaggtctccggtgttgaccaagtgcaaccacaacagcatcttccacctacagaacaataactagtgaggagagaagtgataaggaagcctagaaaaaaaaacctgtatttataaagcacatatggtttgtcacttgtccaaacatgcaaatatactcagtacaaaaagaatgattacttagtgctctattacagtggaagtaaggtaaagcctggcaaatactgttcacacttccgtatttcagagaacactccataaaaaaaaactctagaggatattagaagaattactgttgtgccatttttgctgtaaatgttcgtctctgcattagaatgagtacaagtactgtgtctggaatttcatctctgagaatctatagaacagaaagttaataaaccactgccaataaaagggcagtggaataccttcaatgatgaaagctctctaagccccatttcaactgagagcatgctctctatattgccttctcccattacatcactcatatctcgcacaagtttatttctcctttgggcgtcatcctcacctgcttgaaaagatccaagaataattaactggagtacatggaacaaactacgatctacaacttgtatattataaagatgcagacatgccttgtttgagaggttcctccttagccttttgaccagcagagagaacaacctcaaggggaagaggagctaatgatgaccaatgttcatgctttgataccgcaatctcgggataaactccttcaagttattaatgggccatcacataaatcacggacagggaaaaagttaacagtacatttcaacatcatgtgcaaactacaattaagcattttcgagaccagaccagggtcacaactagttactttcaggccccctaagccctaatctaagtgacacctagccatatacatagtcaggatggagtatggactgtttg

SEQ ID NO: 82708 - DNA, 5767 bp, Oryza sativa
actagtggatcccccaaaaaatttaagtaattattaattttttccctatcatttgattcattgttaaatatattttcatgtaggcatataattttacatattttataaaagtttttgaataagacgaacggtcaaacatgtgctaaaaagtcaacggtgtcaaacatttcgaaacggagggagtatatatcaatagaaaaaaagaacaaatattctgcatgcatgccgggaaatgtatatagtggaagtggagagagaaaacaatactatacccagctcatgcatatataacataaacaccatatatatgttgctattgtatacttacttattactcaatgatcagttatttaatctcaatgtaatgcagtggaaatatattttgtgaattcgtgaaatggttcaaaaaaatattggaagccgtctaagttattttttttttgcaactaaatgttatatactaaagggtggtgctgttgtacaaaacatgtccaaaattaatttcatgatctagctcttttatgtttggatgatacaaagtttacaaacagcagaataaacgtatttagcattggtttcatactttcatttgtgggatgctactagctacatgtattttttccatggtaaatattaattaatttgtaccgctaaaaattgacctacacataaatgttgtcgtcacaaacgagttgaagccagaaacacctaaaattaagttttttttttcctttggagggagcaaatattttttttcttcaaaatttgccaaagctatatgaaaattcagccataaggcctcttcagggaactgatctaattatggtccaaattacctaccgaatctaagagatcgaattaatgaacttgcatgatgcatatggatacaaatatacagaacagcatgatggtattttggtaactatatactacatgcatgctgatatgggcctgtgacctattgcttttgtctagtaccaaatcaaagagatcccaaccttagctcaatgtggtactttcgattaggtataatgttcctttcatgatcccccctaattgccaacctatatatgcggcaactcagcacaagagaatactagctaccttgcagtgcaaattcaacaactgctcactattcactattgatcactcgatcgctgcttcttccaatcattttatgcgacaatcaacaagcaaattaaatatcatcatcattaatattttatttagagaaaattatataatcaaggtgtagtaattaattaattaatagtgaaagaaaaggaaagtatatatgcatgcttaatttgtagctgaagaaaggtgttgactaattccggattattgtacctgaagatgagattgtgtgagtcctagcttgccggccaagtacttcatcaccacttccaccttcatgttgctatccctgtgaaaaatgtgcaagtatatatattcattcattatcttaatgtgtgttttatgtaactaggacctttgaaaattccatataagacattataaatcaagagaaaaactttatttgattggtacctagctagactgacctatatagaaacttaaagactactagttagctagatatatatgccttgcagaaacaagctacacagtgatgatagctacacatgaatgagcaattttatggtccttgaggaggtatcatgaggtaccactttttttattgtaaatttggtatctattggtacctaaataccatgaggtaccaaattttacactaaatttttggtacctcatggtacctcctcaagaaccgtaaaattactcacacatgaatatatatgcaaactaaatggacatggattgttatgcatttaatttaagtttgtactttgaaattaaaggagagaattaagcatgattttttttgaagatatacataattaacttacttgattctaaggtagctctttggtatctggggcaaaatgggctctcgaaatctgcaaacatgaaaacaagattagacattattaagagctaaatggttacaaacacaagataaatttagatatataaaagctagcttgtgcagataaacaatatctacacatatatctgtattgggcttatttgcattgttgtcatgaggtgcatatactagctactttaatttgcatgtatgcatataaccaatcttatatggaatggatcaacatgttaatgatcacaagtttacatgcaatttttttttgaggaagtttacatgtaattttttttaaaataatggaaatggattacatctcttacatgtaaataaataaataaataaataaataaataaatatatatatatatatatatatgtatgtatgtatgtatatacacttactgatcaggggatgcctgaagtgtcagccacaagccggcagcatcagcagccgccgctcttcgcggcgggctgatgaccctcatcacgccggggagatcgccggagctcctcaacggccgcgcgaacgggaagaacgacggcggcggacaccggccgccgccgtggccgtactggtggtggtggtggtggtggtagctcctcaagatcggcagcgggaacagcggcggcctcccgttgtactgcttggcggcgaacacgtccagctccggcgccgtgggcgtagacgacgacggcgccgccgccgccgccggagcggtggcggtcggcgccgcggcggcgaggccgagctggagccagtccttgtcgccgtcgtcgtcgtctcctgcaccgccgccacgagagctcgtgccggcggccgcgtcgtcttcgggcggcgccatggctagctggtggtggtggtggtgacgtctacgcgccggcgcggcggcggcggcggcgtcgagctgggtggcgatgcagtattggggagtacaggacgacgacgagttgccgccgcccctcttgctgctgctgctgctgtcatggtggaacaggcggctcctagctggcaccatggcggcggcggcggcggcggcgacgacgacgacaacgacaacctgctgctgctgctgacctcgatcctgcagctagatgcacgtctcatgtctctcacgcactcatccgattacaccacgacgagctccaccatctccatccatggccgcaatcctttagtaattaacaagaactcaagaagtgcaaagaaagaaactagctagctacacgccatggatgagacagacatcctccatggctgtagctatagcttcaaaggcaggaaattaaagattggagcaaattggagagagagataatctaggagagatcgatgaaaggggttgtgagatgagatgtgatgaatccttttctctcctgtaggggagcaaactcgaaggagaagagacaaggagaagaggaggagagctagctagctgatggaggcctcactttccctttgctctcaaatgaacttggagcctagcttctcacccttatgccaagggatgcaatacaaattaatactagctagctagctactttctagttgtagagagagatgcaccagcttgaggagagataaactaattatgtgattaaattagagataagcaaagattgtgaatagctgtcatcagtgatgaattatatatatatatatatttggtttttaattaattaattaattatgtataatgtgtgattttgtgagatggaaggattaagggtggtgcagtgcatgcaggccataatattgcattaatttggttgccatttgctgtcgatcttgtggtagaatctatgtgcagtacagacgctggacaggagaactacctacgcaaacaaacgcacgtagccaatattattataggctacacgagcaggcaacattgagagagaaaacgacttgagaaagaattaaggagagagagagagagagaggagcaaggtgaagtatgttctaagttgaggtgacagaatggcaactggtgatcagctgaggctgaggtctccctgtgttgttatactgatctttctgagaagaagtaatatataattagttagtaattcttagatacatgtccaaggattctatatttagtccaaaggaaagctttttaaccaccaaaaaggttagctattttgtgctgactattccgtaagcatgttttcttcgtacatattcggttaagcttaattaattatttttttaaggtcaagagagaactttattaatgattaaatagagggttacattcttgatttaacaagtctaggcttaattaattattagttaattaatcagctcaacagtgactcaggagcaaaggctacctaactttgtatggagatgtcctagcctgtttcttttcatgttccaaattatgcgaggtttttttaagataatggaaaatgatgcgaggttttaattatattgatatagtaattgggaaagaaataaaactatagttgtataaaaggctataatcagaaggataaaaaaaaagaaacacaacaccacatatcgataacgcaagcaaacacaccatcaaaaaagcaatataatgaagacacaaacatacaacccaatgtcatctctaagacagtcggcacacccacgggctcctagacatcactaggatgaaagaaaggttgtagatgaaaagggcgatataggatccactctccctcacatagatccgtcatcatctaggaacgctgcccaactgttttaagggtggaatggtggattacacaatcgagtgatctcctaggcgatgtttcaaggaacaggaaggatgtgctgccactactatacccatttaacgattaacaatgtattttttttgcaaaaacttttaataacaaagttgttttaaaagttcatataacttatttttcaatttttaactaatacttaattaactattccctccggttctataataattgacgttttggacaagattgagatcaaacttttataactttgatcatcaataactaagaatatttagttcaaagaaactagaacaatatatatatatttgtctttcaaaattaaacactataataaaagtaaacacgtatttatttattatatatattataatagaaaaataaggtcaaaggtatgttttgtagaccgtgtcattattcaaaacgttaattaaaatgaaaccggagggagtatgtactaattcattgctctgtttttttaatactaagaggtaatggttcccaacccttactcttccatatgttttataatacacagccttagagctgttttgtgcttactcttccatatgttttattggaaaacattcagttaagcttacttaatcaattaattactagttaattaatcagctcaacagtgacacaggagcgaggcatcaggtatacctacctttctgtggaagatatatgtgttgttatgctcctattaagttaagacgctatcatgtccctgtttctgatacattgtcatttatcagagattccttaatcgcccaaaccttaaattcctgatgctaggtcagatcaacttatgatctttattactacatccgtcctacaaaaaatttacttttgtgtttctgtgtccaacgtttgatggtccgtcttatttaatttttttttaaaaaaaattagtcacacataaagtattattcatattttatcatctaataataataatagtaatagtaatcatagaaaatttttaaataagacgaagagccaaacattgtattgaaaaactgagaatgaagtctctgtgaaacggagggagta

SEQ ID NO: 82709 - DNA, 25767 bp, Oryza sativa
cgagcgagaccattcagtatctgatggaatgcatctcctgcctgagcaggctgggggaacagcatggcctgcttcatcgacgggttcgcgagaagcctctgcttcctcaggataacatctgttggtatggatgtcaggatactgtccagcttcggaacatcctcctcggcgacaaacacgccaatctcctcccaggggatagcatcagcaaaggggaggacaatgtcatctgcaatgatcaccggaatacaaccgaaaaccacagcttccaccagtctggggctccatggagcccagcccaatgggcacaagcagaacacagatctctgcatatcttcgtagtacgtgggtgggtgatcggttgagatgtcaaacagcgggttgttcttgaaattctcccaaaccgacgcgcgggcacctctgataggacatacagaaacatcagactccacatgctacgagccaatgagcagatgataggatgtattggagataagcggaaaatttaccttgcatagtatccaccctcaggatcattgctggtatcgtagaacagaccacggaaatatacaaagatagaccgaggggtgtctgggggaataagatgagcctgcattttctgtgggggtgcatatggcggaatggtgatcgagccgtccttcaagcagacatggttcttttgtccaaaggtctgaaccagggtggcacgctgaagcaatgggaggattccacgtccaattgccttttcttcctgaaacaataacagaagcaaaagatcaatacgctgaaataaccaaagagaatgtgggcacaaagtatgatagaaggtgccaatcagggtagatgattaatcatgaatatgaatctgaccttagtgtgacatttaaataggttgagagaaaatatttttttctgaaaaatatttatattctacaaagggacaaagaacatgtgcaaactgaagtgttccaattaaatcagagttgccaactaataatattaatacagtgaatctagcatcttgatgccccccattgctccccatgttctctgctgcaattagaaatgtcccagctgttgcaaacttaagtgttcagtactaaactaatgctcaaagtccagaatttgctcactaaaggaggaataaatgtgtccaacagcaaggttttgtacttgtgcatgtacctgatagtggaagcaagcgccaaagtcatgtggtgtaacaaagaaatgatcagccccctctgatctattccagtaaggccaatttgttgcaatcagctcaattgcgctgcgcatcattcttggggatttgaagggcaagggaagaccggagggagtcaggtcgcatgtagtgtacaccggtgtgtagaaccaatcagcttcctcgggattaaaagttcggacagcgcttgacaacaggaaccgatgcatgaaaatctcagcggcaaacatgtggttcaggcacctaggatccttcttcagcagcttcttgttgtacttgcttgggagatcatagacatagaccttaagcctcccaacagggtcatcttccaacacatcaccagcacttcctgcatttgtttcgccacaatattaagcaaaagctatggagtatctatagaccttgcacagaattagggaaaagaatattctaaattttagaagcatagcttgggatcaaggtatgatacctaagcaacctacagggataaagtaagtgtgttcctatgctagattaaatgaaacataattaggctaatggctatgttcttatcatattggtgcctaggaacatgatactgcatatcataaagaagatgaagaggaggaaaaatatttgaaggttcagaggacagaatggcattcaagttttttggcagcagatgtctcgaggaccacaaaatccaataagaaagaatgcctaccatcaacaggtgtatcaataccagtagatgttcaataaaacaaggtttaaactgaatccaagcattgaaccataactcaaccaaatcatttagaataatacaccaacataaacaacctccatttgcgtctgatctgaaatagatcctatatatttagggtggagaggtctgaccacaaacaaatcaaattgacaggctaaatgatttcaaaatgctttgctttaacagtttcttagatgcacaaataagcagcttgggttgagttctactaactgacaagaatgtatccatcaagatcaaaaccaagaagagaataacacaagaaaaacaaaggccccccacctgagatcctctctgtctggtggccctgccgcacctcctgggcctgagctccaaggaagaagcatacagcagcagcaagaatggcaatggccaagacccacctcctcatcttcttgatccccacaggcctcttcccagcacctgtgtctcctctcctctccaaccctctccctgtccggccttatgagctagcaggcaattgccaggaggtaattaaaggatccaaggagaagggggaaacttttctggcaattctcctaccaagaagcgtttggtgagttgagaaggtgaggggaggctttcctaggcttccttccttcttcctccaactccacatataagcaggcttcaagaacaattaggggggccatgctcttacttaaaaggaagaaagaaataaaggaaagagattaatatttgctcagagagggtaggagggctgtctactgctgattcttttgcttctttttctatgcacccccccttttcctccagctttccttgctttttcctcttacaccaatgatgagctgtagttctgtggagctcctaatagtctattgcaaatgtgttccaaaaaagaggttcggtgagaggtttacctcctcttcagatgtcaagtttctttcctttcaccaaacatggactagacctctcacttgtcttaccttaacatgtcaaactcttcacttctctctctctctctctctccttgattttttttttaacccaagaattactaccctccatctatgatctgccaaatagttaatttttttcagtttcatgtttctccggtccttttcttttggtttacttattccgcgtgacagtcaagccgtttcctccaggatatcgtggtgatttggattgttgcctcctttgcacatggtgattcattcatttcattgtcatggctcatgagacacccatgagaggggggccataatcattggcaacaaggcccccatttgcagttaataccttccatttgtttatacaatattaaaaatcttgggagggacaattcacagtactctcttacctatactttattggtggtgattgttgattgcagaggaagagattagtgccaatgctcatctcccaaaaaaaaagattagtgctaatgctgcaattacctgcttgtagggtttggtgaaggttagtactacaagtagtagagctgtttgtttgtttgttatgcttcttcttctataatttgggattaagcaaaatggggaccccaactcccaagaaagtctatgaactgaacatccccaaagacttctttaacatggtagaccccccatgtgagcatctcaaatttagaggattttttttaatttgagaaaaagaaaagggatctgaaattggatggctttgattgctgttgagcggaaagatatcaaaaacagcacaaaagcagcggatcatcggtgtgttcttgcgttactagtgcctatagctcttggttgaactgttggggagcaagtggggcgtaccgatggatggatgctcggcgagcgccgccgccgctgcgacgaagcggcgcgcgcaccctcgccggagcagggcatcgtcgccgccgcaggggaggcacgcctcggagtcggtcgccgccgccgacgaggaaaaggcggtgaaaatgtgaaatcctctgccgttggggcgtaccacgtacagtagaattacgcttcgacacggcgaaagcgtattcggtgcaggcgtattccgtattcgttttgtccgcataattatccacgttacagtagaattaaattgagcggtttttgtcgtcgaatcgaatgtgttacagcataattaaactatttttacagatattttatacatactactatacatgatacacccaacccttctcttaaaaaaaaattgatacacccgttgactttcaacgacaacaaggagcactagtatttttttacacccattgacctggagtaactgatgcggacagctgggaaaaaaaataaagacgacaacaagctactcgcaatatacaatgtagtaatataaatataaatttcagtttgagatttatcacatgtttgttgaggaaaataaaaaaggcaaagtcgtcgcatgttttgacatatatgctgagttgacacatcttgttcgtcggcgctcgcaatatacaagagcacgtagcaggggagcatgcagcagcagtttatacaagcctcaaacatgaagtttgggtgtgttatataccacatgtttacaacttctagtcttctactcctttatctttatctctcatgtgtgcgtttttttattattaaacggtatatttttttaagaaatttttttataaaaaatcgctttaaaaccacactaatctattatttatagctaatattctctctatttttaatatatgacgccgttgactttttaagatgcgtttgattattcgtcttattaaaaaaattatgtaattgtgttgacagaaaacacgaggactggaagatctgcttaactctagtggaggtccaaagctcgccttcgaatgtatgagtgtgccagttgatttgattctgtaatcaacaataaatagagacaaagaattcgtggttaaatctataaatgatagccgatcggctaggtgccgatgacatatcatttatctttaagccgatgtcatatatgaatcgatcggcggttataaatagacagtaagggactaaatctattcgatcggctgtagatattaacgatatatagtttttatattaatatatacttaaatcaagtgattgggaaatatcggtcaccatgccgagaaaatataaataacttagatcgaaatatatattaataacaggattatatatgtttatagcatagccgatcagatagatctagcatgtatcggctaatactccgatactactctatataaagatatcaaaacaagtataatataccaaacaaaagcttaatatatttaaatgcaataagatattgatataaagggcggatttaacatgtcactgaagcatatagatcgaatatggttaaatcagataagatcggctgaaacttcgatactaccctaatcggcaaccagaggacaggctagagattgatattctaagcacgacttaatagatcaaacttaactgatgcagcaataagtatgaaaagaaaaataatatctagacaatcaagccgctggatgttttataaagtgatagatatcttatataatctaggacaatgtcgctatttaacctaatcggctgtcttctattaacagatgttagccgattgtaggttagataacaatattgccaaggattatataagatatatgataactcgacgaattatatagacaagattagagtgtcataaagatggaagcactgatctcgagaacacaagtcgtcataacaagttttacctcttattgaagatcgaaaccgatgcagctcaacccgaaagcaagaactcgtcgaaacaaaactaaagcaaaaatgtggcaatgtgccaaaattgtattgaacgtgtgtgttaaaaattacatagggctcggggtctatttatacccgagaattacaagatatgtccataccggacacgaccactatctctaacaaactctaagataccataaatctttacggcagacttttgcccaaacatatttgtaaggaagttacataaaacatcttaattaatagatacaattgccttctaaggactctatccatgtgcggcaatcatcttgaagcacctcaattcaacccgatgtcatacaccaaattatactgtcggaatcggctgcatcggcttacctagtccgactcagactcagccgatactaatcgtagccgatctagacttcagccgattcttgttcttttctcggatcaatctccgccttcgactccacctcgatctaatctccttttccgatgctgatattaccaaatttggttgttaacaaattgtcatttattttattgtggcttgatttatcatcaaatattttttaagcatgatataaataattttatatttgtacaaaagttttaaataacatgaatagtcaaatgttgataaaaaaattaaatggtgttatatatattaaaaaacagaaacagtaattaattagacatatttagtgagtaagcccacagaaaagaagttctaaacttctgtccctaacacacttgagtcttgaaatgttgcgagaaatagtagagatggtaaaattattttcctgtctacaactaggtagtatccacaagaatcatatttattgtcttatgtaaaatttcttatttttttcaaatataattgattttaggctttcttccgccactgacccggcgaaaaagaaaccgtgtgttggctggttggttgattgttccgctggctgtggagcaggaacgcggagtcgccggcgtacggaatggagtagccgagtagggacgcacgcggtggatcgacctcaatcattcacattttccgccccaaacctaaacaaaaccaccgacactatgcaaaactcactaatcaatccattcagggcatgtttagttggtgaaatgaaaatttttttgatgtcacttcgaacgtttggccggatgtcggaaggggttttcgaacacgaatgaaaaaactaatttcataactcgcctgaaaaccgcgagacgtatcttttgagcctaattaatccgtcattagcacaggtgggttcctgtagcacttatggctaatcatggactaagctcaaaagattcacctcgcaatttacatgcaaactgtgcaattagtttttctttttatctatatttaatgctctatagatgtgtcaaatatttgatgtgaattttttgggaaaagttttctgggaattaaacagggcctcaatcaagcaggcaagcaaaagcagtttgaacctgcaacccactctttgggtacactatgctggcagtgttttgctacggatgtcaacacggcttctgctcctttttgcattcgcgtcacctttcattttatttccaagcagtctctggcatggcaataggatttgtttccaataatactttctccgtccacaaatataataactttataacaattaggtttatctcaaaatataacaacttatttacctatattccatttccgaacgatcacaactttccaccactaaaaatctccatctacttttttcttatcaaccaatcaaatattctttcatttaatttcacttaatttcttaatatctgtatatattaagaaggatgcaaaatattattgtctgaactatgttgacattatttggtacttactgctttactgatgcaattggatgtgctgtgcctatgaaccactaactcagtttcaaaatataactacttttgactatgatttatgtgactaacctaaaagtaattatatttagaatggaggtaggatgtaatatttccgtttctaactgctcctattttttcttttttctttttctttcaaggtatgtccggtaaaaggctcgtttcgaggccctaactgcttgcggtctggttgagaaaggcccaaattacggtccatctaggatgcctacgaggcctttgattcgatgggtggtgggccgggccactattcatacgagagacagcgagggccttggccttggccttggccttggcatgcgcatgctcctccaagtcagcccaataaagcccacagcgatgggccgttggcgacgcctagatgccatcatactgatgttggtagatcgatgacgaattgattgagagacaccaaaataaacatcacggtcacccacgcagatgccggcaccgccatgataaataggcttgttcgtttgtgctatattgcagttagctgcggcatataagaatttcggttggataggatactgctataatataaagaattgtccagagtattagaatatgtctcattcactttttcaactctcttcgtttgttagacgcacactttcaaactactaaatggtacgtttttttaaaaaaattatatacaaaagttgctttaaaaattatattaatattttttacaaagaagttaatacttaattaatcatgcactattgagttgctctattagttcccaacccaaggagccgatcacagcctaacatatgttccgaacacattcagtgattgttcgagctgttgggatacgcgtaggctacgatagcataaatcaaaattttttatcgcgtaaaccatgaaccatgcaagtattagatcatagatcgttaccactcgacgcgctgcgcagcggaagaagacgctgagaagtcgaaggaactctcgcgaagtagcgcgcgtcgatgcagaggaagtagtcgatcgcaccggctcgaccttctccccgtgcgttctcctcgccgtactcccacgctgatcaacaccgcaaaccagcagtgcctctaccggtatccacacgtacagggacggaatgccacgcgcagatgtgctagcacccgcgtgcggctagggttttgctcggggagggaagtgacggctagggtttctcacgtgatgcaatgcctccgccggtcacacccctcacgaatatataggatccatcactcgggcctccaaggcccgtaggactcctattcggatccctatccgaattaagctcatattggatctccatccaatctccttattccggcccattaagcgtgtgaccctgtagtttcatatatactcggctgtaacccgaaaactccttttcggtccacgcgtcaacaacggcccctagcagaatatattgacccaccagacatacataaatatcatatcggctgaacctctagtgtatacttgtacgaacccctttgcctcacgatatcgattaagcttaaggctagatatgtacctagaggcaatcactaacacgagctacgattgaaaagtcataaacataataaagaagcaaaagataatttatatataaaactttaatatacgtgttattagcgctttaaaagtccacactaattaaaagtagactataatgtaaaaagcaacatcaactctcaataaaatttaaaatttattcattgttgatttgttaataagtagtggacgagaagaacctaaagactctctgagttactaacgagtttgcaattagaatcgtaaagagggtcgagcttgaattgaaatgctagcgatggcgacgcttatgaaagatggtccatgtagaaaacgcagccaatcgtgcctatttttacaattaattgttgtctctatttcttctctctgtttctgtttcaaattgatgattgttcaacggtaaacatgcatgggaggactttgcatatcgtgtgaaaaaaaaaaaaaaccatcaccagcagcagcagcagaccggagcctggagagtcaaaccggcgtgagcgaatcagtgttcgacacgtcacgtgggctcacctgcaccatatcttaatcccacgatcttcggagagaaaaaagtaaataaaaaacatattatagtccacgcggcctgcaagttccggactcgcagtgggtggatggatgcattcagaggaagggaacaagacgagacagagacagcgagagcagtagtgaatagtgatgggccatggaaaaaatatcgcaaaagaacaaacgagatgaaaagtagatgagaatattgccctattcgataaaagtggtactccctccgtcgattttgagtttttgtttacattgtttgattactcgtcttattcagaattttttgaaattattattatttttttggcttactttattatccaaagtattttaagcacatttttcgttttttatatttgtacaaattttttttgaataagacgagtggtcaaacagtgaaagtaaaaactcaaaatcccttatattatgggacggagggagtatgtttttaaaccgctaaacgatgcatttcgtgcgaaaactttctatatgagattaatccatttcttaagtttgtaataattaaaattcaatttatcatatgttattactatctcgttttacgtaaaatacttaatattttatctttatctttgttacattcaaacactactatgtgtaacagatctgataacgatcgttattacaacaaagtatagattttcaagtcctaaattcaattctaaaagttggattaaaagtagagttgtgaagctgtctaaacttttttttaaaaaagttggaactatttggttagatttcagctttagaaatttaagttgtgcaaaataggttctatatttcactgtaaatatgttttccagaaaatgtcttctactatattgcgtaaaccactagttacctaacatatttttttagataatagttacctaacatatgtataagaacattcgttcaaaaaaaatgtataagaacataggatgatgagacacatcataatgctactaatctgaacaacctgtttaaattcataatattaggatacgtgtcttatccgattttaagtttttatactttataatagagggagtacaaattatttcttctaacctaaaatatagctacaaagtatagacatggcaaaaaacaaggagtttccgctgtcgttgaggcctcgtcaagtgctttcgctccgtctaaattataacactaagtatgtccagattcttactatagctaggtatattttgaacaataaaagtactattattgtttgtcaagttcgtttattaatccgatgtcaaactcaaaccacgaccgtatatgcatgctgcgaatggatccaatagtctccccacgccgcttactttctggggagcttccctgacttcctacacctctgtattggaactattacgaccacatgctctcttcctactctcctccttagaccatacggacttaatctctctcgccctaatcatcatcgtcttcctcctcttggatcttctcctctgccatggcgggcaacagaggaggcgatgccggggaaggggagtggctcaaggtcgccgagctcagggccacggtggaagcccaggacccccatgccaaggtacgcgacgagatgcatctcatccaattccaaccaaaacttactccatccgcaactgcatgaacgaattgaatttactcattctttcgttctttcttcctgcttcgtcattctccgttttgttctgcttactgttcttcctgttctctgttccagtcaattattgtttagacgaactcagtgtgttttgattacgcagcagagctgaataaaccaagctgttttgactgtccagccatataattgtgttggattgacgaaacgaacagtcatgcttaatttgtgcgaaaccaaagagaatttttgcgtaagaatctttgctatggacgagcatttagttctctcgaatcacacgcttttttctagcttccactcctcagcaacagaaagaatgagtgtcggattagcaaagccatgacgggaaagcagggcaaccaatcaggctgtcgctatttgtagagaaatatcgaattaattagagtattactacatcagatttggctggcagttgatccaacagatcgtaccagtagtaattaagcgatgtgatgagtaattagtgccttagtggatcattggccaactgtacagatcaccggatcgagtctggaagtacagggtgtatggggtcgccagctgaatgaaccacgtgaagaagaatgatgcttaaggagtaattttgaaggctaatggaatatgctcccgtggacgcacacgccagccattacatggagctggacctacgtttcaggggcaattatattctctccatcatcgtctggccagaatagcggaatagattacaaacattattataaagataaaaatatactttatttgtcttataaaaaccaatttagtactagatcctatattagttttttataagacggatggagtattcaaaacattcttttaagaatattatatacagaaagttttttttccttgaaaattcaccactgaaaatgcgtcgaattcattcattatttcatttctcaaaacagaaaaaagagcatgccaaataataaacgtgctactaatactatgaaagtatgcactccttcgtccaaaaaaaaaaaatcaacttgtagtgtttaaattttgtcccatagaaactaaattctaccatcctacgtaccatagcaagtaaaatgagaaattttatctctttaatatcatttagctacataccattcttattgccttttccaataattaagggtattttagtcattcttcatctccactaaatctagtttgggatgatatgaatgaattttctatgggaggggggaagtagtaactaacaacattgttcgacgatcgatcggacaggatttgtgaatacacgatgctgcagaactgaagcgttcctgattctttgcgcatgcaggaagtggacaacctgacgctgaggaggttcctgcgggcgcgagaccacaacgtggagaaggcgtcggcgatgctgctcaaggcgctccggtggaggagggaggcggtgcccggcggctcggtgccagaggagaaggtgcaaagcgacctcgacgacgacaaggtctacatgggcggcgccgatcggaccggccgccccatcctcctcgccttccccgccaagcacttctccgccaaacgcgacatgcctaagttcaagagtacgtctccgttggattcatattctcctaccataatgacactaccattacaatcactgacgtgtgggggaatagaaggttggaacccatataccggtaactgtaatgatagtgattgatattatggtagagaatcctcgcccatctctactagctatagagtttatatactaattcctcatttctaaaatatactaccttcatctcataataagttaatttagtatgtgatgtgatataaccaaatactacagatttgaataaaattaagatatatcatattctatactaaattaacttattctgaaatgaagataataagtgacagaaccagtagttatacgtgggaggtcataagagtcttggaggaggcctaatacacattacttagattaattatttaattaattaggtggttatgtgtgaaaaaagttattggagggggcatgccactggccacctccttgtctccgtcattggaaaacatgaaaaaaaatacttatattttagaaatatagtactccttccgtttcgaaatgtttgacaccgttgactttttagcacatgtttgaccgttcgtcttatttaaaaacttttgtgaaatatgtaaaattatatacctacataaaaatatatttaacaatgaatcaaatgataggaaaagaattaataattactcattttttttaataaaacaaacggtcaaacggcgtcaaacattttgaaacggaggaagtattaatcttatgtacacatagcctgacttatcgagtatgcatccatcttaactatttcgtcttctgcaccgcaggttattgtgtctacttacttgacagcatctgtgcaaggtaatcacaatggaaaatgctctgatcgatcgagttttgttgatttactgcttgaattaattactgatgaagaacagctaatgcacaagactgacattaagagtagttactgaacgctgatgatgcatatgggtaaattcaatttgcaggatccccagaggccaggagaagttcgtctgcatcgtggatctcaagggctggggttactccaactgcgacatcagagcttacatcgcggccatagagatcatgcaggtaatatgaaagatcattcttcagttaattcagctaattaaacattactgaacaattaacaagcattcttacagattgatgatgattagttacatatttttcgttgcgtttgattaattccccctcgcagaattactacccggagaggctcggcaaggccctgatgatccatgtaccctacatgttcatgaaggcctggaagatgatctaccctttcatcgacaatgtcaccagggacaaggtaatgaaatcgatcaaagaacttgaaatcaagtgccaaacaagctctcgcacattagcactacgttttaatttcgttcttacaattctctccttgattaattttggttcaattttctgtctgaaaaaaaaatgcagttcgtgttcgtggacgacaagagcttgcaagaggtgctgcaccaggagatcgacgatagccagatcccggatacgttgggcgggaagctggcaccggtttccctcaagaacaacgcgcgaattaaccttgattagtagcgaggctcaattagcacgcagttataccgataatcaagcacaagattatacacacacgtatactatacatggatcgatgggatgaacaaaagatatgtgtaattgtgaaaaatgcagctctcatatcacagctggtctcactgtttgtagcattgccatcgtcatttatctcagtaacaaaagcttctgatcagtaattacatgtactactgtcactatgacaagtaaagactccaatactccatatcgaaaaaatatgaaaaagggagccacgtggctaagaagtataaatttataataaagtatgcaccattccttctaatgctatttgtttaatctaacatctctcgatcgctaacaagtactccttcgcaaataacaactgaacttgcaatgaattgttgtaagctcgcattttaaatttttgaaatattaaaaactaatcaacgtcgatggccgtcctagctcagtggtagagcgcgtggcttttaaccacgtggtcgtgggttcgatccccacggacggcgttttttttttctctcatgtgctccctcccctcccttttagttctcacgtactcccaccccacgtaaaaaaaaaaactcaaatctaaatattcaaaacaggatttcccttttagttctcacatactccctccccacgtaaaaaaaaacttaaatctaaatattcaaaactggatttgaatctaaaattccaaaaattcttccattgcaacaaatcacttatattatagatcaaatgttgcagtgaattgaaacatcatgtcgctatttgctgaaacattgtattaatatatggtgaaacagtttgaaaaatcgttgttttataagttgtagcaaaatattttatgagatgatttggttgtgtttcagctttttaaatgattgaaacattttctatctacttagtgaaacaattctgatctacttggtgaaacaaggcccgatttttgcaaaaaaaaaggcaaaaatgggcgcccgatttgtaggcgcctcgctaaaattcagaacacaacaatttagatcatctctagaatttgaatcttccaaatctaaaagtttaaaaaaggatttgaatctaaaatttagaacacatgtgtttagattcatctctagaatttgaatctgttgatgtaaaaacacgaggcataagagatctgcttaactccagtgcaggtccaaaaagcttaccttccggttcgtgagcgtacaagttgatttgatcctgcaatcaacgagaaataaagataaaaaaccgcggttaaatccataaacgatagccgatcggctagttgccgatgacatatcatttatctttgagccgatatcatatgtagatcaatcagcgatcatgaataaataagaaagaactaaatctactcgatcggctatagatattaacaatatataatccttatgtcgatatatacttaaatcaagcgattgggatacatcggtcaccatgccgagacaatataaatcacttggatcgaaatatatataaacaacaaaactatatatattaatagcatagccgatcagatagatctagtatgtatcggctaatactccgataccactatatattaagatatcaaagcaagtaaaatatacaaaacaaaagcctaatatacttaaatgcagcaagattttaacataaagggcagatttaacatgccaatcagacatatagggtatgaagtagttaaatcaggtaagatcggctgaaaccccgatgctaccctaattggcaactaaaagcaggctatagatagagattctaatcacgactcataagatcaaactcaactaatgcaactataagtatgaaaagaaggacaatatctagacaatcaagccgttggatgtttcatagagtggtagatatcatatataatctaagtcaacgtcagtatttaacctaatcggctgccttctagcaacagacgttagccgattgaaggttagatagcgatattgtcaaagattatataagatatgtgatatctcgacgaattacatgaacaagactagagtatcataaagatggaagcactaatacagagaatgcaagccgccataacaagttttacctctagttgaagatcaaaaccgatgcagctcaactcgaaagcaagaactcatcgaaacaaaacgaaagtaaagggtggcgatgcaccgagattgtattgaacgtgtgttctattaattacatggggctcagggtctatttatacccgagtttaaaaaatatgtccatgtcggacacgactcttatctctaacaaactctaagatgctacaagtctttgcggcagactcttgcccaaacatatctataaggaaattacataaaatatactaattaatagatacaattgccttctcaggactctatccatacgtggcaatcctcatgaagcacatcaacccaatccgacaacgtatgtcgtgtcatattgtcggattcggctcaatcggctgaccttgtccaactcggactctgccgatcctggtcgcagccgattcggactttagttgatccttgctctgtttccggaacgattccatcttgaattccactccgatcctatcttcatctccgatactcagattatcaaatttggttgttaacagaatctttcaaatctaaaaattcagaacatgatttgaatctaaatttcagaacgcatgtggttaggctcatccctatgattcaaatctatttaggacagaggtttaacttttgcttgcctttaatgaaacccatttctcctgaagaaaaaaacaaattccattttacgcccccgactttttgaaaggaacggttatcacatatttacgttttgcttcctttaataaaacctatgttcctaaacaaatgaaaaatatcattttacgccccaactttttcaatggaatgcttagtgtaatttctcggtttattttacaccgtaaactattaaaaacgattcaccttactattatcacttatgtcttaatgtttcttgaaattatggttgtttatataggttggaaacactcagatgaatttaaacatagatgttttaaattttaagtaaatagttatgattcttttaaatatgttagaacttttatagtggtgccatctataactctataaaattttagtttgaaatacgactagtatatagacaaacaaagaatagaaatgctaatgctagtaaagtgaattatttttaatagttcaaggtaaaatgagaaaaaaaaagtttaggggttaagtgatacatacgagcattcaggtgcacatactaactaactaataccttcaaaatatattttaaccatatttttctataattttcgctgatatttgttagttggtgtgtacacagtaaggcatggtctaattctaaaagaaaatcatcgtaatattatactacaacctttctaattgctgggaggtatcaacaattgtctagttctaggtcaaggacatgcaaaaagccaaatatatgtacgtagttgatggtagtttggtggaaatataacattctgtaactgtatatactacatagttaatcggaatttggtggaaatttaacattttgtaaatatatgtgcatagtagtttttttaggtaaatgtatacagctacatatattgaatacgtttctactatgcttaaataagaacaaccacaccatcatataatgcgtagtttgcatgaaaatagtgataggttctgttcacagtggattgggtcttttgtggctgggcctttgtcatcacaccgattatacggcaaggtagatggaaacatccatttttttcgaacacacataaatcttgcatgccaatatattagaagaaaagtagcatatatcagtaacacacctagacggttagaggggataggagggtacaatatgacattgaagagcatgctaaacttaatgtgactcgtgtgaggaaggtgagagaaacaaaactaagggtctgtttggttcacagcccaaaccagtcatcaagttgtggcgtcgccagagattgtggcgagagaaataatcgccacagctgtggcggaaataagcatgcaaatgaactagcaaaaagtgtggctgccacaactcacgtattaaccaaacatcagccaaactgttgtggcagccgcatgtttggcgaggcaatgtgtggcggggatccaaacaccccctaagtaaactaagctatgtgactaacagccttgtctcaacccattgccgcccttcttgcacaatctgctccaccaccgtcggcacccgtgacagaacacgggccaaagataggttattcttttctttccacaagtgctaggcgaccatgcttcaaatgactaataaactgctaatgataggattcatgtgttcgtgactaagtaatgaagaccatattggcgtaatgcgacatatgcttgccgtataggatttaacttattttgagatggaggatgaccattttctacaatactggtgttaggtacacttgtcttctcaccctcagcattcaagtctgctaatgagcaaggctagagacactcgcattcaagtttgcttaagagcaaggctagagacaacaacagtggtgtttgtttatgaggtcagcacgtaaagcgagaaaaatattagcgtatgattaattaagttgtagttattataaacatgaaaaatgatttttttttgatattttaaagtaatttctacatagaaaaatttcgtacggaacacacaggaattaaaatcgaggaaaaatctatatcttaatagaaaaagaatgggccaaagtgtgttcactggggattcaaaaggaaggataaggctgagttcgctaggaagttaggattatgattttccacatcaagcaaaacgatacaggtaattaatatatgattaattgaatagtaattattataaacttataaattaggtttatttgtttttatataaataaacatctatatttttttttaaaaaaacgcgtctgttaacagttttaaaaaacgtgcccagagtaaacgggagagctgcaaaagccaaactctctactgaacccaacctaaagcattaatgtttctctccttttgcacctcctgacctagggtgtgttcggaacttctagttcccaacccctttccctcattttccacgcacacgcttttcaaactgctaaacggtgtatttttgcaaaaagtttatatacaaaagttgctttaaaaaatcaaattaatccatttattaaaaaattagctaatacttaatcaatcatgtgctaatggacagctctatttttcgtgcgggaagatgggtttccaacccccaagtaccgaacacagccctagtgacctagagtagctatgaggaatgggtatgcgtttttcctattatacccttaccagtcaaaccacgtaaatctaaatcatgctttacctataaatgcgagttttgttgcaatgcctattactgtcgtattttttagacattgatttagtaataacagatgcaaagttaaatatgagtagtttagatgatactagcatgattcaagtttctattaaagatgcacatcttcagtccctgacccagcggtgcagctgaacactttaggttgaattttcccctctaggtaaaacatctggttcaaaattcaaattcaaaacaaccaacaacaagcagctctatctttccaagaatcaaacactatgcaaaaaggaaaggtgagtcctgtctacctatggaatagccccatgattcatgaacaacgaagggaaacaaaaaatctcaaatcgaagattgccctccgtcctgaccactgcgaactggcgcgctgatttgacttccggtttgaaataccaccacaccaatcggacggcgcagccgacgcctgcaattcgaatgacgagctcccagccgtccgatctcctgacggcgtgaatcccacccaaaattcaaactggtggcagtgcccgtaaattgatgcgaacttccgggggtagcgtggtaattaacctcagctcgcaaaaggcgaggaggcgcagcgcagccatctcgcgtgctattttgctctgctcgctcgctcgctcgtctccacaccttctcctcctcctcccacactgctgcgcggccgccgccgccgccgccgccttccgcatcgtcgccgtcggtgaggttctggatcctgcgccgttcgtactccctgccatgttttggttgtcgcttttgttggggttgatttggtgtgaagactgcagagttgggggtagagtggggttttgttcatctggcgcgcgagtttttgggaaggtttttggtgggttttttttttgttgtttttgttgcttttggtgttggcgtcgattgggtgaagagttggtgtcccccaaaaaaaggggcgaaaaattggtggtggaatggggttttgttcatctggcgtgcgagcctttgttttggggtttttggtggggttttgtgttgattgttcccccatttctcgcggattgttgcgtgtgattttgtttagagcaatttgttagcgatggcgtgtggaatccgaacgagcgaggtgagagcagagtggctgatgcagcttggtttgtcgtgtttgggtagattttgcggagctccagtggatggaggtgatggattcggtggccgtgatggaggtctcgccggtgccgaagccgccactggaggcggcgcttgcgctgcgccgcagcgttcggtgcttgaacaggacgcgccgtcccacttacgtggagcaggaggagcccaaggagagtgctggccggcggcgcggcggcaagaggaagcgggaagaggagaagaaggagccggtggcgcagcacgccatgaagccggtcaggatgggcgatgcagcctcggagaggaagccctcctcggaggggaagccgatgcccgcaattgcggcggagccggtttcttgtgccgggttcgcacgacctgctgccgaggatgatgtccttggcaacgggaagagtgcgaaactgcgggtgaaggaaaccttgagggcattcaccagccattaccttcaccttgtccaggttatcttttgcacctgaatgttcagctccattttaatcgttttaattttagaaccagtttggaaagcacagaagaatcacattatttttcagtaggctagcagaatactcatgcgttgcaactggaattaaacaagaaacccaccgaacaatataaagcctagtaaaataaaattatttctattgtaaaatcttcaggtcgtatctgtaaccattttgtaccccactttgaaataaatttaccttgttagatggtttagggtgcccatctacctcatggcattggtgattggtgtggcggattcaccactccctaccactattgagatcctttaaaagagtagtatatttgccatcattttctgccttacgttaaaataaattttccttgttcgatggtttgggatatctatctacctcagcattttggagaaccacatggtagctgtggttggtggtggcatattcaccacctccaccaccattgagatcctttaaagagtactacacagatataggaactattcagatatcattgcatctggtgaaaaaaattattgcaggaacgtatgttatctgacaatgcacttgtggaatttcaggaggagcagaaaagagcacaagcggtgttacaggaaggccagaagcgtccatcaaagcggcctgacttgaaagccattacaaaggtgctgtgttgctctttgcgttttgaattttgggtgatatttgccatacacagatatccccaaaaatgcctctcttccatacggtgttttagagaaaacacatacctgttttgcttgggttacacttacaactattgttataattctagatgcaagaaagcaatgccgtgctttatccagagaagataataggggaactacctggttagtatattctcttttcctaacaagggaaccttgtggtgtagtgattcgaactagagatacctggtctattctcattttatgtttgccccatatgtatgtatcctaaagcaaggattttcaatataatgtcgttcttcttccttgccaggtgttgatgttggggatcaattttattctcgtgccgagatggttgttttgggcattcatagtcattggctgaatggcattgattatatgggaatgaaatatcagggaaaggtaaatactgtacatttccatatcaactaaaataaatcatgttgtacaatattttgttcatctgataatggaactacaacttacactagtatacttagttgtatcgttgtagcttgttattcagacatggcatcattggttcaagaaggccctaaacactggatggttagcagttctagagcctagcgcctaggagtgcctagacaccgcatagaaccaacttgactaggggcttcctagcaatcagcaagcatatgacagaaaaagaagacaattgaacataaatataatagcactagagttcccacggtagggcaagcccctaatgccaaattgcggtggttatccagcaccaagcgctgacttttagaacacacatagcattctcttttagctttctctcaggtttatagttctttgttgctgcatttggttttaattactttcttagacctcctttggaacatagtacttagatttctgcagaaattagttcaattcctataaaaacaaaatgatagcaaattcaaagttccaaaataaaaataaaaactgcttacagataaatgttactgtttctttgggtttttctgctgaactaattaatttagcaattctcctttaaacaggaggagtatgcaaacctaactttcccactggcaacttgtattgtcatgtcgggaatatatgaagatgatcttgataaggcagatgaaattatttatactggtcaaggaggaaatgatttactcggtaatcatcgccaaattggctctcaacaactgcaacgtggaaatttggcattgaaggttagttatggtggttttcttttactactgtatgataattatttatgttgtttgaagggtatccatttatttcagtgatgatatatccttttttaaaaattatagccaattaattgtccactatacgaataccaactatttaagatgtaaatttcagatttgcatagtttccatgagctgtcattgtggataatctattccttttcagaagatataggatttatatgcatagacggtgcttgttttcagaatgctttttttttgtgctggattataatacattccgattgtggcttgtttgacgtatttttgcttgcatctttgagtaaaggcattctattaaatatgtttcaatttgttcgtatctttcagtttgcaaaatgttgttccttagtatttatgccaatggcattatttttcttctgaactttgtttcattttgaccctttctctgttttggtaatattgcagaacagtaaggataatggcaatcccataagagttatccgaggacatatatcaaagaatagctacactgggaaggtctacacctatgatgggctgtacaaggtagtatcttttcttaatctcttcagatatcatgttacttttttcgataatggaagctttattaaaactcagttaaatacaccaagatgatacatttcaactgagcccactaccagcctctgcataggatgcacacagccagacacaaagaaagacctatctagacccccttcatgaaacaaagatattagtggctatcaatccgtagactagatcgtgcctcggtaaaaacctcccgtgccacctggtccaaatgtcgcgataccaccgcaatagtatcccgaagactggtttgtggatgatagcctagtcgaagccccgggtgactaaagtaatatcatgttactagctaaaggcctgtgcattgcaatggatattataagagataaaagcaaaagcaaaaaaaaacatgtttatagcattgttagttgattaggcatataatgtcatctctaaaggcagccatactgaaatatactgctagatcacctcttttcatcctcttcatctatttctacaagccatatggttggataatacaagataggacgcttatagttcatcagtgagtggcaagtaatttgaaggttttgtttgtaaccccttacaatttctagattagcaattccagggccattcatgtgttgtgaggaccttatgcttatagccccacatgtcagtttgtggtgttggaggcagacttggacaccaccagtagcatcatttaaaggagtatagatgttctagataagttcatacaaatgtgttgctgactgttgcatgcttggatatctgccaaactacctgtctaaacagttgcttgccttttattatgcctgacggtgtcccatttgttaatacagagatagaaatgaatttcctgaaacacactatttacactgcctccggtgattatttcttcaaccctgtattgcaaatatgctaaagaatacattcaattaactaaatccttatccaaagatagtctattggggacacaataaaaatagttttgccaatacctcttcttttccatttcttcatccctgacgttcatattttccaatgttccataggttgtagatgactgggtgcagaatggagtacaagggcacgttgttttcaaatataaattaaagcggcttgagggacagccatcactgacaacttctgaggtatgcttgagcttggttaaagctatttttttttgagtaaatttcacaaaactacatatattttgatcaaattatcacaaaactacagatttaaagtgatgtatcacaaaactacagatttagcactaaatttatcgcaaaactacagatttaaggtggagtatcgcaaaactacaaatttaataacaaaattatcacaaaactacaaatccttagcactagtgttatgtttgagttataaacgtgtaggttttgtgattaaattatcactaaacctgtagttttgtgataattttattactaaatctgtagttttacgatattctaccttaaatttgta

SEQ ID NO: 82710 - DNA, 27204 bp, Oryza sativa
tgtttttttttcacggtgatatcaaatgtttctctttgttattcaatgtttctgattgctaggagtacaagattagggggctattttaataactatgtttggttctgtcgaagggtatacctaacaatggtatttgtaaaaatatgtggatctttggtactaagatatataagaatgtggtaaaaaagatgggagatatagacttttatatagatttgtgccctactcttgttagcggaagctagtgttactattatatatcaatatctcatgattacaatattaagggcgacataatctaatctctatcagcttagcggcgtaaagctctcacatttgctggacggctagcttagtccacttcctcgaataggaactcaatgatattggatgtagctctagatctctctggtcggcttgtggctttctattgggtttgtctagacttgccttggtgtatgttggtgtatctttgcttgtgtttgtttgtattgacacgtttcctctcctccgagagtcttgtatttatactctcagggtgcccacctgtccaagtaaaaataatgaagtaaggctatgttctttaacacctcttcccaacttctactctttcgttttttgtgtgcacgcttccccaaccactaaatggtgcattttttaaaaaatctatatgaaagttgatttaaaaatcatattaatacatttttcaagtttattttagctaatgctctattaatcatacgctaatgaatcactctattttacatgcggggaggtgaagttcccaaccttcaccttcgaacataacctaagtatagatacgattcaaatagaacttgtaatatttgagtaggactctatttctatttttttaatatgaaggaccttccaatcttccatgtatgatagtatgaggctttattccgtatatgacttgatatatggtgaataccgccgagtctaatacacaagtatgaggtctcacgtatccaggacacagatagtttctattctaatttcttcttatataaataaaaaaatagccttaatggaatgcaatttttaattgtggataatggattaccacgcacacattttcaacatcctaaatggcaaagaaaaacttactttattatttgtaaaataactttttacaacatttttcaacaatctaattatcatttcattcctttataacctcaagtaattgtcacaaacttatccatgagcacattcatacagccactatatattccctgtgatactgtgtttttctctcaactttcccaacctctcatctctcatttttcgtgtacatgcttcctaaactactaaaagatatatttttcacaaaataaattctataaaaaattactttaaaaattatattaattcatttttaaaggttttatagctaatacttaattaattatgcattaatcatttggttttgcgtcagaaggatacgtgttgccctctagaccaaacaactgtaccggaagcatttccacacgcccccattactcgtcggaacttttgaccggcgctgaagaaaacatatcccgcaatcaatgatcataatcagcccctaaccccttcccttcctcccttctccctttcccctcccctgaacggcttgtacggaggaccggacagctgggcagccagacgcgcagggacgcggtcgacgactcgtcatcacaacacactccgcccgcgtccgcgaggacgcgcagggccgcacgggggcgcgcgcatccaagccgtgtactcctggtgtgtacgtgccggagcgagtacgcgaccgcccaatggaattcgcggccgctttgaagaagcttgatgcttcgcgctggcccgccccgtccccgtggttggttggtttggtttggttacttgctactactcctactacgactactattccctccctggtttgctcggacgaacgagtcgtggactcgcgggttgggtctgcgcgtctgaccgcgtggcgttgctcacacaggcgagcgaaagcgagagacacaggcgggtgggggggcgacagagagggagagggagagggagagggagagagagacgccgccggtttcttccgcctgctcccgctcgttcttcctcggggtgggtgggtgagccggtccacgaggcggcgtcggcgacggcggggcaacactgccgcagcacaggggtcaggagacggggccggcgttggcggaggagaagattgggcacaacgagactatagagcaagcgacgcctccttttctttttttctccgatccatcaggtgaactaggccatgcgtctgaacttgtctcccttcccccctcttcctccggctgcttcatcggctccttaccttgttggtgacctagaaccgcgtgtagattggcaagattattttttgttttttgtaattttttttgcatgtgttttctcgtgattttaggggaagcttctcccatctcgttgactattgagaacggatattcgaatggagtgagggttttgtatggctaatcgtgagctgagctgggtgatctggtcttcgtgacagttctgagcacgaactggggaactggcttcgcattgaggttccaagaaggtcaccggatttggcgcatgggggtctccgccagctgcttgtggggtggctccgagtcgagggggaaccaaaatggttctgctgcggtgacgtctcctcgttcaggtatagtatttcactcacttggttccagagatcatgagctagctaatactgtcagaattttaatgctgcttgcatttcaaggtctgcatttgcatttaggaaaaaccagtgttgttttacatgaaaatggcgattaaattactacctatcctcttctgccatgtacacatgttgctccaggatatatatggttatggatgtgtcgaacaatcattctttggagagtctactgagaggattttctttttctttatgttattgaagcattcaaagggatgaaatgatgagaaattcatgttttttttaataataggaggaacgtctgaatattttctgtcttttcatacataggaaagtgttgttggcaagtttctctttttaagacaaaagcaaggctcaacacaccaaaactcacacaatatatgcttcatgagtataatcatcactcaagataacacatccgaaaaaaagttcttgatgttcttatgtcttcctttaagcagtgccatctgcaaggaagttttgagcgagctacttcctgcattagggcttaggggtcctgttggaaactatactgtgtaaaaaaaaataggaaacaccatgtaaaacggtatgcattataattaatcatgcatatatgaggatattggtcttaaccttagagcagtcaaccttaatggccactatcatgttttagtgaactaatacatgtacttctttttattacttctctttcctatttttctaaacaaacattgatgatatcacctctggaagaaatgcaggtcaagtaatatcaagagctggaagtaatgtacgagtcttctccctaaaggagttgaagcttgccactcgaaactttcacatgatgaactgcgttggccgtgggggttttggagcagtgtacaaggtgagaaatggactcactttgtgcatcatattttcctggcttcttactttatggccttttattttatcatcacttgctagttttactgtaagaattctctcttgatattttgtaataatacgttttataagtctgcaagtatataatgaataacaactaacaagagtctccttcacttagggaaacctgaaagatggcactcaaattgcaattaaaaagctgtcagctgaatcaaagcaaggggcaaatgagttcttgacagagataaatgtcatatccaatgtcaggcaccccaaccttgtaaagctaattggttgctgtgttgaagggactaacagactactagtgtatgaatatgcagagaacaatagcttggcacatgctttacttggtaagttcattaaatcaatactgacatattgatcaagtaaagtccagccattgtgttaaatttacctttgtgatcaggaccaaggagtaggtgtattccgttaaactggcaaaaaagagcagctatttgtatcggaactgcttctggccttgcatttcttcatgaggaagcacagccacgcattgttcatcgtgatatcaaggccagcaacattttacttgataagaaactacttcctaaaattggagattttggactggccaagctttttcctgacaccattactcacattagcacacgtgttgcaggaacaatgtaagtacatgtaaatcttttgattatttacctgctcttgtaatggatctatgcacattacgtgtagattttttccagaataatcagctcagtgtatgaatttttccaggcagttttgtcagcttactattgttgcctctatttctagtgacccaagttgacctgtcattgtcaaatcacttaaattgcatcttgcttagtctgtgataggatcattttacttatcgtttgggatgttatttctcctgcaggggttacttagcaccagagtatgccttgttgggacagttaaccaagaaagcagatatatatagttttggggtccttgtccttgaagtgataagtggtgaaagcagtagcaaatcgacttgggggcaagatatgaatgtccttgtggaatgggtaacacacttttctctcctcaccagagcactagtttgcagcaattttaatgcccacatcaactcttgatagcagtagtattattcattgattcatgacagtgtaccagcttttccttatgacatacatctacatggtcttgttcatctggaaaaaaaataattaaagctttgatgtggtttaaaatttaaatggcagacatggaagcttcgagaacaaggaaggcttttggaaattgttgatccagaactggaagaatacccagaggaggaaatgcttcgtttcatcaaggtggcactcgtgtgcacccaggccacgtcccagcagaggccatccatgaaacaggtggtggatatgctatctaacccaacagaaatcagtctggagaacttagtcgcaccaggtgtgctgaaagaaccccgccatcattcaagtagttcgggtttgacaccggacacaacctcaaacagaagcaccaaagccaatccagctgattcctacagcacacagaccagagacatgaatagctatcagttgagcacgattgaggtgtcgcctaggtgatacggcacactgcgcgctttcttgccagattcagaggggctcccacattgtcagattttgctgcgctgacagagttttacttggaaatgagaaagtgaataggatatgcttaaagccctgatccatatgcatccggattgaggaaatacacaggataggatgggcattgctgtgggttgctgttgtacacttgtacagaacttgtagttatacttttagggatgcattgcaagagtagtgatgtcttcagacacccaaaagaacttcaccattcgaagacgtggtgaagaacagggtgaagagttgtcacgtgatgatcatagttttaaggcttatttggataggcatggattaggtttaatccttccattttgatgcagaattggttcattatctctgcttatctaaaggacttaaacctaaaccccacctatcgagacaggcctttgatgacattaccttctttttaccgcttattggcccaatttttcttacatcgtagctagtgcaaaaacatgtgatttgagacaaatagttggtttctggaaatcctttgtacactgattttttgttcttttgggatattctcatatatgaagtgaccgtctggactctggactgtatccatttgtgataatattatagtgttgttgtattgaattttcaacagcaattattggattcctgatttcgtgcaatcaaactcagcggggaatgtgcgtgtcattaaatatcaagactattgagcttacacaatcttggtcataaggtgtgaattaccatcacaccccttgcttcttgggatctaaaatgttgataattctgccatgaggatgttttgtgagtgtagcataagcgatgcccattcgcttttgggtttcttttgttttctccaacttgctttctgctgtatatatactctgtagctgcaggggattatcatataatgttggtcactgctattgtttctctgctgtctttcttttttctgtaagggttttcatgctaaatgtataatctttggttttgtgccgggtttaaacctatctttatctaaagacgtctaaaatattcaaaatagtctctcttttttttttgaagtcattcaaaatagtctttgttttgatgtgtatcttaatcagcacatttagtgaatggttatcaaatgattcaaagtatagatcgcacataactccacatgaatcgactgcgactgtgtttctgtacagtgcatattatagttattatagttatataatataatgaatctgcaaattaactgaagatgatagggagaagaacttgcacaaccgtgcaccaaagaggatgacaatacccctgttaagcccttgcttgatttagccagagagcgcactatacatgcctccaccaaacaaaacaatctaaaagcatatacctttctaatgaacacagctaataatagctcacgaccataacctccagtttattcgattcacatgacaacataggcttattgcttctctcaactcactgatgatacctttcctgctaaacatgcagcgagaagaaccatgaacaagaactaacaaaatcaactctcttgagagagactctattccttgtctacgaaagctgattcagcaagatcgatggctcgagccagagcggctgccttgttctcgcattcacgttgctcgtcgtctgggctgctatcagcgacaatgccagcaccagcctgaaggtgagcgacccactcccggcgcctctcggtgtctttgtatgagtacatcgtgttgtggcttggcgctgttgagaacacaatggtgcggagtgcaagagcgataagcatgtctccgtcaaatgatatccctccaaggccgccactgtatggtcctcgtcttgtgacctctagctcgtctatcagctccatggctttcacctggttatgtcagacggaattttgttaaacaacggtttgttccagaaaggaatatgaagtcctgatgggtaaatgagatgtatttgttactgtacgcaaaaaggatatgagcaatgtgatcgaagtcaacagagcaaaaaaagaaaaaaaaaggaaaaagttctagcataattctatgcagtagaagacttcaaatagactaccaagaggctacactgtcccaaccatatggcttgtattgcaaaaatgcaaatatgtcaaacaatctctactgacatgagtgtggaaccaaaatgatctacacaaagaataaatttggcaaacatgcttaaaaaaaagacggaatggaggttggacagcacatcactagatccaaataaggagattgtaggcaacatacctttggtgctccactaactgttccaacaggcaacgcggctcgcagggcatcccaactttggagatgatcatccaactctccactcacctgtaaatcattcaaacaatacattgtttttcagtgtaagtacagaagacaagaatctcaaaggcgctcagccagcacacttacgtaaaagagcactacatagtactaagacacaattcatacttttcatagaaaccgagagagagagagagagagattatatccagaaaccaactcattattgtaaccattgctcattacacaatgtatcgtaccaaccctagaaaagatagcagtgaagatcagtcacttgtggtgctactaaaagctttgcactttcatgtctattagacaagacacatttgaaacatagaagcgtcaaaattgcagaaattgttggctgtttataaaacaagccaataaattacttagaaaccacatatccattttgtcgcaataggtaatacatctgatagtgttatgcatactgagttaagatcctagattttcttagcataaaaagacatttgtctgaactaacaatgcagactggaatgctgaaggaaataataatgacgcaacattgccaaggtatataatgagtacagaaccattgtttcacagtatagaagaagagcctaaccgtggaactgatgtgcatgacatgggagtagcgttcaatgttcattaatttctccaccttcacagatccaggtttggagacctgccaagtagaaagtaatcataagaaaagttgttaacacattcctaacaaatctgtcaaattaatgcaaccatgactcagccatcgaaaaaaaagaacacaaacctttccaacatcattccttcccaaatctacaagcataatatgttcagcacactgtttttcatcacttagtagctgttgctcttgcatttcatcttccttctctgtcttgccccttcgaacagtcccagcaagtggacggttaataattttaccctgaaaaagatttaaaaggatgaatgttaatgaaaagaaaaaatgtattccaactatcatcagtaggagagtttacataccttcctcacacgagtaagaatttctggactagatgctaccaggacacagcctcttgcctaagagatcataatagtatattattatacataagagcgtttagtattatcttatacaaatgttagaaacagataccagtcaaaataagcgcatagtgtaaatatacctgtacatatgccatgtatggacttgggttcacaattcgtaaagctcgatagacttcaaatggattggcgtatgttcgcctctcaaacctctggcttaaaacaatctggaaaatatcaccagccataatatgctccttagcctgcataacagcattcttgtactcatcacttgtcatggttgatttgttcaaaggtgtaccaaactgccgagtgtgtaactttacaaatcctggagaaagcttgggtctggagtgaaaatgaaataagatatagaagctgtgagcaccaaagcagaattagcaaaacacaggattgaaggaatgggcacaggttagcttacacatttgaattgtgcactttagatagcaacaggttcagccgggacttgccatcttggaatgcatcctcggtggttgcatgccgatcaagatttacccaatggatgacatatactttctgcagcaaacacatgaaccaaagaatttgaaatggatataggttttccacaagttgtaactcacggtctcacatttgcagcaagttcaaattctggaactaccaatctacaagttattttatgtcacaaacaggatgagctccgtggtttctgctgttgttggcaaccaaagagaagaagcacaggtttgcaatttggcttcaaatttagtgtaggaaatagtgtgttatatattactagctaaattgtgcattgcaacagatttcaaaaaatatatctaaagttcttgactaaaaattatatttttgttggaaaaatgcatatataatttgcaagcaaacatcgaaccacaaaaaccaaaccacattcacagagatatatatttatccagccttagaagatcccaccaaatctaagggatggaagattcaccaccactactaggttcttttataaagagattttttttcttttgttactgaaagagatgctcctactgatagtctgatggtgatgaagaaaatccaaagtataggttgattctatgataatcctcctcccaggcaatcaaataaaatagcccataatgagataaaggaaatgacactgaagaataagcaccttctcgacattgtcgaagacgagaacatcatcataaagcccaaggtgaacatcaggaaggttcctatcgtcctggggagcaccggagaagggcagcttcttcttttcaacataacggactgtatcataggaaaagaacccgacccatccacctatcacaaacaaagaaaccaaatgccatggttcacatttcataaccaacaaaatcaaatattccccatttcttcttcctactgtttgatttcgttagctcaccggtgaaggaatcggggagctgatcgatctgctgcgggtgccatccttccatcatgctcctggggatctgcataggatcatccacgacctgctccgtcaccttgcccttctcgtggtccatgattgtgaccttgtgctcctttgccacgacctccatcactgggtgggctcccaccatgctatagcgacccttcgaagttcgaaccaatcaaggcacgcagtgttatttgccaaaggataagaatcgataagggagcagattggaaggtggaagaacatggaggggaggggaggggagaaggccgtacgacgttggtggtgccctcgggcccctgctcgacggactcgaagaggaagctgggcgtctccatgttgtcctcggggacgaggcagcggtaggcgagcacgggggtgaggtggtcggagacgatgcactcccacatgggcaccaggttgcccttcccgctcccacgctccgccgcctcgaagaagcgcctcctgtcctcctccgccgcccgcgccgccgcgctcccgttgatcaccgcgcttgcctctggcttccccgcggagcacctcacgccgccgcgcctactcgtcctcctcctccctcctgccgctaccgccgccctcgctctaaccggggccgccgccgccgccggagtggcggggcgggcggcgaggcgcgagggcgtgaacgtggcggcggcgatggactccattgcgataggctttttttccacagctcgtcaactccacttccccccactacgatttggagcacacgcgaatgggagagcgcgtatatataaggaagattcagcgaggcgaccccaaaggagttcgattcttgaattcttggattgagacaggccgaagtggtagtcggattttaccaacacggagtgggatttttttttttttcgtcttcctcccgtcgtgaggaatggttgtggccggcggcggctagcgagatgggtttttgggtttactcttcctcgatggggagagggagacggtgccattataaactgggaaaaatacgtggaaacttaaaattacaataaaaaataaaatgtacgagatttgttcacatcatcataagtactcatgagtaaatcgtgatgacgtggataaatgtcggacgtccatttttcgatccaactgtattgtattttttaagtttccactacatatttccccttataaacttacctattttaaaatatatcattgttatttactattcctatttgaattttacaattatttttgatatattactattttatatatctatctggtggattcattaaaaattttgatcagcttacccttctcccttcccctctccactcactcattttcaatgaaatgagcctaaccacgatggtcaccgatccacctccacctctccggcggccatctctccctatcccctcgccaccgtcgcgcgttccctcccctctaccaacccatctcctcctctagcgtgtgtatcagggaaagggaataattcgaggtcaacctcgtttggccaccttattgttcccctcaagccgaacggaacctcatcttgaattcaggcgccacttagagactctgtcgtcgtcaagcaagtgtaggttggcgagccacctaggcatggccagcgtgcttgtcaatgatggaggtggattcgatagtggagtgacgaggaacacaaacgtaggatgtcaatggcggtatcgaggtcgccgattttactctgcccgaagtgagaggggatggagaggaagagaggggaaccgccgacccagacctcgccatgcaccactgccggaatgagtagacaggggagaggaagagggtaagtagtaagtagtggtaagtagtggtatatctcaaatagatgtaaagttgtaatgtcatgggaccaaataggtgaatggtaatgatattttttaagagttgcaaatttgttatgacatggatccaattaacccaaaaaataaaagaggggataagaaacaaccatgctctcactagttactacttcctccgtttcatattataaaactttttagcattgttcatattcatataaatattaatgaatctatacatacatatatgtctgattcattaatatctatttaaatgtgggcaatgctagaaagtcttataacctgaaacggagtgagtagtaatgttctcttcatctagaataagtttattttttatttcctcacgtttgtcccaaaataagtttatttttaagtaattatcgtatcagagtttatgaaaatacgggatgaatgtgttaaaaatagataaaaatagggaataattacattaagatttgataaagtgaaggtatttttttaaaagtttgtattggtatgttgcaggatgagtaaaaaataaacttgttttagaacggatgatgtagcagttgccatcaatagtctctaaatcgtgggcaaaatctgatgtgatttgcctcgttagagacgtggaacaaatcagcataccggcccggacgagaccaggttaacgattgtttcgatcaacacaggaaaaaaacagatcccgactgaaattttagatgcttgtaaggattttaaatttaaaatcgtaaaaccgattatgaaaagttcaatcgaaatttagcaaaaacgatggtaccacagcaacgcagaatacccacgtgcccccaccattccaccaaccactcccgagtaaacaagtccattcaacttcaaatcaaaccacagcgccggtgaattggcggagtctgtcgctcgcgtcggtcgcgcggggacggcgatgggctcggcccgcggagccggacagaccggaccggaccactcacgctcacgcctgaatttgccggtgcatcgcacgttgctcacgcatagtacaacgcaccatagtgcactgtgcaccgctgtagcctgtagctgtagggtggacgagcgaaacagtcgtgcgcaccgtctcgtcgccgtcgcctcgcctgtgaccgtgccaccgtgcgcgaagctgcgcggaagcgtactcgcgcgcccgcgcccgcggcaccacggcgacggcaacggtaggtgggtctcccacctctctctcccgtcccgcgcgtgtccgtttcgttgtgcgccacccgcgctctcggtctctttctctccgcgagataaacaagacgatgacggggaagaaagcgatggcagatgtggccatggcgcatgtgggggcatggtttgcacgacgaggggaggtgcgatggcgcaacatgccggcgtgccgctccctccgtccgtcctcggcgacaccgaagtcttcgcgcttttaggtttttgtgtgttggaaatggaatacggtggtggctcggtgacggagaccatcgaccgagaacagtcaaccgacggccgggccaacggtcagcgtcagccggcgacaacggtctcgagacggtgctgaacaacgcagactcgtccacgcaaaaaccatttgaagttctcaactggattctcccccagatcaataaataaagtttggatcttccttgtacacgagtactaactaacacaaattaggacgacgtgatgttctctgatcgagcccggtacttgactacctgtccggtggccactttgaaccggcgtctcttttattattttgccgttcaggggttgttcacttagacccatcccattagcagcagtgttactgaaaaaactcaataaatcacgggtcagtttcatacatcaaggggacatgaaaaatgtcaatatcaacaaatctaaactgctcagattgatccggatataaacaaaaaggaaggaaacagagagttatattgtttgctcgttttcttcacggatggaaaggctatccatcaatcatgctataaagaaaaggattttgtcacgtctttttcagctaattcaccccatcattgaaatgtactatttggtccaccattaaaatttatgttttctaaaaaaaaatattctactacttacgcctcatgtttaaaacttttaaatttattttttttcaaatatttaatttattcttacgatcaactagctaatctgcgatagtaatccgctcaacaccttaaatcaaagagaggtaagttgctgaggtctacatgagggagcaaggttgctgaggtaagttgcaagtgaagcctatggggaacatggatggagcttcaaaccaagaagattgcaatgaagctgtttgggttgtccttcaaaactccttgttgccttggctctctagggcatgctcaatgtatatagattaccttagtattatggtgggacccactgaaacatattatcatgtccacaatgtatatgtcaagagtggatattaaggtggatcccacaaacccaaaattagctattgagagagggagagagagtaacactaccatgagagaggaagaagtactatattttttttattccttgtgggtagtctttatgcatatggctagctcaagcaaatgccacctataaggattacactcacaatgtataaagttcactttagaggcttaaaaccaacccttatgttcacattgtggttgcccagagactatatgaactcttttcctggagatgtaacccaatgtttgagatgttgcaaaacaattagagtagcgttttggctcatgttggctttagggttgtttagtacttttgtgactcagcgtcacggacaaattgggaataaacaggaaagatacttcttttcatgcctatccttgaggtgaagtgaacttgagatgtattaacgagctcttgttgccactgctttttcccaaatgttacatggcctcgttataggattagactggcttatacaacctcaagaggtacgtgtgaagttacaggaatgtcctcaaaaagcttggaaccctaagggcatatttgtatatttaggcggtccttagggcttgttgcaggtactagcttgcgggagtggttggagcggtccccttgttatcttctgtgataatattctcgtctggtggcgtatctacaaagctccttcatcattcttcatgtaccactcatctcatgtagtatgctcgaattgtatcttcctgaacactcaactcgaacactacttgcctagtttgcacgttgttccctccaaacagcttgatcctcttctagttgtctggttagaactcgagaagtatttacctctggttaaaaaaatgcccgaagttacatttggatcgaataggaggtacaaccctcactccctcctacagtagtgcctaacatgaatctctatccccagtaaacccagaggtacctaaaacatactgggaaaaaaatagatgatcacacgagggaaaggaagtgggggaggcgtttttttagctttcttgttatttttgttaagacctactacctccgttttttaatagatgacgccgttgactttttctcacatgtttgaccattcgttttattcaaaaaatttacgtaattataatttattttgttatgagttgttttatcactcatagtactttaagtgtgatttatatcttatacatttgcataaaatttttgaataagacgaatggtcaaacatgtgagaaaaagtcaatggcgtcatctattaaaaagtggagggagtatataatatcatttctattacatggaaattaggagagtttggttttctttcattcaacagaaaaggacctgtttggcatagctctagctccagctccacctctcctggagctggagctcagccaaacaatttcagctccatctaaaatgggagtggagttgggtggagctctctcacataatgaactagagagatggaattgggtttaggcagctctacaactccactccagacttaactccagaagctaaatttagaagttggagctctaccaaacaggctcagaaattcatctggataatcaagcccaaatcaatgctcattgcggcccatgacgtataaaggctgaacaagtctacgtaggcccactaaagtaaggcccaactgcccgagcgcggtaggttcgaagcccacgagaattaaaaacagagctcaattacacatgccaatcgacagagcagagcaaaactacaaaaagatcaatgtaccattgaaccatattcatcagtcgatagttgacgcaggaccaacaacaacagtagtagcaggtacataagaacatggcaaccaagctacataacttacgaccattgtgcagcgtgtggtagaacccactcgacaatactcaacgtcagtgagaccatcactgtgctggatgatgtgtcgagtgctcgatccgatccagccagaggcaggcaatgtgcagtggcacccagctccatgcattgccgatcgagtacactcatagcttgatgtagccaaaaggaccagaaggccagaacccaaccggtcggacagatcaacgagcagcgagccatgcattttgccgctataattgaaccgagaacgagatctcactgtacgcgccgccgtgaccacagcccaacgtacctaacgagggaaaaagaagggctatacactagtacgacatgcaggctggccgcctcgtgccgctgccgcaactagcaactgtagatgatgacgaagcatgggagcacggcacgggggttgaacacgagcagctcgacgtcgtcgtcgccacgggtagctgcagcgaaggaggaggttggcagtagtggaaccatggagtcgtaggccaccttgtcgtccgcggcgccgcggccgacgcgcccggccacgacgcggcacaccagcatggcgcggcgcacctggaggaacgcgaactcgcgctccacgtcgtcggggagagaggcgtgcgcggcccggccggaggagtaggtggcgatgccgtccacgtcggcctgcttcccggcgaacccgtggcgcaggatgctgcaggtgcagcagtaggggctcccgcacacgcccgcgcccagggtgcagagcatggtggagcagtagaaccgcagccgctcgttgccgtccgcgacgcaccgctcctccaccgccgccgcgccggcgcccgcgcatcggcgggcggcgcgggcgcggacgaggtcgcggtactcctcgaagcgggtgagcacgcgggggttgtggtggatcctgaggatgcgccgcaccgacggtggctcgccggcgccgggcataacggccggcttccacccggcgaggaagatcatgcggatgatgttcatgctggagtcgaggctggagagctcggagagggagtgcttcatcgcctggtggagctccagctgctgcggcttgctcagcacctcgccgcacaccttgcacgggaacacgtcgccgcgggcggcgaacgacctgaacgacgactgcctggtggtcgcctgagggatctgcctgttgtgcggcgacgacggcaccgcaggagtaatgctgagagactgcggcgagagcggggacaggaacggcgacgcgcatggcgacgacggcgtggacagcaccaccgacgacgaggcctggcgctgaggcaggcacgacgacgactgcgcgagcggcgacgacacggtcgtcgtcaccgcctcgtcttcctcctccgcggctggagcgccagcgccgttcttggctccggacgagtaggagaagatgcggtggaggtagaagcggacgctggtggctagagacgacacctgcctccgcctggctctggacctctcgtcagccaccgtagaagacgacaccgacggggagaacgcgagcggcgatatcttcctcctcttgctgccgccgccaccgccgcccctcccgtcggccccatgtccagtgtcatcttcctccagcgtctgcgtggaagatcccgtcgagaagcagcaaccggcatggccaatgtggatgaacaggaggaagaagagtgacacgaagccacggagcagcgagctgcacctgccaccgcccgccatccccgtatccttgccaccgactgagtcttccgcgactcagatcatatgtgagcaaagcaaacaatgggcgcgacgagagagaggaaggaattctccggtgggcgagtggagatgaagcaaggaagcctagccagggaggagggcgacgaaggcggaaagggagggagggaaaagggagcgcaacgtgggctatgtatcgcgcttttgtgttggcacgaagtacgggagggcaaaaggcgatccggcgacagcaacagggtggcctggtacgcagtaatcagcacttcaccagcaacccccagcacgcaccgcagcgtggtgctgccactctacggggacgatcgtgtcagctgtggcggtggaacgtttagccgcacttaaaacgagaaatgtgattagcatttgattaattaagtattaatatataatatttttatgaataaatttgtaggatttttttaacaactttcttatagaaagttttcttatgaaatataccgtttagcagtttaaaaagcgtgctaataaaaaacgaggagaatctaatcctataagctcaaaacgaccgcaccctacaactctgccagcggccagcgccatgcctagttgcattgaataggagagagtgagattgtgacctttgtgagaatgaccgagttggatgtgctatctatagagaccagctaggcgatcggggctagcaggatgaatgactgaactgggacgtgtaggtttggagggcgctatcattgatcataagctctaaccctgaccattatgtcccccccccccccccccaatctcaacaattattcatcaggtctcatgccaccgcattatcatccatgatgcacgctgtacaggaccggtccaggataaaactagcagtttttttactctgcccaacggacttcactcctcgtcagctgggaagcatgcgccatacgctcccaaagagataaaccaggcagcagcaggcggcagctgcgctgaggcgagcgacagagggcgggacaagatacgcctgtgcctgcctacgctcccaaacaagggcaaaacgtgcaggcaacggcggtctgaccgtgcagatccccttgcctgctgctccgtcctccgacttccgtgctcttcatcataccccacgacaaaacaagctggatttggcataaaatacatgcattttgaggtgggcacacaagtcagatgtcgatgtgaatcctactccttatcttaccttgtcaacaattcacgctcatctgccataatggaggttctgaacatccgatgtgcctcaagtctcaacacagcgtagtaaaacagatcggaagccacaatccagcaccggataatcatctatccaggcacaacgtactcatcagttctctggaatccgagaagctgcaaagctcagtccttttctaaagtttggatccaaactttacatcacatcaacctgtcatacacacacaacttttcagtcacatcatctccaatttcaaccaaaatccaaattttgcgctgaactaaacacagccacagcccatagtgccgcgccccaaatctgcgccttgcacaaggaacgaatgatgctggctgtccggcgcacaaagacacagcagcgctcttgagattcgctgtcattacgatgtcatggaggtgactattgtaccgttgtctgcgtttcttttcctaaacgaaatattagctcatgctttatggtacaactcgccatgttctgagccaaaaggaatacttgagcccatgcatagaaacagtgcaaggagacaccagattatgtgttccaggactccatcatgaaacgcaaaaaggtggtcatgggactagagcatatgaactttatttatgaatcatgctagtcatgggaacttaagatgaactcttaacttcctactcaaagtctacaggcataatacaaagataataaagctggaagtacagtacggaatgaattgaagtacaaataacaagcccagaacagtaaacataccaactgctaatttatgatacaacgcaatatctagtggcccatgaaactaaatgtcacacctacccatcaaacccattcggcagactacacatcgcgtacagcccttagccatcaaacctcatactccctttgtcccaaaatatgatgaaggattttggttggatgtgtcacatccggtcaaaatcacttatattttgaaacgggggagtagattccaacaaatatagcgtgaagctgtgtggacaaataacgagctgtaaattaacatcaaataagtgcagcatagaagcaataacatgttcatcatgctctaatgcattacaatatgtttttttttactgtggctactagcctacaaagagagtactggtgcatcacataacattcgaacatgaccaatcaagattaatctatgcctcccattgccgtatgctgatgctaataaaaaaacacctatttgatatcatgcacaaaaaatctctcttccagacaacaagcctccaaagtccaaagaagacaatacgacgttttgaaaaaaaaaatacaccatcattcttcacataacacttctttttttgtggagatcgcaataactttttttgagaggacataacgcaataattgatattgataaagtgagcatgctcatccgattctttccttgtgctactctaagggttatctgagataagttctcttgacatatgacacatccactttaccaactaaactgtacataatctgaacacaaaaaaaacagcacttttgctccttaaaacataccaatgatgttgcaacttgtaacatactgttacgtcaaatgaagcttcaaattcaggcaaggtttatcataaaatcatagttcaggtttcttcacccaaaaaaaaagttcaaatgccatgacctgctgaatcagacatggagcaaaaccacgagaactgtttaaaagagatgatccttcatagaaaagaattgcgatgctagatgtcacttgattggagagaaagtggagaaagagaggatacactagacctctaaaagaaaatataaaatgaggctcatatttgtttttcttgtagaactggggacacaggaatgtactccataagaaatttgatagctctattctaatgttctaagatcctccataagaatcagaataccaatcctaatgttgtgaaaattctacaacaaaaaggaccgtcaataataattcatttatatcaacacatattgtttagaatataagcatctcggccagcatcatagatttttggtacattgaattttggcaagccagcataaaaatagagtacgaaaatgctcaagcatatttgacccaacaaaagattggtacgcaaaattcaagggcaagtcagcggaggaatttacacttccaaaagaacctatccattagctggtactatgttctactattagcttccagaaagatatgatcagctatatcaaattatcaatgcatttttaggaaggtaagaagaaattaagaatgataagttagttctatgtcatgctctttccgtcaggataattaagagtaagctgcataacaatgcctcatagcattgaggatgctaaggtttgcttgaaactatcttgtattaagctgagctcctcaagctaagggattaggaaaagggatatgaaataagcttaccaacatccaagggatttgatcaccacaaaatacagatgcagaagcaagaattataacattaccgcatcatgacttgagaggaattttcagtactgaataatgcgatgctatggtagaaaatgcacactcacgtttaatagaaccacctgaattgccacaggtcaatcatgttcagacaagcaaactgctaagagatagagagatagcaccagccagctgggaggtctcccacacctccacgccttgcatttcttctctggtaacaaataagcggtctccacccccttccatgatgtgtatcataccacggtcagcatcctcttctgtatccacatagcaactcctaaaacagttctcgtttattccttcgttgttgatgttttcctttgctctcgtttgctccgccaagttggctgtgccattgctctgttcttccagtcgagaccaaacctccaatccatccttccggctgacaaacacctgagacttgtagcaatgcagaacactgccatggccccctccactccctctaggtcctgacgacatataaacccaagggtctttaccaaggcatctcaagtcagcggctccaatatctcctgactttgagcacaccttgtatagtatctgttgcttaacgtcaacatccacatctgcaaatggatctccaaaccggctgcttcttccaactccccctggctcgcttgtttcccacaccacatccccagaacgaatgtcccacagcctcatgtacccagagtaaccaaatgcccccgagctcacagatgccgcaaataccagcccaagctcctgcaggtgcactactcggcctggcgccgacgacttagctgcgctgccagtttgccggccaatctcttgaatgggctttagagttacagggtcaaacaccaggatgcaattctcccggtgtgggcactcgaatgtagctaagatgggtgaattcttatcagctgcatcggcagcaggacgggcggcaatggcaatcaccttggccttttgaacgcgaaggtcggtgggatctgaccattggacagaggcgacgtgccgacctttgaggaggtcgtacacatggagccccggggagaggctggacccggcaacagcgaggccaggaggcagctgccggagggaggtgatgcggtggagatgggtccggaaggtggtgaggtgctccagcgcaggggagtagtgggtgagcaggccggcgccatgggcgaggcagagcgagccatcgtggcgcggggcgagcgcggtggggaagggctcggagggcggggagagcgtggaggcgcgggaggcggagaagccgaggaggggcggaggggagagggcggcgaggagctggtcttggaggccgtaggagtgggcctcgtcgaggaggacgccggcggggaaggcgggcgcggcggagggggcgcggatggcggagaggatcgcggagagaagggcggggtcgcggtccacgaagattgggtttggggaaggcgagagagagagggagatcgggagggagcttgcctccaaggcgaagagcttgccgcccacgttgagctgcttcaccgtgccgcgccggccgccggcaccggcggcttccattgatgcttgctctcaccagtcgctagatgctgcctgtcgaggcgacgacttttctgactccgccgactacagtcctgctgtctaggatacggccttggacttgggctagcccagtccgcctaacaacgtcagcccaactgcctctaggcctaacagccccgtactgtttctctttctctctctttcctttgaagaggaagcatatacaccctccatccccaaaaaaaaaaaaaatctacttctatgatgaatttagatatgtatttgttcaaattcagccacagaagttggttttttctaagatggagtagaggttagtggctatcatgctcctccatgttggtgtttttaccatgagatatatttgcaagttcatggggtttgacgcttgtaaaacttgatatcaggaatttatactcacgattttagtcattttacatgcctttctactatagagaattcctcgtgtccgtccaatagcctaatataatcatcagaaatgtacacggggtaaacatatagcgaaacattgactttataacgaagtgcaggggggcaaacagacctagctagagcagaagatctcgaactttcactggtctttttacagcatttgtgaagccctgtaaatgaaaaaaaacttcttagtgacattgcccaagaaacacgagtccaaactctaacgacaattgagtggaagtggacagaaataaaaagggaatacagaggaataactcaaacgccacagcattatgcgcaacattatgtccccattagaaaaagaaccacgtgttaattctgagacaaaatcgagcaggatctgttcataactggggctctgagcaagtaaaaatactcacttcgagaatcaaatgattgtctagtgctgtaagtatatagatttaacagcaatgtaagtaagataacgtaatgaacttcagtaataacaggaaatgtgacaatagcagtttatagttactgtttatttggcactactaagtgcaggtcatgtgggtttccaatgtattccttatagtaatgagcgcacaaagatagttaaagatagatccaaattgtggcatcatgatgaataactcaaggagcaaacctcattgtatttgaagatcagtggacgcgagtctcttagagttgtagctacttgttgccctgcgtcatttcgagcttttgcatccactggtctctcttttctaaacctgtattttttgtgttaacgaggaaaaaaaagcctttattatcaccgtcttgcaataataattgcatcttgatgtctaatgaaattatcagtattaaattacctatcaaagaaattaattccgtggttggagtgcttctttgcaggtgcaggatctttaccactcatactagatgctgagcttaattgcatcttaagtgtagtcgggttgctcttggaggtactcttggtagaaaccaatgcagattttttctcacttacggaaacttcatttctcttatctccttcattggcttggttcaacaatttgccagcactatctttcatgatcttttgcttctctacctgaaaagcaacaacatacattggtcagagaataaaatcttcttttaataggaaatttcccaatatgaaaggcttctggcaatagatatctgtattgagaataaaaattaaaactataatagtaaaagttcaagtagcaaacacatggaagtgaaatatagaactgatacttaagctcagccttccaatgaaaaggaagtaatctatatagatacaaaagaagatttctgctgcatccacacgttctaaagctccaagtacaagttaatgctatttaagtgcttgtaaaattcagaagtcaaaaccagtgctactgctgggacatggttatcctactatggcaagtaactttcatttcaacagctctggcccttagaacttttgcagaaaagtacaattcaaagttgtatagttaaaatcactttgttcaatagcttattaccaccagcacgagatgctaatacttccaggttcaatatagtttgccaagcaattataagtacgtaacagatggctatcagataagtgttgcatagaagcaatgatttttagcctgcaaataggttagaacttagaagttactcctacttaaagcaaattaggtgttgtgaaggtagcaagcactaagcatgagaaataaataaaggaatccactcatagaagttagaaatgccactgacctcatgcaccaagacttgtttcatggccaaagagagaccaatatgctcagattgatatccctaacatgagaagctctgtcatttacagtgagaagagcacggtagggtaaaataggacagaagtttcaaaaagaaccttgaagtttataatatcattgattgcaggatcaagagaaagtgaaggaacatcaggagacaccatagatccacttatcctttcttgaggctctaactttgtgtttctgtatgtaattgagtaagaaaccatggtatcaactagctgcacaagttcatccttttctctctctgacagcaaattcagtgccacctgaacaaatcttataatgtcagcattcagcaacctaaaagagatgataatatgtacaaaaatactagtagtaatagaaagttgcagtgctactttcttgcaaaacctcttacaactcatcagttccaaactaagatctaactcatttttagtggttagtcgctttgttaaattggcaagggtattcactccatccttcatttgtgggggtattgcaggatgttttgggttaatggcatagacattttactatgccatcctttattttaattcttgatcttacaactcaagtgaaattaaacagaaaaattactatgtgcaaacagggaaggtccatatcaatgattagcacacctaagtaagaacttacaggtctcaagctcgatggagaaataatatgtaagaagggagaagcaatgtcctccacaaaagattctactgacaggtgcctagaaattagcggtgacatttggttttgccaggtcttcagtttatccttcttttccaaaagcattgttcggcacctgaaaaatatatccacattaatcctgctaatggatagctgatagctctatcaatgcgcaagaattacctctgcaaagattttggccattcaatatttggtttctcaacttgagcaaccagttggcttatagttatggcaacaggaggctgatatactgaagtacagagtcaaactatgtaagttagtcaagtatttatacaaacaaatacaataaaaaattggatgctaccatgaagtgacatctgctgagtccgataaacatattgcatcaaagaatctgaaactccaagtatatcgagacatttcacctgtaaggtcttttggagttagacaagttcacggatatatttacagaagcagaaaataaaaaataaaactcctgtaatataactagaatcaggatttcatgcacataccgtcttttgcaacatcgggtcatgataattaagtttcagaaagttctcgtgaattccatccatagtaacatcatagtcaccactgtacacatgatgtgatgtgaaaaagtgaagcaattctaagaaacaaagcatgaaatcaaccgcagaaaacttaccggttagaaatgagtgagaagagagaatcgatgtccttgcctctgctaaaattactatc

SEQ ID NO: 82711 - DNA, 24373 bp, Oryza sativa
tttttccccttggttattgttctcttatttaaggcactaaaccgatagtgtggattgtacttgatagggtgatggataaaattaatactagagttgttttactgtctaaggcattgtagtttaggctcactggacaatggattggaacatagttgataggatgatgggtattagatttgtgtttgagacgatgtcctcatatagattgaagacattcaaccttgagttttccagatcacactgagtaggttttggcaaattttcccttctatttactctcttgatcaacacacgtgttcctgtttttgttgtcatgttactgttatattttcaagagccttaccattcgctgagaaaacaatacttatagatgttattattgtaaatattgaaattctgaaattaaaatcataagaaagtatttttaaatataaatccattgatgccacttgtatggtgctgaacatagatattggaagcttaactttttttttgtcaaaaataacaaatgttgatatttctgaatacacgtgtgccctatatttccaacagcgggagtaatatcaaaaatcataaagttattgggttttataaagtatcataatgtaaaattactggtgaaagtttttaaagtttaaccgaatcttgttctgaacgccaaatatttatgaccggagcgagtactaggtagacaattttcccatatgccataattcttgtagattttggctgcaaaaggctcaaggtttttgctttttattgtactaaaactatcagggtaaagcgctttatgcgttcaatttattttaatattatgatacttgattattgtagctgtgagggtgcctgtcgaaggtatttccaccgaaccatttccaatgatgcagattttaactgtgaaactctcaacatgagtcaagaacaagtggtaagtgcatattcctttgcctcttcaacttattcttgtttaagtattccagtattgccatttaccattaatatttttcaacaatataggaatcatcaaagttcatatgcaagaactgtgtgtataagcaacaccaatgctttggttgtggagagttgggatcctctgacatgtcatcgggttcagctgaggtatgtataagaaaaagaaactttgtatgtccttgggatacttcctcttgtatttggtatttccttgatttatcattttgtttttcaattttcttatggaattgaattaaggcactgcttgaaagcaatttttagggatggctaggagtcaatgataactttgaggaatctgagagcgatactttggaattgtatacacattaaagttcaagaactttttttttgtatgtgctcgtcagcataaaccaatttcctttaaattccaacttttccttcactttttgttaggtatatcagtgcagtaagagcagatgcagacgcttttaccatcctaagtgtcttgctgaatttgactctagtaagaacccaccagtttttgaatgccccctgcatgaatgctttgcatgcaagaacaaaggggaaaaatataacgaggaaacatgcaagaacaaggggcaggagagtatcaagaaaaaacaaggggcggaaaacaacaagaaaatgcacctggcattatgcaggcgatgtccaatagcataccatcgcaagtgcttgcccaggtgtgatatgtatttggcactatttgctagtgatagtgcccttctaaaaggatattttgttgacacggtgttctcttttttaggaatatttcctctgttcccaaaggttgtcttccaaggaaatggaaaactaataagggccaagttttcttctattgcctgtaagctttttgcacttcatcctttttgttagcatatgttctccatctccactatattcgtggaacttattattcacatagaactttttcagaaagcatacgatggtagaacatctcagaagtgcaacaagggatcacctcaaatttccaaaagttatggaagagcacatgcagaagtatgttcccaaaagagaagttgaaaacaaaaaacttattgtttatgttaggaaacgacatagaggtgcatctaagaaacaaggagcttccatggtggaagaagttgatcatgggaccatggaaagtgatcatgttcagagaagtagagatattaatctgcgagcacatgaacaaaccgaagcacctcgaaactatatgtctgaccgtaacacaagcactggtttcgtgttgtcttttgcacctaagtccttgttcccactcccatatccaggcaattgtggttggcttgatgattgattcatgatagtatttcagaaagaaaactgaagatttttaagtttcatgtatggcagataactttgtctgtagcatgtaacaccgttgtgttgatgttcgtgatggtagttaattactggtgactgttgagtataaatgtctggatactgtggcagcgacattccttccattgtcaggaatgaggatatattaagtactattatcactgtatgaaatgtttttcgcgaacgcctgtatgaaatgttattaaaatgcttctgttcatacctaggtgaaacaatgcactaatgtgtaatgcaggtatgtaactctctgttgggcagctttgctctggcctctgagactgggagtgtggctgtttccctacaatggtgaatcggtgatgcaggtcacagccttgcatcttgccgatttgtccagctcatttgaggtgacggatatggtggattttgctgtgtgttcattgtttatgcagtactggttcctccaattattttcataattttcttttctgttacgggccggcggaagctgccgtgaccgtggatagcttgatttccagtggacaagggagtataggtggactgtcaattgcaagtttgccagtgggaaactccagtaactaatgcatgcctcagaaagcattcagttgagatggcatgatgaaattattattttttgcaaactagatgaggagatgacgtgatagcctatttaagcgaaagcgatcgggttgtagtccacattacgcagaagcagcagtaaaaaaacagtgtctacctccgtcagccggaataatggccagcaacagggaagttctacaggtggtaacatgctgtgacggtgtatctaattgggtttatattctaagtttgacactgatgtctgctaattttagaaaggaatacacgtgggcacgtcttggtggttacatggatgctcatactctagcgggtgtttgatacgtttgacggtattcatgtatgcgaacgacacacatacttaaaaaaatttccctcttagaaaaagaaaagaattgtctgaagaggattagataagtcataaaccgcggtgaagtggcagcttgacccactagcaatcgcgcacagccgcacggttgttatcatcaaagattcaaagctgaagccttcaaccagggcaatctccattttccactcccggccgggtcggagtcgcgcgacgacgccaccaaggcaccaactccacgtctccgccccttccggttaattcgctcctacgcgcacccacaccaccaccacgccatggcgtgggagtaacgcgcgcccgctccacaccaccgacccgtggcaacgtttctcatctggcatccggctgtcacgttttcccgttcgctacagcccgcaaactcggggtttccccgtcacgccagccgcccaagcacaactgcacagcagcggggactccgccggtgtgcgccgacgcgagccgcatcaaccagttaccgccacccgcgcggcaacggcagcggccgcggcagcgaatcggggccagggcaagggccaatccatcctcaccaaccgcaccaccaccaccaccaccaccaccgcaaccgaacaaaactcggggaggccgcagaataaaggcgaggaggcagtataccggcgcggctggcctagtgtagtgcgcgctgtactgttcccacgtcgcgtcgaggcatcggttcgagcgagcgcgcgcgcgacgcgggcgaggctccggctcgattccgtcgccaccctgtgacagcagcagccaccgcccaccgccgccgccgctttctggaggcttcccgttggctcgtggttgcggggggactcgcggagtcgcggttgcgagttggctgcctgctactctgctagtgtgctaagcctgccttttagttagtctgggagcacgctactgctactttccccaatccaatccaatccaatccaatcctcgccggcgttggttcgctcgatcggcgcggcgcggatggagacgctcaggaagcaggccagcaagctcagggagcacgtcgccaagcagcagcaggtacgggttcctttgcccaattccagtggctccgtctccccactatgccaccaccaccgatcagcgcgtggcccgatgcgcggctaaaaaaccggaatttgggagtgcggggagctgcgtggtcgggttactggagttcttgtttgctccccgcagttaattccgcatacctagtggtaggaatcagggtagggagtggcgagtgcttgggttgggatagcagcaggccagcagttggtggaaggagctgaacatgaactgctcatttgctgcgcatttctgtatatcagatgatttgttccgaagcttgagtttcacttgttccagtagatgtgcttgtttggtaactaataacagaattccttgtgattacaggctgttcggaagcagttcagtgcacgctataaccaggatccttctcttgtcgatgaggcggaacttgagtgccaccagaatcttcagaggctatacaacagtacaagagctgctaaagtatgtgctccaactgtttgttatatgtgatataagaaagttgtctagctcatgatgtaaaagttattgggcatatgtctcattgtatagcatttccaacgaagtattgtacgaggtgtcgagggtttcattgctgtcagcaccaaacagatggagattggtaactgttaccatggaatatctgttcaacatccttccaaattttataatttttgtgtgatcacgttgcgatgtttcttcctgtagtgaaaaagctagctgaggattgttgcagatatggaaacgacaatcaaaattttggttttattcttgcaagggcttcagttgagtttggtaattcccatagccaaatggagaaagagcgggagaatcttcttaaatttcttggagagcaggtgctgtcatattatcattttcctctctttcttaagttttcagaaccaagcaaaaacaaatacattgcaacatgcaacggatatttaaataaatatatcataaattgtatactcaaaaagctttatataaatcctagaggaaaacatatataatctgcaagcacacatcaatccctaaatagcatcattataagcaacatgcacttattttctaaaaaaacacatgcacagatgttatgcttatcctcaaaacatcccactaactcaagatgtggtgtgcgatggcacttactatcaccaacaccactaacttattttatattgcatagaaatttcaatgctgcctagaatcttgtttaatgttcttaacctgaatcttctaggtttccatatatttttctttttgtacccttgacccttgagttacctgaaattaaatggtgttctcctgaaagtaacaaaacagtgtaaaaaacaattggtggattctactccaagagtacatattatatatggaagtttgctacaaacagaaacttattcagctttgctgatgcttgatatttaagttgatggacgtagcatagtttgtttatgcagtgcatggagctggagggaatttttttttattgctgtgtaaaactgagtgccttaattgcttcatttcggctccaatcttgcaggtttttgagcctcttcgagaaatgataatgagtgctcctcttgaagatgcccgcctgttaacttaccgttatcaacggatcagacaagatatggaatctcaggtaattacccgaagtgagacttcctgttcaccagagatgacaaccagatactaaaaataaattttattagatagctgatgtgatgagaaagcaactgaagtccaaggagagtagcggtaatgcagataattctgtgaaactgcaacatgcagaatcaaaattatctgagctccgaactacattatcagcattaggaagagaggcaactgcagctatggaggctgtggaggttcagcaacaacaggttacctttgaccgtctccttgcaatggtatgataagcctcactgttctcataaaaatattgcttaacatcatcaaataatatgtttttgccaatggttaagacttcatgtacatggcaagttgagcctatccatcgtaacaacatggctatttctcttttgctttgagtatggtgtaaccaatacatgtacaccattaggggtagaaaactgtagacatcaaggtcacaataacctttgggttctgagcagaattggtgtttgtggccatgtttggatgttgctttttttttttccctgtcaaccccaatgtgcaggcccctttgttagttagagcatatctttgcaatatgttgacccataatcctagaagtttctgcatatctacgacaatgaaaaatcccactccattgtttaaggccttggttggttggggtggtttgtcccagtccttataaaatttaataccaggaatttgatcggttttcctaagggcctggtattgactcttaagcccacactctcatacagggttccttttctccctgctcaccttagattgtaacaatcttatcttttatatcatgtggttgcttaagttcccatataaatttctcatctggatttccatttagtagttccagtacttataccatttgtccataggatgttcctttcataaagagtcatgcatctccaatttaccttatgacccacttgcaggttgatgctgagagagcttatcatcagaatgctgctgatattctgaacaaacttcacgacgaggtacataactgttgcaaaagaaagaaatggagattcttacacctgttggcttagaggaaattcgaatgccataaacctggaaaaagtgtgtatgtttatgctgaatatcactctgtttttgttctgctaatttgcacagatggtccaagcaaaacaccatgatgagccggaaaaccattatgatgagacatcatcagatcctaaaacagctgcaacacatgagcattcacgtagcacatccgaagatcacatatttactaatactagtgaacctacaaggactgaaaccagtgaacctacaaggactgaaactagtgaacctacaaggaatggtcaggaagtgcattatgttggagaggtatgtgtgccctttgcactgctgctcataatgatcataccagaacttataatgtgtcaccaactcacaacatcactgtctttcatttaattgcagtgcagtataaaatgttagaccttagcttgtattactggcattgtatctgtgctatctgtttatgagatgttttagacatagatacaccctcttacaaatatggtacttcgactgaattttatgtccacatgatatatataaagcggtttgattctgcagccaccttagaagttaaaatttcgatagcatgagcaatacatatgtgattttttagagctactttttttttaactttttaggaatggaatttagagctactgttggtaaagatggtagtctgaaatcatgtgaatttaaattcaaaaggtgcaacttgaacataccggtgtttcttcaacataaccttttaccttaatctttacatttcactttattcctctttacacctggtaaatactatcaccgaatgtcggtatggaagtcacctggtaaaaagaagcaaacatatacaggcaaaggatatcagtatatgccaaaattactagttcaacaattttagcagttacacaatcagtaaaacagatcagcacattattatacaagctgagcagtttgtgaattactcattggtcaggtaatccatccattcgatgctcaggctgatggcgagctcagtatttccgtgggagattatgttgtggtccggcaggtatacatggtttttgcaggttttattcatgccatggggtaactaatgaccaaaattctgaagtaaagaaccatgtactgtataattcactgcggtagcatcctagtgtatacatctgtgaccgctgcaggactatgatcagatgcagtgcaagcatataattgtccccttgttatatttttaattctccaagggtgaccaggggggaccagaatgctaactaagcattccttgtctgtcttcacaggtggctcccaatgggtggtctgaaggggaatgcaaaggaaaagctggctggttcccatctgcctatgtggagcagagggacaaagccccggcaagtaaggtgatagagcctggattgctgactacttaatctctctcatactaatagttgctttcatcgccctgtttcccctgtacatggggtttttcttgagtgaatagcattttgtagaacttctacctttctgtgcatattcatgtgcttctaggcttgctgttacccaataattgtatgtaaaatttattgttttgcctttagcatctcgttttctctttctttcacaatgtatagagctattggtcctgggatgctgtaaccttccctttcttttgtggaaagcgtgcttcctgccaaaattgtgagatggatttcagaacagtctcactggccttgttccttcacttttggacccaaaagctcgtaatctacttccctccaaactctatttactcttcttttttctgttcttatcaaaacagcaaagcaaaggacggattgcagcattcggtatgtctgattgggtagaagaagaaggcatggttgctggattcctggatccaactttatctgaaaccctgaaccttaacgggaacaggagcacttgtttgattgctcccctcctctcatcatttcactgcccacaaagttaatttgccacttttacctacttttggctctgcggatgctgaatttatggggccaagccctgacgcctcttccgttgccggtccgcttcgcggaatcgcggtagcctggccatgagcgcgccaccaccgccgcctcgcttcttgccgcgacacgcacatggagctcggaaagctcgcgtttcccaagccccgcgcgatgagtgcaacgtagcccggattgattcgcgacgttagcccgtagcacgttgcgcgcaccagcggcggcaggactggatttttcacattttggtccttttgaaaaacttatttcgcaaatagacccctgaaaaaacttatcccagaaatggtcctttttgggacgccagagtggctggcgccgtcatccaacgggacggtgccagcctctctggcgccgtcctcctgccaccgtggcgcacgcgaaccgacgtggcaggaggagggcgccagcatggctggcgccgccgcctctattcctgtttctctgtatggagttgcaacggtgtcatttttattttatttttttgatgttttttcacactcaggatcacgatacaaccaaccacaaaaaaaaattaaactcgaactaccacttagctaagtttgaaaatatttagcataccacttagtctactttgcaccttcactaaaattagaccataactcttttagtaaaactctttgatcagcatgttaaacataatgcactctaccactatatgaaattacttaatctaattcaaaatataaccacatgaaatgagatatataagttaaacagtacatagagatgtaatttttttatttttatttcattttttttgatatttttttcacacttaggagaacatagaaaccaaccgtataaaaaataaactcaaacggacaaaatatgtgacatgtagaattttccaaaactctaccgaaacggacaaaatatgtcatctattaaaataggcgtaactttctcatacggactcggaatcaggcaaataatatatgcacggacatctacagaaaaagttacatccgattctccccagctttgccgggttcggcgatattaaaacctccaaattccgcttgcaagattgtgttttcgaggagagaagtttttcggtggagctttggaaaattccacatgccacatatttcgtccgtttgagtttattttttacatggttggttcctgtgagttcctaagtgtgaagaaaatatcaaaaaaataaaataaaaataaaaaagttgcacatctctctcctctgcactagttcggagagaggagaggagaggaaaaattctacatgtcacatattacgtccatttgagttcaatttttctatgattggttcttgtgtgtccctaagcgtgaaaaaaaatatcaaacaaataaaacaaaaataaaaaatttcggggggggcgccagccactctggcgcactccccctagccacctcagcatcgccccgccacgtcggcagggggacggcgccaaagaggctggcgcccccccgttgaacgacggcgccagccactctagcgccccaaaaaggaccatttttgggataagtttttctaggggtctacttgcgaaataagtttttaaaaggaccaaaatgtgaaaaatccaggcggcaggatgggtcttcggtgcgtcgtgcgcaaggggcggcgtgtatgggtggtggtgtccaccggattgattgcgtgcgcttcgcctcaccggtcttgggctgctgggtcctcgtgcagttatggcgcggctcgcctcatcgcccgtgttccgccgatcgctttggggggcaaggtagcagagatggaagagagagaaaatgatgcgtgccggagacttgccagtgtttaccgttcgtctgtctgcctgcctgcctgcctgggtgggtttaacccctagactagtatcttcttttggctaaattttcaggacatgtactaaactaccacgtgattttaacattagtgaagcagctagggactagggagagaaagcatcaaccaacaatcgacaacgaaagattgaggccatgtcttagttcacatcaaacttctgcctgactctcaacttttcatcacatcacatccaaaactttcctacacatataaattctcaattttttttcaaactatcaactttccttaaacttttttttcaatttcaaaaactaaacacagcgtgagaagcttcaacggtagcaggagtacagtaaaacgggagcagtggtgtggaagggtgaaaaaacaggcggtttggcctggccgatgggaggaagggtcacatcgagagcagaggacaccgggtatgagacagcacagctcagcaacctctgggtcgcctcgttggtcagagctccgggcccgccaccagcgacccgtcgtcctgcttcactaggctttgtataattgtacccgtaggtgctgcacaatcaatactttacctaatacctaaatactctaccaatacgatacgccgcttagctcaactgaacatcttcagtatcatggagaagtcgacaccgcgtgtagtttccagtgacagactgacatgctctatctagtttaaagctgatattctgtagaaattttgtcctaatcgcaggtccaaatagctcaaattgaaacaaaacaattggctcaattatctatcttgaggtctatgccgacctaacaaaatgtactgctcctaaccaacatatattgacaagctgcaataactcggcctaccttcgcctatttggaagttgagagcacagggagggccgataggaaagagagaaaaacactgtagtttatcatctgattgttcagaatttaattcgtcccaaaggctaagcacggtccggcatgggaatctatcgctgtcccgtcccaattggcacgtcattttcactcagcatgccacacaagtaccgctacgacgcaaaggcacgcacacctaataaccaataaatgtgaacgaaaaagagaaggaaaggaaaagaaaaaacgggcgaagaagaagaaaaacgtaaaagcagcttgcggtgcgaggcaaaagctagtagacgaggcgggggtgattagctgttcgtcccgtgtcccgttgctcgcccacgccacgccgcacgcggacaaaaccgcattctctctctctcactacactcctcccccacactctcctctcctctctccctctcgcagccacagcacagcgcagcactggccgcctaatctctccgcactctctcccctcgccgctccctccactgccgcttcgtctcggccgacgacctcgtcgtcgtcgtcgtcgtcgtcctcgtgttcgccggtcgccgcgccgacgcggatcgccgtgccgctgtccagtgcgagagcgcaggcaggcaggcaggcgcaggtaaaaaccttgcccccgctccccgtcctcgcgccggatctgccgccgattcgtgcggccgcggtgagcccgtgcgtcgcgtcagcttgtgtgttgctgagtggtgaactggtgatgccgcggcagcgggcgctcaaaactggtgtgctcggtttcgtgtcggtagcgtcgcgggggcttgtgggttgggttgtggctgtaccctactttttgcttagtggcgtcggcggcggcagttgcgacggctttaactctggatgactggatgcgtgcttgcgttttggcggttgcgagctggaattagtaactgctttgttgtttcttcggctaactaagttggtccttttttttttctttttaagaagtaactgaaagatgttgatttacagtaattggggtgactaaattgttttcgaaattaaccgctgtctaaattgtttttgttagaatttttggggaaatttcaaattgcaggttctaggtaattcaaataccattaaacaattttgtggaagcacataattttttttattaataaattgtcatgttttggttcttatggtcgtccattttgctaaagaggagccatgagtgtgtcacaatgtactgcatttgatctgcatatctgattgttgctctgtttatttgataactttgcatgattgctgatatgttcctgttttcacttacagtgccagcaatttgcctccctcaccaggggcacatctacatgtggagttcattcccataaaagaggatgcacatggtatacctcacccatgacctctgtaataagctgcggtgatctttatatgcttcaccaactggtgaaaaatgggctcttttctgagaaaacagcccagtttcctcttaattttgttaattctgcaccttggtgctcgtgaagcaagagcactaagttcagatggtatgtgacatttcatagttatggttggtatttgtgtgctacatttgacaatctgtgctcatttattatgattcttttgacggtttcctacaggtgaagcacttcttgccttcaagaaggcagttacaacttctgatgggatatttctcaactggcgtgaacaagatgtggatccttgcaattggaagggtgttggatgtgactctcacaccaagagagtagtttgtctgtaagaccaaaataaaccctacataaatattgtgaaatgcttagaatttcaacctggctattattttgcttcagtaatatggttttcgtttttaagatggcattttctaataggaagggaatgataacttcatagcttccattgttataaatatatctgaccaccaatatcttttgtttaggattcttgcatatcacaagttagttgggcccatacctccagaaattggaaggttaaatcagttgcaagctctgtaagtgtgtgttgatagcgttctttgcttaacctctttcttttcagcatctgaaattactattttatgtcattagatcactgcaagggaatagcttgtatggctcactccctccagaattgggaaattgtaccaagttacaacaactgtaagtttctaagtattactgtttttccagcatttgtaacaccatgtcttgcaaaaaactattcataacattcatactgttatgcaattttaattgatgcaactttttacgttttgtgttctgacttgtgagatgaccagcaggtatctacaaggaaattatttaagtgggcatatcccttcagagtttggtgatctggtggaacttggtacactgtaagttttgggtggagtttctggttgctttttttaatcatttattacctcaatcaaccaatgtctttcctggctgtccatttcacatcagactgatctcccctgtctgattagttcaatctatgcatcagaaacgtaccatttcactgaaacaatcaacacaaaagttctgatataaaaattaagtgcactggattgcaaatgaattcgtttgtcaatttagaggattactcatatttctggaatatgtttttccccttcagggacttatccagcaatacgttgagcggatcgattccaccctctcttgataagctggccaagcttacatcattgtgagtgttttttatcttgataaatccattgaatttttatgctaactttgtgcggcaaattaaataagaaatttcacctgtgcagcaatgtttccatgaatttcctgacaggagcaataccatctgatggttcacttgtgaattttaatgaaacttcgtgagttatcttctctatgttgtttattcttgtctaattcaatatgtatatttgagcaagtagagtgggggatgtcatgtgatagagtgcttttgtttacctcttcatgatgcgctacactacatcacacttgtaatatatcatatgattttgcatgttgcaatgcagcttcatcgggaaccgtggtttatgtgggaagcagattaactcggtgtgcaaagatgcacttcagtcaccatcaaatggccctctgccaccttccgcaggtaccagatgtttctaaaactgtctacatacctttttttcatgcttcaaacattttttgtaaatagttaaatggttagcaagatttcaatgtttgtatttaatatttatccatcaatatcaatcatcagtatcagttgcttttatatttgactaggaaatatacttctgcagtttggggttctgtaaagtgtaaattgatccctttcttttcagttcctttcatgaacctatgacttatgttcttctgattatcatatggcagacgacttcatcaatagaagaaacgggaagaattctaccagacttgttataagtgcagtagcaacagtaggagctcttctgttggtcgctttgatgtgtttctggggttgctttctgtacaaaaattttggaaagaaagatattcatggtttcagggtggagctatgtggaggtaaccatgtcattgaatatgctatgtgaatcatcttcaatttatgcggtccttataatcttgcttgttttcttttaggctcttccattgtgatgttccacggggacctcccttactccactaaagaaatcctcaagaaactagagaccatggatgatgagaatatcattggagtagggggcttcgggacggtttataaacttgcaatggatgacggtaatgtttttgcattgaaaaggataatgaaaacaaatgaagggcttggtcagttctttgatagagaacttgagatactgggaagtgttaagcatcgttatttggtcaatctccgtggctattgcaattctccctcatcaaagctattgatatatgactatcttccaggtggaaacctagatgaggtgctacatggtgagcatgttcagttttctacttcctatttattttatttgtattgcattcttccaattgttaacagttttagtttgtcttcctcagtaaggagttaagtatgtgttcaaagcccaacattaaattaaggtttgaggtgattcagttaatggatatgaaagaacctagtggtgatggtggagtctgccattccaccaccacctctagggttggtgttatcttctaagggtgcatagatacttttatatgtgtggcttggctatcagtgtggattgatgctctcttgcaaattacatattcttccatgaggagtatacatataatttgaattttagaacataggatagtatagtactatagttacattcaatctacctattggaaagaggtacaagtacaacaatatcttaaggggcatactagctaatgtcagctagacacagaatgcaatagccaagtgggagatgaagactttagtatgtgaaaattgtgccactgtgggggcaacaaagttgttcatttttaagttcttgatcgtcccatttggctattttgtggcatgttcagacctccatgtgaattagcagctacagattccacgatggatattatttctgcctcttgtaacaaaaatggaatgctacttagtagtcgatgggcatgggacttcagctattatgtagtacgagtagagggttgtatataacatactaggacacaaggacagaagatgctgtctactcatggtgattccaattttacattggcagcgagtctgagaattatactttattactttaaatacagacctctgttcattcttcaattacatctggatctaaacaatcgagataagagtgaaaaccttaaccatgatattaccatttatattccatatgcttgtggaatatatgcattgaattttataacaacgtataattaggtcttacattagcagacttcactattttattttttaacatcaagtcctaatatctcatctatcttcaatcttgacagaaaaatctgaacagttggactgggatgcacgtattaacataatacttggagctgcaaaaggcctggcttatttgcatcatgattgttcacctcgaataatacatcgtgatattaaatcgagcaacatcttactagacggcaattttgaggctcgtgtatcagactttggactcgcaaagctattagaggacgacaaatcccatattactacaatagtgcaggaacatttggctatcttgcaccaggtatgttaaaactgttctgtttcattcattgtgggaaaataacagcatataacaaatgcttaccaccttattgcatctctggattttatttatcaatatataatttcatatgctctgagctaatttgcaaaattcaaaatccagagtatatgcaaagtggcagagccaccgaaaagactgacgtctacagttttggagttttgctacttgaaatactaagcggaaaacgacctactgatgcatcatttattgaaaagggattgaacattgttggatgggtatgtatgacctttatgtccttccatttcatatccacagttttctgatatgaattacgtatgccttcaattgatttaatgtattcttgaaataatctacttgctctgtggcagttgaatttcctggtcggtgagaatcgggagagggaaattgtcgatccatattgtgagggagtgcagattgagaccttggatgctctactttctcttgctaaacaatgtgtaagttctttgccagaggagcggcctacaatgcacagggtggtacagatgttggagtcggatgtaattacaccatgccccagtgatttctacgattcagaataggcttcgacttacggctgctcttgaaaacgccacactgccgctggttttcctgtggaggcacattccatttattctttgcagattatgtaaattcattcctgcggtgttcggctccaatcggctagctcaatggggaggacatttttgtgtctatgtatctatgctacgtacaaattattactactacatgtcaagttaataagaaacttaccaggagattactgtacttgtattgaactgtcaatctcggaagaatggaaatggtagggattagggatgccaagtttcctgaatctccatgagctgctgctagatatattaatatatttgagtataaccagctgaatttctcacgcattgtgcgtctcgcgatcgagaaaatatgcacttggaggcttcacatgtgctaatttcttaagacataagaatataagattcatatttacactaatcaaggtgaagaaaattgactaagtagagtagtagtagaacataatatagttcactttcataatgagacaacaggtttaaccgttttacatagcggagtagttcgagcggcaacaacacacttgaaaggaaccagagcacaccaaaaacaccagtaattacacctcacataagtgatcgatacacttgaagccacagataaatcgtttagattagcccaatgctctagccggtgatctggatggacttgacgtcgggcttcttgggctcctccttgggcacggtgacggtgagcacgccgttctccatggacgccttgatctgctccggcttggtgttctccggcagccggaacctgcggaggaacttgccgctgctgcgctccacgcggtgccacttgtccgtcttctcctcctgctccttgatgcgctcgccgctgatctggaggacgttgccgtcctccacctccaccttgacctcctccttcttcagccccggcacgtccgccttgaacacgtgcgcctccggcgtctccttccagtcgatgcgcgcgccggcgaaggccgcggtctcggaggaggtgccgcgggggaaggacgggaagatgctgccgctgcttctgctgccggagccgaaggggaagccgtcgaaggggtcccagaggtcgagggagaaggggtcgaacacgttgctgcggcggatcagcgacattgtgtattgtgtcttgctgttttttggttgtctggtttgtgttctagatggaaagagggtgatctcaattctccagaaaggctggtgatttttcgatcgaagaactgaattccttggcaccctggcggtgggtggtggcaacaatttatatagcagttcgtgatggtccatgggttctactggaagttttgcttccggatagttctcgtttgttcgttaatttgggccgaaattggaagtggtcttctggattgttctaggcctgcttatggcctagattattctggagagtcctggacgctatgggctacagcccaccccgctaccggtggtgtaaacttctagcccaagctatctcgtactaggttctagcccatgcgggggcaaactggaagtttctagaagcttattccaagctccacgatgccctctcgctgccctctataaaaccgcgctccccttcaccggcagaaccacgaagaaaacgcaaagcaaaccaagcaaacatcagagtaagaactcagagaagtccgatcgttccacctccaaattcgcagctattccgacgatgtcgatgatccgccgcagcaacgtgttcgaccccttctccctcgacctctgggaccccttcgacggcttccccttcggctccggcagcggcagcctcttccctcgcgccaactccgacgcggcggccttcgccggcgcgcggatcgactggaaggagacgcccgaggcgcacgtgttcaaggcggacgtgccggggctgaagaaggaggaggtcaaggtggaggttgaggacggcaacgtcctccagatcagcggcgagcgcatcaaggagcaggaggagaagacggacaagtggcaccgcgtggagcgcagcaacggcaagttcctccgcaggttccgcgtgcgggagacaacaaagccggagcagaacagggcgtcatgggagaacggcgtgctcaacgtccccgtgcccaaggaggagcccaagaagcccgacgtcaagtccatccaggttaccggctagtaagaaacttcgggtgtgacatgcacggtggagagcttcgattcgagccttcggtttgtgatcaattgcagtaaataaaagcgtcaaatctggtcctcagtgtttatgctgtgaaaaagttcaaagctatgttggaagtgagcaataaagacttttcttgttttgtgaacgaacctgagattatactagtcctacacttgtttgtttaatctaatctccggtatattctgccatttttatctcgatgtttcagtacttttagcctttggttcttgaatccttctgtcgagactggagagttcatttcggaaattgagagctcaatttccacataagtcccacaaatttcacttgtttcagcattttcacagcaatcgattcgattccaacagaagtcccaaaaatttcacttgtttcgaaagatgcctataggttttacgttttcagatcggactgagaaaaggcctataggatttccgttttcagatcagactaaaaaattattccaatgctaggccatgactgaactaaccaaatataacgaaattgctaatattgtgatttgcgattcgtacttcatgtgttttttcttcaactccaataacctcatttatttctacaacactgataacaacctaaactccggcaaataggtttgggtttaggttggggctgagagagaaggggaaggtggcttagagggatgattgtggaaggtgatggcccgacgatgtacagcgggatgagtgggtggcgaggcaacgacggcaccgccaaagccgtagggtcgataacatacggtgggtcagtgttaggggcaaagtagagcgacgggttaggagatggcgtggcaggggcacctcaccaccattggattgaggtgacaacagaggcagcgatgacgagagccattgagcgttgttcaaggacaaaggaacaaaagataaaagataaaaggattagggtttggatatctgcaccaatccgaaagcgatctaatggctcaaaaattataagaatttttaagtggtgttttctgtcaaatgtgtaatagaaagtctcaaatataaatatgaagctctgttatgattaaggagtttctacttctaataaatccataaaatagaacttttatttatgcgacggtggtagctcatgcagaacatgccatgatattcacaactattaaatctctgacgtataaaaagtggatactttgctatggacacaaacatcttagattttcagccaaaaaaacgcatggccgcatgtctaagggcaatcccactccgaaccttcaatcgaacaaataagggcatcatgtcacaacctgttatagatcaactaatatgagggtattgttctttagcacgagattgtttctagcgcactttctttttctcaaaactttgtttaaacttttttcatatgaaatgattttattgaaaaattcatctgaaaagttttacatgaaaactttcatgttacgaaagcacgtaggctaaatagcaaatccgactagggtaaatagatctaattgtcctaatcctgttccgggaccatgtgcagatggttcactctttgcccaagagaaggtggagcccaccatttggtccataaacggagattgagatcctctaccttcaaaggcaacatgccttatgtcactgacaaagacttcatccatcaccgccaccatccctcgcggcctcgccggcgatcaaatcgcctgcacggctggttccggtagccgttctccatcttggatgctcaagcgggcttggggtcctgaagaggcggcgccaattattttcttctcctccccttccgttctctctcgtggtcccacggcgttggcagaggccagggtgcctcaaccctcaagagtcaagaccctatgcgcctcgcgcagattgttggtgaaggggctcgtgtgcccctcttcctaatcccctgttgtattacttcttggtatttctgtgcagagattaatgatcattgcgctttcgttgggttgtggcaatggcattagtcttaacgctggataagtccatggtgatgcaggagaatgaatccgggaagtgtgccatgccatcagccaggtgcgtacattgttcttgccgcttcttcgtttgtccatacctttgtgattgcgttggtttatgttttgctaattcaccggcatagtattgtgacggtcgattcggattctgctattacgtctcttataagaagaaaatgggagagattcagcgtatattagttatgctggataataatcagaactgatccttctaaatcaaccgagctaccagaacaaccaatgttgtagaaccgaactggccactcccagtttccattccaaaaggctcaagaaaaactcaaacattggtacattaatcaagcttaaagtttatttccgtacataaacgcataggagacaaacacatttgggacccttggaggagaccacacattcataaacacatgatcatatcacacacattttggactgtgtccctcacgacacaagcaaagtaccaaaggaggagatcaattgcagcattgaggagaagcagcagaataaacaaacggggctctagccggagatctggatggacttgacgtcgggcttcttgggctcttccttgggcacggtgacggtgagcacgccattctccatggacgccttgatctgctccggcttggtgttctcggggaggcggaacctgcggaggaacttgccgctgctgcgctccacgcggtgccacttgtccgacttctcctcctgctccctgctgcgctcgccgctgatctgcaggatgttgccgtcgtccacctccaccttgacctcctccttcttcagccccggcacgtccgccttgaacacgtgcacctcgggcgtctccttccagtcgatgcgcgcgccggcgaaggccgccgcgtcggagttggcccgagggaagaggctgccgctgctgctgctgctgccgccggagccgaaggggaagccgtcgacgggatcccagaggtcgagggagaaggggtcgaacgcgttgccgcggcggatcagcgacatggttgacggatttgggcgagaaggaaggctgtgtttgtgaacactaaaacagtgtgtgcttgggaagcttgggatgtgagcacaagggatcgcgatttgcgagttgctttcgatctttgtctgggccgcagagcgggaggggaggccggatttatacgggctgtgggcggcgttgagaggtgggatcctgataattctcgtcagttcaagaatgcactggaaaacacctgatttggagcctggccgcctgggccgaatcatcgagtgccttccagaacttttggccctgtggatccaaacggcatgggactctggttacagatttacaattgccgatttccttctgccatgttaatatagaaattgccatgtatctattgtgaactatagttagatttgttcctatttctatttttaaaaaaatatttaaaacgaagaccttttaaattttggtaatatcaaaatttaacaaggcagcatactaaacatactattaccaatgcaaccatattttagtaattcgggaactttctactctagctactacacaatttagtaatgtgttaaaccaaacatcgtccacatccttaccttattatcttactactaaacttcgattctggtaaaattactaaaatttgataagttttttccaagtgaaaaatgaacaagtcctacatctcctctggcctatagcatagaaacccatcactcccaatttctactttgagtacgcctaagcggtcaaaaaaggagaccgttcacacgttttacaatgtaagcataaacttatatggtcatttcataataatcactaaccttttgtcgataaaaaaacatccccaaatcttagggcctgtttactttaatgccattttcaactataccattttttaataaagttgtcaaaaaaaagtatctacgtttagtttgttgccaaatttagtcaatacataagaaatcatgccaaaattttagcaatattgccatcttgccaaaattttggcattgctaaaatttggtaaggtttattttagctacaatctaaataggcccttatagttttgggtcactagatgtgctttgcgattcgtgctgtagacccttatcttgtagctctggtgatctccctttcttctctggcaccggtgacactgcaaactctagtggagtagcacggattagggccccgggggttgggtggcagtggaaggaggagggggaaaaggggatatccatgcgtttagatggatggaagtaggaggcggtggacacgagcaggcgacgaggcaacaatgacgacgctggagctgtggggatgaaagagagtggtatactg

SEQ ID NO: 82712 - DNA, 4174 bp, Oryza sativa
tcttttggcatcttatctcttgttcttgtccgtctttgagcctggatctcacttttgctcctgcatgctgttgcttttctcaaaaggcagaagcaccaatctttggcacctcctatgattagcatcagtgctgtactgaactttctgatgaaatgctttactcaatttatctacccaggcccggatttatcatatgtactctttctttttcttttttgttttttaaacaaagccagaatcactgtcttgtttcattgataaagaagagatacacatcgatctccaaatgcaccatcttacaagcacctcaagaacattttccaaagctacactaaaacacctgaaaacaccaaaatttatcatatgtactattctagttgtcttctattcttgaaaccagtataatcaattacagcatggaaggcatcaatctgaatgtgaactttcactcgtagctgagttcactcattgcacctccaatacatgtacaagccttccatcacatcacatgtgttctttgatgtgaaacctgcactttcaagggagcatagctctgaacattttgccctgtttgtgatcagagtgagtgtactataaacccaggtaaaaacataaagtgtctatcatcaagcacagcatgtgaaggcgaatattcagtcgccactaatccctgtcccccaagcgtattgcacggatgcagttcgttaacgcttctgttgttccattacatttggcgtcattgcgacgctgaaaacattctctgaattttctgaaacattttgcgaatgttgcatatgcctgaccaacctctttgtgtacttcagtactagcttgtaccattaactatatatctggttgtattaggtccaaattaacattttttaggtgaacatgtaattaactttgttatccttgcaataccacctctaggctacaactttggatgcatctgatggcagcgagaaaagtgtctcctggctggcgtagtaccctacatggatccgattctctaggcgtgttgggcgttggttatactgatcgaataagtactttgcatcatcgttagcttggctgaaaacgacatccatccactggctttggtttgggtagtgttgggttgggttggggtcgttcagagtttcagatggtcctagcaaagaataaagtaagcaatgaaccctcaatattgtacactctagcatgttctttttcgattaagatacaattttatcttgatttccgttaaaacgtcttttaaactgtaaaacgatgtattttgtgcaaaaactttctatatagagattgctttaaaaaatagataaactcaattaataacgtgctaatagctttcttgttttgtatgttaccttgcaaatagaggattttataatgcacagttatgggcagaatatacacatttcctaccatcatacgttattttcaatcaaaaagaaaaataataaaacatgagaaagaaagaaattgcaagaagaaactaaagagaaaaataaacaattaatcgagcagctatatagcttctagatatatctatatatattagtagtatataagtaacactatatgtagactatagtatgcactagatagtagtagttgctatgaactgtagcatcgtagaaaccaggccagcgtcctggcgctgtcattgctctgagaagacgatttcttctcccagtttgcagcgattcccttcttgttttcctcatgcttcttcttgtgttgcttcctcttcttcttggtgtgcaccatcgtccctctcactgtcacctccttcttcccaaaatccaccatgtaatctagcaaccctgctaattaatcaaacagatggaaaatatcaacaacagatgcagtaattaactgacagtaacactagcagtgatcagcatgctattcacaaacagttcaaacatgatatctctgtatctccatgcatgtttctgtcggtgcaatttaaccttaaacttaacgagttctcaggactgaagctatgtatgtgatgtatttatcgggtcttcagatttgatgtgacccatcgatgctctcttgtcgatctcatagaactttcacaagggttattagattctcaccgttcatcttggagacaacctttgtgacccgctgtcggcagtgcgaacagcccatgttggcgctcatcaccaccacctgcacctgcagttttcagttccatttcacacaattaatcccactagcagcctccataaataccatcaattcttcattatcatcttctgtatttgcattgcttctaagtaatcaggaagttaattaagggaccactctgcaataatcagctatgtataaccacttattgatctactaattaattaaattataccactactttattagtgggttaggctggtcttacactatcactgttgatgagactcactaattaaaagactagttagagcgactacgtgttgccaatggatacatgtgtggtctcactctcacttaaccattaatctccatctttcgctaattggcaccttgacaatatgaaggtggtcctctcctgtcctctaaaaaccacatgagagccactattgacctgcattgttaaattcctcatctgttcttgttcagtttgctatgggcatacatacagttttaaatttctgtccctgcttctatgggatgcatgcataaatactacatgcctacatgatatgctaatataattaatccgagcacattgcacatagattattatgtagtacttgtgcatcacgtgtagtccctactctaccgttgtgatcatcagtctgcaggcttaattacctgcatggtgggcaacagcatgtggcctctcataccctatggtcgggtggccaaaatcattgacatccatagatagctagtcgaggcagcaagtaattaatttatttactaatccgatgggaatcttactaatatatttcttcttagctgtaatctaagggtgtacgacatccatgccaagcaattccagtattctacctatataagtagtaaaatacatgaggttggaaatgtgaacttctctactgtaaaaagaaatagtaaaaatgcaggaactaatacacgtatagataaagattggtcagagctgtacactctggcttagctatgaaacggtcactaatttgcacggaccagtataaaatccgtgcacgtcagcacgtgcatgtggtcaaaatatacgtagctgttactggcatttagcatgttaattattacgataacgatggatgaatggatgaaatggatgtattgcctataattattagttaattccgtatacatgtactctaggtcaaataaaacgtattgtgccacatgtgccgaatttgactagagatacagagtacgtatgtgagaatagatcttttcttaatgtaaatataagtacagctgtacgcacgcatgaagaaagacagactaagtatttttgctatgccaatggatgctacaatcgatggattctgatcggacggtcgaaagagaaggtgaaaaacaacaggtagaagttattctttgttctaaatatttctttatgattctttttctagagtaaacggctccatcccttgtgaggataggagaccacgtgactgccaggtacttggtcaaaaaaactcagaaaaattcaggctttgttttgcactgcatcccattaccaagagacagccatttagatgtagatagttaattagaaaatggatttaattaatgagatcattcttttttttttgaggggttaatgagatcattctgatctcagcagttttgttcctgctcctagctagaagaaaactctgtagctactgcagtgcaattgtttggttgattgatagtccctttttaacctttaggctaaaagcctgaaagttgagaggtactaaaaagtgactgagaaataggggcccagtatccgaggagataaactatggtcgtcactcatcacacacatctcaatgtgcaggggacacaggatgtaatggcaagacaaaaggcagtaaacaacagctgacattggaggtgctgatgcattgagaaagggaaagagattctggtaggaattctgtcattgcctattgctatgcatgcatgcaccagggagggagaagaacatggggttctggaaaag

SEQ ID NO: 82713 - DNA, 2030 bp, Oryza sativa
gaaatgctcaagaagaaaatggtaagaagtaaagattcaagaacattgctggttgctgctatacattgtcagcctgtcatgtgcaatgctatttatgtcctattgattgacatggttagtggtatgacatgattatttggcctaatgaacatgcttgttatgagacgacattagctgtactagattaacttcttgctaattttctttgccgtagttatgattcgccagtagaatgacactgattttctatggcctcttagttggatgagataaaaagagatgagtatgatgagattaatttcttgcctgtttctgctggatgccaaaattgcaagctttgattcccgatttaatggcggcgatggccgcagataaatcccagcttggtggatccctctcgatcgatcgagttccgggaggcagcagcagcagcagcaatgtcgggcgccgccaacgcgacctcgccggcggcgggcgccggcacgccgcggtcgcggctgccgcggtggacgcggcacgagacgctggtgctgctccaggcgaggcgcgccatggagcaccgcgggcggcggtcgccgcagccggtgaggctcaagtgggcggcggtgtcgacctactgccgccgccacggcgtcgagcgcgggcccatgcagtgccgcaagcgctggggcaacctctcctgggacctcaagaagatcgtcgcctgggagaagaacctcgccgccgtcgtctccggcgccggtgacaacgctgtcgccgccggcgaaggcgaaggggaggcgccgccgccgccgcggctcgagtcgttctgggacatgcgcggcgagcagcggcgcgcgaggcagctgccgtcgtcgttcgaccgggaggtctacgacgcgctcgtcggcggccacggcgccgcgccgccgtcagacttcggcgaggacctcgccgacggcgacggcgtggacgccgacgagctgccgccgccgccgctcatggtcatgcccatatcaggtcagaacaccacccccacttgtccatttgtatttttctacaaaaagaatgcgtacatttgtacacttcacactacgtattgtacgtattatctgcgtgtatatacggtagttgatacgtttggcttgcactgtcttgtacgcagcgaggaagtacgtgccacctactgcttcatctcaacaggaatgctctgatccaggtgtcattttgcacgcatttttgtccatcaaattttatcatgttcatagaccaatcatgtactacctccgtttctaaaatataaacatttttcaactctgacatgatttccaaaatactactttaaccataatacatataaaagtaagatattttaaataaaaagtgttgcatattataatagttttttttacacgacagaattttttttattattaattgttaaagttaaaaatatttgacacgttactatattaaaataatgattatattttaggaattttcaaactaaaatccaattcaaatggctcctttttaaactaatcctattcataattattggtgtctatgtttctagctacggtgagcgccaagagaggcggcgcggcgtcagacaagaactcgacgtcgcagcatgacggcggcggcggcggcggcctgaaggacagcgaggcgacgtacggcgccggcgtcggaggggaggagggcacgacaacggcgacggcgacggcgacgacgacgagcatcgggaggcaggtgatcgaggccctggagagagggaaccggatgctgggcgaccagctggaggcgcagcgcgcggcgtgggacgccgagagggagcagagggtggcgctcctcgccgccgtcgacaagctcgccggcgccgtctgccggatcgccgataagctctgactgagcaaccgcaaatccatacgctactactatactagcatgtaaaatactctcattaaaggttcagatcaggttacagattatactgtttcagttaaccatgatgaactgcgtttcaatgaaattgtgtggtttctagg

SEQ ID NO: 82714 - DNA, 582 bp, Oryza sativa
gtcctgtttgggcgggttgatgacgaaggagaagccggtggtgaagctggcaacctcgccggtggcggcgtcccagagagggaccggaagggcgtacgacaccctgccacggctgtcttcgatgctgccgtgcctgttggcgctgatgtcgacccacccgccgccgtcgccgctgaaggagaagtcggcgctgaaggcggcgtcgccttccagcctgatgttcgtctgctcgtccgggccgaagttggtgtggttgaaggtcaaggccaaggcgactggagccggcgagtagagatcgtcgcagaagacggagaagaagaagatgaggccgacaatattgtacctcgtggtggtcgtcgacgatgtgatctgcaaaacgccggccatcgatggccgccgtgttgtgttccctccccgttgattgatcgagtcaatgcgtacactgtttgcagtggcagtagtgtggagacatgatgatgaattttagaagaaaggtaagggtggcccatcaggaaagcacatggatacttccttttccttcttcgttccacacgtgcgacagcctgtgaataactaacaact

SEQ ID NO: 82715 - DNA, 1836 bp, Oryza sativa
tagtggtcgttaataccagtctcccgtcacaggtaagtcaccaccgtcgcatagaacccacctgaccgccgcagatgactcatctctgacgggttgtaacttacgacccgtcactgatgacaaagcaagaaatacaatttttgaattttaaacgcaacaaaaaacctcaaaaaaatattttgaattttactagccatcctatacatggttacacatcactacctacaaattcacaatttttcacgcaatataacttggatgctacaagtgagattcgaactcaagacctcaacctccatatagagctcccttaccaactcacctacttaacacatattgactactaacccaatgttattattttgtctatgcttgtctgaatcatttaacatatatttaacaccctaaatgacttcaaatgaaaatattatcaactaaatagttatagatctcatcgtgttttataacttttacatagaaaatatcttcatccgatgttgtttgaagaattcaaaatttcatttttcaaaatatatctcactttataacatgtaaattttgtgaaatgaaaatattttcaattataatgttgtagatctgattgagttctatgactttgatacggggcatgtatccatccatgtcatttgaaaaaaaactcaaaattttgtttttaaaagtagatctgatcacttgtaatgcatgttcggggatgtaaatgatctctaatagaaatgttgttagttataaagttgtggatatcattaagagctacaacttttatataggacatgtttcaatccgaggtttttttgcaaaatttaaaaatttgaattttcactcatcactgacgggtcataactaccacccgtcagagataacgttatctgtgacgtgtgttagttaaaagacccgtcagagatgagtggtctcttttgtgatggttcataatactacacccgtcacagatgacatgtcatgtgtgacgagccatggttgtgacccgtcacagacgatctgtgacgggttacaagtgcaagccgtcacagatgacttcacatctgtgacgggtcctccctggtagccatatattgaagaggatattttttcggcccgtcagagatgactcatctttgacgagttgcgttggcccgtcacagatgacccgtcactgaagcccggatctgtagtagtgtgaaccgcccgcggtgttcgtccagttgccggtgtggaacaccgcgccgaggtaggggatgtccggcgagatggggacctggcaacaacccgtcccggtgcacggcgcgccgtcggcgtgagctcggcgcagtaggtgaagcagcccgtggcgtacaggtcgtcggcggcggcgccgcgcgggagaagacgaacgtggccgttggtggacggggaggtggccgatgacgcgtagcaggcgtagctgaggccggcgtagagccgcgagctgccgtgctcgccgagagaaggggggagagagagagagagagaggggaagaggagaaggaggaggtgagatgacaggtgggccccaccatttttttaaaaaaaaaggaaatgctgactggattgccacgtgtacgtcacgtaggataaaaccgctttggattgtgccagtgggggtaattcgtccggtattgaaagttcgaggtgagtgatgtctggttttcagatttagggggtaattcggtcgaccgcgatagtttaggggggtaattcatactttttccttagatattctattataaaatttaaagttatgtttcctcaaaattgttgcgatttcattaaccaaaaagttatagactaaagtgcatattt

SEQ ID NO: 82716 - DNA, 685 bp, Oryza sativa
cctctggtttatattataagtcgctttgatttttcctcatcaaacttaatcaagtttgatcaactttatagaaaaatttagtaacatctaaaataccaaattagtttcattaaatctaacattgaatatattattttgataatatatatgttttgcgttgaaaatgctactgtgtttctttaataaacttagtcaaattaaaaaaagtttgactagaaaaaaatcaaaatgaattataatatgaaaaggggagtagtaatattgtggagagtatggttactaagtgtacacacggtctacacatccgattacagataggtggtgagctatatgatataataggccagtgatagagtaggaccggtcgtcatgttgccttctatcctaaggttgtgttcggcactctgtttttccaactctcccctctcgttttcggcgtgtacgtttttcaaactgctaaacagtgtgttttttgcaaaaagtttctatatgaaagttgcttaaaaaatcaaattaatcctttttgaaaaaaatagctaatgcttaattaatcacgcgctaatggaccgctccgttttccgtgcatactgttccggttgggaaccagagatgccgaacatagcctaaaggtagtgtatagagctccaattggagacccgtgtaatagattagaaaaccgaagtca

SEQ ID NO: 82717 - DNA, 2674 bp, Oryza sativa
acagcttattaattattatggctgagagcctgtcagcctgagactgatggagagtggccggtggtcgccttagtggcagctgtccatctcttccatcacgcatgcaggggtcagattattccacccgcatttctttgcaatgtcctcgatgcagattggcggaaccaccaatccaggatagtggaatgcaatcagagatgtccagattttgtcgtcactaaggtcgtcatcccggcctgttaacacaatacaaacagaattaattagcgcatgcatgcacaagtaattaattaggaatagaagcgctaacacaatacaaacatgcacaagtaattactactaattaggaagagagaatcaagctcagctagattgtgagaaaacatgagatggatggatggatttacctccccgggtttcggtagcggaagtaatagttggacagataacaagaactaaaataagaacacctgctatcttcgtcatcttggtcgatttcatccgatcctttgctcctcctccgtataaataggctccagcccatgtgacgtgagtataataattaatataatgtatgcgaattttgctcaatatcctcttcaacgtcttactatgtttttggaatttggacgtgactacacggtaattaagtgtgcacatgacccgttcgcggcagcctccgacaacaagattttctccttccactagtaacgtgtactcctactccggccactaatcatgcatgagcggcatgacagaaatgtcacattcagagcagtgtgattaaagcgaatgcatgtctttctgtccacctgcttgtgcaagcaactgttagctaatcccctcctccactttactgtctgtgtgctcatgcagattggtttaaccctatagctaatataattaattaactaggcatgaaagtaaaaccaattaggaaacagcagagaaaatgtgacctggtgtaaacgtacatctatatctatctatcatatactaaaagttcattaaattaacttcctacaaaaactcccaagccgccatgtggtctcctacaaacgctcgtaaaccgccacatggtgttctaataaattaggaaaaaaaaatcggtggacctactaattttacccattagatctccatctcaaagaaaaaaaatcaggtatacccaccacgatactcccctccacatgtggaatcgtatgtcctcactaatccccacgtatacgagttctacatacaaaccactatccaccgatcgctaataagtcatattgcttacaagacatttcatgcacaatgtacctaatataagaatcagctgatatccaatgagcatgcatgcatgtcatctagcaccaaagataaagaacgatactccgcgagtaacatcaacaactgataggtaggtagagtatgccaccaagctacaaccaacagtagttgactacaagtaaactgagactattagtagtagtgttccgacaaaatacacctaagttgtcacgtgactctaataaattactccctccgttccaaaatataaggcacaaccaacattaacccaaagataaagaaatagttattatcatcttgtagtttggatcatcctaataaatataatgcatgcatccaatagaattagagaatgtgagagtgaattgtttaaaaaattaataatttaatgaagaagatgtcataattaattgaatgcatgccttatattatggaacatataaagaaagtggttgtacattatattatagaaccgagggagtaattgttctataaatataataaataaaataaaacaactgatcattggtttccacttaaatcgatggaccaagatatggttcgatcatcggaggcgttttagtttatatggttagggaattcatgttcatatatacatgttttagtttatctgcagctgggtagtaaaaggctagtggtagctaagcagcctagcagaagtgcagagaacaaatgtaatttgatcagtttcactctcatccagctgagaaccgaacgtctccgataaattaagaagacagttcaagtcaaaaggagcgaggaaattagggcaaaagttgatgctagtgaatctgaaatctgtttacacccaaatttgacacctatagacgaaataggggaaaattgccaaagtttggaaagtgacgggtttccttcacagggccggtcagaccacaggtgtgtgggcggtctgaccggctagtagggccggtctgaccgcaggtatgtgggcggtcagaccggcagggtccgagtccgagtctgttttcgtcgggtctcgggtttccttgctcgggaaggcatgtttcgtgtttcctttggtttctatcccgagttggacatggagaagggcctgtagagggcaagaccaacccctatttaagcgacaaggccggttcattgtaaaaccccccaaatacaatctacttgaatcgttcttttactatgtttttctattttactctagtttagtctatctttgtcggtttgcgccgtaaaccgtccgccgccgctgcgagagtgcgacacctctttttaggtttgtcctgaaaaccttccattttgcccacgagacgggtagtatcctatatcgatctaaatcggcctagaggctgattttgatctctaaatcggctct

SEQ ID NO: 82718 - DNA, 671 bp, Oryza sativa
ataaataagggggataagaaaatcgcaaagaaaaatcggtttggaataaaagattgatttagtagtagcattttgtcaaaacatctttgggcaataggagcatcaccgatttgttatctttctcttttctactgttgcaaatccaacaaagaattgtgaaagcaattataattattttttttttaaaaaaaagatggcgtagagttttctcaaatttttacaagctttacttcacaaagcacatgacttatcagctatagccagaagatcgcatgattgaaactgatttattctagagagtaataggcaatcatagaaccatccatgacatgcaatcggcaaccaacagatgatggtctatcactcctccatatgttcatctccagcatattcgtgtacagcttgtaatgtacagtcaatagtggcaccttttatagcatgtgtacatgccaacctacaaacagaaagatgaaaaggaacattcagcaacgcgcaaaaaaagatccattttttattcatacagtttgaaaacttttgaatttttacctagcataagaatctttttatatgggtcaagctttaaaccaccagtgttatagtactacctatagctaagatataggtatacttcaatagtcctaattaaacttaattcggtaaaaatctacata

SEQ ID NO: 82719 - DNA, 676 bp, Oryza sativa
cacgttggattacgccagagtgccattgctaggggcccgtacgccgtcatcaagactggccgtgattctttctcttcatcaagccgaggtcgttgtgccgtttgtccgcgacgctttcacttcatcatgctggagttgttcgtgatgtcacgtgaacatcacgtcggagcaccactgcttggtgcctataaaccatcgtcaagccggagtcgtcgtgccgtccgtccgtgacgtctccttctctctacaccgcatgatgagatgccatctgtctacgatgctttcacttcatcatgccaagatgagatattgtctgtccgtgatgctctccctcttcgtcgagatcaacgacgctgtattggagcgtcgctcgtccacatcaacataaagcaagaatggtgccgtttgtgatgtcagggaaccgttcatgccagatctacaccaataatttcctcgaccgttctgccgacaaggcatttacttctacaaaggtcgccgttgctaccggcaccctcatagagccccttttatgggctcgtcgtcatatcaactggatcaatagtagatccatcatccgaaggatgtgctatataagccacgttcgtccggctgctgtctgcactgacttcttcatcaacaccttcattacaaatccctgttgtatagggacatgacg

SEQ ID NO: 82720 - DNA, 567 bp, Oryza sativa
agttaaatcgatggaacgtcacgtcaataacattcttatacaaattgtcttataagatggtatttattgtaacttcattaatcgcaacttgataaattagattcctatcaatgacacaccttagaatttcttactgattttgtgttttcaatgttttctttactggttcgatatatgccactcaagaaaagtgaaaataaaaaggcaaaaactctatgtgtgtttgatatgacaacatatagttttgccttctaaatgtatccgcaaaccttgatggtatgttttgaatttaagtacattgcgatttgggtcacctttttattaccaacaatcgtagcattgtgtttgtgtttaacggatgaacgatctggatgcaactaaatatggatgatggacaaaaaaagtgatgtaatgaatgaaaaatatatgtatttcctaagtatgtgagatttcacaaatatgatttgagacttttactttgtcgcataaatatttcaaatggtttgcagggaacatatgacgatagttcaatgcatatgcaaagaaataacaaacatttgaaacttt

SEQ ID NO: 82721 - DNA, 2703 bp, Oryza sativa
gggagtggcggcgatagaaggagtgaacggccggcgtcagtggtgggagcgagcggatccaccgtccccgcccgcgtgagtggcggtggcgcacggatccgtcgtccccatcctcaggagcgacgggcgacaagcgatgggaatggatggatccactgtccccaccctaggaagcgatggtggcgcgtggatccgccgtccccgctctagccaggggcggagctagaacgaaacggaggtatagctgattcggttttaacgcttaatttactctattttagatcgagtttaagctgattcgggtgtctatgtttgtattgaggggggtgcacacatgataaaaataggtgaggtatagctaaatttttttcttggccggtttcctagacactcctctaatatactatgcctccgcccctagctctcgggagcgattgcggtgggtagtggcagcgcaacgatgacgactagtgttgacggctgctctgacgacgatggcagtggcagctgctctgacgacgacggcggtagcggctagggtttcgggtgattttgattttctggatttcttttaactgaaactattttcgtgtgcggtcggtaaatgtgaccgcatgcgaaaatcacgtttacgcatgcggttgcactaaccgcatggaaatttagcgattttaattcacagaaacctaggtgtagatgggccagaggcctgtttgtgaaaatttgttttggccgtctggagaaattatttatgtactagtgtaggcctactttggaacaaaggacttttagagaatttgtacagaaattaaattgattcctataaatttcgtgtggtcaattggaaaggagccggccttaagctaagttgatttgtttttttttaataaaaaaactaagttgattggatatgtgcagcactggagcattgacctagctcctgcaggtagaaacaaagaaaacaaaacaaggatggatcgatgctagccatctttccccttctctttttacgaggaaatctactttttgggcgcacttgagagatcggagggatggccgaccaaagtgtgtactgcagccaaagtttgatggatggaacaccatacataccatgagatgtacgtatcaaataatgcactttttctcacgtttggatagaaagaaaagggtgggtatggacagtgtgctgatgggtacgataagtgctcttttgtttttgtcagaaaaaaaaatccaccgaacgtcgagagttttttgagaagttaataaattaaaggttatgtgtgtggtgtatatatatatgtgtgtagtcatatatagtgacggctgcatgcatttgcaaagcgcggaaggagtagcttttcagtcaggtgaggttccaaaagaagatagatatacggttctttttacaatcttgcatgagagttaccgttacctcagcgtcgtactatctccggtcactaatatttgattatttaatttgatgtcaaccggattttattcctactagttacttcctccctcccagaaacagtccattcctagcatccctaggtgaaactagtggagagtgaaaatgactaaaatacccttaatcattaaaaaaatagtaagagtgatatgtaggtaaagagtattgaagcaataaaatttctcgttttacgtgctgagagtaggtagaagggtaaaagttggtttttttggaacaaaattcaaactctagaagttgagtttttttggacggagggaataggtgttacccgatcgacatcaaatattaatgactagaggaagtatacaatatatctttgagttatgtcttaattataagccgtggccatattaattcttaacttttcaaattaatttacttatttttatattgtttttgccacaatatggattttggaccatcatactttaagatcatttttcattgtatcgtgtgtcttcagcatataaagcgcaaaatggaatgccttcgaaagtaggcccatcatcacctgcttagtaccttctaaattctaataaagaacaatagaaatggagaacagggaattgtggattttgtccatcaatagctactacaaatgttcggccataaaattcacggatgttatgtagcaaccggatgaccggcgatggttgccaattgagagatctcctattcggtcttttttttatttcatccttcggtcaagattcaatggttcaaaccaactcctatagacatatataaaaagagataactattacagtcgtcagtcgcatcacaccaatctcattgtctgactcctcctatgtgccggtcactacttaaaaaatggtttttccaagcggccaaaactgatctttgcatgcggttgaccactcccagcaatttctccttctcccacaactcactatgctgaatccgtcattgcagcctaaccactctgtgccttcttccccatcttcaacgatgttcctcttaataccgatctctccgtcccctgtaattcctattactggatccacggcccccgctatcgtcgctcatcatcctcctccatcactttggctttggaaatgcctcacttctatctgtatcagcttatcgtcgagccatagctgcctcgatcttcctctaaacccgagggagtcccctcttccctcttccccaaccctgattcctactccctccgtcccataatataagggatt

SEQ ID NO: 82722 - DNA, 3758 bp, Oryza sativa
tattgtaggacggagggagtaactattaggggccaccgccacattatgggcctattcactttaatgtcattttcaaccttaccaaattttggtaaagttaccaaaaaaaatagttacatttagtttgttaccaaattttgataactatataagaaagactgctaaaattttagcatagttaccaagcaacttgccaaaattttagcaatgacaaaatttgataaggtttttttttatcaaagtgaacaggccctatattctcgtggtagaagggttgccactatacgagtcgctagagctggatcgaggagcctgacgcacaaatcttcaagccaatcaaacggtccgaaattctccttcgttgaaaccatgccacgctctactctcgactgctttccgtgtggaactcctaggttgtcagtcataactccagtactgcaaattttggctgtttgaagggtcatatcaaaggaacaatccatccattcagtcaatcgatccatggcctgtgtgtaccagtaggcgtgaagcagctggatagctaggtggccatgtgtgtgagtatcagacaacccagcaacgtgactccacacttgccgatcctgcaccgtccttttctccatctccaacgccttcccccttctgtccatgtcgctgcctctctctagatctctgaccgaggctagagtagctactatctccgtcccaaaataagtatagctgtggatatctgtacctaacgtttgaccgtccgtcttatttgaaaaatttgtgaaaaaattaaaaatatttagtcacacataaagtactattcatattttatcatctaatagcaatgaaaatactaatcataaaaaaattttaaataagacgacgggtcaatcgttgaacacgtgaatagtcaaaactgcacttatttgggacagagggagtacctagctagccacctgcacacatatttcatgcaggtcggccatagatcgaacaggagagagagagagatcgggcggggaagttgtgatccggttatgacatgtctaatcgccagcttccaggtcttgttgtgaaatgttcggcgaggaaagctacgtgtatttataaaagatcaattttagtcagggtgtgtttagttcacgttaaaataaaagtttagttaaaattgaaacgatgacggaaaagttgaaagtttgtgtgtagaaaagttttaatgtgatggaaaagttgaaagtttgaagaaaaaatctacaactaaacacggccaaaggtgtaaagcataaaaagatttcttgtacagtatatatgtcctaaaattttagccgatcacttctatatggccctactattttctcacttcctttatattactactgaatttcggtttaatcccttacatgccaattccgttacttgacagttgatcatttaatgcttatgatttatgaaaatgtctattttacccttagacatagaagaaacataaaatttgtgtataacattattggaagtgtagaaaacttactacatgaaactattatattgatgagtttgtgtgaggtacgagtattattcatgccaatttatttttagataatgataaaatttagtaatatttatttttattaattaaaagagtatattagcgtatttcggtgatggtagtataacaaatttgccacctgttgtatgtattatctaaaaaaagttaaactaaactaattattatgtttactgtctaaagatacactacacttactatttttaatatatattaaattttgtatgtataatacttcctcaaacaactactttttggtagactcacaaatttctatgttccttccatatccgagggtaaaactaaattttttacggtcaactaaatggtcaattaacaaaaaaaagtatgtgtgtgtgtgtgtctctctctctctctctctctctctatatatatatatatatatatatatatatatatatatatatgcttcggacaaaaaacactgttcaaaaacactatttagtttactgtttaaattactgttcaatactgttcacttcgagagatattttaactttaggatctttgcagggtggcgaatcctatttagacagcctcagaagcttgtttcagatgatgtaaagtcctactcggtactcaccgtatgcctcacctatctatctttttagaagcaacttaaaaagatattccaagtcacacttgttctagctaagagtttatcgtctccccaggcagttccacccgaagggaacacttctctacggataccgattctccagacgcctatgcaagatgcaggctaaaaacgagaacaaaccgaagaggtttctcctatagggtccttagcataaacacttgtctagaacaaacgtgtaggaatacttaaggaaaattacttcatattaaacagataagcttacatacggttttccctttcgggaaacccgaaggtaggtacaagcaagctgttcttaccttacacagcgttataacacaactcattgcttcaatatactatgcaaggtaggctaaagtcactactactaagaatggtggaatggagggtgagagcgcgcttggaagctttgctctgaatggtgtcttcgttgttcttctcagctgagcaaacccctccttttataggagctcgggaggctcgactgtgcttcaagcttatcttctagatactgtattttcacgagctggctcgcaccatggagatgcttatcttctttttggctttactttgtccttgaattggccaaggtggagacacctctgtacctgcgcctttcttttccgccgaaagcaatattctccacagtatttttaacagtcaaatgtcattcactgtccttgcattttggattgattcaaattcaattcatactttggtcattcgcccaaagaatggatatttattatcaatttatattatattgctttattggtcaggctgcccatgaccacctaaatccatagtatctacatcagaaaaggagacttcaaatttttcatcatatgcttttttcatttcttcaaatttgtcattcatttctttctttaattctttaagtatttcttctttcaattcttttttaatttggggggatgcttcttcaaatttttcaattattttccaatcgatatattcgccatccaaaggatctactcccttagtcaagcattccttatacgtaggtttttgggatgatccttcattcttaatatttgaacaatatgggttctctggagctttcttatttttggcttttttgcatttttgtatatattcttttgctgctggttccaagtagtagtttattcctaatatttttctggcctgagttaaagcttcatcaaaatctatatattttttccatgacaatccacccattaattttgcatctattttttgggctactatctcttcaaaagatatgtacactccaggaagctttccgtcaaaaacaacatatatgggtttttgtggtattacttcattattttctgatgttggcattatatcattcattagatggaaatattcagcaagactgtttaatattgatagcatatagcctttttcttccctcttattattgtattgataccagaaattatctaaaatgcattcttggacttcatctaatattatgtgggtttttggcttaaacttataggtattcggtgggaatactttgagcttattgtcttctccaaacgtgaagaactcaac

SEQ ID NO: 82723 - DNA, 3492 bp, Oryza sativa
cacaagcttgttttagacatatactacaagtcactctattttcttgactagggtaatatatgcaaaaagcacatttgatattatagtcaccctttcctctaatccaatcatgttcacaatttaattgatccatcatttcaacctttagacctgctaattcgtcaattaaatctaactcttcatcggatgattcatattcttcgttgatagtttcaacttcgtctgtttctatgatagaatatattgattcgtcatcttttatttcatcatcacaaactaatatgttttcgtttacgctatctataattagaaccctctcttgttcttcatatttactagaatatctcttttgatctttatttgggcatgttctacttaaatgatctggcgagttgcatataaaacacctgcatgttttgtcataggttttctttggattatatcttcttacatttcttttatgtaagaagggtgctctattatctgatcttcttaagaaataccttttctttgttctaatattattatggtttctattttgatgtttataaatccttttacttctaggcttgtcttctccatatgacaagggtatttgaactattttattgcagaaattgtaatccgagtgtttcatagatctttgggcttggatacccgtgcatatttttattagttgcttaaacacaaaagttatagcttgagagatattgatttcaactccttcagtttcctttttatattcttcaaatatcatacttcctagtgggtcaggtaatttattgaagtaacgttcaactattcccctgttatatccttgtttagcagttgtagcattatataaataatgttgggagaattcttttatgcctttccaacttgttaacgttaatttttctatttcttttaacctttcattttgcaaagttgtataacctaattccggatcttcagctataataatgttagatataacatttgcaaaattatgcggattgctaccagctcttttcaattcttcataattattaggattcttttcaacccattgttcccatagaaccttagcagattcacctaaaaatgtttctaagtaggttatcatatcttcaactttacttcctatattgtgttggttttgtatatatttttgaactattaaacctttccaaatactaataatattaggccaatcaatagggtcatgtgcggctaaatttaatatagcaccatcactcctctggttttgaaatttaacaggcttctcaaagtctcttctctttgtacccatatgcctatattgacctggtatatagttatatgaaaattcttctctatcagggggccattttcctgctgccctagctggtctttctctttctccttcgtttttcacagtaccttctccatatctttttctctttcctgttcctaagtccacttccatagcttccattgcattatcaagattatgtaaccctacttcatctaatgtgtttataaaatcattatattgttctgcattgtctatttcattttttatgttctccatctcatttattagattaatttcttcttcataactttcaagaaataatctttcattctctgcccattgctcttcttcacttaaaattttaccaagattttgctcttctttaccatgcttatcttgctctttcctctttatctgttctatcttggtttcttggtttttaaaaatttctactgccatatcttcgttcttctttactttctttactctagctaattctctatagaaataaagttctttatctcttattttaggccactcacacttcatagagttattatattcttcatttatttcctttaatttattttcgtaatattttatctcactttcttgatctaatttttccataaactctgaaacactatgtcttctattatctattatatttctatcatatgcttatgtttctaagtcatctgtggttctgggtttgtaatttataaatctaatgctggtatttcctttactattttgataacttatataattttcaggctgactcaaagttttgctttcaattaaatcactaattttccattcttctcctgccctttcttcagaacttatttttaaagggctcatgacagttattcccttagagtgcatattttcaatcacgtcatttacatttattttgtatttggaggcacttctattagttaatcttcctataaattctatgcttactagcaaatttgttcctttaaattcctcgtatccctttgtttgaaaaccaaaactcattttatctataaattcttttataggcatcattagatctggggctatatatgttatcaacatattctcattcatgtcaccttctaaaaatcctaatgctgctttatctattgtgtcccaccttttatctaacagagttattagaactttagctcctaatttctttcttgtcatacctttgattcctattatatacataccttggtgaatatatttataccctgaatactttaatccattttcaaattccttggctacaatttttagctcaactggctttgttaaaacgcttaactctacttctctagatattctgtataacccatttttattctcaaaaaatcccatgcaatatatttgttgaggtcttattgccctcagagtatctctttgatatctttcgagctgtttgtctacttctgcaatatcttcaagctcatctatgtcttcatttttacctttttgtttatcaatacaacttaaagatttatcgtctctgcttgctattcttctaaacaaactcctagataggtccatttttctgaattaatagcttgagatgaggtaattatgcctgttgaagccaaaactatctcttttcctttactagaatttattatttctaataattctttgatatagtcactgttttgtaatatcttattctgccttgtcttatattcctctagctcttttagcactgaatttaatttattactgacaagcaaatattgttcttcagattgctttcgttctttaaacaaatcttcaatccttcgctctaaatcttcctgctttttatcccaatttatataaaaattatatatcagatcaacaattaaatttaattgactattgttagagtgccaactatggtcttcaatgtgatttagcctacaccttatattcagattatctttggtagtaattacctttccaatattagcttctgaatttgatttctctatgatgactggctctgataccacacttatgcttcggacaaaaaacactgttcaaaaacactatttattcggctgaatactattcagtttactgtttattcggctgattactattcaaaaacactattcagtttactgtttaaattactgttcaatactgttcacttcgagagatattttaactttaggatctttgcagggtggcgaatcctatttagacagcctcag

SEQ ID NO: 82724 - DNA, 561 bp, Oryza sativa
acaacttcggtcagaccgcgatccgtcaaattcgaaggtaacttttatttccgctaaaagttttcagtttttgggtataccaaccattcacccccctctggttggcttagttattgtgattcgatcctacaagtggtatcagagccttgttttcttctttggacttttatcgatctagagtttttgccatggctactcctgctaggttttcaactaagcctcatgttttcgatggaacggatttttctcattggtgtagtaggatgcaatcttacattatggctgaagattatgatatttggagaaaagtttatcatccttatgtgattcctgaagttattaatactgttgctgcaaaaactgagtttgaacaaaattgcaaagctcgtaatattcttttgagtgagatttctcgttcggattatgatcgtgttgctcatcttcaaactgcgcatgagatttggaattctttgagtaattttcatcaaggtacaaataacattaaataactacgtcgagatcttttcaaaaaggagtacattaaatttgagatgaaacctg

SEQ ID NO: 82725 - DNA, 747 bp, Oryza sativa
gcatagaacatgctacagactatcaaggtttatgtggctgttaagcgcataccttagatgctaactcctgaaccatcagttgcaaatttgacatctttttagtatactcggagagcttcaactccagttctgttatatcaggcctgcaaaatgagaatgactcaagatttgaagcatacacagctgattttcaacatcttacttttcctctttttcttcaactgggagtacttacaaccaacaaaattatcagataagaagtacttacaaggggtaaattgattgtatctgaacatctgcaggaaatagtttgcactcttcagaaaatatttgggcttgtttctctgcaattgaatctacgagcagcacatcttttgccagctgctcatcaacactaccaaaaagcaatttgttaggaattatgtctccaatgcactcatgttgatcctaatggattatttgatgtatatgaaagttcagttttcttcagatatacttttattttcttacatgttttcttcagatatacttttattttcttacattgctagaagcctagaacaaaagtttcatgaaaaaatagtactgaattatcacaaactgacaatgtttatgactatgtcctgtatgaataacatgaagggtattatttcgttgcaaatagaaatagtcaagcttaaagccaacctccactctggattgtcagcatagcagctagcttcaactagatcaacaatgagacagaga

SEQ ID NO: 82726 - DNA, 1534 bp, Oryza sativa
accaaagacaatttaaccccaaatatattactgccattctcacaattcatagatcctgtataacagcagctaaaattcaacaactgttaccgtatgacacaaacaagcacacccatttctctcacctgaattgcctccgtgtcaaccgaaggcgttataccaaggaaattcgcaatctcggccaggtctgcacagtccccagcatttcaatgtcagcaccgcactttgatcccaagaacaacagcagtagtgaaatgtttgaaactaaaaaaccttacgttggatcctgctgttctcctcgtcgcggtcgaggctatccccctgccagttctgctgcgtgaacggcgatctgtcgcctaggagcctccgcaacaaagagaaaacgaaaccctcaatttcgagttgggactgtgagggggaaaaagaacgcggaccaaatctacccgcaactgtgcagcaagccttgcagattgagatgcggaaatagggaatgtggcgtgggtggccgcgtaccggaagaagagccactcgaggaggcggtagcgctcgacgccggcgaagaggagggactgggcgggggcgttggcccgcgggtaggccagcaccgccagcttccgctggatctcctccatctgcttcgacgccatggcgagagccctcccactcttcctcgcttccccacctcgccgcgccgcgccggccgaggctgccgctgctggtggtggtggtggggatcgagccgctcgcttcgacggagacaacccaacgagcgagatggtgtcaagatttgcaaattctcaaaatcgaatttgtttttatatttcccttactgtcgtttcaaattctgaaggtgtctggaacttacctgtagcatttgtaaatttaccactgttttttaaaatttatgagctgttcagatggtatgcactttcaacccttctaaaatttgtcattgtcaaattttaacacattttggcactatcaaatcaaattttggtagtgttggttgtgtttagtttgttaacttatcaaaatttgtaaaacaattttttaggagtagaaacttatcgaattaccaaaatttggtagggtagcattgataagtatttcttccgtttcatattataagtcgtttgattttttttattcaaacttggttaagtttggctaagtctaaaaaaaaagttttagtaacatttaaaatatcaaattaatttcattaaatctaacattaaatatattttgataaatatgtttgttttaggttgaaaatactgatatatttttctataaacttagtaaaacttaaaagaagtttaattaaaaaagagtcaaacgacttataatatgaaacgaagagagtatgtgtttggtttatagtctaaccaaaacttgactcttttggtgtagttaaaagtggcaacataataaacaaaccctataacgatgtcactcgaatgataattctagggatatttttataattttctagtaacaatctctcaacaaggatttaaaccattagcaaatgtgg

SEQ ID NO: 82727 - DNA, 1687 bp, Oryza sativa
agaggtatgtcaatgtgttattggcctctacgttcggtagaaactagtaatgatgtactatattatgtgttctgaactcattataagatctctaccagcaaatgattctttgctattgtgctactatttgtatattgcgtttcatttatcatcatatgcagacaacctggatacaacatcgttgctcatattacaggtagaaaacgaacaaaattaaatggcattgtgtgccatcccgttttgttttaaagcttcgcctaaatcctaatgtattttagtgtctcgctgtgattgaattgtttccactaactgttgcatcatttgcactcttgtagtacttcatgtacactcttctctttaaaacgagactgaaatatacactgatgtatcatatccttttctcctgaatcttgttgactcaaagtagctcattctatcacgagtacttatcttcagcaagaacatcttttcatttttcttgttcctggatgtaatttggagctaaattgttttgagtactactaatatttaccaggaaccatttttgttactcctgaatctggtggcttgggggtaaattgcatacattagcaataaaaaaaagtaggtcccaccgggattcgaacccaggtcgccagattcaaagtctggagtgctaaccactacaccatggaaccggttgttgcatgtggtccgtcgatggtgatacttctgtcttttactgaagatcagtaacaaagggaagtatactagttgaaacccacatgttcatttgtgggcatccatctgctaggcacttcaattaaacaaaaacacgggaatatccaacgaatcctcttctccacattcccgtacttttttgtgctgaatcgaatttcctgacgccatataaaaaaacgaatttcctgacatatctcaggaaaaaaaaaaggtaatactcgagagtcgataacatcctcctagactcctacggcgtggcacacagttcactaaaatccaggcaacacaagtacacaacacgcagagtcacacatatgcttggagttggagcacttttccaggagtccggctcaggtgcagggaaccctgcacatagtaatatacaggccaaatcaaatcgcgacacctgtacacaaggtaggtccacccaatcaaccaagtaacaatgtaaacggaggtttaaccacgatcccacaaaatcaggtaacagaaccattcacccgcgaaatactttgacgtcgcgcgcgacgccgcacagagtttctttcctctttctctgttcttctgtactgctagatctctaaaattagattggtgattcttgatagagatcagtgtcctcgtgaagcaagacgcatggcggaagccccagtccacccttcatcttcaaagagtatgttaattgtccataaacttggcaagacccgattagtttgtctcaatctctgccataagttatctgctaattgttattaaattagattggtttcacctatatatggtgaataggattttatattgttccttgcatgttaaactagcatatacacaataatgatcacgttatacttattcttatatttagatcatgaaaaagaagacgtgggagacacgaatataagcagtactgatgatgcttgtgtgcaaaagttagagccagtaattggcatggaatttgatgatgaaa

SEQ ID NO: 82728 - DNA, 2047 bp, Oryza sativa
agcgcgtcgcggccatagaagggattcggggagacgtggccgcccgggcgcccgtcgcgcaccctatcctcgccgcgcgcccgccggccaatcgccacccctgaatccacagccacgccacgcggcccatgcctacgcctcccacccgccacaggatctccctctcacgcgcgcgcgatctcataaaaacctcgccacctcgatcggtgaggtagcacgaggcggcctgagctgaacaccgcatcagcagcagcaagcagctaatcgcgcacgtacgcacaccgcgacccggggcgagatggcgcagtcgatgctggtgtcgggagccaatggcacggtggccgccgcgagcaccagcaggctgcagcccgtgcggccgacgccgttctcgcggctcgtgctgtcgcagccgtcgtcgtcgctggggcgcgcggtgtccgtcaagacggtggcgctgttcggcaggtccaagaccaaggccgcgcccgcaagaaaggttggaatttggatggatgaatgcaagctaaactaagctaagctaagctcgcgtttgttttagtcttatgtttgatggtgctaactattttgtaacgtgtcaacgtgtgtatgtaggctgagccgaagccaaagttcaagaccgaggacggcatcttcggcacgtccggtgggatcggtttcaccaaggagaacgagctgttcgtcgggcgtgtcgccatgctcgggtttgccgtaagtagacctttcttggccttctagttatttggtatgcatcatttcttgccatcttggtacgtacctgtgcgttcgggtttgggttagctagctagcaagagcacaagcttaaacgtcaaaagttttgtggttaacggaagcactttacccgggagcgtcatcctttattctataaagggtcacatgttgcataggtagatttgcttccaactacttttttttaaaaaaaaattatagtttttgtcatatattttactttgaattttctgtgcacataaaaatgctatatttctccttagcaaatattgctacttttattttatttttcagtccgagttttgacagcgacattgtttaatctaggccagttagcaactcacatgtataccacacacataactaatgaattatctggatttagtaatataggtattgtaggttttaaaaaattcgtctttcgagcagatatattgtttaatgagtaaattttagagaactataaatttagtgactaaattatcagcttgttgtaacgttagtgacatattatatttcagtttaggaagaagaggggatttctgaaaaaaaaagaatgaatctccttcctgcagcaataacaaagaaaatcattataaatctacaactacgtgaacaacctaacgttaatcctgctgaaacgccgctcagtcggtgcacctgagtcaaaacctcattccaaggtagggcaaatggccatttcatcttcccctttgccctttttagcttgatgggttttaacctcggtgcaccaaccgagtgcgagtagcattctagtcggaacaaacggaacaattagtttcaggccgattttagttacaaactttttcttcaaacttttaacttttctatcacatcaaaactttcctatacaaataatcttacaacttttccgtcacatcgttccaatttcaactataaacttttaagtttagcgtgaactaaacacacccctagtggagtcgaaccaaagtgatgcacttagttgtcggccgatgtggcatgctgctacgatgcacatcttgacattgacgtgtcatgaagacatgttcctccatcttgccacactatatactacctctatgacacgcgatgtccatgtatcaataatattactaggatgtatatgatgttacagatttgtgatattttttttcttttattactgtaacaaactaaaactggttgtaaatgttgtagcacttagatagtttagtcactaaatttacagtgctttaaaatttactctcgtttaataatttgtatagtgtacatgcat

SEQ ID NO: 82729 - DNA, 721 bp, Oryza sativa
  unsure (1)..(721): unsure at all n locations
tgtatttgaagtataggtggatggtgcctcnnttatagatagagttgtagttggcttagataaaccagctaccactagtagttgtgttagttgtgtagttacgtcctatttgctgagactgattaaacccgtatgcgtgtggtctgagaccaccggcgttccggtcgccggtgaacctcgccggcgtttcggccgatggcacacatgggcccatatgcaggccgcagcccatttaagcccaagtaaagaggcctcttttctttctccatttttgggcccaatctgttattgcataaacttaacttaagcccatacgtattccaatcagaaaattattagagaagagaaatactggaactgacgcgtcttgcgttgtcttggcttcacaaatcaacaaagatcggcagctgcatcaacatgcctgacacggcacgcatgttatttttgttggttgcgattagatgttaattgatttttctgcgattgaatgtaattacttgaccccgtccgtataatcacacgcacatagaatagaatggttatgcgtatacgaagatgagaaaggaagatacggtccaaagaaattcacaagcaattgaaaacaaacgaatatttttcaaggagcagatctctgttgcttccttttcttctctgttgaaaagggaagggaatgttctctctttatgtcaacgcttatctgacgacaaagtggattggatat

SEQ ID NO: 82730 - DNA, 6918 bp, Oryza sativa
  unsure (1)..(6918): unsure at all n locations
tcaggatacttgaataaccttgtagcaagtcgatcatttgctttttgtggcttgtagtattgccgttgtgccaattgtcgttgtgttcttgtgtctgtagttcgtaactgcatagatgaaaactttaacattagcttatattgaaatatcatgccgagagctctctttcaaggctgtgtacggctgcacgttgcagcggctgcaacgctgtacaaaataatgtgcgaggcggccgcagccgcagtagtgcagccgtaacaggccccaagtttgtgcagtacttgtatgttttttcttttttctttttttccccctttgattctttagacagtagtaagtttcgctaagcaaatgtaccttttttccccctgaaaacggttctaaatttgacacatcaatgatgaattgaatcaagtcacagcctgcacgttgagccacttcccggcgcttcgttttccggatgctgctgccgtaagagctagccttcatcaatactgtccattgtccaacacttgtatgttgtgtttgctcttcttgatcttttggcggttgccaatttcagtgtacagatcttcaaaacttgacaccatggttctgaatcttctgataaacgaagggaaaagcctgcatttctacagagccacagcgatgcacgcacttgtgtttgtgtacgtataatcaggcttgacatatttgctttcaagagttcaagaccaagcatttcccagtccgatcgcagccacacgacgtttcagttttggacgtcacaacgccgccggcgtacgattgtacgagctgagggcgatggactacccaccacctactccctctgtcaaaaaaaaaaaaaagacaaatcctagggtttttttttaactttgactgtccgtcttatatgaaaatttttataattcgtattttcattgttgttagatgataaaacatgattaatattttatgtgtgacttgtctttttaatttttttcataattttttcaaataagacggacggtcaaacgttgagcacggaaagcaggatttgtcttttttttgggacggagggagtactccgtctttcctaaaaaaactcaacccctaaaatttcagtacacaaatagtagagagagaaaatgtcacgttaatacaaatttattactattgatgagtggataggaaaagagtattgaaagaataaaatttatcaatttacggtttaagaatagatgagaaggtagatattgatttactctaggacaaaatttaagattggaacagctagattttttcacagttagatgagctttgagatgtgtgcgtcaattggagatatactccctccgtcccattaaaaaacaattctagaactagatgtgacacattctagtacaacgaatccggacagatgtatgtctagattcatagtattaggatgtgtcagtactaggttgttttttttatggacggagggagtaacaattaaccaatgcatgcagtggtcaaggattgagaacccacgatctgtcgaatgctcacgtaccactaaaccaccaaactatgccaatatcatagttatgttacaatatagttacaatgtaattacgtatcaattatactatagttatatctaaattttttttaaaaaaaaacttatcactgttttagatactcccttaaagatggtagttagggcatctccaagagaatgctaaacaggttactaaaacataaattttaggaatttggtgaaaatcagccctccaacagactcctaagcatggtcccaaaatttagccacctccaaaaccaggaccaacctgaaccaaatattgggcaactagaagcgctcccaaattttagtcctctcttggagaagggggtgtattttaggctaaatatgtttttggctgtccccaatacatgatttttgggagtttaattttagtcatctattggagatgctcttactccagtttattttgggaatgagagaatactactctacctccgaggcatcttcagccatccaccattccaaccgcaccataggagcaactcctttgggcttcagcgtccgcaatatgggccactttaattggtcctggaatgaatattagactctccaacaatacgagtgacctaaagtgaacttatttctcaattggtccatggaggccacactcgaatcgaaatatgggcctggcacatggaggcccatttgaaatgaaggcgatgtgccctattagaaatgaataagttcatttcagatcccttaactttacaccaaatccgattttcgttcttagaaaccaaaaatcagatgcaaccggtccctgaactgtcaaaatctgtgcaaacgaagtccctcgacggtttgaaaggcgattttgactgatgtgacgtttgcgtggctggtttgattaggacttcgtcccacgtaacattgacatggcgcatatgcgacaatttgatcccggaaaaataataaaaaaacgtaagcatcacgtcagccaaaactgtctttcaaaccgtcgagggatctcgtttacaccagtttttgacatatacagatacaggagccggagtcggagccggatccagaattccagatacaccgtgtatcatacacgaacacgatcaatcacctgattccttcaactgtttcgtcagccatgacgagcgtttctttggctcttttcctccgaagtactagtactacattcttctcccatccagtcctcagcaagcaagaacttgggcaatcagttcactgtcctgcactgcgcctgccgctaactagagatcgaactatcgaaggcaaggcatgctgccatggacaagaccatcgttctgtacccgggcctctacgtcagccacttcgtccccatgatgcagctcgccgacgccctcctggagcacggctacgccgtcgccgtcgcgctcatccacgtcaccatggacgaagacgccaccttcgccgccgccgtcgcccgcgtcgccgccgccgccaagccgtcggtcaccttccacaagctccctcgcatccatgaccctcccgccattacgacgatcgtcgggtacctggagatggtgcgacgctacaacgagcgcctccgtgagttcctccgctccggcgtgcgaggccgaagcggcggcatcgccgcggtggtcgtggacgcgccgtcgatcgaggcgctcgacgtcgccagggagctcgggatcccggcgtacagcttcttcgcgtcgactgcctccgcgctcgccgtgttcctccacctcccgtggttccgcgcgcgcgcggcgagcttcgaggagctcggggacgcccctctcatcgtccccggcgtcccgcccatgccggcgtcgcacctcatgcccgagttgctcgaggacccggagagcgagacgtacagggcgacggtgagcatgctccgcgcgacgctggacgccgacggcatactggtgaacacgttcgcttcgctcgagcctcgggcggttggtgctctcggtgacccgctgtttctccccgccaccggcggcggcgagcccaggaggagggtgcctccggtgtactgcgtcgggccattggtcgtgggacacgacgacgacgacgagagaaaagaaaacactaggcacgagtgcttggcgtggctcgacgagcagccagatcgcagcgtggtgttcctctgcttcggcggcaccggggcggtcacccactcggcggagcagatgagggagatcgccgccgggctggagaactccggccaccggttcatgtgggtggtacgagcccctcgcggcggcggcgacgacctggacgcgctcctgccggacgggttcttggagcggaccaggaccagcggccacggcctcgtcgtcgagcggtgggcgccgcaggcggacgtgctccgccacaggtccacgggcgcgttcgtgacgcactgcgggtggaactcggcgtcggaggggatcacggcgcgcgtgccgatgctctgctggccgctctacgccgagcagaggatgaacaaggtgttcatggtggaggagatgggggtcggcgtcgaggtggccggatggcattggcagcgcggggagctggtcatggcggaggagatcgaggggaagatcaggctggtgatggagtccgaggaaggggagcggctcaggtcgtcggtggcggctcacggcgaggccgccgccgtggcctggaggaaggacggcggcgccggcgccggctcgtcgcgcgcggcgctgcggcgattcttgtcggacgtgggcggccgcgagcttcgatccgttgagactttactactttgggccttccacgagattgtcgtggcacgcattgggctaccactggactaatatgggcccaatatggcccagtttatttttggcattctcccgctcgagcgccccgttgggcgggaaaccaattttgatgggggaccactttgcgtgtataatttgtatactgtattattattaaccgataatttggataagctagattgcattgcggagtaatgtaatttgtaaagaacactatggtaggctgcagatataactcttttcctcttaaaaaaatatacgtttatacgattgcacttctggtacatgcattctaatctttactcccccataaaaaaaccaatactaaatgtgacatatcctaatataatgaatctgtatatgctatcacctagaggataatgattcttttgggtttaaattctatcctacaattaaaatgcataggcgctttttactattacttcctatgtttcataatgtaagactttctagcattgtccatattcgttcaatgctagaaagtcttacattgtgaaacggagagagtaccttataagcacattttgtgtaggtgtttattcactactacttttatatccacattgttcctgtagagcaaagacatcttagacatgggctaggatgtatttatacatctgtgcacgtataaatttccgtatttagaacgaagaaaaataacgtgcacaactttatacttgagtacgttgatcgagaggaccaatttaccctcggcaaaacccaccgtcactgctacccaactccgttccatggcctccgcctccgcctccgccctcgctttcgcctccgccgcctagcctccctagggtttcgggttccgagatccgtgccgccgcaatgcccgcctcgccggagcaagccgtgcgcgaggtcggcaagcgcctcgcgcagccacgcctcggcaaggacgccctcgtcaagcttctaaaggcgagcagcgtcgcatccttggtttcgtcttgcttaaatcggtctaaatcaaccgcgcttccatttccggtggaacgttgtttcgattttcgagctttcgaactggttaggggcgttctgtgttgccaactagagcggtatttgctacatgtattggtaatttctcagttggagatcaggggggcacttcagcctctatatatgtggctaccactaccaatgttatgagtttttttgttgacgctttggcgaattcgagtaccatgctgcattttctaatgatattctgctgatccgctcacatgtccacgcgacactgcagtaacaatgtagtagtgctgaggaagttgtgtatccactatgcctgtgtttgaaaatttgaatgaatagagcttccgagtaagtctctgacttaggggttttagggtcatctcggtagtttgtagaaaattgatttgtcgaaattagttttggtatgcggatatttctgattggcatccagtagaggagtcgatggcttaattttgtgttcatgcgaattcgaagtagccatagagacttcagttaattcttatatttgattnnnnnnnnnnnnnnnnnnnnnnnnnnnntgtcccaagttttcctgccttttgaattgctgagttgaagaaagttgctctccattgtaaacttagtgggtaaggaatgaatgataaccaagacttacacctattcattgccttaaattgtgattcacacttgagcagttcaatctatttttccttttccattttacatgatagtttctctggcagatctactgggattaaattaatttttatttgccttatggcaaatccaattctagtcacttgtctttgtattttattgatggtcaagggcactgactatgttcaaacactttgttgaaagttgaaactctgtttaactattcacttgctcttattagacaaatcgttgtgataccgtctcaacagtccaaaattgaactttgtagtgcagccaaatgcactttggagctactgatgaacattcaaatacttaactggcatcattgtaacaattatagcttcaaataatacacgagtcgatgttctcagcttcaatttgctgttaactgattgcttctttacattatcttttctctgaataggtttattctgtacttccataactgcttctgatatttttttctgcagcaagctgaaagtgctttatcagagttgagtcagtcctcctctctgcaggaggctctacatcctctgagtaaatctctggtccagaccacattacttacccatagggacaaggatgtcaaacttcttgttgcagtttgctttattgaagttatgcgtgtccttgcacctgatccaccttttagtgatgaaatatttaaggtatttaacctagtccaccttcaatactgatgattggttattgctgacttcttcaattatttcctttagtgacaacctgataggtactacctaatgaccatttttgaataggatttctgaaacagtaatcatgttagatttatttaatttaatttagtggcagagaaaattttgagcaaggaccattctctcttgacactctgttaactcctttttctcaggaaatatttaggctctttat

SEQ ID NO: 82731 - DNA, 4885 bp, Oryza sativa
tcgcatagcctaaaatctcaacaaatccaaccagctaatatggtgtaaatatcacgctgcggccttcctactctagtagcccaaccaccaactacattgcagacaagggactaatatgaacttagctaaaagttcctgaatctaaacctagcgaaagctaaaccgatcaacccctcggaacaacccatcgatctcggaatccacgcccaaagctcacgggaaaaacacgagaccaaatccgcacagatccaaccacggagaagcaggaatccacgcggccgacgggaacggcgggggccccctaacaggagcagcacgggcgcgcgattagccccccaatgcagccgcccctcgccgcgaggcgcagcacgacgagcgcgtgggttgggggggttagatccagaccttgcgggtggaggtggtgggcgagctgggccgcggcggcgacttggccgggtcctccgggtcaaccgcctccgccgcctggctgagcgggatcgacgttgactcctccttctccgccatggctcgcgcccctcctcctcctcctcctccaaagctagctcccagcaagcggcgcggccggagacgagggcgaggcgaggtgaggcgtcgctgccgctgcttttggctggcggctagtagcagcaagcggttgatgcttggggtgggttgggttgccgagagggagacgtcagacgtggcgtgctggccccacctgtcagtcccgctttccgacgccgtgaaaccgccgtccgccacgtggcttttctcgaatggctggcaggtgggacccacctgcgacgcgggtacacgtgtcggcgcggccgtggctggcgcggttaaggagacgggaggtgacggcgtcaacggggaagcgcgtcggctgcggggtttgggctggcggtgagctggcccgggtggaacggaacggacgtcgggtgggccggacggaagcgggggttggaagggtaggacggttcggaatgtggggcccagtccacgtcagttcaacggccgttgtccatgcacccgacggcggcttcgggaacggaagagagttcgtctgggcccacctattcggcgtttacttattggtcccacatgtcagaggacagagtacgttccggactaccacttggagacgctaatgggccattttagtttcacagactcaacgtgtccacgtaataagaacatgggcctgtatgcggagttggatctttgttctcaactttgctggtgcctaatttgaagccgataattaattcctatgtcgctcttccataatcttgggcaaaatcatttccaatcggaataattaggtcgacggcgatcgatgttgacatggtgatgttggccaatctactactaatatccaaggcgatatcgttgttagaatatctatcatccaaggtcttgcaagacatccactcattctctagtattctatacttctaccatttaactatttcagatcttacatacacgcaggtcttttatagtaagaatttatgctagtaaatttggagatgcatgcagtggtaaggggtgtgtggttttaaccccgaagtctcgtgttcaatccctaacacgctcatgatctattcttaaaaaaatatttggagggtcatctctccctcaaaatctcatttcttttataataaatttgtcctatcttcgctttcttataagcacatataaagacattcctattatgtgtttctacttgtcttctgtccgagtaactgattttacgcagagatagattttaaaaacatttttttctagaaacacgtaatagagggactcaaaacatgtgtgcactcgtccttacgtacatgcgcgcacatcctatttcgatgaacatatctaaagaccggacggatatatattgatgttggagatttcatatgtaactgttgatttggtttctatagatatgattcgttttttgcacataaatatatcgatagtccctgccgttttaacgtgaaaccatcgcattcaaatcacgcatctcttttttatttttctcgatcaacataataattaggagaatacatcttcaaaacgagcgtggtgtcttgttttcatccagtagttggtgtaaacgtccttagcgccaatgtcgtggtataaggtaggcaagcatctaacacttgtgcaatccaactgtctcacatgtctacccaattctataagaccataaccagagacaaagattttgtgccttgttaccaaccattactctctcataaagaactcggagaatgcatgcttttacatccatctaacaaatctagtcctctcatcgttcttcctcttctaatttgcacccaaaacatgatcaaagaaaaagaaaaagaagaaaaaagagaaaacaatggagatgcatcccatattcccataccaccaaatctaatcaacgaacaaaagaaaaaagatcagagcagaacgcgatcagacaatctgcgacgtccatctccgtctctccgtctcatcccagccgtccgtgcttaccttattcttccagaagcgaaagagagcaggacagaatccggcggctactgcgtgtgcggcggcggcgggtggtggtgatagctcgactccgaccatgacgccgccgtcgccgggtagaccagggcgttctcccagttccactcctccgccgccgacatgctctggtgcgagccgccgtgggacgagtagtagttgcccggcgcggaggaggtggaggaggggacggtggccacggaaacagagggggtagggaaagagtagtaggagccgaggaagccgctcatggcgccgccgccaccgcctccgtagggattggtcatggagccaccgccgccgccgccgccgtagaacggaagaagggtgccttggttgggggtggcggtggtaagcctcccctgcagaagcatctggtagcgcaggtactcggcgctctgggaggcgccggggtagatggccgcggaaggcgatgccgccgcgaccggcgccgggggcggcgccgcggtggtggtggtggcggcggtcgggtagaggcgcgcgtcctcggggaagttgagcttggcgcggctgccgcggaaccggagcgcggcctcgtcgtaggcccgcgccgcggcctccgccgtctcgaacgtgccgagccacacccgcgccgccttgtgcgggtcccggatctccgccgcccacttcccccacggccgctgccgcaccccgcggtaccgccgccgcggcgtgtcgggcccctccgcgttcccgccgccgcccaccggcgagtggtgctcgtccatggtcgccgcgctcgcgctctgggtgtccgagctctgctccgatcctgcacacgcaaccacatatttatacacgcgaccgcacgaggcgtgagcaaacgacacagagaaagaaagaaaagagcaaatgcgaattcaaaacctgctcgctttaccactattaactactatacacacacatgtagtatatgaaatatgaatgcgatgtggcgcaatataaattataaaatgagaagtggacgatctctatcacaaaacgagtgtaattatttttggaatgaactatacaaatgcaagtgatgacatgacaccagcttataattttattcagacagcttttttttttgcccatgtacttttaataacattttttcctcatttatactttccagtagtatcttttgtgaagtgtatatatcctgtgtgttacgcaagcacatcgagagagagagagcaaatgcagtgcacgcatgcagcagcgctgcccaacggattcacatggggaatggcttagctgtatctttgttgtgttgcggaggtgcagtggattcgaagactttttttgtgctgtgccggtgaatggcgtacaactgtgtcgtgcagatatggtttgttttgaacccctgatgtcagctgtaacatgcagatatggcgaccaccctgccgctcccgtcaaatactttgatattaagcttcgggtcacgcatgcgtgtgacttatcgttacgctcgcaactgcatgggtatgcatactgtctcccatttgtttcgtagtgacaagtggtattgctatttaagcttaataaagaaaattgttggttttgggcgaaaagaaaaggaaaataatgttttttatgtttgaatggaactccgctgtaaagctttaaactatatagaggtgcaattggtttgtcattttccgttcgcttaactaagggtataacactggaaaagactatacatactatattttttttactaaattcttactaaaaccgatgtgtcatgctacgagtatatttagatttttttataacatttatctatctaaatcaaatggctgagattattgttagtataaattttagtacatgtagcagtgctcgggtacatgcatgctctggaaattttttttaaagaaggtcaccacatgtgtatattgcaccgtacaaattccaaatggagaattttttttagatactttgaacagaggatatgatatgaaaccgaagttaaaatatacgcaaaagcgcttatatttggtgaatttttggggggcatgcctaaaaagttgcaactggtttgtccattgaccatgcttgccacgtttcgtgaaaaaaaaaagttgcaaagcaaagagcagaagttggtaagcaaagcgtacgcgtgttcgctgttccattacctgcgaactccggcgatggcgcgcccccgcaggcgtatcccgccagctcgtgcattgcctgctcctcccgcctcctctcctgcacgccacgcgccgccgccgccgcgccgcccgccacgacgcgcgccagcgccgacaccatcgtcgacatctcctgcgcctggtaataccccgacatg

SEQ ID NO: 82732 - DNA, 1275 bp, Oryza sativa
gggaacatgcatgatatggaaattttttataaagaaggtcaccacatgtgtatattgcaccgcccagattccaaatggagaattttttttagatactttgaacagaggatatgatatgaaaccgaagttaaaatataggcaaaagcgcttatatttggtgaatttttggggggcatgcctaaaaagttgcaactggtttgtccattgaccatgcttgccacgtttcgtgaaaaaaaaaagttgcaaagcaaagagcagaagttggtaagcaaagcgtacgcgtgttcgctgttccattacctgcgaactccggcgatggcgcgcccccgcaggcgtatcccgccagctcgtgcattgcctgctcctcccgcctcctctcctgcacgccacgcgccgccgccgccgccgctgacgacgacggcgacggcgacgaccacgcccactggtcgccgtcgccgtcgccgccgccgccgccgccgcccgccacgacgcgcgccagcgccgacaccatcgtcgacatctcctgcgcctggtaataccccgacatgagctccgacgcccccgccaccgtcattgccgtcgccgccgccgccgccgccgcacgcccgtcgccgccgcccttcaccggcctgccgccgccgccgcgtggtccacgttggtctgccaggtcgaagcacatcaacgtctcatatgcaccggagtctctctactacagagtcgcttcgatgcaagagagagggatcagaattcagaggagaggtttatctcgttaattctcgtttcaacccttccgaaagttttcagcggacgactcgcgcatttatagggctagtttgtggcgtgcgtattctagtaatcggcacgaagagagagagaaaaaaaagaagaaattaaaggagattaagcaacgtgacagaatagccgtcttctaaagctggtttcaaacctgcatatatcatccctttgcagcaacgcttcccttggttttgtttattctgtttttgtgaatttatttatctatgtcccggtatgaacaagcgtagtaaatctatgatcggtttacggtttacggttggaaattatcatcggtaattcttctttttttctaaggattagcgtgggcaaattaattaccaggtcggcagtaggatcaagtgattagtacgagactacgagtgattaagcttgtgccgacatggcgcacgtcgtcgtggcgagcgcagcgccggcacccgacgctttgacgcggtcagcgtctcgtatccgacataaatt

SEQ ID NO: 82733 - DNA, 11574 bp, Oryza sativa
ctactatacaagaatggtatggataaagcccgattgaaaataaaaatatgagagcatcaaagtatctcgttttcttaaaagggaataaaaagggggccataatataacagaggtatcaactctaatttgggtggatgaactccaaatttgattcatcccccccttttggaatctaatttataatgtatgccttaaatgataaaaatatacaattgttgtactacataaataacattggtgagtatagtctctatctcctttctgtatcgccgtggttattcttatacgatgggttcatgaagtagagtttggaggggaggaagaaaaatagagcaagagtaagaaaagaaaacggtgcgaataaagacattgtcagtttgttaccaaaggtaagagaaaatctatgatatgataattttatatgatcaaaggagaaaccgtctaaaatattttagatacatgatggatgcagttggcatggacggcattctcggagtcttctcctatgactatctcccatcatgtggtttctaggctctccatcaacacctgtagttgatagtgtggcgggtttacttgcgatgcaaagtttgccctacgtcccgatcaaaaggaggttgcgctacctaatacgttcttctctggtgagctactcacaattgcaatggtcttcttacttatttttggcggtggcttttcatggtgtggctgaatttctctctcatcatcgaggttgcctcaacctccaacttttggacgttctatctaagtttgcgtcttggtgtcttcttctatagctcgtaatggttttactatcctagcccatgttagtccaaccactattgttgtggccaaagtgaagccaagtagttagttgcttttatttttctttcattttttaagtatttctttgattgttttcatgatcaaactgtaatttatctatcttcaaagggcttctttgattatcttgttgtacaatcatatccaaatatccacttatagggcctaattcaaaggtgagacacgcctggcacacaaaacgagtaacactattaatgctatattaacttagtattaactgttataattttaatgatagggtttatttgaatttttaaagaaacgtttatatacaatttttttaaaaaataaaacacatcgtttaataatacatggagtagtaaacgagtagctagcccaataaacccaaatgagaaagtaggtgtgtctgagagtaggaaaaaggaagattgagaaatatgcaaaagcaacgtaagttattagtgtatgacaatttacgtattaattatttcaatattgtaaataaattcatatacactactacaatagggatttttctgtgcggatgaaatcgattttcgcgtgcggaggattcgaccgtctagaaggaatcgtctgcgaaaatgcgcgatttttcgtgcgggcgacgcacttgcacgcgaaaatcattttttgcgtgcgggcgcttaagttgaaaccaaaataaaagaaaaaacaaaccctaaccctaatctagccgccgccgccggcggcggcaccgccaccctagccgaggcccgccgccgtcatcccgcggttgccggcgatggatccattgtcgccgcggtcgccggcgacggatctgccgccccctaccgtcgttgacgccagatccgctgcccgcgcgctcccgtcgccgccgggaaaggaggggaggggaggagccgcgggccccgtcgtggccgccgcccccatgcctcccctccgctggtgccggatgcaaggggagggagggaggggagccgaggggaggggaggggccgcgagccgcgccatctgccgccgccgcctgcgcccgcgccgctcgtgctgccgcctgcaccgcccaccccctgcgcctgagagagagagatcgagagagagggctgagagaccaatagagaggagtgagacagagaggtccgttcccgaagacccagacttaggcgcgcgcggatgggaaaaaaacaaaattttcaaagtgggtaggagggaaactatttttccgtgcggttatctcaatagatctgcacggaaaaatcggtctattttcgcgtgcggtcctaattaccacccgcatgcaatcttaatgggtttttgtctaggaaaatcacttgtatagtgtgatatttacatagcaacttttttctatagaaaacttttgcaaaacatattgtttagcaagtcggaaagcgtacgagtgaaaaacgaaagatttttttctccctctgttctccacttctcctaaggcagtttatgcataaaaaagagtttatcaaatggcaccctccaaatccaccttttggttcgaaggcgtccatgaatcaccaaagtgttgtatgaagaaattagctcagcaaatcggaacttcacatgaaatggatgatcttgcttttttgtcacgaagattttctgctggcacagtggcacttcaacctgtgtgcgtcaaactgttaaccaaaacgaaaagatgagttaaaaaaaacgaaacgaaaagatgtactacttcttccgttctaaaatataagtatttttaatgttagcacgggtattaaaaaagtaggtgagaatgattgaagaaggtgtgtgattggttgaaaagaaaaagtagatgaaaaagaatgattgtgattggttaagaggagaagataggtagaaaaataactttattttgaaataaagtactgtgctaaaaatagctatattttaggacggagtcagtactacccaagtttatctcggacgaaactttgctgtcaaatgtcacatcgttaagacaaatatcaagacgtgaattttggaaccacgttaagctgacacgacaaacacggagcatgttggttgatactccagtacaatagtgtagtacttcaaactagacttttcgttttttatatttgtacaattttttttaataagatgagtgttcaaacagtataaagacagatgaagtagtagtagtaagattctaccatgcggggaccacgtacgactcatgggacatgccattttccgaacatgtacggcaccgatgtcgtatccagataacgtataaggggcaaggaggagaaatcaacggctggatcgcgacgattcagcgtgcggcgatccgagtgccagcgacgccgctgccatcgttttccctccctcgcctagcctcactgaacctgagccgttggttgggaggcgacgacgtggtgcgctcgtagccgtcaacaggctcggtccgagccttgcatacagctaaatatacggtggaaaactccggctaatctaaaaaatcacgtaaatcccgattaagaagtcctgttaattcacagaaagtcttacatacagttaatatgatgagtccagttcaaactcgactaagtttattgagatatactctaaaaattaacaagctttaagaatgaaattgagccgactttttacacagctatgtatcttgttggataccagctaaacatccgtgttttgctatagatacaagaaaaaatatcataatattttctaaaataaattaaaatgtattttttatgaaatatgttaccaacatttttttataggacaaagtgtctatccacattaattttatactccatctgttccaaaataagcgtagttttacactgttcatatccaatgtttgaccgttcgtcttatttgaaaaaaatttatgattaatatttttattgttattagatgataaaatataaatagtactttatgtctgaataattgtttttttaaaaaaaattcataattcttttaaataagacgaacgtcaaacgttggatacggatatctatggctgagcttattttaggacggagttagtatgtgactatccatttatatttagttgttatgtaatattaagaaatttaagggttagtatgtaaaaattgcaatgatagtggatgatgtatcatcactatcactatcgttggagtcttttaaaagagtatagaaatgattctcacctgaattttccattgaataggaatgagggtatcgtcaccctatctacctgttaaattttctttcataatttagcttccttttttgttgagatttgtatcgttttcttcgaagttgggggtcccgctatatatttagacaccgataattttttagttacatgcaaaacgatatgggtcattagcatatgactaatgatttgagtattagctactgtaaatttgaaaaaaaaattgaaagaaagtaaaaaaaataacattgttcgatagattgagaagcgtggtcgctcaaaactaggtgtgcctaggcttttaagcggtttagagcaaggataataacagagcccacttcctactattagagcagccgcaatggtaaagtaaggtgctatctataaaacatgtacatctcagcaatagactagattaatagtaaactacttcaatggtatgtctacatgggtatctatagttgtctaatccattgcctcgtttttctctatagactatctccaggttagtaaatagctttgctctctctcttcatttaatctcttccaagtagtaaaatatgctgacatggatctcttgtagagagcctatagatagccattgcgggtgcccttagtccatcttaaagccaacacatataatagattagctataaggttggctacaattttcttctcctctctctatctctcacttatacatttaatgcatttatcttggagcttgtgataagctagctctttcataagagccaacatccttattttttcactatatctcttctccacctaagtttatagtaggtttatagccaactattatacttactcttacccgtctctccttgtgagaccttgttcatttaggctgagtttgagtgggaggagattgagaagattgggaagatacgcaaaacgaggtgagctattagagcatgattagttgagtattaattattttaaatttcaaaaatggattaatatgatttttttaaagcaactttcgtatagaaacttttcgcaaaaaacacaccgtttagtagttcggaaaacgtgagcgcgggaaacgagacaaactcactcacaatctcctcctgccgaacgctcccttaattcctcctacaaagattaattttttggattaaacgaacaagacctgatggggcagtcggctgccctgctcggtcgctcgctagtgctttatccactgcaagcatcgtgcggcaacggatcggcatgagccatgtgacactcgcgagtcgcgagatcacccaaggttagaattgctaatgatttggagaggttggcgtcgcgcatgcacctgcgcgcgcgcgcgcggcgtgatttggtggagtgccctcgtcgtgtcgccagcaggtggtgttgttgtttttgcacctatccacgatctaattaagttggcggtctttggctgggaatcttgatctttgttgttgttttacacgtgtcatttctcatgatgtcttatgacggtattatggcattaattaatagacgtgtgatgcgtcctcatgattaatattagagcaagtttaatagtacagcacactactagctctaaatcatccataaccaatgtagtaatagctaattcatataatagttgcttactatactattaatatcttgtcacacctgtcatacacacgttacgtcttagagtccgtgctacagctgactacagatctgtcccctgctcttctctctcttcctttatctctttaaaatatatttatagttggtttatagactgctattgtacttgctcttataagacgcactatcactcaatatctacaaaggaatataaaatttactgttcatgaggagtaaagggctggtttggtttcaggcctaaattggccttaccaatatttgtcaatttcaatagtgttcagtgtctatttggtttgaacttaaattttggcatgcctaagaaaatatgctattttaatagttaacttaggctattttggcttcaatccaaacacaactttactttgacaaaattagccatgctaaaatttaccaaaatttgcaattgataaaaattggtaaggtcaatttaggtcacaaaccaaaccagcccaaagtaacaaagtttacatatgaaaaaaatgatgcatcccatcacatcccaaagaatggtgaaaatcacatgtgggaccaacctatatgtgagcaatactacatatgtaatactgcagagaatccaatgtctaaaattactcccaaataaataacatgtatattgcagttattatatctacgaggacaaaggtatgagatgaagagggaggtggtggtagacgggctcagtgaagcacacgagccgcgagggcgtaggagggaggtgagcggggagaaaggcaacgtgaggtctctccacggcttggccgcttgggggattgggaattcggaataacgaggggactgacggtgtcggtgacatgggaccggggatatcttgactggaggtttggggcagccgcggtcacccacgtggcctgaccccctcgggggggtcgggcccgagggtgatgaggccgcccctccctctatctccccgaggggtcgggccgctcccgtttcgaccccccgagggctggggcgccccgaccccctgagggtttggcgccacatgtgtgggttaggtgagcacagcggcgctcacctaaccacgtttattgcgggttggacgagcgcctcacgccgcatttaatgcagcatagcgcatgcttatccggtccgtgatcggtcgcagtgtgtgaccggtcacagaccggtcagatcgtgggttagggggcaacaggcggcctgacacacgcctcgccctgtcccgtcggaatgatgagagcctccaggcactcgtccctagccggagccggcgtgggaactcctggagttggcacgtcagccccggccagatacattccaggcttcatcgcaaccattgcaaggaagtcattgtatgaagaagggcagacgtgtagcatgctaaactgacacgtggtggacaagaatgaccggtctatgactggtctgacgccagtcgcgtcatcagcaaacaaccgtgcttccacgttgcacctgcttccggcggagtggaggttggtatgacccatcccatcggagggtcattcggacagcagccattgcaaatctccgcccattaatgagggaggacagggttatcccggtgtcagacgaaggtacacgccaagttttggtcaaagtaggatgggtccccacccaaaagaagggtaggtagaaatggtgtatgtggtatccccttgagatataaaaggaggaccatgcctaccaagagaggagacggacaaaaagactagagaggacctgagctggtagactggagaaaagaggagtgagagggtctctagagtttgaactctcttgctctccagttctctgtaactccttcatacacagatccaccagaacacaggagtagggtattacgcttctcagcggcccgaacctgtctacatcgcccgtgtcttgcgcatttgctctctcgcgaaccattccacagatcaagggcttagaacctcacccagcgcccccggccgaaccggcaaaggggggcctgcgcggtctcccggtgaggagccccacgctccgtcagacggagaaatagtccgctctcatataaacgcttgatggtagatcgaatggatggcgcagtcaagcaacagaggatatgaaaaccaacctcctatcatagtatggggcgactttaatagcacggtgatcaaaacatgtcagttcaaaatattatgggggcttcaaccgctaggagccttcaatattctcgatataattgatataagctgaaatatatttttttgagaacatataagctgaaattagatgccctttttttcaaagaaaaaaaacatgatggtggtaggacaggaagtctggaacagtgggaggatctaggatggttgcctatgggattaacaaaactttttcagaacacgagaaaatctccgagaaactttcaattgggataaggcacacccaatttgaacatgacaaacttcaactgagaatgtttgaaaacttgcaggttaagtttttttttttaaaaaaaatcagtttcaattggaagaaatcaattcccatccaatgggttttgaagcgttcaccaaggaataatctcaaccaattaattgtgctactgttggttgatggtggtaggacaggaagtctgtaacagtgggaggatctaggatggttgcctatgggattaacagaacctttttagaacacgataattttatagtattttatataaacagcttcatttcctaagaaatctccaaaattcctcttttataaaggaggcttgaaccagatgtggacggggaagaggaacaacggaatcataccccatttacacaaatgctattgtgacaggcggttgatgcagggcgttcattgcataaaatacttcagactgatccctaacaatattgtacacaattttattagccaaatccggttgaacacacacaattggcgaagaacaagaaagatgccatgtatatctagtactactggtctagctgacgcacacgttttttttcttctttgtttgaaacgagtgattgaaatgatgccacattcaaatgaattgaattcgggctcaagtgatcacaatcgcgacgaaccgatcgaatcagttattgggatgtgacgatgacgggtgattgagaatttaacagttgcttcatatccatcactctttggttggctctcatcatagaaaaaaaacaaacttttaacctgtgatggttgatggccaccacttcagaagtggaggtacttgtggctcctagcaagacctgatcccagctaggtgatttggctgttccaagtgcctgtctagtcccgcaacgggcaacagcagtagccgatatgaactttatttctagaattaggcccggttgttttttagcgtattcaccttattattgaaacatgctatttgtttcatatttcaaaaatattttttctcaagagtttttttctactgcatttttctgttgttttaagtaatttgttaagtattattatttaaaatatctaatttatttctataatttatagtcaaagtttttatacatgtgatataaaagccagtactatgaaataaaatagactacggcgaacataactccaaaatcaacataaaaataatttccagcctcattttttcgattatacttatgcttatcaggcaaaatttgatttttttaactttaaatttggagttgattttggggttttttcattgaagtttattttttcagccttttcttttttatcactaagaacacgtatataaaagttttattcacaaattatttttagtttgcaaatataccgtttggcttattaatggggaccttcgtattttaaattttggttgtaattgacaagctaataaggagacgacaggaagcatagtctttggaaaagaaaaaaaacggttttactgagatgtgacaatgtgcttgtccattttgtgaagggcatgtgtcatgtgtgtcccatgcacagcagcacatgtactggcgatgtactacctcccatagtcacacatttgtttcttctccagcttaatttaatttaattagttagtgagcttgtgtgtcacatgcttgtcacgccaacaactgtggctacctagatctcattgtgattgttatgtacccaccatatccataacatggagaattggagatcttgcttaacacacatttgccatggatatgcatgcctgtaactgtagtgattacacactttattaaaaaaaaaacatagagatatctgatttgagaccagaactgcggggatcgtcggaagcgatatggtgcagagaaggagaagaacaagacaaaggaaacataaatagcaatgattcccaaaggaagatttgatcttccccctgtggagtttgacagtgacatgtcatcgagcaaggacgggaaaagagtgatcagagtgaccccaaagcgacttcttttctcttctttttttacataaccagaaaatcgatctccaaatgattgcaacccgtgaaacttcccggaaacacacacttgttaatccccttatcccattagtactactacaatccagctgatcgatcacatatggatcagtgagcattcatccatccatttattcacttggtcctccacaaagagcgaaacacagagagagagagagagagagagagagaggggcagacatggagagagaaacaagatgcaaaaatgcacgcgaacatatccgatcgacccagatgatccaaggataagatcacgagtagatcacccagaattggcctgcttgtgcctggataaagatggcaaaacggaagcaatacatggccctacacacacagctatcgtcacgagctaagctttcgttttaggcacttctggtgtagtgatggtgtggtatctagtccagtatttcatctgtcaaaacaacgaatctaggatgacgtgatatattctagtataacaaatttttacgctgtgtttagtttttaaaattggagagaagtttagtaaaagttggtagtttagaaaaaaagttaggagtttatatgagtaggaaagttttggatgtgatgtgatgtgataaaaagttagaagtttgagagaagttcggtttaaactaaacagggcgatatctctcgaatgtgtcctgtccgacgccgagacgccgtacgtggggcaggccgcggacgcgtttatcttgtgcgcgatcgcgcgcgagcgccgcaattgcgttggtagggccgcgccgtcccgcctccaaccacgtcagatgggggggaggagggggtctcgtctcgtgacgagccaacgtcctcttgagggaatccttccaccaactgaacactggctcagtacaacgctatctttccttgttttgttcgtgtttagctgttgagctgcattattagatttggggtgggggtttgaggaagagaacttcgacttaagcagcgtaaatagggatttgtttttcaaattattattcataacttcattttatactatcaaagtctaattagatcctgacttatccaaaccagggttcattacatcatttatcgtgcggttatcacgaatcgaaatcacccacctggtgtatcagttaagttcaaaaaattaaaaaaataaaaagaaatatcagttttcgccagtttttggtgggaaccgttcagttaccgctgatactgctgagtagtggtaacctacccttattaggtaaggcaaacatgacccaaacaagatgaacgtaggttgttgttgacgaagaacgtgatcacgaccggtagcatcatcggaccacctatatcaaataaatagcggaataaaataacacgcgaaggagtgacctgacctctattagatttggggtgtgtttagttcacgctaaaattataagtttggttgaaattagaacgatgt

SEQ ID NO: 82734 - DNA, 1504 bp, Oryza sativa
ggtactactcgtagaattcactaaatgtgacaaccaaagattgcattgcaaggcaagtgtgggcacgctgagtttgtaccagtaacatgttagcatggtcccctagcttcgctagctagctcccccacccccggctttactgtacaagacgatctccctgatctgtgcctaccaggagcacaagttgcaaaagtggtcatcaccactggtggtgactggtgagagatgcgtacggtcaaaactcggaaggggggcgcatccatccaatccatcctcggatcggtgcagatctcaataggactttcgctgctgctgcggccggcacgcgcgccggtgacgttatgctcgctcgcgggcggccacgttcctgcacagtggaggggagagcacatggcaaaagctgcgtgatgagggaaaaatatggttcgatgtgcgtagagtggagcagtactagtgtaaacttaattagcaaatgtttagttggaaaaaaaatttatcactgcatgactacattagatatacggataaatatttgaagtattaaacgagtctaataacaaaataaattacagatttcgttagaaaactgcgaaacgaatttattaagcctaattattctattattagcaaatatttactgtagcaccacattattaaatcatggcacaattaggtttaaaagatttgtctcgtaattttcaggtgcactgtgtaattggttttttttctacatttaatatttcatgtatatgtccaaatatttgatgtgacagcgtgaaaaattttatttgggaactaaacaagtctttatttcgtgccaaaataaaccaatcatgtactaatatatatgtgtccagcttagtaaaatgtgtaatctgttgtacgagattttattctgagaggaggaagtattatcagaaaccgcttggcatgcaggattacgccatcatggagcacgctttcaggtctcgtttcgtgatgattgggaaatattgcgatgttatggtttcactgtttcacacttcaggtttcgtttcatgattggcagacgttgtgttgtggcattatgttaatatgcattctgttttttttttcattctagaatataaaaatttctgactatataaaacttccaaaaaaatatgtatagacaagtgctattttaatgcatggacagtgtgtatatggacaagtgttttttttttcatatggagtatttagaatgatagaaatgcttgtattttgaaacggagttggtaatataattatagggaaaaaccaaaagtgtacttagtacggttgtattttcttagtgtaattggctaacttccataaatctttaataatctaaaaaataattacagaatcattaacctttcattgtttacatgtatacttgttagcttgttagctataaccaaaattaaaatttaaaataaaaaggttttgagatgtttttggtttttttatcgtagtttacttttcaacattagcttataaacag

SEQ ID NO: 82735 - DNA, 7093 bp, Oryza sativa
gtgacttgtagaattttccaaaactctaccgaaacggacaaaatatgtcatctattaaaataggcgtaactttctcatacggactcggaatcaggcaaataatatatgcacggacatctacagaaaatgttacatccgattctcccccgctttgccgggttcggcgatattaaaacctccaaattccgcttgcaagattgtgttttcgaggagagaagtttttcggtagaactttggaaaattccacatgccacatatttcgtccgtttgagtttattttttacatggttgattcctgtgagttcctaagtgtgaaaaaaatatcaaaaaataaaataaaaataaaaaagttgtacatctctcctttgcactagttcggagagaggagaggagaggaaaaattctacaggtcacatattacgtccatttgagttcaatttttctatggttggttctctaagcgtgaaaaaaatatcaaacaaataaaacaaaaataaaaaatttccgggggggcgccagccactctggcgcactccctagccacctcagcatcgccccgccacgtcagcagggggacggcgccagagaggctggcgccgtcctgttggacgacggcaccggccactctggcgccccaaaaggaccatttttaggataagtttttctagaggtctatttgagaaaataagttttttaaaaggaccaaaatatgaaaaatccagtcgtggtgaccatgtgacaactataaccacactaattgaaggcatcaacggaggtcaatcggtctgaccctgcagcgccgcccgcctagctaggccaccgtcgcttaatttgcatcgcatatgctgcattcatgaatgcgtgcgctcgtggctgcgtgtaccctttgcctctctgccctgcctggtcgtgttcaacgcctacgacgacgtttaatttgatcaacgcacggcagtagagctaataaatactagtacgtgggtcagtgatgtatgtgtggtgtatagtagtaggagtgtacggcatcattcgctgtatgtaccgtaggtttgctaaatggacaggcgtggaagttactcgatcgagattgaatttcaatcgttgaaaagttgaaaacaaccagtggcagtttaccctcgtatccctacatttatacgagtacaacgtgtttacaggggtattataagatgttttgattttgatcaaaatcaaatttatttaagtttaattaagtttgatgaacattcatgttagcaagatgaagaaaaaaaactagagctctattcagttgcaccttttttttttactgtagtgcagccaacaggcacaatgtcttgtatttgtagttgccgcagcatgatggttgcatatagtagccgaatatacccagggtgcgggatggttgctggggctcaacttcgctccctccactaccaccgcaacatatatattttgtgataaatctaggccagttactacatataagttgtagagtagttacaatataattatactttaattattttagttacatttgatttttttaataaaaaattatcgcatgttatatagctactcccgaaaagaaatttaaaagaaaacctcaacgttcgctaaagtacatgttttgtctgaaccaatattttggtttcaaattttcacaagcttagcacccaagatttgaaatttggttcaaaatcactaacttttggatttacaatgggctcctgtagggaaaaaagaaaagtaaatttatttgaattttaaaaaaatgcagggttttcaacattaaactaactttttgtcgaaatttttatttttcatccctggaatctgcttcctgagatgtaaaatctcgtagagcccagctcgtagctagtttgagtcagagtcatccggtcaggtggctaccggcaggactcgatacaaatggatacaaattactaaatgaaaataaatgagaactaaagctaagtgcctattctgtcgaaggattatgtataaaactgacttccggcaattattcgagtgcacaaaggaataaattaagcattaagaagttaaaaggttaattgattattttttttaagaaatcttagttaaaaaagtttttgcaaatatatagataaagagcttgggtaacatgtccctgaccctgataactcacgcgcctctacaacctttggctagatgctccactgtggtgttgggctggtggtacagatgttgctcttgtctagcagcggtcgtcgatcgttcacacgtagcgatggttgattcgatgctagacttttttttctttggttatgtgtacatattgttggtgcgtggtggtattgttttgccttttgttttttttttctcttgtgttttttcacaccctaactggattcaacgacgctactcccttgagcagcttcaccgtgcactgtctaccaacgacgccgtaatgaaatgttttagtacttctacttggcaacgcaacagaacacaaatgtatactccctccgtacgtgtaaagaaatcatttaggacaatatttaagtcaaatcttgagaatataaatcatgaatactccctctggattgataatatttatcgttttgaacaaggacacagtctccaaaaaaacaactttaactatcatttttcattataatatatataaaagtgttaacaaatatatgatattactaaagtactttttaagactaatatatatatatatatatatatatatatatatatatatatatatatatgtagtcaccatatttgaaagacaaatattttaaaaatgattcataatcaaatattctaaagtttgaccttatctttgtctaaaacgacaagtattatcagtccggagggagtaaatctcaagttgttgagtttgaaaatgtaaaaattatataaatagatttggcttgaaaaatactttcataaaataatgcatatatcatttttcaataaatacttttatagaaacaacaaatcaaagttgtgttttagagactatgtcgctgagggagtatccacattccacaaatgatctttttttttttttttgagaacatacattccacaatggtcggcacggtgaaaagtcgtagccatcagcccgtcacccatcagtgccccatgcatctcgcctttgcaacttggattccggtggaagaaacacccccggaacggacaagcggcgaccgggcgggatcgtacggcgaacccaaacgctcgccgccgccgtgaaacatatttggcggcttccccgtgcgagagcgagagcgagaccaccaccaccgctatggatttggatatttggatggagcggcggtgtcaacgcctcgggtggctgaccaaaccgcgtgatgagtttgcatcgcatatcgcagccacaggacaagaggaaaaggagcgcgagttgctgtggcggcaagagactctccgagtccaccggttcacacgaccacgggcgggggtgggtcggggtcgtggatggatcagtcggcatcggtcaaacctgcttctggtatgagtatgatgatgaccacggcgagcagcggggagttttttgtggttgggtgtgccatcgtcgcagagttggcacgatctcaacatctgcagagtactttatggaatgtttgtgtttttcacagttatactgtgagggtgtttttgttcacgagagctaaaagagttagtagtactctttaaatatcgtgaagatatatcgtttctttgaatgtttctttaggtatgtttgggtgagcttttagctgctgcagattctcccagaatctccagctcccccaaatagtccagattgtcagccagattctgggaatctgtagttgtagaatccaaaaaatgaactcaccaagaagctgctccagaatcttaagctcccaaacagggtctttgtagtttcgtcgagcagaaaatctaggacgcattgattcgctcagaaatggagtattcatgatgttaagacctctttgattcaaaggaaatttatagaaattttagagaatttcattccttcatgcggtccaatcaaacggtcattcctacgtttttcctatattttgcaatactctgttttacacttaggcatggtttatttcgcaaattttttccccaaaaacgtcacatcgaatctttggacacatgcatggagcattaaatatagataaaaacaaaaactaattgcacattttacaaatcgcgagacaaatcttagattaattatgctcaaaagattcgtatcgcggtttccagacgagttatgaaattagttttttattcgtgtccgaaaaccccttccaacatccggtcaaacatccgatgtgacacccaaaaaatttcatttcgcgaactaaaaggccttacattcctatcagaattctatgttttttctattacttcgtttttttcattcatgagattcaaagggtcctaaggtatatttctggagtagtgttctgtatttgggttttctggtcatcaagatatactgagaactacaggtgttaaatctacgagtgctttgcccatggaattcaaccaacatggataaggaagcgaagcagagagcacggtaagactccttacctgctcaaattacactctgctttttttctcttcttgtatttttttttaaaaggaagacaatgaaagtgcactccactgactgacgctctaacgcattatcaccagcatacgcaatgtcagcgtcaaattgatatcccatgcgacgcgacgactcttgggtcaacattccatttctgacagacagcaatggcgttttatcagaggcatcaaacgctcctgaaaatgcagatagtaactgagatgtcgtggtcaaatttttgcaccaaactgaactttggtaaccacgagacaattaagatatctacaacatcacagctgcaaattttctctgggttgcaaaaccatacagagaagacaaccttaaggtcttcggagttcggcatttaccaggagatgcttccagtctcagctagagtgagtccaatgcagaagtctgaatccagaagccaacgagagggatcgatgtcgccatatcattgattacaggattccagtagaacaacggcacgaccagcattcaaaaggcagctctgaatctggttgcgatggcaacatgtcggtgatgatgccaatgtcctctgcattgaccaccagatgagcctggaatgtcaagttgtagaggtagaaagacctgttgctgacaatccgaattcaacagcacagcatattggagaaatagtacggtatgtgaacagaattgtcccactagagtggtctcaaaatggaacgaagtgatgattgccctatcaagaaaattgtattgtttgtaagggtacaaaatggggttgcattctagatgaaatcgacatcctccagacgatatgagggtaagagtgtgcatgaggaacgacaactgatacgcgcacaggagaaattcagagcaatagaattacaggtagcatcctaagtatcatggatcagtttttttttacaaaaagaatcatcctggcactatcagatgagactagcagaaaaaagacccacagcgaagtaatcgcccacttctttgaaaacagaggtacatacatgaaaaatggtggaaagcactgatgaatgccgttgaagttcatgaagggcatttgttcctgtctgtgcagatgtgacttgaatgaatcagttcatcagcttaatgatccatgccactggcatctattcagacttcatagaaactgcctaaagagcttctctccgaaatgggaatgcaggttgggagactggagcacttgttgtgatgccttctgatgcgaggtccgaacttcgacttctttcaccccgactcgggtgctgtacctcatcttccactgtaggagcttgtgcatccgtctttgatatcaatttggagtttgagacagcctcattcctactatttctgtctccacctcccatttcaatatcaatgccatcataattatgtcgttgtgagatcttcaagagatcaccacctatgtcaaggtcatcttccacttttgtccgagcaccaaccggctcttcttctctctccacagcacggttagctggtggagctcgcgcttcctcttgtataggttccctgaacttgtgtttggaaggtggaaccttagtatagaagacttctagaaagttattcatacatcctcgatcataggcatttggtctgccatctgctctgtaccggaaattttcatatgtggtctgaaaagccaaagcatccgtatcagagatcatgcaatgtaaaaatatttatgttcaggagaagaggcatctaaaaggggttgtttcaaatgcttggaatgcttgccctttgaatcgcagggtagaaaaaacggaggaatagaaaaacataggattctgacaggaattgaagtgtaaaacagaggattgcaaaacacaggaaaaacacaggaatggtcgtttgattggagcgcaggaaaaacgcaggaatcggatgagagagatagactcaaaggaaattttccaagaggttggagctcttgctaaatttcctccaaaatctacatgcaatgtgtcattccataggaatttcataggatttggaaagcttcaatcctttgaatcaaagggccaaataggaaaatttcctataggatttgaatcctatgaaattcctacataaatcctttgattcaaaggggccctaagtattatttaggaactactcccttcttccacaaatataagcattccaagcatttaaaatttgtcaaaagtataaggattcctagagtactattttccccatcaatcacctctcattcattttttttcccatcttacccccaaccatccctcatttaatgaggggcaccaaagtcattttttcttctccttgtctctccaaaaatgtttatgaatgcttgtatttaaggatggagtcctgaggctgtttggatggattactcactttaccaaacttctatgccacaagtgtggtatgccatagtttttgtggcaccaaaaaagaaagccacacttgtggcaa

SEQ ID NO: 82736 - DNA, 3307 bp, Oryza sativa
cctaaagccctgaactgactcatcgaatcaagggtttgtgctttcccatgagcaaaagaatagaagctggcacccttagtcccttaccctcacaaatgcacacacacactgacaccacagtactaaattaagaagaggaatcccagattcagacaaaaatagtaatggagaaactgaaaacgccctctttcccaaccaattaatcaaataaatatttttttttcaaaatctctcattataagcactaagcataatatgactagatgatgttgcgatggtagaaacaaacaggcaaaaacataaatctttgatcaggagcacaggcaaatcaactagcaaaaagaaagataaacttcacataaacaggctgacctggtttgtgctgatgagatatgtatgaaatcctgtgagtccaccaacaaaccaaagacagatgaaacaatatattagtaatgcaagagaagcaggggagtgtttcaaagccttccacactgtgggatagtctccatccatgagaatctttatgtacaatgctgacatagcaaatacataaatgcataggatactcgccgaagaaacaaataggaaaaagtatcggtaattgcgctgcacaatggaaaagtagaaggaaattaagataagcaactaaaaaatggagcaactcaatcaaaacatttttgacattggatgctatcaattgtagatatgcctatgagaaactcatatttacactatggatgaataattttcttataaatatcaaattaaccaaaaaggttaaaaccaggtagctcgtatgaatatataggagcatttttagtaaatatgaaactgacagtttgcctttgcaatcacattgtctataacatgaatattgaggggtgtcaagtcaccaactactgactgggaagtgaatcagtacaattccagtgaatgctacatgtacattaggtagtgattgcctgtaacattatgttgagcaactctgctcttagatgacattgctgtccagcaatcaataaccgtagaaagtttactttgttaaaaataagttgattaaaagcaaggagataatatcagggaaatcatgtagacaagcggtataagtttattgcggacaactaaatactctgcctttagattttaatcaagcagttgctgaatttgctgtagtgtaagagtaatcatctcactacttaatattactagcttataacacacaaaaaaaagttacctttccaatgcattgccctacccaggggcaatgatggtcaaaccgttccacgcaattgttgcaaatggaacagtgcgaacaccgaggaggccgaaaaaccatgcaagtttcacagtacttgaccttcacaggcaccccatttaccataacatcttttacacgagggaagactagtctgccaggtgtgtccgcaagagataaattgtcatagtgaaactcttcttctggtggatgagatgcacgaggtacaataccaggatcctgagctgcggtgatgaaaagtaacgaaagcacctgcaagaaaaagaatgcgcatttgttgtgtcattaaatcttaaaatgcccagtgtgaaagatacctacaagaaatagaccaaaatactcacatagattgccaacactattgctacggcaagaattgcgtaccctgcattgtatgcaggaaattgatgacgaagattccgtgctacaaacgcacagaagaccgcaaccgggacaaaaatcagtgcaacagaaaaaagcagggatttagcatcaggtccaaatattagccgaccaccaaagaagaacctctgcagattagaagcatcgatcagttcacaacaatgaatccattccaccatgaagacatacagagtgccacacactttcaaagatggagcaaattgcagctgaagtaaaaaggcctaagcaatgtatgtaagcttaaaaaaaatgttattaatgttctggagcatcaattccatagaccatcaattatctaaaaaaagacaacacaaatcaatccgattcaactgacagtatggtgattgcagacagggtcggtacgagtgatgtccccatcacagccactctgacattcgcattcagattttttcgcatccgttatctccacgccaaaaatgaagcatagtattgcattggaacaacatagggcattccaaacaagtagtgatatcatagtatacattgcttcttaaaactaggcactactgaactaattaaacgaatcgacaagttcaaacagctagggcaactcgattccacaaagcctacaaacttggcagtaatctgtgtttgctagactatatgttatgattaatgaaacaaatagtatcacaacacacctgaaaagaaaaggtatcacagcgaggcgcatgtggccggaggtgctcataggggtagggtgtgcgtgtgtgcgttcataggggtgagtgtgcgtaagttgtgagcgcatgcgtttatactgtgtttctcaaaaaaaaaaaaaaagggaaatccccgcaagagaaaaaaaataaatgttgatacaaaatgtaaaattggtaagctgaagaaacagcaaaacctcacgaacgcttcgaaattcgaatcctataacggagcacaaaccttcgaatcctagaacagagcacaaaccgatccccctcctaacctaacaataaagaaaactagtatacaaacaacaatttaagaggtaaaaatcctaaaatcctcccaagaccctaaacgagaacaccgatacgatccctagaaactgtaaaaccaactcaataccagaaaggggaagcggaaacgagacgagtatacacgagaggaagaacaattctcacattattccccttccaggcttcgtagacgcgctgccgctgcgactgcggctgcggctgcgccatgggcagcggactccaggccctcccgaggctctcctccaatcaacaacccatcgaatccgcgcgagccggcgaggaagaaatcgatgctcgcacgcaagaaactgaagtgcacgaaatcgacgcgaagaagagagagagagaaggcaagcagccgagagaggaatcgatggtgaatgaaagcggctactgtgagcgagagtagggtacaaaagaggactttttttattgttcgtgggaagtatggagactggggagaccggaagtccagaacgcccaaaattctctcatttttttatttgttttttaaggaagaacgctgaaaattattagagcctgtttggtatagcttcaactcctaaatttaactccaagatttgagtctggagtggagttgtgg

SEQ ID NO: 82737 - DNA, 2418 bp, Oryza sativa
gtatcagtacctatgtaaaccgagtaatccggtagtatttgcgtgtgtaaaactgtaaattgggtaattctcctctagtgtgaaaactagtcggatttcatatgtaattttgcacggagctagattatccaaaagtcaaattatatttgatgttttgtttctaattttctgtgaatacaagtatgttttgtatattagttgatatatagtataaatttataatctggatctgacgagccactatgaacatggttctttttgttcctttcaattatttataggttcttagtataattggtgcctcattttagctttttttaaaaagtcttttgtcgattacctcattatttacattcatattgcacatatcccatgcagctgtggtcatgtcacacataagtactcttattgtcgcttgtgctacaaccaaactttagatggtattagagtgcaccacaaacttttggtggtatacagctaaagtcgtgaaatttctatgacatggaaccactttttcccaactttgagtttgtcgattatcttcaactctcgaatactcttattgtcgcttgtgctacaaccaaactttacatggtattagagtgcatcacaaactttttggtggtatacggctaaagtcgtgaaatttctatgacatggaaccacttttttccagctttgagtttgtcgattatcttcaactctctaagccgttcatatttcatcattacacatcaataaagataattttcaatgacgtggtatcacctattgaacaaatcaaaataaaggatgagtataagcggaaaagaaggtgaagaaggcatgtgaatttttatatatttttttcttttttaattgtttattattatttttatgatgacattattaccctttatccacgtaggctccatataaatgccatgccataaaaaacaactccagttttaaccaagagatgaaatacaaatcattttgatagtcgaggagctaaaagtgaacggtttttatagcttgaggaccaaagtcgaaccaggaccttagttgagggactgaagttatatctgtaactgtgcggccgctcaccgctgcacccggtctacttgacttgacgttaacaacggagcaggatgacccacggtgaaaagtcgaagggaaggcctcgtaggtcgcttagatcgggcccggccagcgaagatttcccagcgagaactgaaaagcgtgaagcggcaatcggcaacgaaagcgacgagcctagcgcctctagtagtagaagaagtaacaaagcttcctttaccgtgtgatgctttgattcgatcattcgattaggtataggttaggtgcattaagctcctagcagaagcaaattttacctcggatcccctcacattcagacaatcagatccctacttttgggagcagggaagtgtgggatgttcagctgttactccgtagtagattattagagaaaataatcaaaatgtaatgttcagtcctcaggagcacctgaatgatagctggtaaaagcacgcaaagagaatagtgcatatgatccgtgctactactatcttgctagttgctgcgccatttatatatagtttgacttgcagacgatttaaattggcagactgaaacttaaagaatggtcctgggttactgtattttgcaggagatgacccaagaagagacgtacggtatgtctgtggtccaaatagaaacgcaaaaccaattttaatgtgttccctatagtaagaatggttaaattgtgcaacaatttatgtacatactccctctagttttcaatttaattgacgttttggacaatgacacggtctacaagatatatctttaaccttatttttctattataatatatacaataaataaatgcacgtttacttttattatagtgctttgaaagacaaatttatatatgttgttctagtttctttaaactaaatatttttaaagttttcgatggtcaaagtaataaaagtttgaccttaacctttattcaaaacgtcaattaatatagaactggagagagcagtttttttttcttttaccaacatcagccatgcaggctatttgcgcagttgttcatgggcgttattatttttccataggtagccgcccggggtaacagaacacatttaagagttccagtacgctagactagtagagctgtcttgcatgtttgaactgtaaaacagttttcctgaaaaacgatatgcagaagaaaattgttgcatctatatcatggtttgacattatagaacagcagaagaaaaatgacggttccatgtcctaagcttatcagtataagctaatttaactgtttcttgtttgactcaccagatatgatcaacgcaagaatatcttatggaaatggtacttgcgtaacaagctggattagca

SEQ ID NO: 82738 - DNA, 1027 bp, Oryza sativa
gactttttaaaatatatttgaccgttcgtcttattcaaaaagtttaagtaattattaatttttttcctatcatttaattcattgttaaatatacttttatgtatatatatacatacacatatatgtatatatatatacatatatgtgtatgtatatatatacatattttacaaaagtttttgaataagacgaacagtcaaacatgttttaaaaagtcaacggcgtcaaatatttaggaaaggagggagtacttatctcgatgacattgacaagtagtgtatgaaattaactaggaccaactaattcggcacgtaaggataactacagtttcagctactacttacccgtcagtaacgtacacgtagataacgctctatctagatctttagaaattgcaaagatctcttaaaaatacgaaaattttacaggttctgaacaacatgatttcccctctaaagaaaatatgaatatatacacacaagcacacttaccctacaaacatacccaatattttatcacaataaactctttcaagagactagtcggtaatatcgtagttggcaagtacatcatgtctactcttaattaatataaatacgaataattgtgctaagtcaaggacataattttggttggtaaagtaacgaactcatcgttcgcgaagtgaaccagaacagaacacttttaggtgaaccgtgctaaaattttctttcaagaaaaatcacacaaaactacaaaattactagtaccaagttgagttgctttcactgttctgtcatgtggtctccttgtccgctctgtgtattttctgccccctccagcgcgttggcgcccagcccccgctagtcgcaccagtgcgttggctcgatggaatccacgtcaccaagacaagggtgcgtgtagccatctagaccgagacaccgtctcgtgttacgtgggggcggctgccacgtggacgggccggcgaaaatcgcgcgttatctcccatttcgttcgtctcgcgccgcgccacatgcgtatggttttg

SEQ ID NO: 82739 - DNA, 69039 bp, Oryza sativa
  unsure (1)..(69039): unsure at all n locations
ccgccgccaccgccccaccgcgccgccggccgcctcgccggtgccgttgacgccctccggccagccggcgaggcgggcggcggcgcggtggggcggtggcggcgggggatcgcacgcgagagacgggagtagcggtggcggcgcaatctggatgggggaggaggagaggagttagggttaagggtctgcatgaatcttgaagcatatccaatggtccaaaatttgaaagataggaggtgggattttctgtcaacagatgtgtagacagtcccagtaagtaaatattaggctctaatagtaccccttctcttcctactttaaaatatgtattcccttctccgtcattctcactctccacgagtcggaaatcattctcgccgactctagcacaagagaaatggcgaacaggatggtggcaccaaatcgtgtgatcttctagcttaggtacggatggagggagtccgacttctattgctatagctaggactcacgttttatagtatggacctaaaaactaggtcctgatctttcaatagatattgataactctcaatttgatagaaacttgacacatacgatcccgttttcgatcaacacgatccgaaccttgcaatcacagcaccacgtctcctctggttatcaaccatgcgctgttcggttgacctcgctgagaaggctaatccctacgggtgtttcacctaggcctctgaactctcaaaatgtatttttgggtccctcaacttgtctcgagtgtcatatatatccaaacaggcttcaacccgctccatgtgctgacgtggtatgccatggtggcgcgtacgtcagtagaacccatatatcagtcacatatagaaaaaatcaagaacatatttttctcctctatttttttatttttttaaaaaaaataaaaaaaatccctttctcttctctttataaattttatttttttttctatatggctggcatatggatcccactaacacgagcgtcactgtgacatgccacgtcatctcacaaagcgggttggagcccgtttggacatatatgacacttatgacaagtttgagaacccaaaaatatatttcgagagtttattagggatctagatgacacatccgtatacaagtttaagaaccgtacgtgtacttcactactcttaatgtttatgatatagctactactgtctgcttccaccaatcaccgcgtctatttttttaccaatcttacttctaatcacccctccttgctcccactgatccccaaccatttctcatgcattcaaggaacaatgatgcatatgtgtagagatgcatctattctcgaaataatttagagctatatatgtcgatagggacaagataaattgatgatttgccattttttggatatatcttagtgtttatatgcatgtgttgtgttaattacaaaggttctatgagttgataaactagcgtgtaggttgtacttgtttgagtttgaccgctgagctcaaacagaattaagatgcatacatgatgggcatgcatcaattagctaggttattgctttgaaaagtaagttagactttggtaggaacgtactgggtgggtatatatatatgcaataattcgaaacacggatgctacttccactaattgaagaatgaatcagtaggcgcgtcttcacacacttgcttcaatcggtcggatatatataggcatgttattatgattttatcctggttttcgttagcacattcaaattattaaatagaataaaatctttctatataaaagttatttaaaaatatcatataaatatcatatatatcgtttgtgcttgtctactcccctcccatctcctctgtcacatatggctagagggaaggagcccgacggtggaaagggtggcggagacggcggctggcagcggaaggtgtggcagctacggtttcggccggcctcctccactcccctatctcccttccctctcctagatctggccggatgggatgaggtcagcggcaactgctggggcttcggtcgggcctatccactcccctcactctcccaaatctggtcgaaagggaggaggtcggcggtagcaaaggggtgatggcggcggcaacaggggcttcaaagggctccttcattccactccactcccctccctttcccagactagctctccctctaccagatctagctagaggggaggaggacgattgtagctgcggccggcagtgacaagggaagaggagcaaatggcggcagcgcagtggagaatgatgacctagacgacgacaacgacgatggcctcgatagtgcgcaacggcgacggcaaggctcctggatctagtccatcgcggtcgcttgattgtagttgttgcttcttctttttcttgtgaatttttgttggatttgtaaatacaaaatattttggagtagcttgatttgcaaatctgatgaaacgttcttcccattttctctttgatttgtggattgttctatgaaaattgatgtggcaatgggcagacaaagggcaattgtatgcccccccccccccatgagccaagtggggaaattgatttctacaggcaaccgaaaccatcctctagaaatacccgatttttgtatgtcttaattcgcaaacaatgtatggccgaccgtgtgcgaaaacctgttttgttcgcatacgaaaaccttttctctcgtagtgatttctacagccggctaaaatggcatgtgtccatgcgtataacatttttttcctactgtccaagaatatataattaggagaaacgtacttaacagctagctagcattgtttcatgcatatattagttgaagaaaaaaaattgcatgcgtgcgtgcatatagggatcgaaattagccagtgtcaaattaacatacatgaccgatcgatcgattcccgaccacgatcgagctagcacatatatgtccatggtgtatgtatctatcatgtttaacgacctcagctagctgctggctaacgtaccaacaaccagctgctgtccaagtcaattacatgaagctgatgttgatcccgatcgatctcgcatgcatgtactcatctttaatttattccgatccctacccggccgctgctgtccattaattatattctttggttagttagatgatgattatccaaattatttcagtctcttctctagctagtatatattacgtgtgccaaattaatttaatcatgtctgagtagtaaaaaaaactgatatacagtacataattgtacttgagcaaaagaaaactaattagtaattcattcagtctatatttttactacggtcgacatgcatgtatatatgctttcaattttaatttgttatattagttatatataacaattatatagcaaattataaagaaattaaatttagtgcatcctagttcgttttccgcccggccctccaatatacgtagtatatatagtatatgcttggcattgagagttatatatagttggggtgcaatgcaaggaggccgtgcacgcgtgcttgcaagcgacggatgcatgatcgagatggatggatagatagatagatagatagatagataggagtatgtgccaagaattcaacttagtagctagccaagactacctccggctcaaaatatttatatttctaaaaaagagacatattagctgtacaaacaaattaccataataatcctaaaaatatagaataaagtaaatattgagacaaatggagatggaaatataggagggggtagaaggtaggatatttctaattgggtactacctccgtccttcccagaatataacaatttttggctaaatgcttatattttgggacggagggagtaggttttatcttattacaaatacaattattttaggagaaaatttaaaaagtagaaatacaattattatactccctacattctaaaatataagggattctggagggatgttatattatgcgacagagggagtaagaagcagtagtcttctttatagtgaagcttaattaggaacatacatacatatatatatactagcaaaatgcccgtgcgttacaccgggtattagcggggtgtttgaagtttgatattaatgatttaccaaaacaccatagtatgattattagcatcggttatatgtacagtgataaaaatgatgcccgtgcgttgcaacgagtgaagataattttaatcatgtatagtgttggacaaaaatgataaaggaatcgtaatcataataataataatgaaatgaaattgcagtgacatttggaaaaaggataaaaatatataattaattttccgttaattccattagctaaaaataatttaatatgaagtaggaaaagttattctcaaattttagcaattttcaaaaagcttaaatagagcaaactaattttgtaaatgaaaaaaaatttaatcgcctaaataaaacaattagacctgtaattgaaaatctgttggccatctcgtttaaacatgagcctgcgggtgcgtgtggtcacacaaattggaaaataacatctagccccatgccccatctgtcagcgcatttgatgctacctgcgaatttatacatcttttcggtgttactgagcaaagtgtgatcattgaatgctgggagaaggggtggagttgtaattatcagcacctgtgtgcaaaatacaaatgttctctcctctattggaaaatttatttataggaaagcgatacaagctgagtagctgatacatttatttttatcttcactaaaaagttcatgtgtgtgatacatttatttttatcttcactaaaaagttcatgtgtgtgatacatttctttttatcttcactaaaaagttcacgtgtgtgatacatttctttttatcttcactaaaaagttcatgtgtgtgatacatttatttttatcttcactacaatgttcatgtgtgtgatacatttctttttatcttcactaaaaagttcatgtgtgtgatacatttatttttatcttcactaaaatgttcgtgtgcgcaatacatttctttttatcttcactaacaaggtcatgtgtgtttataatgcttcctatttgtttagttttgccttttgcttttttcacctttctttctagaagctaaatataatataaacaacttttcttgttttcttcaagcaggtttctttgtctgatggcattattcaggaaggtcctcagagaatttcagaggcagctatacagatctctaggtgtcgtgtagcggattttctgaatggacaaactgggtatgatttactcccagattctggcaaggtatggaaaatgagctcgtcttgtatgaattttagtgctctaatggttattcttattacattatatttacaattcaggtcattgctctagacgttaatttgcctgtgaagcaatcttttcatattcttcatgaacaggtgactatgccttcttctgctagtttccctccaatctttcattcttcttctgctctgtagcctgtttccctccaatctttcattagttgttctgacattgaactagtgatattttgctttgatctgtaaatatagtggaataggtacatacctttttagtaaatatgttggcctgttgttgcgtacaatgtttggtttcattggcagcttcaattcatctgagattgcatgaaaatggaaacactgcagcctcatgccttaaaagttgcagctacttcacctacttcacacttcttgtacaacccaatgttgcatccttcctcttgtacacatcacctagaatgcatgtggtcaacctttaaaagcttgaaagagcactatatatgtaaaaacattcactttaatttattaatcgatacatcatcaatggggtctaatttttgttaagatttgattagagcaagtaattgtcaagggtgatgattgatgtgtcagacatccaatacaacaattagaagaggttggaggaagtaggttctattctgtttgcactccacaatttccatataggttataagaaagttcagctctgtgctttcttagctgccatcttgattctgatttaattatttttggcatcttgatataactggaaatttcatagtttctttaaccatatatattgaagtacaagaaatattggctggttttgggaacatacattaaataaatagtgtaccttgcagggaattcctgtggcacctctatgggattcattcaggggccagtttgttggccttttgagcccactggattttatactcatattgagagaggtaatttattctgtcacttactgtttggtgttagtattctttaattatttttttatgtgtcattgttgttctctattgtatattttttattgttacaagtgatggtttaatgttcatttcaaatatgctgccacttttagtggccctgcaaaacgaaattgcgcaattcttgttttttttttttaaaaaaaatctgaagcagtgtaatatcattctttgacagtattaagttattgacctagaagcttatttcacatgaattataaagacgactggttcattaatggaatgtgggagtctatgcatttgaacaatgtacctgcttgtaatcccgattctgctgtatcacttagtaaccatgcatctcatggaactttgtttgggtgaccacaagaagttcagccaagatagtgatcatgttgaactgtttttcccttaattggaagtgttcagttagtagaacctccaaaaatttgaaatcgtatcttttggaaggtggactctagaaaatagaaataaatatgctagtagtagcgactgcatcatgatactttatttttatgctgtttgaattgtttctgcttccaggtaaaggattattaatcctgaccatgtgatttgttacttgaaacaatttgtgagcatattccaacagagtagcatttaatatcttgtttatattgcagctggaaactcatggctccaatctgacagaagagcagcttgaaacacatactatatctgcgtggaaggaggccaagcgtcaaacttatgccagaaacgagggttcttggagggcaaatcaccatttagttcatgtgagttgtccactgtgtttgtgaaccaattgcaaatctgtatgcactcaccacaaattgagactgctgccatcaacttctatctatatttactggccaaattacactccagtgaattttagaattcatgtattgcattctaaggataatattttaccctttgatttatttgcatttgacaaattgttgtcaacaattgttgtgtgagtaccacataacagtttttggcacaccatgacacacatttttgtcataacattttttggcacactatgacacattttactttttgtgttacaactaagttatctactggatgctgaaatatattttgcttaattagctttaattgccatgctcaagtgagttacttagtgaactgcaatttgtttggtgtgaaatttcatcgaaccccttgcatcaactgttccttttcatttccatcctagtattttataacatgcttagttttataatgatcatgtgtctcatgcacttatgctggagtgaatctattgtttaggccaccccttatgaatccctgagggaaattgctatgaagatactgcaaaacggtgtttctaccgttccaattatgttttcctcatcaccagatggctcatatccacaattgttgcatcttgcttccctttctggaattttgaaatgtaagtgtttctatgtatttgcatgaaaagtgtgctatacacaaacatattacatgatagcttaacaacatttcattttcaggtatttgtagatattttaaaaattctcaaggtaatttacctattttgagccaacctgtatgcacaattcctctgggtacctgggttccaaaaattggtgatcctaatggccgtccattggctatgttgcggcctaacacatctcttagcgctgccctgaatttgctggttcaaggtatgttatctgtctgttttaccataaccaatgcctgggaaagtacttgcatttctgtttcttggtgcaattactgaagtttaatactaattccactgagatctcttacagctttcgattatttacgctatcttgttgccaaattaatgtcttattacaattactctgtactctaattgtttcattcagctggtgtgagctcaataccaattgtggatgacaatgactcactgcttgacacatattccagaaggtgcccatttgatactcaccattctttgtgtagtcatatactattctttggtccatgtattcattgtgttttttccattatgtagtgacatcacagctcttgcaaaagacaaggtgtacacacacattcgcctagatgagatgaccattcatcaggtatgctagtaaatatttaatgcgtcttgatttagtttgtgtctggaattttagctgggatacagttgtacaataatttttgcagagtttcttttggtcttgaagactggttaacttagaaaataataactttactgatttatgtatatgatagggaaatctgtatcgatacctgcatcacacatatatactatgaggacatgcctttgtggttctggcatttattagccctgtgtctttttgcacgcagagcatggagcatgcacacacatctaaaacaaaggctgtaggctgtagtttgatgtgttttgtccatttatcactcttactttccataccggtcaaacaaacatatactataatagaataagtagtgcaatgctgtttaaagcaggctttctcgtgaatttgtgtatatgttatccatcgagctggtgtgatttttggtgtgaacctactcatttttgttgttatgttcaggctctgcagcttggacaggatgcaaattcgccctttggattctttaacgggcaaagatgtcagatgtgtctccggtctgacactttgttgaaagtgatggagcgattagctaatcctggtaattatctgtgcctagatatgcttcctgaaagcaacttttcgggttcaacttactaatattttttttttgcattttatattgttggtaggggtgcgccgtgttttcattgtggaagctggtagcaaacgtgtggagggcataatatcactgagtgatattttcaagttcttgctgagctaagtgaaaatgcccgagccatctgtgttttgttctcacaactgccggagttaacaatagcagaaaaaaattgtgaatctccaacatcgatctctctggcttttggatcagacaggtgtcttttcccgataatggccaaccagagtctgtaaagtcttttttttttcccttgccccttcgttaccaaaatgtctggtgatttttatttattggattgttttgctgcttgctcggtttctgagccccccaaggagttagtagctctgttgaaagggtgggatgggcgcttagagacatattttagcatgaatcatcatcacagggaagtaagaattgaaggaaagaggggatgctctgaagcaagaaggatgaattcaatgtgttgtttttgctcaacaaccgtttttttggcgggcagtgttgcaaccatgaaaggagaaattacagtcggctccttgcttgttagacaaaaaaaaaaaagaaaaaaaagaagagaaaaactattggatatctgatgatgtagtgactgagaagcaggagtggagttgtgtaaaacctgtaccacctgatttttatgtctaaaccgcagcttactcattttccttgtctatgattcttgcttgcttgtgtagtgaatagtagtttttcttgtctggtatctctctctggtagcggcgccgacgtgcggaggctgtttgtacaagttgagccgcatgcaatgcatgttgaggagcaactggaaatcgatttggaacttcattgatgcgtgcaggtgaaggtgaaggtgaaggtgcaggtgcagcgtgcggtgcgtccttggtccctgtcgagtaacggcgacgggcttggcgtcgagcggaaagatctagagagggtgggttacgtcgacagacactggataagatcaatccacatcgccacattactccgcccttttagacgcttgtctgctgctgctcatcagtagttcatcagtagtagtggtaggggagataattcgtcgttcgttttgtgcatccatccagaattcgttccagatccagccagccagccatctcaagcttctctcttctcttgttattaagagcaagcaaacagtagtctagcgaagcgagactgcgagagcagagcattgttcttcttctctagctattagtggtggggaataatggctcccgccaccaccgcagcaatggccctcgcgccgcctccttcccatcaccatcaccatcaccatgtcaagcagctgcagctccctccgtctgtctccgtctccgtgcccctccgctccggtttccttggccgcgcactgcctgctgctgcccacccacagccgctgctcgccgccgagagccgccgcagcagcgccgtgtccgtgcggatgtcgtgggacgggcccctctcctcggtccgcctcattatgcagggccgcaacgtcaaggttctcctctcctactgctaccactagtttgcttccctggaatttccttcgtttcatattataaggttttctagcattactcatattcacatatatatatatatgataatattctagattcattatcatatatatgattataggtaatgctagaaaatcttataacctgaaacagagggagtatatataattcggtaatggaactagagtatttgttttattaattggacctttatgaaatactagtagaattcaacgaaactacattcttctttattggttatattagtagtaatttgcttcactagaattctattttatactagagagattaaaaattattacaaaactaactgtatacccgttgcaacggaatagtaatatggacctattacttattactacctccatattttaatgtatgacgccgttcactttttgtccaacgtttgaccattcgtcttattaaaaaaaattatgtatctattatttattttattatgacttgattcgtcatcaaatattttttaagcatgacataaacattttcatatttgcaaaaaaaaaaaacgaatggtcaaatgttagtcgaaaagtcaatggtgtcatacattaaaatacggagggattatatgggatagctacagtagcagagtcatgataaagtagtaatgtgttgggaggagcggtagagcgttgtgtggaaaaataaagatgggaatggaatggaatgaaaagcgtacgtgcgtggcgtggcggtgcagctgaatgagaaggtgaaggagcacatcgaggagaaggcggggagagcagtggcgaagcacagccagcttgtgaaggaggtggacgtgcgcctctccgcccgcggtggcgagctcagccgaggtcccaagatttgcaggtgcgagatcactctcttcaccaagcgccacggcgtcatccgcgccgaggaggacgccgagtccacctacgccagcatcgacctcgcctcctccatcatcaagaggaagctcaggaagatcaaggagaaggagaccgacgtccgccacctcaaggggaccaagccccccgtctccgactggccgccatcattgctcgacaacaacgacgacgacgcccaggcccagctcaaggatctggaggaggccgtcggcgccgaggacgaggacacggtgctcaccaaggtctgcagtctgatgcatgatcaatgcatataaatcaaatcattcatgaaccaaattaatgcaactgtgaatgcaggtggtgcgcaccaaggtgttcgagatgccgccgctgtcggtggaggaggcgatggagcagctagtgaatgtggaccacaacttctacgccttcagagacgagaagaccggggagatgaacgtcctgtacaagaggaaggaaggaggcttcggtctcatcgtccccaagggagacggtcatctccacaaggagaccatccccaactctgaccaccaccacccctcccttgctgcctagcctctacacctcctgcatcaccatcctcatttgctaattatttctatgcttgcccaagagtctctaaatattactagtattaattaatccaagtgatgagagaggtctttgattttgtctccgtgtacatcgatcgatcgactcttgactactctgtttaaccaactgttttcgatatatttatattattaatgatttttccaaggtttttactctgctttatttctggaagctgcatgtatagcttgtgcttttgctgtattattgcaaattttaaaaaatatatcctacatcttagccactcgatcgagaaacaactgaggaagtccatttgtacctgtttttgaagataggagaaacgttatattcagtttttactgttgacagagttgattcgatccaaatcgaagaggtgaggaatgtacaatagacttattcatgggtgtgtaagttaataaataggaataagttcaccagaggtcccttaacttaaccgcgagatttttcgaggtcccttaaccacaaaaccagaaatgtgtacctctaaactcactgaaaccgttcaaaggaggtcccatagcagtatttttgcccggttttggtgacgtggcattctagtcagcaaaagaaattaaaaaaattacatgggacccacatgtcatcagctgcacatttttttcttctctcttcttctttctctctcctctcttcaccggcagcgggcggcgatgggtgagcacgggatgcgggcggcatgcggagagccagcggagtgggtggcgaagctggatccgcatgtgctgctggcgccgccgccgcggcagatgaaacaactaaccgaccatcgctgcttccaggggcggagctagtatatattagggggggtgcccaggaacccggttaagaaaattttttagctataccttatctatttttaccatgtatgcacccccctcaatgtaaacttaggcacccgcataagcttaaactcgatctaaagtagagtaaattaagcaagtggcaccaccctccatttcgctctagctctgcccctggctgctccgcctgtctgctacgcccgtcgaccgctcgccgccgcgctcgcccgcccccacccccgccgatgggagcgaggcggccggccgcgccgacgtgagaggggcagaggcgacggtggcggcgctgacgggttccttcccctgtcgctggtcgctgaccggtcgggggacgacattgacgccgtgttcaaccccgaatggcgccgtacgattctactgcttgctatatagctcaacgattataaagcttgaaggatgaattgaagcttcgcttttcttgagctatatggtgtttctttgggttttcttctttgtaggtaggtgaccaggcgctgtacaatgggttcggggccgccggaatgcatggcgctgccgtcatgcagccgccgacgttcgggcaggtacgcggccaagaaccagtactcccgtgggttcaacttcttccccaattcattctgcttctttaccagcgttggaaacaactgcctgcctgccgcctccgcggcgctcgtccgccgtcgccgcgctcgcctacccccgccgctcatgcctgcttcgcttgccaccgctgcgctagcccgccgtcgccccgcccgtctcggcccgtcgaagaagagagaagagaagaaaataaaggagaaaagagaagaaaggggaagaaaaaagagatgtggggccacatcattttctctcactgacatgtgggcccccacatatttattttattatttttactgactagaatgccatgtcattaaaaccagccatctatactgccttagaacccaaattagatggttttgtatagtttaggagtgaagatttctggttttgtggttaagagaccttaaaaaatctcgctgttaagttgagagatctccggtgaacttatttctaataaatatagccattagtgggccgcctatacgaggcttattttaggctataaacgggccgtcattatgatcaacacggtccatcgccacgcatgctaagcaggctgattatgtgtcttctatacgttatgttactgcacgctcactttaaactgtcaatcatccatcattatagttaggcttatctcatattctcatgcaaaacaagaatgttcaacatcacccactgacaatgtactcacaaaacacacgtacacgcgcacgcccacacacaccaacacacgcaacgcacgcacgcacacacgcccccccaccacacaacacacacgcacgcacgcacataaaaacacacacacagacaattgcatgtttcaaacattacaatcaatccgcaaacgtttagctattattttctacaatgaaagcagcatttaattatcatgaaagcaatagtcaattcataaacactttattccagcactggtagggtgtataaaaatgggacaatagctaaaggtaaacaatgcactattattcgtgcaatgcatctactccctcagttaaaaaatgagaagctttatccttcaataccctttacctaccatcactcttactacttttattaatgattaagggcattttagtcattctcactctccactatttccaccttgggatgctaggaatggtttttttggacggacggaatataaggttggaacagtgagatgtgatatagtaaaatgttggactacgcacgtgcctgggatgcgcacaaacgcattgagaccagcccacgtgcacccgactcgacccatgctctttctcttccgtttctaatcacaatcatcgaccgatctccatccgagtccacgcaggcatttagggtcgaatacaagaaccaaatctattagaggagggtgaatggtaaaaacattaaaaaaataaatccttttatggaattaaaagaacctcaaacctaataaagttgtgtccggtcagaccgcgttgtagctgtcggtcagaccgctcttggttaacaaatctgccgacatgctcgctgtcgctagtgtgatcgcccatttatcgtcggttagaccgctcgcatgatgccggtatgaccgttgggaccaaaaaataactttattgcatcaaaatgtgtttataaagtgcatccaaaacacttagctctcaactcacgaactagaattgaagcctcaaagcaaaccctgactttcctttccaaaaagtcaagatacttaagccacatcccctcttctatttataccaaaacatagttgtattttgccacaaatcgaactataattaggaatcctaatgacaaagcaaacccttcaaatcaaggaaacaacatccctatacaactccaaactcagatctcctcaaacttggaccacaatccaaatttgactcatctttccatacgcacgcaatctcccttatatgccatacgaaaatctttatcctcacgtgcattgttctctagccttagtatcccacaaaatctcgttaaccgtctagacctcaacttctcccaagctagttcagatccatcactagcgatactatctgaggccttaagcaatatatgcacatgaacaacaagagaccatatccgagcataaggtcgcaccaacttaattcacatcagcacacaacaatatcatatacgtatagaaaccatctacaaatcataaacatgaaacaatatagaatatccactaaaataacccgaaattgactcaaaccatacatcaccccggtctgaccgttaggctgcccggtcataccgcacaaacacctcatgtccgataagtgatcactgccggtctcatttagagacgtataccctgttcacggtcagaaaacacttcaccgtgtttttcataaacacttacctttgacaattattcatcacaaatattaaaccatcatgatttcacatagtagtgagctcagccccacgatgtacctcattccgatggatctatcccaacgaccagatttgccccctcccccccaacattgggcataccccgccttacctaactggtcgatcgatcactggtgttatttttttaataatagaaatggttattagtggcgctgtttccttacatgcatctcctctctcgtctctgatagtttactccactagataggctgccgccacacttgcctactaaccattgtatcttcctttcctcccacggaccctacacatgtggtcgaccctgcccaatttccttctctctcctcgtagctccggtactccgtccatcacatacaagtacattgtagcctatccatctccgccacccacacctacagttggccaaaaggcccgtagtccgacggtccggcccacaacacggagttttggtccggtccaggcacgacacgactcgactgttgtcgggcctgtgctagcctgactcaaccgttgggtgttggctgggcctcttccttggcacgacgtgccagcccgacacggccaacactcccgcatgccatagcccgtcgatggctggcccaaagagatgagggaggcaaaatagacttattttagccatataagacacaatccaaagatatgagggagacaaaatagacttatttcaaggatgagcacagtaagctagtcatgccttcgggccggcacggcacgtcctgagtcttattgggccgtgcctaggccataggtacagcccgtgggtggacaaggcacgacacggcgtatcagtcgggccgtgcttcggtcgtgtcagaccgaaccatgtctggtgatctatttgactatagttagctctaattaagcctcaaagtctcgaactttctttcttcacagaatcacaatgctcccctctctaacccgctatctaggtagaatcctaatatgtccaaatcggaatcgggcggtcgtcgaacgaacgcataggggccggcttggcgcattagcccatctttctcatgaaattgaccacagaggcaacacgtaggccagcgcacgtacacaagttccaaattatgtccctgccaccacttaatacgcagtggattattatatactccctccgtttcaaaatattttttttgttttctgtactttatcctttttttttacagtttttgtctcctctattcaatgaaattgacggcctcattgattcgttcaaaaaaaatgtttgacaccgttgactttttagtacatgtttgatcgtttatcttatttaaaaaaaattgtgaaatatgtaaaactatatgtgtacatgaaagtatatttaacaatgaatcaaatgatatgaaacgaataaataattacttaaattttttgaataaaatgaatggtcatacacgtactaaaaagtcaacggtgtcaaacattttaaaacggagggaatagtatgtaattgtaaatacagatggaagggtgggtgtgcatacatggcaagtagctagggaggcttgcacatggtgggcaagagatcgaaaagaaacactgacaattcataaggcccctagctagctatcaatgtgaagtactcactccatccgaaaaatacgaatctagaactgaatgttatgcatcttaataccatataaatctggatatattatatccggatttgtgtcacacatcagtactagattgattttttataagacgaagagagcagtagtatacgtttagctagtagcctctctagctcagcatacgtacatcgatccatccatccattatgtgctagctccaaacataagatcgcccatggtattaattaatatgttggttgctagtattagctaactcttgtccgatatattgtttctcgactcttgttgcggggacaataattagcaggcaaattataaaagcagggggaagatccaagctaggcggccagtccgtccggtatggaacatgacatgacatatggtactaagcatggatatatatgattgcttgctagttgcattcgctagctatatacacaggcctggatccatccatcgatcatatgtatgtatgcctgccaaacatgcacctacctgcagatcttctacccttccttgtcttatttgttgtcgtttttgtcagagatatatcgatcaatactactgctaattaatagtagtattaccttagctagtcgatcgatcgttctagctcccgcagaagagttaatttgtttgtcaacaaatcagggctatagatgatgggtattcagagttccaaagtagctttcttagatataacaatatcaattgatatgttgttagtacaatatagtaccatttttatggattacttttactacgatttgtatgcatgtacgataaaattatattgaaatcactatagaaaatgatttttcacgacgtcacccaattattctcggtggcggctatttgttcaaaccgccagcaaaaaatgtaactgggggtggggggcttcgaatcgcaagcgaaaactgatcttcgctggcggttgaggccgacggggctcggcagcggcggcggtgatggtggaggggacttcaaggacgacgacggcaacctcgagtgcgacgacgccggcggcggttctctgtatttgtgatgtttgtaatatttgtgatgcactctatttggattgatgcttgatgttcaaatttttgttaatttggtgatatttgtgatgcttgaatgcttgtgtgaatgggaatttttggctgtaaattgtcgatgtaaatttatgtggatttgtggatggagcgctgatggaggtggacggagcagtgttttcttttcatattttttcttttcaaatttcctcttcgctggcggctagggtagctgcatggttttgattttcgttggcggtcgttttaacacagccgctggcggtcgcggtcggtgtaagacaaccgccagcaaaaatagatctttgctggcggctgacttaagacgaccaccagcgaagattctgatcttcactggcctttgctttgtggcggctccaaattccgccagcgaaaatctaaaatggccgtcacgaaaaatggttttcgtagtagtgagttttgtaattcattataatcagcatcaaactataaatctttaaaataaaaattagtaggatgttatttctttacataaatttcactttggaccaccttttattactgatgtttgattcattttggatcacctttcaaccaatgtttttattttatattagatgattttacctttatggcactttggactatcctcaactcttatattccatctatatctaatttatcatatgtcaaatatacggtctacatatagctgagggagtttattgatgagagtgaaccagcgtacttgagtatatattcatgcatgcaactgcagcttattgtttataataatttatcggtgagagagagagagagagagagagaaccaacggaagtaaggttgttaaaggtgtactagtacaacagatttggggttgttctgcataaacgattatgtcgtactatcgctaaacgcagtaaagctgatcgatcttacatgtcagcaacttgactacacccggtccctgctgcctaactaactaattataatttactagttcgtactcttgtacttgcaactaattacttactcctaattgctactgctctcgatctagggttacaagccaattagatcttaaactaactagcactaatttttcatccatactacacatatatataccaatataaaaaaatataatatcataactttattaaattctaatacaatcatttttctctttatctattatcaatgcactactaacataatttgataaaaataattacttaaaataaatttattttgaaataaacgtgaggggtcaagaaataagaacccatctcctatacacgaaaaatggagcggttcattaacacatgattaattaagtattagctaattttttttaaaaaatagatcaatatgaatttttttgacaacttttcgtaaaaaacgtatcatttagcagtttgaaaagcgtgcacacagaaaacaaaaggagagtgttgggaacttgctcttgcaaacacaccactctgggaccgagggagtaagttcttggagattcgtcgaattaaatgacaagacagactggttggctgttggtcctctaattgtgcgcattgatctaatgtgtgcagtacttaatccacaaatgattgcatcagtacttccgagctggtttccttaattccaaaaccaaaagggaatcccaagcacaacttgctactttacatacatatgcttgctcaagaacatatttaaataattaagggcaaaagagaaaaaagacaaattgatcagctagctagagactagccagacaccaaattaaagatggctagaccgtgaactcagcgtcgtgaacctccggatgactcaacaaattcataccacctcaaattagagccgttggtgctgagccattatagcttagcgctaaggcccatggcgttgagtccacggcctatttttggtttaatttttttataggaactagtttcaaaataagtttttaaaaaggaccaatttattaaaaggacggctagttttgtggctaaatactttagtattgtggttctttatcaaaaagtcagtctattattttaatatttcctcttcacatggagagataaaactttgcaaaagacgattttacccttggttcatctagtatggtcaaatccaaacaaattttagttggttctaaatatttgcaaaatttaaaagctatctcaaattacggaaatcaaaactattctacaaaaaatgtcaaaactcaaaaataatatttcaaatttcttttttagaaaaattgaatgaatttgatttcagtaattctaggcaacttttgagttttgcaaaatatatttaaattataccaaaactgtgtttaaatttgaattaagctaggttagccgagagtaaaatcgtcttttttgtaaagttttatctctccatttgggggaatatattaaaataacggataaagtgtcttttggcaaagaaccataaatagatagatcgattggtagtaatacacacacacacaaaagaaattttgcatagcttatgctaactttcttctcaaattaaacttaatttgcaggttcctatatatagcaagctagtattctggttggatgcattgtacttattttgcaaagattaagggattgaattgagcatatatgtagcaggtggatcgcgctcctctgacgtaaagtcggagggacgtgggtcactgacgtgtgggcccaacctttgtgggtcccacatgtcagtgacaaagtccctctgactttacgtcagaggagactcatccgtagcaggtgtacatacatatatacaggctgctactagtagtattacttttttttaatatatgacattattaatatttttattaacgtttgatcattcgtttattcaaaaaatttatgtaaatatataaaaaaatttaagtcatgcttaaagaatatttgtcattaattaagtcaaaataaaataaatgataattacataaatattttgtgtaatatgaatggttaaacgtatctcaaaaaatcaagaaaagattagcatatattgatctcttaattccaagcttccctctcacagttgtctgatcggatccaatccggaaaaccgtatgatcgattttggattcccttgttgccactctaccctagctactgtactttgctagctgtatagtacatattccaagcccttaaacatgcatgcacggttgatatatactttatgttaatccttctatgcaaaatgatcgacgacgaaaatactgtccaactgctaagtaaacacaatcactagctccatcttagaatatagcaatttagaatggaatgagacctattttagaacagaatctagacatgaggcatatatccagatttatttttctagaataaaatctattgtagattgctacattctaagatagaggtagtagcttacaactaaaaagcaaaatccaaaaggatttttgtaatgactggaatattacatctacatgaatgcttgtgtcatgacagcaaatgcttttgagcaaactagccaaattgctaggcggcaccaagacaagaacattactgtacagattaaggaacagcggaaaataagaaccctcaccacgacccaatattatctctccgtgtgaagtcttttattttttaaacatcttaagggctccttaatttggaacgcaggatctgaaaaaatgcataaaacatgcatgaaaaacacaatattatagaatgtcatgtatgggtaaatccaacatatgaaatcaaaacatagaaacttggatggttaataggaatataattacatgaatttaatggaattaagagagagaagatacattgaacttctaaaaggaaaaatcaagagaagaaattttaaaaataccgttgataaatgttctatttcaacgtttaccattgacggtagctacataagtaatagctaactcggcggagacacaatccctatcatgacattactattttttacagatcaaattaccatttgtgaccgttcaatttagactactaagcgtattattaccacgtattatgatcacagagataaattaaatactactacatagaagtttagaacaaacggtctaaataatactccctccgtttcacaatgtaagtcattctagtatttttcacatcatattgatgttaatgaatctagacatatatatatctctctagattcattaatatcagtatgaatatgagaaatgctagaatgacttacatctgaaacgagggagtatagtggaagaaagatttttagaaaacatatttagacatgcataaaacatgcaattaatttaatttaatacttcagttaattatgtctagcctaatatgtttgcaaattatgtctgaaccaaatgatctttctaccggccgccagcagagattgatcacaatcaagtgattctatatattatatatagctatgggtacgtcgtctgcgggtgcgtgtgtgatgtataaattgcatgtatatgggatgtctagtcgacacgtatgcaatctaagtacctgacctgtttatttcgtcgttacatgatactctagctaactagctagcaccatatatattaattacccctgtgtccttttaaatcaaaagatttatgcaaaacttcataagactttaaatcttaatggttttttttctatttggccctttgtgtatataaaggatacgactatatagaagcttttcaaatcttatgaaatttctatgtaatggtttattacatataaatttttgaggaaacttagcatgagcttcaatattttagacaattttctttgagcctatctctcttacccgattgctgtgtttttcccgcagtctaattcaaacggtcgatattaatttatgtgttttgtaatgctttgttttacacttgtatttatgttagaattatgtatttttttatattcttgtaattcaaagagccataagtgattttgtttatgtaactgggacggaggtagtacgtacatgtttgttgttagtttcacagttctgttcaagtgttcatcgatctatatatatctacagaggatggctagttatagccgcaatatgcaagcacgatcgatcgatcgacttgttgaacgcactgtgcgtactgttatgcatccatgcatgtggtagctgctgttgccgaaacaaacaaaaaattgcctgattaattaagaaattaataaccctcgcagctatgccaggagccaagtaatctgatcgattagctagtcgcagctttttgctagctgctatacctacctagctggctagcttaatttaggtttaacgtggaacatgcctatgattgtgcaaattccaacaaattgatttggattttgccaaatatccttctatttgagagatgattaatagatatgcggatcatatagtgtaattaaatatcatatatatctcacaaaaatacattttaatgccagaacaaaatactcataattaattagctatatatacgtgcgactgtgtacaaactttttaattgtacatacatttatacgctcgatcgatcgcagttgatccatgcatacagtagctgcgaccattcgctaatatgcaagtacatcgtgctaattaatccgacaagagatgtcatcgtcacctgttaattaattgttagactagctagtaattgcacacaagtgtgctgtgtcagtggtgacaacaacattagcagtccagtccgggctagtgggtgataattaatgatatgatcctatacatgcatatataaaaatgcacgcacttatatatacacacacacacagatacattcgtctcatattatagatcgatcgacgtactcttataaagcgagatagttatcagtggttaactaagagatcgaggctgaaaatgtaatataattttactatcttcaaatctctcaaaaattgaagagaacaaatattattagccagactggaaattgtaatatattaattactacattgcgccaacgaatagctaacaaattaacatacataataatagtagtatatatataaaaaaaagatgtagccttactttgtatatccattttggctaatatatatagctactagctagcttgtttgcatatatagatcagcttagatgcattacaattaattgtatgcataaatggtaatatcgttccaactaaatagctgacatcagcatggtattaaatttggtacctacggagtagtatcatgtttgataccagagacactagccaattaatcccgtgtggttccggtgcaccgcggcttctgagaggagctcggggaggcatgtgtggctgctgttgtggtgccgacggcgaggggcaagttcttgtcgtctccggtgcacgggcacgacaacgaagctcgtgctcctgtgggtgccagaaccgccgagcaaggtgttcgttgcggccacctcgatcgccaatatcaacaagcagctcatcttctccatcgcgtgccaaggttgaagcgcctcgatcggtaggtggatcgctcgctgctgaaggaggatatgatggttgtgacaggccggcatgctggcggccggcaccgacgacgctggtggccacgaaggtagatgtcgactgagcaggctccttgccatcgcccttctccaataagcggcacacctgcctagtccctccttcctatccatgtctaccttacacattgtgtgctccggccagctcgtgagccagaacgagctggctggagctttgcttccgagccgagccgaactccactttttgctcatttagataacgagccgagtcaagccagctcgttatctaaatgagctggagcgacatatacccctatctgtatactgaaggtatcatatccgatacttagggtatcatactgacatcatcatgatacctaaatactagatttgatacttgtggggtatcatgtttggtaccagaggtatatataccagatctgatacctatttggtatcgtgctgacatcatacgttattctattgaaacggtataccactacgtagtctcactcaataatatactatatatgtacgggtaggatggaaggtacaatgcaatctttgcgtaagagaagaagagcgatttggtgggtagctagttatctatctatctcatgctgttttgtcttgattgctggaccacatgcatcaacatgatgtggcctggctctggctgtaatagttctatggaagagagagccagagccagcagcatcagcatgcatgatcaaggagagagagagagagagagagagatgcatgaagacgtactagctagctgtgtgtcgtcttctagctcgatcgtgttcgctgattctagattaggatgttaattgcgtggttgacatgcgtactgccaaaaccatccatcggtacgccagattaattaacaatctctaattccaagatcgatctacgctgtagcatgcagtacattttatatatgtatagttaacttattatatctgacatatatttgtttgggagccaacagacaaaatacatgaaagacaaattagttgaggctagctagctgcgctgctgcctagctctatgtaatggatcgatcgatcatatggcaccagctagcagctatcttcgtcctcattaagtttaaaccaactgcttgatatatatgcatgcatggagcgtagatatatatatatatatatatatatataaaagctgttgcgatggttgagacgattcaaacacacacagaaaaagcaaaaaagtatcgagcaataatccatatatgagtaaatatttaaaataaatccagcgtagatgctaagggaactcgagtcctcctatcccgctagatcaccatttaattaaggaggaagggagggtagaagaagcgggagaagaggaagagtaggaagggtagaaagaaaaataagagttcccctctaatttaattctggatatgctccttaatgcaacaaaagaataatattctctagagatagaaggccaaattattaatagagagaatcccttatataccactctaaattaaccggttcccttatatgccacttcaaattggcttctctcttctatgccaccagttcaagtttgttatcccttttatgccattgccgtcactccaccgtcagttgaccgttaacttcatagtaaaaagacgcatttgcccttgagagttggtatacaaccaatgataggtattttaatactaatatagctactggatacaacatatgaaaattgattcttttttgcattatatgcaattttagccatcaccatcacaaataaattttcaatataagcatgaaacatacagtttccaacaatatttttaatacaaagagcattattcattggtttggacaaaattttgttcactcaaaacggatttaaaataaaatagttatgattttttgaagtttacacatttttttagttgagagggcatattggtcatttacgaaaaaaactaacatgcgactaacagtcaactaatgctgcagtgctgaggatggcataaaagggtagaaaaacttaaccagtgatatataagggagaagccaattttaattggcgtgtaagggaactggtcaatttctagtagcatataagagattctctcttattaatatgacagttctcagcttgtgtatggcctctcaaaggccatgcttttatatattttcaccctatcaaaactcttttcatattagactacctcagtttatggtcaattatatagatcctattcgaagccaaccctcaatccatttttttcgcaaatttgtgtgaagctggatttaaaatatataattcttgaattaaatataaacaactctcttatttctattagcctgttataatttatatacaactatatctattaatttataatctagaccaaccacaatctaggaatgtaaatctttctgtttttcttattaatgtagtaataatttctaggtttttgtgaacgcgcaataatttctaggtctctctagagtaacatgaccttattgcggagttgtttgtccagtcatcaatctggtggtggcacaggcgctggggtgttttgtagtttctacttgagtaaattgcataaacgtgaatttcacgttttaaaaatcaaacatgtgaagtggttgtctaaatctcgacatagcgtcatgtcgcagtacaacaacacttctgcaacgccagccaaagaaaaaaaaacttgcatttagataacccttgcatgtccaagataaaattggcccaagtgaaaaactcagaactacataaataattttcgcaaatggccaaaactcatttttggatgtggtattttgacgtgtgggcatcacaggtgcacgtgaaaacccattttcacatatggatctgttgaggaggctgcttgcaaaactgatttttgcaggcaggcaagtaaggactttcgactagaacgatttttttttttaaaaaaaagaataaacactacagatccaagaccctatagctagggtaagccgcatgtggccgcggccgtgtggtccgttggctgggtacaaagagcagagtgggctaagcaaataccgggttgtggcaccatccctttcacattcactcgctcttgatatctttctctctcatggaaaagaagagataagtaattttaattgatgccgggatagagagagagagagagttaagaaggtagctaggggagagagcgaggttgatgccgtgatcgatcgatcgatctgttggcgcagcgtgtatataagggcgggaaggggagtgagagagagcagcagctagctagccgcggtcggtcgatccagctgctggggatgagtacttagttagctcggagctagctactaatggatgatatacttatgctagttagttaaatacagttattagttagttgtaggttgcatctatcatatctccatcggttaattaattgattgatagctagattatcaacaattaatgagcatggtggtgcagcaggagcaggaggtggtgttcgacgcggcggtgctgagcgggcagacggagatcccgtcgcagttcatatggccggcggaggagagccccgggtcggtggcggtggaggagctggaggtggcgctgatcgacgtgggggcgggggcggagaggtcgtcggtggtccggcaggtgggggaggcgtgcgagaggcacggcttcttcctggtggttaaccacggcatcgaggcggcgctgctggaggaggcgcaccggtgcatggacgccttcttcacgctgccgctgggggagaagcagcgggcgcagcggcgcgcgggggagagctgcggctacgccagcagcttcacggggcgcttcgcgtccaagctgccgtggaaggagacgctgtcgttccggtactcatcggctggagatgaagagggcgaggagggcgtgggtgagtacctggtgcggaagctcggggcggagcacgggcggcggctgggcgaggtgtactcgcgctactgccacgagatgagccgcctgtcgctggagctgatggaggtgctcggggagagcctgggcatcgtcggagaccggcgccactacttccggcgattcttccagcgcaacgactccatcatgcgcctcaactactacccggcgtgccagaggccactcgacacgctgggcaccggtccgcactgcgaccccacctcgctcaccatcctccaccaggaccacgtcggcggcctggaggtgtgggcggaggggcggtggcgcgccatccgccctcgccccggggcgctcgtcgtcaacgtcggcgacaccttcatggcgctctccaacgccaggtaccgcagctgcctgcaccgggcggtcgtcaacagcacggcgcctcgccgctcgctggccttcttcctctgcccggagatggacacggtggtgcgcccgccggaggagctggtcgacgaccaccacccgagggtgtacccggacttcacgtggcgggcgctgctggacttcacgcagcgccactacagggccgacatgcgcacgcttcaggccttctccgactggcttaatcatcatcgtcacctgcaaccaacaatatactcctagctcctagtcctagctatatactcctattatccatccatccatccatcttacactactataccattagcatcgatcgatcatccattaattaattaattaattactagttccggcttagatatatatctggcgattatttcagttcctagctactcctacatgcatgctttgcttaattagatctatctatctaatctatcccggccggcctgttttaattccatatatcatttggtttgcacgtacccatctatgatctatatatacatgcatgtcgactattgttggtcgtacgatattatattatatatagatgtaatacatatgttgaaaatatattgatttcttcttgctgtaggagtaattaattactccagttgttgctgtcactcgatcaatccatgggatatggggatcgatcggacgatatgcaggaagctcaaggacgatatgaatgatgcatgcatgtgtaaatgtgttgttgtgtttggtttctcttttgtcgtttcccctgcccgtccgttcgtccctcagctttttacctatatactatagctacctacacaaacaaacaaacaaagaaagagagacatatgaatcgattactagtaacatcgatctatcaatggttgcttcaatttctacttctcaaaagaaaatggctggctaaaccttgggtggggcgggtgacgccatgtgatgaagtagataggaacctcttcgccgcctcaacaaacataacaatatgggacggaaacacggtgcgatcttgggagtccgcgtggattggtgggcgaagacccaaagacctcatgccgcttgtctatgcgatctcaaaaaacagaggaaaatcccttcggcaaggaaaggaggaggacgcctgggtgcaagatttgaagcttgattcacaatcatctatcacagtcgacctcgtcgaacagctagtcgcactgtgggaagcggtccgaaatgtgcacttagacgttggagaaccggatcagattatttggaagttcacaaacaacgggcattacacggcctcctcggcttaccatgtgcagtgctgcgggacgccgagtacaaacttcaattccttgatttggaaagcctgggcgccggggaaatgcaaatttcatgcttggctcatcattcagaacagagtctggacttcagaccggcttgcgaccaggggatggcagaacaatggttgttgcgctctttgccgccgcgagactgagacggcattgcacctcgttgccacttgtagatacaccaagaggatctggcacctcatctctgcatgggtgggctatcagcagatggacccaacggaatgggaggaagcccagtcagtcaaacagtggtgggagaacattgcaaacacgcctagtgtcccgaaaaaaggacttcgatcgctcattctgttagtcgtctaggaaatttggaaagagaggaatcggcggatttttgatcacaaagaggtggcaacgaacttcctactaatgaaaatcaaagaggaggcgagcctttgggctttagcaggagctaagcggctgcgtgagttaataatcccgcactctgtatagtgtacagctatagtggttctccgttttccttttacgtctaggggtttgtattttctcttgctctattcaatgaaaaggcactctagtgctgctttccgttcaaaaaaaaaaagaaaatggctggctagctgctgacctatatatactgtatgtatgctcgatgcttctcctttcagacaggcaaaggacataggtacatactgtacgtatatactctacagatagtatttattatgtagtactgtagatcagacgacggcggcagcaggacgtacaaaacaaactggtgactagtctcctccagctacctatagctccattgcatcacgtgctaacgctaattaatgctaatgctaatgcaattctctctgctgcactgtgtgtgctactgtacgttactgaccaatctctatagctagcttttcatgcttgcgcctcagtggttacggatagagatctggccgggagagatcgatcagctcagcttaatactagtactgaaagaaatatcagatatcaacttcaagggattgattataatatactagcatcaaaagtaaattaattaagcaaatataattaatactactccctctgtcctaaaatataacaacttctagcctttaaaatttattccaaaatataacaacttcttctcaactaatcaaaatcctctaccattcaattttcccacctaccttcacttatcctaccatttaatcttaccaactttcttaataaccggaccatctctaaaaatacttatattctggaatgaagggatatgaatacatatatagagcaaatattaagatgccgatcaagatgcttagctagctagtaatgtcttggataattacatggtctctaaaatatatttttattattatactaatttataagaaaaatatatatattattttagtattttttaaaaaaaattaaatattttaaagctgttaaccattaaatttataaaagtttaactttaaatttatctaaaatgtcaagaattatgaaacgaaagaaaatacaatgcaattagaaaagaacatgggaagggatgggcatcggcatggccggattagatatagtatcaccattttaagatgatcagtatacatgactagtcgtatatactacactatgcatatgccatgctacatgtatgctgctacctccgtcccaaaatgtaagcatttttagctatgaatcattttaggacggagggagtagctagctaggaaacgatcgatcggcatttcagctatactacagtacttacatcagatcgtttcctagctatcagatcagggtcgggtcgatcagagtgatgaaaatcaatcgatatatattgatcgaggccgcttgctgtcgcctatcgacctactagtataacaacgacattttctctaaaaaaaaaaagaaaaacaacaagtacctagaaacactccacttagacacaacggcttggctatttcttaggcaaatctcaatcatctgatcgcgttcgttggatttcaatccaatgcgcttctctccatgtatatattcaacctctgcatgctcttaatctctccactcaactaaactctcagttaattactaattatcctcttctccaccaacagagtacgtttaccacaatactcctcgaaacagactttcagccccatcgttttccttgtacttatacttatccattagtactacttgttaacaaccaaaaaaaaagtcacgagtaaaacttttatgtgtgtgtatccttagcgatttaaaagcaaatgcggtagaataaattatgatgaaaaaaactaaaaaagtaagttttgaaattaaattttggcatataggcattagcataagtgaaacgatagggttgtttgttcttttttttggggaaaaggatttcatcattcatgaaccttagagcataaccaacatatgcccagtagggctttctaatcttaaaattttggttttctttaaagctggttccaattgaaccacttgcattatatccatcagcattcattttggtgcatccttggttaggacagcttcatcttttgtccattttgtcatttatcatcacgtgaattattgcatatagctagacagttctagtatcacccggaaagattgaccattgaagacacacttccatcctcatttgtggccataagttcagcttctagagcatatgaacagacctctagtgatctataggcagctcatatgaccggccattactatcccaaataaccatttgcattacaacattcagttaatttgttccatcctatgttaggatagcttcgtcttttcatgccaagatccttcttcgatcagcttcccacttatcaaatgcaaatcttctccatgatagtagttgactactttcttaattagcgtgtttacatatccgtcactaagatgttttgcacaactagccaacatatacttacatgtgcataatgcacacacatgtactagtataatatcatagaagatagactcattttacgtccttcgttataagttattatatatatatatatatatatatatatatatatatatatatatatatatatccttcagtattggtagtaataatgatcgagtagcgagcattgtaaagagagtctattaactaacacaacattatctttttacgagttactcatatgtggatccattatgttatagcctctcaaagtttctcaagcattggaacagctaatcatagtttgtcgcgacttgggcatagtatagggagggcagccagctgcaggaaggatcaagagagaaggcaggccaactggaactgtgggcgattccttggtgccgctagccgccgcgccgcctgctttattttgtcgattgtcgatcagtctgcccacaaacgtcacccatgtactgtccatctactgtacgtactgtactgctacaatcaccgttactcagtggttctacgtactactagtactatacacacgcgtgacacgttcctttgcatataggagtactactgtacacaaattcttactgaaattaatagtacagtgtgtgttcctttgcatatattccctccctcccccataaaaaaacatatttttgagtttatatgttcaacatttgaccatccatcttataaaaaaattttaaaaataaattatacataaagtattatttatgttttatcatctactacctccgttccaaaataagtgcagccatatgcatgctcagcgttttgaccatccgtcttatttgaaaaatttatgaaaaatattaaaaaaattagtcacacataaagtacaattcatgttttatcatctaataacaataaaaatactaatcataatcttttttcaaataagacgaacggtcaaacgttggacatgaacagtgctaaaactgcacttattttgggatgaagggagtaataacaataaaaatattaatcataaataattaaataaaaacaaagagtatcaaaaactgaaaaaaaatgtacttttcatgggacagaggggagtacgttattgaattccttattaatttgtactgtactactgtggatgccacatcagccatccagcaagaataacctgcagccacacgtaccaatcacactccaccctgcaacctgtgtttcatgctactatacagtagtgctgtcagatattctcttgtcaagtgtaccatgcacctatgcatgcacgcttctttcttgcagccgaatcgtacgagtacaacctaatttagttttgtttttcgtcactcagctggatagcaaagaatagaactgtaaaaacttctaaggcatcgttcgtttaggggtgataggggagattggttctcgttttccgcgcgcacgcttttcaaactactaaacggtgcgttttttgcaaaaaatttcaatagaaaagttgctttaaaaaatcatattaatccatttttagaatttaaaatagttaatactcaattaatcatgagctaatggctcacctcgttttgcgtatcttcccaatctcctcaatccccttctcctcaaacactccctaagcgatcattgcttggcagcttgggtgaaatcaggttctaggaaaacacgttttagattatttttttccaacttccaataaggttaaatcgctaaggtagcttaatttgctcaatggatggacggaaggatcggtcctgcatgcatccatgcgtggtgaggtttggtggggaaatctgatctgatcgacgatcgagtagatggatttggacatgcatgcatatatacagcaaattaaggaccacaaaacctaatcgatatcagttagttttatactagctatatcgaacaaatgcccatcagctttgcattgtccacaccaggccatgcacatatatctgtggtccctcccggccgcccccgccccgcgaatgcaatctaatcaaatactattgtaatctaatctaaatttatcagtatgtgcacccatgcagcagatagctgcccggccggcctccatccatcaatcctttctcaaacctgcacgcgtggatcgaacactccttttattttgtttgcctgacccggcccatatatctctctctagctataacgtacggtacgtactaatagtcaaaagtaattaagatcatgaccaacagtttccccccccccccttccaataccaaagttttaagcttttaagtaacggaattgctacacttcagttgacaaaaaacctacctccaaatcttgcaaattttggttcactggatgtgcttcacgattcgtactccagctgcttcttctccaactccgacgaactcctcttcttctccggcgccggcgacaacccaaactccggcgaagagccgacgaattagggtcctggagtggggtggggtgggaagggtgggagggggagggggaagaagggggagttcgccgggcttagagggatgactgggtgaggcggcagcccggcgatgggcggcgaggcgtcggagccgcggggctggaggatggcggtgggccggcgttggtggcgagggcatctcgccgcagacggctcgaggaggaaggagcgcgcagccgcagccgcagcagcgtgcccgcgggggcctcgccggtgccgttgacgccctccggccagccggcgaggcgggcggcggcgcggtggggcggtggcggcgggggatcgcacgcgagagacgggagtagcggtggcggcgcaatctggatgggggaggaggagaggagttagggttaagggtctgcatgaatcttgaagcatatccaatggtccaaaatttgaaagataggaggtgggattttctgtcaacagatgtgtagacagtcccagtaagtaaatattaggctctaatagtaccccttctcttcctactttaaaatatgtattcccttctccgtcattctcactctccacgagtcggaaatcattctcgccgactctagcacaagagaaatggcgaacaggatggtggcaccaaatcgtgtgatcttctagcttaggtacggatggagggagtccgacttctattgctatagctaggactcacgttttatagtatggacctaaaaactaggtcctgatctttcaatagatattgataactctcaatttgatagaaacttgacacatacgatcccgttttcgatcaacacgatccgaaccttgcaatcacagcaccacgtctcctctggttatcaaccatgcgctgttcggttgacctcgctgagaaggctaatccctacgggtgtttcacctaggcctctgaactctcaaaatgtatttttgggtccctcaacttgtctcgagtgtcatatatatccaaacaggcttcaacccgctccatgtgctgacgtggtatgccatggtggcgcgtacgtcagtagaacccatatatcagtcacatatagaaaaaatcaagaacatatttttctcctctatttttttatttttttaaaaaaaataaaaaaaatccctttctcttctctttataaattttatttttttttctatatggctggcatatggatcccactaacacgagcgtcactgtgacatgccacgtcatctcacaaagcgggttggagcccgtttggacatatatgacacttatgacaagtttgagaacccaaaaatatatttcgagagtttattagggatctagatgacacatccgtatacaagtttaagaaccgtacgtgtacttcactactcttaatgtttatgatatagctactactgtctgcttccaccaatcaccgcgtctatttttttaccaatcttacttctaatcacccctccttgctcccactgatccccaaccatttctcatgcattcaaggaacaatgatgcatatgtgtagagatgcatctattctcgaaataatttagagctatatatgtcgatagggacaagataaattgatgatttgccattttttggatatatcttagtgtttatatgcatgtgttgtgttaattacaaaggttctatgagttgataaactagcgtgtaggttgtacttgtttgagtttgaccgctgagctcaaacagaattaagatgcatacatgatgggcatgcatcaattagctaggttattgctttgaaaagtaagttagactttggtaggaacgtactgggtgggtatatatatatgcaataattcgaaacacggatgctacttccactaattgaagaatgaatcagtaggcgcgtcttcacacacttgcttcaatcggtcggatatatataggcatgttattatgattttatcctggttttcgttagcacattcaaattattaaatagaataaaatctttctatataaaagttatttaaaaatatcatataaatatcatatatatcgtttgtgcttgtctactcccctcccatctcctctgtcacatatggctagagggaaggagcccgacggtggaaagggtggcggagacggcggctggcagcggaaggtgtggcagctacggtttcggccggcctcctccactcccctatctcccttccctctcctagatctggccggatgggatgaggtcagcggcaactgctggggcttcggtcgggcctatccactcccctcactctcccaaatctggtcgaaagggaggaggtcggcggtagcaaaggggtgatggcggcggcaacaggggcttcaaagggctccttcattccactccactcccctccctttcccagactagctctccctctaccagatctagctagaggggaggaggacgattgtagctgcggccggcagtgacaagggaagaggagcaaatggcggcagcgcagtggagaatgatgacctagacgacgacaacgacgatggcctcgatagtgcgcaacggcgacggcaaggctcctggatctagtccatcgcggtcgcttgattgtagttgttgcttcttctttttcttgtgaatttttgttggatttgtaaatacaaaatattttggagtagcttgatttgcaaatctgatgaaacgttcttcccattttctctttgatttgtggattgttctatgaaaattgatgtggcaatgggcagacaaagggcaattgtatgcccccccccccatgagccaagtggggaaattgatttctacaggcaaccgaaaccatcctctagaaatacccgatttttgtatgtcttaattcgcaaacaatgtatggccgaccgtgtgcgaaaacctgttttgttcgcatacgaaaaccttttctctcatagtgatttctacagccggctaaaatggcatgtgtccatgcgtataacatttttttcctactgtccaagaatatataattaggagaaacgtacttaacagctagctagcattgtttcatgcatatattagttgaagaaaaaaaattgcatgcgtgcgtgcatatagggatcgaaattagccagtgtcaaattaacatacatgaccgatcgatcgattcccgaccacgatcgagctagcacatatatgtccatggtgtatgtatctatcatgtttaacgacctcagctagctgctggctaacgtaccaacaaccagctgctgtccaagtcaattacatgaagctgatgttgatcccgatcgatctcgcatgcatgtactcatctttaatttattccgatccctacccggccgctgctgtccattaattatattctttggttagttagatgatgattatccaaattatttcagtctcttctctagctagtatatattacgtgtgccaaattaatttaatcatgtctgagtagtaaaaaaaactgatatacagtacataattgtacttgagcaaaagaaaactaattagtaattcattcagtctatatttttactacggtcgacatgcatgtatatatgctttcaattttaatttgttatattagttatatataacaattatatagcaaattataaagaaattaaatttagtgcatcctagttcgttttccgcccggccctccaatatacgtagtatatatagtatatgcttggcattgagagttatatatagttggggtgcaatgcaaggaggccgtgcacgcgtgcttgcaagcgacggatgcatgatcgagatggatggatagatagatagatagatagatagataggagtatgtgccaagaattcaacttagtagctagccaagactacctccggctcaaaatatttatatttctaaaaaagagacatattagctgtacaaacaaattaccataataatcctaaaaatatagaataaagtaaatattgagacaaatggagatggaaatataggagggggtagaaggtaggatatttctaattgggtactacctccgtccttcccagaatataacaatttttggctaaatgcttatattttgggacggagggagtaggttttatcttattacaaatacaattattttaggagaaaatttaaaaagtagaaatacaattattatactccctacattctaaaatataagggattctggagggatgttatattatgcgacagagggagtaagaagcagtagtcttctttatagtgaagcttaattaggaacatacatacatatatatatactagcaaaatgcccgtgcgttacaccgggtattagcggggtgtttgaagtttgatattaatgatttaccaaaacaccatagtatgattattagcatcggttatatgtacagtgataaaaatgatgcccgtgcgttgcaacgagtgaagataattttaatcatgtatagtgttggacaaaaatgataaaggaatcgtaatcataataataataatgaaatgaaattgcagtgacatttggaaaaaggataaaaatatataattaattttccgttaattccattagctaaaaataatttaatatgaagtaggaaaagttattctcaaattttagcaattttcaaaaagcttaaatagagcaaactaattttgtaaatgaaaaaaaatttaatcgcctaaataaaacaattagacctgtaattgaaaatctgttggccatctcgtttaaacatgagcctgcgggtgcgtgtggtcacttgtacgtcgtggtcttttttttgacatagaaaaaatgtccgtgcattgcaacgagtaaactgatattataacaaatataaaaatattatatgattaaggtttagctttacatgatatgagctctttaagaaaatatattcataatgaaataaaaaaggttcaactgaagggacctaaagtgaacttattccatacggagcatacacgcggtccatgaggcggcccaaaagtgtgggtggcctgggaacaaaatcagggacaacttaagggacctaaagtgaacttattccatattggcggcctgggaatggcgttcggcccgacgcgggagatgttggagccgtccgatctgatggacgatcctgattgatcccgacttatataaaagttcaactgcccaaaccctaaccataaaatcatttcccctcccccctctctctctcaaaacaatggtggcggcaacgcctctctccctccatcattcctcctttcccaaccccatcggcggcacctctcccccctcccctcccccacacaggcggcacgctcccccttcctctcatcccaccggcggcaccgctctatctcccccacttcccttctggaggcggcaggcaggggcggcgccttcccctccgtcggatctagcgggaggggaggcggcggcagcccgacgtccctgcgacgacggctctccttccgcgggcagtggttcctctccgccctcacctcctctccctcgccatggggccgcatgagggttcgacggtggcgggcagcaccctccactccgtcggatctaggaggggaggcggtggcggcccggcggccccctccaccggatccagtgggaggggagcagccggcagcaacggagacaccctcccattctggcgtgttttcttagtgttcttgaatctgatattgtgttattgtagtagtgttttctctagtatttaggtccaaatttgacaacggacgaaaactctaacccggaagctttacaaattttttaattattagaaataggtatatagatagattgaatcggactttctttttttcatgtttttttcaccctgatttcgctattacggacgacggaaacatttttaattttttaagtagtagagatagaaatagagtagtatttaacatgatattgaaaacattcattgctagtaaaatgccagtatactaattaaaccattaatactcagtgagaaaaaagatataataggtttagttaatgttagctttgatgccagcaatttgcccttcatgcgtcgtggactcgtggcacatcccagccatccgtgtcatggcaacaacgacctactcactcctgaacgccaaaaaaaccgtttttttgacaaattgacccttttcaaaaacttaattcgaaactaacccctgccaaaaacttcaaccaaaactagcccgtcggctcagcgccaagcgcattggcgctgaggttggccgtgtcagcgctaacgggactggcgctgacattgtgccaccgtggcggccgggccgatcccctagctgacgtggcagctacctcagcgccaaccgcttcggcgctgaggtgcccaacctcagcgccaagtaagttggcgctgaccttggctacttagagcccggccgaggccgccccagccagttcttcctccgttttttccccagccgcccacctagggttcggtcgccaccgcgttctcctcgcccaatctcccccaaaaacctctctaatcgaaggtgatttgtgcggcattgagtttggaatcggaagagaaggtaaacccctctataaaccctaagttccccaaagttttattggatattttgcattgttttggttgtagacgtggtttgataatagttggctaaggatggattattagatggataatatgggtggggatgaagtgtggaggtggcatatctttatccatttggttgttattgatacatttgacaaaatatatttgggatggatgtttggtgatgcactagggtttgatgggagatggatgtgtggtgatggcctaggatgtgggatggatttgtggtgattgagagggtttgaaaggggttgatgtgtggtgaagggtaggtaatttgtaggagtagagtttttttttatcaataatgtgtagtatttgagtaatgtacttatttattggaaaaattagacatgttgttagcttttgaagtattggtattgcaatggtaattacatattattttcaagtaattaatgtttatgcatgggttaaaaattgtagatggatagattggtccggcttcattatggtggttgtgtggtagatgaaagtacacatggaagccaatttgagggaatgacagttagacaattagtgttttttgcgaagcctacctttgaggagttaatgtctcgcatcaagcatgaattggattgtaatgatgagtcggttggtatgcaagggagatacgatgtgggcggcggtgtcatgtcacataaatttatgttagacttgaatggagagatcgaatggcaaacatatatagatatagtattggggtcacatttcaaatctcttgaggtgtttgcatggaagaaagatggtaggatagggaagaaagaacttatagaccttaatgaaagtcaactcatagaatcacccattagctgtcacgaactgtcggagaggtgtagtaggaaggaagaattgattgaggaagacgtggagggggcgagggagtaaatgatatggcggatgtggaggtcagggaagagaatgacccggtaagggaggaagtacatgcagaggagaatgtgccgttaagggaagaagtacatgcagaggacaatgtgccgttaagggaggaagctaatgtggaggagaatgtgccggtaagagaggaaggagatgttgaggatggtcgggaggtaggagatgatgtggagttacctgaggaagaagcgaatgctaagaatgtaagtatgggcctaagggagttggctaggctgaaattctataccccagaggagtgtgaggaggctatgatacgcagtggattgaacccagcctggttggagtatgatacagaggatgaattggatgagtccgctttcgactcctatgatgatcgtccagtgcgtaagatgtcagagcatgaaaggactgtgtttgcgaaactggtgggtagaaacccggaaataacacaattcgaggatcttaccagatctgggctagcaattgctgatggggatacacaatatgacggtgccttcgaaccaatgtgtgatgaaccaaggaaggggttggagtttcgatcgatggatgatctgaaaatatggctacagagttattctatccgtgtccaccggccgtaccatgtgaaggaatctaacgcgtcagtaaagtatactgtggcttgtctcgatcgccattgcaaatggcagattaatgcaaggaagagtggaggagataggtggcgggtgactagggtgggcgaagaccacacatgctgtagtgcggaagtaaccggcaagcatttgcaacttacttcaaggtttattggaaacaggttacaggcatttgtgcgagctgaaccaactttatctccagcagcgattgtcgaggcagttgagcaaatatggcactatcggcctacgtatggcaaagcatggcgtgctaagcaagttgctatgaaggtcatttggggagattgggacgaggcgtatgttcgcttgcctacactgatgcgtgccatcaaagcaaagaaccctaccatgcatttccgtattgaggctcatcccgagaagtccaggatggtggatggagtacagaggcgagtatttggacgtgcatattggatatttggccagtccatagaagcattcaagcacttgaggccggtgctagcaattgatggcactttcttaaccggtaaataccaaggtacattgctcacggcaataggggtcgacgccgggttacatcttgttcccttggcgtttgctctggtagagaaggagaatacatccaactgggagtggttcatcaacatgttgagaaacaagttgatcggtcctaatagagaagtgtgtataatttctgatagacaccctggcattttgaactccatcatccacatcatgcctcatcacctaaccattcaccacaggtggtgcatgaggcacttctgtgctaacttctacacagctggagctacgactgatcagatgaaagatcttgagcgcatatgtcaaataaatgagaaagcattgttcctagatgagataaaacgcctcatgggtgtggtcggagagaggccaaagaagtggctagaagaccatatgccacttaaagtcaaatgggcaagagcatttgataccaacgggcgtcgtcatagcatcatgactagtaatatggccgagagtttcaataatgtattgagaggcattcggaaactgccggttacagctattgtggcatacacattttcaaagtgcaatagttggtttgtcgatagacacaaagaggcaactgtagatatcctgtgtggaaagaagtggcccacaaaagttaaggacattttggaggagcagcaaagacgaaccttggggcaaagagcagcatgttttgatttcccttcgatgaagtatgaggtcagcgagcaaggcggagtcacggcggctggggttcaatggggtggacgtcactacgtcgtggttgcgagagataacacatgtagttgtcagttccctcagctccatcacttgccatgctcccacatgataaccgtttgtaagttgcgaggtttggatgtggaggtggccccccgaatgtgttatgaagcttccaataaggctgtgcaggactcgtactcccctaggtttgaaccttacctagatccatcgcagtggccaagttatgatggagagttcttcgtgcccgacttgtcgttaaagaacaacacacgaggaagaagaaggacaagaaggttcaagaacgatatggacaaagcatacaaaggctcagccaaccgacggtcacaaaagccgaacaatacaaattcagagccggtcatgcaaaatagatgctcgctatgccacgaactaggccataagaaaactaggtgcccgaagcgagacaagtctaaggatcgaccgaaaaagcgccgtacgacagggggaggtggtgagggtagcacacaggtgggattggatgacattcatttgctaagttcatattgttgcttcaatgtttactttctgttgtcctcctttccgttctcattgtgatttttccatttaatattttttcaattactaatgattccattttcatttgcaggatggagcactttccggggttagaggatttctacgaggagaagcaccgggccccacagattgccagcggagaggttagcatcaacaatattccattttttttatgatcgaatttattttttcttctttgattttagtttgtacagatagatcatccatcatagagatatctcaaatcaaagttcaggagcctcaaagcagagcatgtaaacacacagatcttcttttcagttttcttgctcaatcccaaaattaaagttcctagttgcatgatgtattttccacaacccttgtatatgatatattgtcgctaactttatgttattatgtttgtctattgatgcagcacttgaagacccttcgagtcagaggtcacacggcgcacatactgttcgacgatcggtacgtcccgtacctacggcgggcgaagctcttggcgttcgtgaccatggcgcagcgaccggtgcctctgtacaacgccgctgctctgacggccctagtggaccggtggcgtccagagacacacaccttccacctaccgtgcggggagctgacggtcactctggaggacgtcgccatgatcctgggtcttcctatccggggtcaggcggtcacaggtgacacaacgtcagggaattactaacgagtcttcgtattcatttgttaatttttttgcaattactaatgattccatttaatttccggttacaggtgacacagcgtcggggaactggagggagagggtcgaggagtaccttggtctggagcctccagtggcacctgatggtcagaggcagacgaagacatcaggggttcctttgagttggttgcgagccaacttcggtcagtgtcccgctgaggcagacgaggctacagtacagcgatactgcagggcggatgcggcaattcgggaggcttcaaacaatcccgcaccgtttctccacgagtatcgacctacacaagttagtaatttcacttaacaatttattttgcttgcccaatcagtcacttcaacatttactacatatttgagttggacattttgcatacgtgcagggtggaccgtcgaaagaacaagaaggtgactgattgggcttactaccatcaggatcatatcacgcaatgggagaagttcgaggagaatggagtaccagaccagggtcagcacaacaggacggagttcgacttgtacttggcgtggctccacaggacctaccgtcttgtcctacgtccggcttggacactagccgacatagcggatgaccccgaggatgttgaggagcagaacaagtacgatactcgtacccgtctaggtaccacggtcgagacgggacctgttcgcgacagagtggttagtttctagcattaatgttgtatattatttcatttcaatgccatatatgttgtgacttacttcatttcaatcctacaggctcgagagctcttgcggaccgtcaacgacgcgggagtggcgctaggcacggctcctggctccgaaggagagggcggcaccctccgcaacgccctacaggtaatcgttggaaagagatgaaactacggtgttttcttccaaaagcgataacttaacatggattattttttatgcagagactacggcagcgatgtcggaagttggcagcaaggctcggctgcaggtcgactgatgtggtcgaacatgctcatgcccaccaagagggggatgaagaaggggaggtgggtgacgaggagggcgagcaagacaaagaggcggaggaaggagatgaggaggaagaaggggatgaggacagagaagaggaggcggatgagctcggtccctcgcagctagaggacgcaccagagtcgtcacagccggatatctcgcagcccggcccgtctcgaccacgacgccggcgggctccttcgcaggactggaggtacacccccgacgtgcctcgtcctcgcactagaggtaggaggaggtgagtgcatggttcaatggatggatggatagatggatggacttgatgcatggttcgatggatgtatggactggatgtatagacgaggatcgatgggatgtttttatttcttatatatatggacttcatatatggatgtattgatggattctatggatgtatggaatgatgttgggattgatggatggatgtatgttttgtatggttctctggatatattactgcctgtaaatttctgtgatttgatgtttgcctgtgttgtgtgcaaagttttgctaaagtttagcagggctgggacgttacctccatgctaaatggctctgacatgtccaaactcaccgccagtgcacctggcgctgaggtcccagcccagccatccataaggcttgttgcgctgcgccacggcctaaacgctcaaatacaacctcagcgccaggtggactggcgctgagtgtcccacggtcagcgccattatggctggcgctgaggtcccagcccgcaagccatccagcaggcttgctggtctgggccttgggggttgcggccaagtcccaccctcagcgccaggtgggctggcgctgagtgtcccacggtcagcgccattatggctggcgctgaggtccaagcccgcaagccatccagaagccttgctggtctgggccttgggggttgcggccaagtcccacctcagcgccagtccggttggcgctgaggtagctgccacgtcagctggggatcggcccggccgccacggtggcacaatgtcagcgccagtcccgttggcgctgacacggccaacgtcagcgccaatgtgtttggcgctgaggcgacggcctatttttggttgaagtttttggcaggggttagtttcgaaataagttttccaaaagggtcaatttgtcaaaaaaacggccaaaaattcccacaaccaacgaacccgagtggataaggccaccgatggagccacttcttgcctcttcctcgctttctccacaatccctcttttcctcgctttctcgctgccctcctcacccaccgcccctggccacgcctccacagtcgactccaccgcccctggccacgctcgcggtcgcgctcacgcttggctggagagccgccgtgccgaggcggaaggtggtcgtcgcaccaagccgatgtgctggttatctccaccgcaccgtcggccatggagataaaggtcgctgccatcggcgacaaggcggtagaggagcaccttgaggattttttttttcatctccagttaggtagaggagcgggtgaggtgaagcaaagatttctttgattggggtggtctgattcgattggatccagctcttcgcttcactaatccagccactgccgcatcttgattgattcgagctggactacacatgtgaatttcttgggtaagggaatgatgggatggttgatttggagggcttggatcggtttgggatttggggtaagccgaaaattgggttatgtaaagggatatttggatttgttcatgcgtttatgcttcaacttttgtccaattttttttagctttggttcttgttcttgcttgtgttgtggtgtatccgatttggttgtaatggggatagatttgatacagactggatggtatatgctgtgattcggtttttaattgatctttgatttgtgatttgcccaccgtacgctattagggggcgctcggttggacttacggaccaaaatttttggtgttggattggaaagatactgattttttttctggaatcggacattttaacgcacgaaaaaacagcacacggagaggtgacgattggaaaaatactaatcttatatatataaatatatatacacacacatacatcccgtgcttcgttacggtgtattaaaagtaaaaatatttgtccaataaaaaaactaaccgttctcaaaatattattcaatagtgcgttgcaacagggaaaaaaactaatgttaaaataatgattatagttattttatagttccatcggagctataggagatagttctggacataaacaatgctccttctctcccaccgacagcagctgcgcatttatccaccgcaggccgtgaaataatattatatggttggattttatttttattgaaataatcatgattaataacgctctttgaattttaattggaattttcgaatcttaatttgataacacaaacatcattttagcatttatttaaataaaaatgtaaataaaaaccacaatttctctatgggccattttcagtccttttactgtctcagcccgtaaataaaatctaatttacgtcccctaactcctcctcttctctgattgcgcaaacttgttggcctatttggaggcccaatagtccggcggcccgagcggggtaagccggagccgtccaatcgaatggacggtccagattgatcctaatctatataaatatctacagccaaaccttaaccctatcacaagatttcatttccctctccccatgtctttataataaaccggtatctataagaagagataggaaaatcggctccacttataatggagttgaaccaaaccgagtaaaccaggcttgactatggtgcaacatggatagagctcacgcaatgtctgagctcgagccactcagcaccagtagcgtgtgcgtgccctctagttcccagctagccgggttttgggtggggatgaaagagatgaacagcgaaggtggttcaagatgcaaacaaagaaaatgttgtccaatccaaagtaaaagcatagcttaacatgtgatccaaattaaaacttttgtagtaaaatgcacgtgcattgcactgggtaaaattgattgcgataaattttacatcttctttgtttttaattcgaaagcccattacatcatttcttttcagccccgcctagtccgttaccttcctccgctcggcctgcagcccacaagtggaactgcaggctcaactcgcatagattgccaataagagtgctgatactcccaatcctatccgaggctgccgtcttcaacctagatcgacgcgcatacacgctaaggttgcgcacaccgttccgcatgcaaaaataaaataaacgacttaagcgaaaaaaacgatggaaaaaatcgtaaaaaaaggacggtcaaaaaaataccttgaagccttatgtattttttttattggtatatagatgtagatatacaaaatttgttaatcacaaaatatataacacacatatatattttttgaggttaatgacttctatggccagctcaatacgcagagctataaaaggtagtttgtacatcagtccagtcttgtaaaattaaaactgccaaggtcctggatatcaatgtgtgagtactaatctgggggtatttttagaaatattttgtatttactgaagtatatgataaaatatactattaggagtaaatatgaaaagagagaatccattatataccactgactttgtcatacgtctatgatttgccactgactttatcacgttttataatgtgccatcgacttttgcttaacttctacaatttaccatcgccgtccggttagtccccgttagtaatgtacaaatttatcaaaacgaccaaaatacccgtaggacaaaacttttaaaattgggataaaatttctgaaatataagattttaagtttttggccaaattttggatgtttacactcttatgtttataatatgatattttgaatttttttatccaaattttggaagtttttgttctaggggtatttcggtcatttggacaaaattgtactgtactaacggaggctaaccggacggtgatggtaaatcgtagaggttaagcaaaagtcaatggtatattgtagaacgtgacaaagtcgatggtaaatcgtagacgtgtgacaaagtcagtggcatataatggattatctcttatgaaaaactgctaggagtcatatgccacgtgcaggtttcttgaggcgagaattgtgtggtgggcggtggcctggatggagatcattatcctctcaccctgtgtcactctctcgttctttctctcccagccgtcgtttctgttctccctctctgtaagactgcaacgcagcggtgtggcagccggcgggagagccacggttggagcaaagcgaggcggaagacgggcgaccgaggcaggtgggcggggagcgaagcgacgacttcctcccctcccacacgcatcccgtcatctcccttgatcccctcttgcgtggatcctcccctcttgcgcggatcctccaccagtgactggatcttgtcctctctctggccgctagcggcggccgcggccttccccaccgtgagcagccacggcggctccctccactacttccgatgggtggatccggcggtggcggtggcggcggccgagggcggatccggcggcagtcggtggtggtggcgtcggtgacggccgcggcctctcttctgccttcggtggcggtggtggcgttgggtggatccggcggcagcggtggcagcggcgagtggatccggcggcgatggcggcagccgagggcgattcggcagcagtcggtggtggtggcgtcagtgatggccgtaggtggatccggcggcggtggcggcggccgagggtggatccggtcgccttttttttcgcccgaatttgtttctttttcgtgaattggacattgggatcaagttcatgagctttactcggattaaaattgctcttttatgttgtttttggttgtctcattgtttgattcatttggggatcaagatgggggattttttttttaaagaatcggactcgaatcctatgagtgtttttggttgtctcattgtttgatttatttggggatcaagatgggggattttttttttttgagggaatcggactcgactcctatgagggacgacagacgaaacggatggtatttttgaacaaaaatcacgggtgaaaaggaggtgatgattggaaaaataggaatcttttaattagttaagatataatttgagttgttttgttgataggtgtaggtataaatcgaattcttataactaggtatatgctcataatttgaaaatttaaaaaaaaaattgagtgattttgtgcatttgataccatggtgcccgggcaccatggtgtcccatatgagtgtcatatatatatatatatatatatatatatatatatatatatatatatatatatatatatatatatatatatatatatatatatagagagagagagagagagagagagagagatgtgatgcgtgcggtgcatccgaaccagcaaactcacgagtgcctgtttcatttcgatcgaccggccggatatatatacatatattcgataatgacgactggcgagatgatcaggagtgcacatatccaccaacctaatttggcatccatcgaatcgtatcggtggttggaatcagatttatttattatggtactagttagatgcccgtgcgttgcaacgggaaataaaatcatcaactttaactcatactactactactcataatttctaaagaatatatttcacccttgtaggtccatgtacaccagctatcttctgacccactaatatcatgatttccattttgaaagaaaaaaatagataggatgcaatataattcagatatgtggattcagaaagattttcactcaatgtcaggcgcaattaagttacaacagaaaactgagaccagaaccggctagattcaggcttggtttagttcccaattttttcttcaaactttcaacttttccatcacatcaaagttttcttacacacacaaacttccaacttttccatcacatcgttccaatttcaatcaaacttctaattttggtgtggactaaacacaccctcagcaactttttactccatcacatcgttccaatttcaatcaaacttctaattttggcgttaactaaacacaccctcagcaactttttactccaattaaaatacaaccttggcaccaggctactggaaggcaccgccttcctcatggccacgtcgtttcttgcatatttctttgctgcacatatttgtccacacaagacataccaaaataaaatccaagcaatcacagataaagaaatactttataggcactgcgatttatggcagcaataaatatacattatggaaaaggatcaagcaagaatgatcataacttaaaatggacaattatattttagactacgtttcatagtggagttgtactgcaagctattaaatgggctccttgaaatagagcaaaaaaataaggcacgagtggatgaaaatatggatgaccaaaaagtatgttcttcggaatagatgaaaatatggattcatcagaacaattacaaattattgcaatagtagttttcaacagtaaacctattgaattcgcaaaaatcaatgagcatagttaaattgccacctcaaaaaggcaattaacagttatacataaactttttcgactaaaaatgcaaaataatattaaatacttatttccatttactccatcacatgagtaacatggtacaaactgcctacatgtcggctaatccagaaggaagtaccagttccaaagagcattaaagaaagtttactacttatttttgcattgatagaatgagacatgaggtgcaggaaatatgcttatcaatatttggttgggggctgggtaggtcgagttcgggcgtgcctccatatcaatatgcttatccaggcgacgaacagattacaagataatccctctaacatgttataaagaaggatacatatttacacctattgggtcgagttgggtgaaagaaaaaagaatgttctaaccgagaaacctatgcatacagatgcgccgttgcatacctcttgtaagaaactgtctgcagcctcatcctctaattaagcaaggtagcaggctagcagccaaacagaaacctcttctgtatctgaaagtgtaaattgaatgataagccacgtgatgagtagcacacatattgtttagatcttttcgttttggcacagaggcagcaaacgtgggcgccatccgtaaccttattatcaccaggattagccctgtcctacagagcaagattaaaaaatatggtgggtggttgtatgcactccgatgaaaagcatgaacctatttgttgagctaggaagactctcacttgttaggcagctcaaggatgtacgctggttttctagcagcttcaagcctccaactgtgtctctgttcagcagtgaggatcccgaattcagcagtgacgataacatgaacacatcatgtagaactttatggatagtaagttaaaagaccataagcttgttaactggcagtgataaatgaattttgtttgtggagacgcttttttaataccttttcatgcaagaattactgagagtttttgtccttcagcatatgcatttttttggattggttttgaaaattatacttcatcctttagcatattactttcagtttttcagtttgcagactactgagagtttgtgtccttcaatatatgcaatgaagtaataagaatttatctttggttcctttaatagtactttcagtttgcacagttttggaagaagagttctcatagtgtgaaaaatgaacatcaataatcatcactgcgcatttctcattgtgaagaacaagtgcaaaatatctgctcatatgaatcacacaagggaaaaatggaaaatagtttgtttaccttaaattcagatgaggagttactgaggacgtcgaatggaaacaacaggatatgggcacaagaggtctctgattggtgaggtcacgcatggcggatcgctgctgccaacgttctgaaagcagacgttgagaccttcaggggattaggactaaacctgaagcagatcgagcactggaccaccttagtgaaagatccacggctgtgcatgaaaaaatggacctgatcatctaaaaacccctgtgctagataacttggtagcagctacacccatcagtggaacaatagaatacttaatagtgctaacaacaaaccacccaaagtttacatctcaataaattgtacgtttgcactcagttttttttttccaaaaagcacacaagctcatctagcatgaagatttcaccagcacagacaagtaagcatctttacttattcaagactatcttgcaaaacttaagtccaatgcacttgtttatcaatgcaacaattattaactaccactgagtattcaattagaaataagcacctagaagatagtgctaattatattctagtatatcataaattatatagcaatttaacaatgtcacattttctcagaatttcagatataacattctcagaatttcagatagagcagttcattatagtgaggcgcggagggcggagtcttctccctgtacgacgaggaaattctgtaattagagtaccagttaaggactttagctagatatgtattgaatgcaaacgataacatcaaaggtatggacgtttcaggggacaagggagttgcttggttagtactacaaacacgatcagcacagacattataatagtaatgaaaaacagatgtgcacttctaaaagaactaattatgcaattaatgatgatgataacagtagttgtttcttagcatcttacatattaagctatctgaagaacaaatatggcaagttagcagccgacggaggtcagtcgacggctcccggtgatgatgcangtggagcggtcggcggctcctgtcgattcggcggctgcgcagcccatggaggaggtcggtcgacagctcccggcgacgatgcatgtggagcggccggcggctcccatcgattcggcggctgcgtagcccatgggaggaggtcgtcgacggctcccgacgacgtcgcaagtggaggcggcggcggctcccgtcaatctggcgcaggcgcagcccatggaggtcgtttcacggttcccgatgacggcgcaagtggagctgccggtggctcctgtcgatctggcgccgacccagccatggaggctgggctccgcagatcgtggcagcgcgacggcggtctggcggcggcgaacggtggtggcgagaaggaaccggcgaggagtccgacgatgttttgtcggcggagatcgggaacggtgcggaggagaccgacgagccgggcgacggtgatttggcggcatcagcggagcaaggcgtggcggcgcgacggtggtatggcgatggagaacgatggcggcgaggaggatttcgcgagggcgagggtggtgcgggtctagggtttcggcagtggaacgagtaggggaaggccgatgagggcggcgtcgggtgacggggtgagtgcgagagagaggagagcggcgatggcggacggtcgacggtgacgatgggggcgccggcgcggcgaggtgggaaggcgggaggcgggaggcgatggaggcgcgggcgcggcgatgtggggaggcgctgtttcttttttttcttcttcttcttctttttgcgttgattccggatctcgcgcggcgcgatggtggtgcggaggtggagcgtgtcgctctgatcgtgtcgatgtaccttttttttttttaaggttgaatggtgcgtggtttcatcatcaccactataaattttttaattttttttttaggtagtagagatatttgcatgatcgatcttgaaaaagaaaaggcagagcacacgcattttctggctgcttgcaagtcaaaacggagtgaaagaagatgggccggatagctatctatacaggccgcgcgcgtacgtttttgggctgacagggccggcctgcttcgtctttttgtgaacatagctatgctgctgcttctttttcctttttctttttttgagaactaacattagctatgctagctccaccaacctttccctcaaagaagagacaaaacagtttctatctccaacacacatatgtgtgtagtatttcagttgagtcagatatcagtaaacatgtatgtactacattttatatactgtacacaacagcgcttaatagttagtagtatagaagtcgatctacatttcttactgtagtatatatacactctgcatgcaatttgtgaacacccatccgttacaataattccattttatttgttgtttcctacctgatcacctccttgtttgcatctctccatctggcatcgtaccttgaagaattcaccattcatttcattgcgatggttctggaagggtgatgagccgagatttcgagtcatataccatctccgtgctacaactgcaaaacaaagagttgcacattttcagattgacacaaattgtagtattatatttgtaactcgaacagtactatattatacacaatcaacaatgatggaatatgtacatataaaagtataggagaatataatacatactctgcacatttcactttgtttgtttcaccgccactagacactgacaggatagtcccgaagaaggaaaggttttcagcgccacaattcggacatggcccctggattgcccagagaataatcatcacttcacttgaacaaataatcatatttgatgtctaatgtctaatgcaaaaaagcagacaagcagagaggagactaaaaataataccttgaggattaagaagtcgttcactatggcattagttatcgactgtgctatgaacaatattagaggcaaagcagcaaaccatgtgaaaatgaaaccgaaaggctctggcagctgcatttgttcataaagattaccgagtggggaaaaacatgtcaaatagtcagtcgaataattaattggaagaaaggaaaaagaatttacctggaatatgttgatctcaaagccagtcaactcatcgatgaagaagaacctaaatgcatgcaaatcgaaattagaggtgacaaacataagtaaagtctgataaaggatgaattcgtcgcaaccagttcaaatcccaccaggacaatggacagtaaaaggtatactgacagtccaatatttatttcatactagctaggtatattggaaggaagcaagagtgagatgaaaagaactcacagtcctagagcaagagtagttgctggaacatttagcaggaacatctttaggtagtcaacggtcaaatcactgtacacctgcgccaggtagcataaataaataaatagtcagaaaaaggcccttttaatttgtcagtaaatttaaatgagcaagatgcatggagatgagtgttgtatgtgtgttttgacaggtttgttgtatgaatggtggtggttttggtcatgaatttgttgtacaggattatgtttccatattttgttgctccagaaagcccataggcaggcttagaatatagtgttgtatcagtataagaggatcggagtaatttttattacctttcggctgcgtagactgcacctgggaccttcggtgacaatgtcacttccgtctttctagcatataatataataagagcagccagtcagaaaagaaattaaactacgtagcagctagtactggtaaatattttagtgagagtacagtagcagtagcagtaagagtagcatggaaggaaggaattagttagttgaattaagcgaccttcaatctgagtttgagttggtcgaattcagcgtcagacatgatggggttgccggcagcataggccatggaggcttcgagcaggcgttgttcgtcagggcctgaaaagatattagtgttaattagtgggcaaagaagatactaacagataggtatccgcagaagagatggaaggagtagtacttacttagcatgacaacgctgctgccttcccacatgagctcctccttgaggttgtcgaactcctcgttggacatgatggccttctggtcgtagtagaaggcctgaagagcctgaaggaactcctgctccatctcacccagcgacctcttctcggccttcttccccttcccgtcgatgctgcagtactggagcacgttgctgtccacaacctcatcaccatcttgtttgccttgctgctgctgctgatcggtggcgccaaggcggaggcgccgcccacgcgtggaggttgcgagtgcacaggaggagcggcgaggcaggcgggggagcccggaagcggagaagaaggcggcggtggaggagcggggagggtggaagaggcgggaagccggcgacagccacgcctcggaggccatcagcattaactcttctcttctcttctctttgatccaaccgaggagctagggaagcagcacagccagcagtggcagaagcgagagagagagatgtgcaaatggccgcagcagcagcagcatcaggtaaacaaacgaacaaacaggaaaacattttgtgtggacgaggacgaagatggagctagggaaatcctttgcttcgctcacattcagagatagatttcctccctcccatctcaaaaaaagagagagatttcttcttacacctctcctctccacaccctttggacctactagctctccatttggctccttctcagatttttcttcccctcctccttccctttctcatacttacttctgggctaagcccaatttcacatggcacaaactatagcccacacaaatttcccataccaactccaaattggatcggcctgtctcaatcaggcctaagggcaaaaaatatatagagaaaattcatttgcctcgctctttgagggtgaaattacattcgtttcctaggattttttttttttggtaccatcctgacactcaactgactagggacaaaatgttcctctactcaaggtggtgtgcttgtaatggtccccagttattattatttggtatcttcctttgtatgatccacataaaattcatattatttttctccatataaaatcgaatatttttttctgcatcttagtatgccctcgagattgaacgttctcttttgactcatattagtaatacggccggagtatatatatttaactcaagcgcaagtttacagtggctgggtactatgccgaaaaatatatgcagctccacatcaatccaagcaaaacactagttttatacctaaagtagcatgatatagtttctctctctcaaccgcttctttaatttcaatgtatgttagcatatatagcttactcgctatgtattgagtgcatatattcacagatgtatcagtttttgctgttcatgtaatgttgttagagttacgcaccagcatgaaccagcactgatgcattgtacacttgagccaactcctaatttggacgtgccaaatggtaacaattaatgttgaagagcacaaaatacactgagactaggatttttatatatgtaatgagagggagaaaatcgtgtatagtgtatggaactgatctatcacctgtctgggaaagaatttgtgaatgtttagtctgctttactttacacaaagtgaatcttctaacagcatcacgtcaaaatgcttgtgttgtgtgtgtgttggtatatgattatgtgcaaaaggcctaccagtttcttcttcagctcctctgtctggcatgatcatacatgtgcacggttcccgtcagagaaatatgaagcagcatgccaacataatttgcagccaccatgatataggggattgagaatgtgcatgccctaccaccccaggggaaaataaaatggagaaataaatacggtgctgaatgaattaccatacaataaattgtaccagacttaatgcggttttatactttctgcatattatcatgtctccactgtatgttgagacctgaaagttgtagtaaaagttttgcaacatcttgagaaccattggtcatttggcattcaatttcactccacatcctagattattttccttcgtatttgtccttgccgatttgctatgcacaatcattttgatgctatcattctcaaacacaaacacaagaaaggggacactacactttccatcatgaaaagtgtaacacactaatggtcatccgtactcattgaatatgatgaagttgtactgggctaaattggaaaatttaattataccaagccaattcaataatcataagaatgagtggtccatgaaactaaataagaaaagtagaacataaggtgcgtagtctcttagctatttatctgataaaagaaaaacaacacagagaggactagagcgtggaagtaccatagttcaaataggcttgagccaacatatgtccaagctggacttgcgcttgggtgctaaggtgcagatggccatcttctagtggcaaaccctttgcatcaacaaatctcacgtttcgaagtttgatccctttctgagcttcccttactacttcagtatattgcccaagccctgatgctagtcctacctgaaacaccaaacagaggaatggggattgcctactgtattatgtgatatagcagcgaagagtctaatttacaagcgatttgacgaataccacaaatagttttgtcttgcattgcctgggtggtttgaatgaggagaagaatatgcaatggtccatagtaagatgacagtagttgtgcatgtagaccttggacatatatatgcctattctatacagatatatatagggattgtgtgcatatcatgcatgattgagctgaggtggcggtgggttggcaacatataatgcataccatcatctcagactttgaaaaccaacaaatctaaagtaagatggaatgccttaaactacaatggaatttattttggcatgtctacctgacggaatgtgatggtatgttattacattaggagaagaccagaacagaccagaccagaggaaatagtagcttggaatataagtatgttggagtagtatagctgaaatcttgatgcagacgctattaacaactctctattccgtatggccaccctccaccttcctttattattacattttgttttctaattggaaaaaagagtagatgtagatgtagcaacaacagaagaagaggaaggaacagcaagcatgcccaagtgacaagtaaagctaacaaatctagggcaggcattgcatagaaggtcagcgtgtattggattggagagatatggattgataggagaaaaagaagagaataataataagggataatacctggatgaggagaaggtgtggcatggcgagatcggcgcgcaggttgcggacgagcatggccatccggcgggcgtactcgttggcgtcggcccagcgcacggtgtcgctctccccctggtaccagaggacagcgccgatgcggccgccggtctcgagggcgaccctggagcggcggacgagatcggagtagaggtcggtgcccttggcccagtcggccatcctggtgccgccgacggcgcaggggacgaggccgatgacagggaactggccggagcgaaggagggcgttagcgaaggacatcccgggaccgacgccgcaggtgcggttggagtcgatgccgttgtggagcggctcgtgggcctcctcccatcggagctgcggggagaggcggaggatggaggggttgggggcgcactccgggggaaccatgccgtcccagtgggaccccaccacgcccccgcgccccgccatgttcgactgccctcccaggatgaacaccaccttgttcgacggagggagggacacagccgccgccgccgccggaagcagcagcaacagcagcagcatccgccgcattgctgcttgctaccgttgggcttggggcctggggggttgggtttgggacaaataatttgaaatctactcctcctcactactctactcgtagtcaatttataatgcagctagcggcatgtctgtttgagtttgtttgacccaaccaaaccaaaccaccaaagaaaggaaacaacatccacccatgtcgtgcgctgctcttcccttttcttttcttcttttttttttgggttttgttttgcgcgagtatagcaggaaggaaagtagtacgatgggcctagtttgttggatggccgtgggctccttatcctagggctacggcccaggtgcatcggaggagcgagccaggctcgttcgccgtcgctccggactacagtatactggactggactggaggtcacggtcgtcgccacttctgcccgccccgatcactcttccatctggattcaaaccatcttcttctcctccgatccttgccataaacacatttcactcagcaaggtcatccaaaggttagctaggccggaacatccatcattcacggtacggtcaactaaattttactgaaatacactactactagtagtaccaccacctaggtgtctgggcaccaagcctgatacttgtggttatcggctgtgattttctgacgtaccaggcctaatacttggtatcagccgtgataatcaccttataccagtcaagaatgacttgcctatgcacaatgaagaggagcagcatgacgagctagcgacaagtacaatgtaacaacctcgagacctccatgaactccgagattgccctcacaccgagaacgaccgacttgcttttatccttggtgcccttgacctcatctccctcagcctcgcgtcctccctcttgtccctccccagccacgacaaatggtgacctcgctgtcgcagttacctttctacttgccgatttcaccgattccaacagctacataacctcgttagagtccacatgcccattgatgtggtgtggggaaggggaaagaggatgtgggatgtcatcgtgttggggatgatggcgatcggtcctccagcaaagggaggtgggattgattggagtgaaggagggattgattggagtgaaggagttgggaggagcaaagtggacgacggagagaatgagtcggagaggaagaaagaggagaaacagatatggagaataagaaataaatctagggtgtttgttgttaagttgtatcccattctacgggatctagggtgtttattgttaagtaggtgtactagtatcctaattcacgggactccatccactagtttctgtaataaaaatatggcctctttgaccgtatcgtactagtaggtgaaaatggaccattgtcgtatgaagagaagagaaataggatgaatgatgatgagataaaaatatgggaaaattggttccataccatcgaaagttcctgagttttgctttataccatcgaaaatttgtggtgcactttaataccattcaaagttttctccgttaactctctataccacaactgtttatttccgtcagtttttttttcttttcaatatttggctggaagacaaacaggatatgactgtattgcccttccttcactcatctaaatctggcccaaattttctcgttttttcctctttggctgacatgggcacatcgctccatcgatggggatcgggagcaacaagagcaggcagcacaggccggaggaacattgtgaatagaggactgcacgagcaccggagcacggcgagtgggttacgagcgcgcgcgccggagctgcacggccgacagggacgggctgtcgccctgtcttctgtctatcttctccccgccattcgccaatctacacgtccctgctactgatctcttccctaccggtgagctggtccccaccatttcaactctcaagcaccattcatcccatcaatccgcgtaatctcgccgccggtggcccaatttgcctcaagctcttccaagccggccccctccaggaattgcagcgtcggtcaacatcgtgctctcccgcgccaaccccttcctcacacagcggatggctggccagctccgacaggtgcggtggcaagaggatgtgatggagctggcggcgatgcttggtgaagaagatgctgcttttgatctggatgcgtcggggaccggagacaagggcaagcaatgtcatgtttaacgacagatccactaaagttgacggtgatggtgaaataagtaacggagtaaattttggatggtattaaagtacgccacaaactttcgatggtataaaacagaactcaggaactttcgatgtcgtggaaccaattttccctaaaaatattcctctaagagcaggtagaatagtactccctccgtctcaaaataagtgtagttttagcactattcatgttcaacgtttgaccattcgtcttatttgaaaaaagattatgattagtatttttattgttattagatgataaaacatgaatagtactttatgtgtgactaatttttttttaatattttttattaatttttcaaataagacggatggtcaaagcgctaaacatggatatctatggctacacttattttgggacggaggtagtaggctataaaccagctataaacatattttaaagagataaaagaagagagagaatagcagcggactatatatttgtagccagctacagcacggactcaaagacgtaatgtgtgtatatgacaagtaggaccaggtattaagagtatagtaagcaactattgtatgaattagctattacattaactatgatgatttggagcgctctaacgagcgtgtatatttttattgagccaatcctctcactctcctctcctccatatatacggtagtactcctatattggcctgcctgcctgcctacctgtcctgtccgtccaccttgctgtgttaaatgcgtttctagcgtagcgtagcagatccaacaaacacctagcagcagcagcattggtacgtactcctcctagtcctagctagtgagtgagcgtgaggagcagtgagcatggcgtcgccacagctacagctgcaggtactagcgctgctgctgctgctcgccaccacggccacggccacggcgacgccgacgccgacgctgatattccttttgggcgggcagtccaacatgggcggtcgcggcggcgccaccaacgggccgtgggacggcgtggtgccgccggagtgcgccccgtcacctcgcatcctccggttgtcccctgagctccggtgggaggaagcgcgggagcccctccacgccggcatcgacgtccacaacgtgctcggcgtgggcccggggatgtccttcgcccacgccctcttccgcgccatcccgccctccaccgtcatcggcctcgtcccctgcgcccagggaggcacgcccatcgccaactggaccaggggcacggagctgtacgagcggatggtggggcgcggcagggcggccatggccaccgccggtgcaggtgcaggggccaggatgggggcgctgctgtggtaccagggggaggcggacaccatccggcgggaggacgcggaggtgtacgcccggaagatggagggcatggtgcgcgacgtccggcgagacctggcgttgccggagctgctggtgatccaggtggggatcgcgacggggcagggcaagttcgtcgagcccgtcagggaggcccagaaggcggtcaggcttccttttctcaagtacgtcgacgccaagggcctccccatcgccaacgactacacgcacctcaccaccccggcgcaggtcaagctcggcaaattgctagccaaggcctacctatccacgctctaattatatcatttgcgttcactgctggctactaagtactgattcattcctccccttcccctctatgcaaaatctgtcatatggagcgcgtgctgtatgtaggggatgagtatcttaccacttcttccttcattccggattaaaatataatgttactgattttctttttcccacaattattactccactactttggttattacacacacacaggacagacacctggattgatttctggactaatgcttctttcttcctacttacattactatactctcctagtactcctgaaatgtgtactgtcggcagctccaattgtactcatgctgtgatgatctgttatgtaatgtagtatgcaaccatctccctccctccctgtttcaatccttcgagcggttcggttcggtactcactttgattggccaacatatgcaatgcatgtttcgggcagacaaaaggcgccaagctaaaataaagatgttggtctgtctgacacggtgactcggggccagagatgtcttattctcttgtttattactactacagtacacctcaaatcagctttaccattcattccatatcttaatcaaatctacttctacagtaatccaatatagtactccctccgtcgcttattaggatcccgttcttttcttcagaagaagttggatgaatattaatattttcatgacacgctttttaaactgttaaacggcacgtttagtgtaaaaaaaatacataaaagttactctaaaatatcatattaatctatttttcaagtttataataattaaaacccaattaattatatgttaataccatctcatttagcataaaaaacttaatctttatcttcgtatattcagatgaaaagaagaccatctaaagggcgtactttttctttttcggagatcaaggcgtgggtgtaggtggtagtttcctccgcatgcacccctaattaaacgcccatgcagaattaatcatatggctcatctaagggtctgtttggcacagctccaactctaacttcacctctgctggagctggagctggagctcagccaaacagtttcagcttcaccaaaactgagagtggagttgggtggagctctctcacaaaatatacta

SEQ ID NO: 82740 - DNA, 29140 bp, Oryza sativa
ataatgatggtctacctggagagtttttccccacaggttaccgctgatatttgtcaattggcgtgtaagcgggagaacactcaaatgaaacatgagctccaaagcaagacatgcatcagtctcgccatattcaacctagatgagcaggacaatttggcaaataatgcttcagtttgtagtttctgaagaataagcaatctcataaacaaaagaaagttccaaaaaaaactgtaccagcttgagaagtgctcctgaagattggaacattgggggaatatcatgtggagagacctctttcctctcctttttcaattgtgtttctgcaagttgtgtcaaagaataactcacctgtgtacaaacaaattcattagagaataaatatggtagtaagaacaaacaaacaatttaaatgccatttacctccttcaggagatcgcgagagcataagtaggtatcacagaggagacgaccagcaatgcaggacataattcctggacttgccccagacccataaagtgtgttccctttggtgagtctgggcattactgagcgcctaagacgaccaatcttggaccacatattgcttggtactttgcaagtctaacaacaaaaggacagtgttttcaaatgattgaatttaaatcgaaataatagtaattaacatagcgtaaaatgatagaaaaacctgtgcacggtgcaaaaggacgtccaagtcaaatccagaaatattgtgtcccacaagtacatcgcaatcaagtttgctaagctcgatcatcaagcggtttaacaatgcacgttcactgatagcagaatcaaaaggttagtgaatgctaccacagttagagttattaacagttatagaaaagaaagttagaagtgtccacctgctctcgagtgccagcacattgctaccagccttctggttcctatcagaggattccttggagaggcctataggaaatatactgccttcaagcttgcgcataacagtaaaatggctgagcattccccgtttctgccaatcttcagaacgcattggactatctatctgaaatcgaccacccaaaaaaggataaattagttggtaggagaaatgttctccttttataatatgcatattctataattgttttagtgaaacctggaatgtgctagttagttttaaatattcatctcagtcatggaaaaccatttaatctgacaattcattgacaaaatttataagtaaatactatagtaaagtacttcaagtgcaaatgaagaatatgcttactttcacacggtgacagcatatgactgatgctgacacaatttcatgcacattgtgtttctcatttatgatagttttaagattaactgctgcaaccacgacaggaggaacttctaacgtggtacttgtcatcaaaacagatatgtctttgggactatcaactgtaacttcaaatttacaccagctgacctgtgaagaagtcaaaaggcatcaccatcaacatggtgcaaaataaaagcagataggagctatgagggcatcataaactagaaacatggcatggaataataggatatttaggatatacccgctgagtagctggacatgccaaaaatttggagatcgaaagccatgaaggccccttgatcttccttttgatgagaagcaattcaagagcactggaaaggtacgatggttaatatcaatgaagatactgagcatgaaacagcatatacactggtttgtgtatgctgtatagcatgaccccatgtatttgatggatcattacctattgttcgtcccaagtaatgcatggaaatgttgacctcgaaggtctgtaggtagcgccggatcctaagaaaatatatgcagtataagaaataagcaaataggagtcaaagatgcattgcccaatagacataccttatatgggtaatttatcttcaagacatactgctccccatttggtagatcagtcctctcaaatgcatagttcctctatggcatgccaaataggaaaaaatagtaaattagctcagcaaaagaaaaaaaaaaggaactaaaagataaaagtcactggatgcctagtatcaactttccaccaacagaccttgactggagtcattgcaaaatttgacacgttgaagtctgacaacttatcagctatttcgctcttcaatcctgatgctaactcctggcaagagaattagcatgtatagataagtggtgcatgcaaagcatcacatttactttcaaaaaaatcaatcattctcacatgtagacttgctcgaagtgatggagaagaatcagaagtagtggaattcttctctagccttgatatggtgtcccttgggaagattgaactgcttggaatagcatatatgcacctttgcatattctttacaaccacacaacaactgtggaaccgcttgcctacttcaacctacaaaagaaagcagcttgtcgggagaatggaaataacctctgcaggtagagctgcaggtgtgtcactactaaattaattacagtttctgacagaacacagtaactatccagcagagttgataactgttttcatatcgcatagttgtaagtagagcttcttttagaatgaaattttctgactagtttaagaaatgcatgtgagccttaaaatgtcaaaatgtatcaagcaccatatcatttaaggcaaatcaattatcccacactcccactaagttaaatagtgcttaaaggacacaatatgatataaaccccatgcttttttatatgaaattggtcattaagcaaaaacattctgccacacaacagtaactagaatctgtgtactttacaaatgaacagctgaaattttcgttacctttccaaacaaatatactgtgcccgaattagcaccaaaaggctcctcgtatgcatccaatatgtagaatggcagcgctccatccttcagctcaaattctgagctttcatccacgccggtgttgctgttagcagccaccgctccctcacctcctgcattgtccccatccccgcatatcttcatccaccctgctgttgcactagccatatccccattccggctgtcctccgtcttaatcttagcattcagacgatgcaccttctctatcttaacctccccattagcctcctgtttcggttcctccaggctgttactattattcgccaattcagcactagcaccaagaggtgtgtccaatttgggctccatttccacgtctggcttcaattccatatccatatcatttccatgatctgaaacctcatgggcctcgaaaacattatccgatctgaacgccattgccgtatcgactgccacattttcagccttgatgtgagcagttgttgttggcgctggcgccggggcacaaaccctaccaacgcggcggcgccgctcctcgcggtcattgtcgtcgggagcgaactccgcgatgacgtcatccacgatgctgtcggccgccagcgacgagtccctaccgcggtcgctgccaggcttcctaaacacggaggaggtgaacatggaagagagtcgttgcttccccatcatggcggcggcggcagagagggacgccgcggcggcggactgctgaggcgggcgcttcgactgcggacgcggctgcttccgcttccggggggcgccatcctcgccgtcggagccctcgtcggaggaggagtggatggtgcggtgggtccagtcctcctcccgcccgtcgtcggcgtagcccaggccgtcgtcgtcgacgatgaaggcccccgcgtccttccggcggcgggcgacgagcgcggcgtagtcctcctcggcgacggtgtcgtagatcggggcctcaatcctcacctggacggcggcggcggcgcgggcgcccccatcgcggatcgcgcggaggcgctcgagcgccgcggaccgcgccaccgcctcggagccccgggcgcgcgagcggcggccggaggcgcccgcatccgcggatccctcatccatggcttcgcctctcgctctccctccccttccctaacacacgcagtgacacaaggcaatgtcccgatgctttctcttgcggcggaaagggggagatctattctggatttgtgtactggttggattgggcgggaaggtgttcgagggcttgtggcttttggcgcgcagaatttggggaaatggaggtctagggtttcgcctggacccgtttagtgagctagcgggtggcgcaggtgagaacgaaggacccggtaagagattgggctgaggagtacgtgggcatgacgttcggctgctaatttagcccatcagttgtacacgttgggctattctgttgaggaataagtccactttaagtccctaattatacttgcatctaatttgtatccctcaaaagtcaaaaccattaagggagtcaaaatgtaccggttttaatagttaagaattcaatatatatggtattgcaattgagggatacgaattaaattgcacgtatatttgtgggagtccaaatgtacttattcattccgtcattccgttgatgctttggttcgctcgaggatagtatttaaatggtcttgggccaagattaaatggaaaaattagtttgagcaaattgcaattttctgttgttgacagacaataggggcttacatattttgcaattttctgttcttgacagacaagagggcttacatattctatatgatcgttcaacaacatatttttttttccgaaaaaacattggttatattttcaattttgttttctcgttctctgtcgtttgttgatggcttaccttctatagttggaaaccctggaatgccaccatattggaaagtcaacttcaaatacacttatcaaaactttcgtggatatgctgttcattacacaatgacttgtgatgttttaattactatgaacgtaccgagtctgtacagtgagcacaaatagaaaatcaaacgtggcctcgctgtttggccccgggaaaacattctagcccccgtttagtttgacatattcgtcgcattatcatttggcaatctccgtagagaatccatatgagaacaaaggctataaatagtggaatctcaagtctaccgcaaacacattctagctcagcctttgctggacttgttcccgccaaaagtcaggatcaagttaaaagaagctgcctccaatggccgatcgaatcaccgttcttgccattgccctcctcgttctgatcttgtcgccgcaaatggctgtccagggcaagcctgcagctggcaacaccgcgagcccaaggccgaagcagcagcaactcgggaacttcttcaagaagcacgggtcggacatcgccggcctcttcccgaggcatcgcaacggcggatcatcaggtagctacagcggccaggccgtgccggccgacggcggcgaaaacggcggtggtggccagagccaggacccggcgaccaacaccggcatgtacgtgttgagcttcagcgtcggcacgccgccacaggtcgtcaccggcgtgctcgacatcaccagcgacttcgtgtggatgcagtgctcggcgtgcgccacctgcggcgccgacgcgccggcggcgacgtccgcgccgcccttctacgccttcctgtcgtccacgatacgcgaggtgagatgcgcgaaccgcgggtgccagcggctcgtcccgcagacgtgcagcgccgacgactccccctgcggctactcgtacgtgtacggcggcggcgcggccaacaccaccgccgggctcctcgccgtcgacgcgttcgcgttcgccacggtccgcgccgacggggtgatcttcgggtgcgccgtcgccaccgagggcgacatcggcggcgtgatcggactcggcagaggggagctctcccccgtctcgcagctccagatcggcaggttctcctactacctcgcccccgacgacgccgtcgacgtcgggagcttcatcctcttccttgacgacgccaagccgcggaccagccgcgccgtctccacgccgctcgtcgccagccgtgcatcgcgcagcctctactacgtcgagctcgccggcatccgcgtcgacggcgaggacctcgcgatcccgcgtgggacgttcgatctccaggcggacggctccggcggcgtggtcctgagcatcaccattccggtcaccttcctggacgccggcgcgtacaaggttgtgaggcaggcgatggcgagcaagatagagctgcgcgccgccgacggctcggagctcgggcttgacctgtgctacaccagcgagtcgctggccacggcgaaggtgccgtccatggcgctcgtcttcgccggcggcgccgtcatggagctagagatggggaactacttctacatggactcgaccaccgggctggagtgcctgacgatcctgccgtcgccggccggcgacgggtcgctcctcggcagcctgatccaggtaggcacgcacatgatctacgacatcagtggctctaggctggtgttcgaatcgttggagcaagcgccgccgccgccgtcgggttcatcccgacagtcgtcacggcggcgctcatcgtcagccccgccgccgctgacctcgccggcagtggtcgtgatccatttaatgttggtcgtggtatacatgttcttgtgaacttctactcgaccttgcggtaatatctggaaggtatccttattgtcatgtcgcagacgtgcagatttcaccaaggtggttcattttgacaatgtctgtaagtaaaatgatgtattctgaatttctgattgtttttttttccaaattactactccaaatcaaagcgtatacgtgttgtatcgttttaaaccgtgttgtcacatgtggactgatgattgtctgattctagtttttaagtggttagtatcctttgctgacgctataatttctaagtgaaatggcatatagcctagtggttgcagtgacctgagtagcaccttaagatcctgagtttaaatttcgagcgaatttcggattggattatttgagggctaagttacctatttgataggctaaatttctaatctaaaaagttcaaatctacataggaacgaatttcggattgaattatttgatagttaagtttcctatttaataggctaagtttttaatctaaaaagactacctacatccggttggataaaggccgggtaaaaaatacccttctacaaaagaaaaaggcaatgtggtgatttcaaaagacagagagttgagcaataaaccatcatcaacgacagcacatttttggagaaaatattaccaatttaccatcccgttgagagataattgtagaacattacgtgctgataagtgacacagcatgcatgcgacatggtatgtctctagcaaaactagcacccataatcttgatgaaaatgtacccataacccataactagttggctactacacctgtacaccaacttataattagtttttcattttttttttgcggcgaccaacttataattagttgacactggaacatgtctgattccccttcttcagtctgtttagcgaactaaatcctgttctgagttcttttattagaacgtgcttgtctgtactttgaacccagaacacagactaaattctgttatggtctggatttgtgcagcgtctggattgggcgggaagttgttcaccgtttggcgctcagaatttggggagacgggaggtctagggattgcttgggaaggactaaatctcggcccatcatgggctgctaaaatgaaccgaaactacacagagatgggctttgtcaaacatggaccaagagatttacgaacaggttcaggagaaattggcccttgaactcggcctactaacttaaccgagcaccgcgcgatcacgttgacgctctgggtcaacctgttagtttactttgaaatggtcttcgggtcgaaattcgaaaatcacatgggcatttactttgaacagattgagtttttccaagataatcttattaaatggaacagactggatcactgaacagagaggaggggtcacattctcagcgatcattaaccactggttacataatcagaaattaatattacttgttttgttttttttctctctctgtctctgtcctgtttttgttgtgtgattcccaaaccaatgactagaatggtatccatagcattaaataagttgtcacctatgacaaaaaatgatgtagcaagtgaataaatgaggaaagagaagaaaatcatgtcttgcatgagacatggttcctacacaacatctaagatataatgtgagataagtagcattaaattaaagtatggaataatgatgtttgtattggaagactagtgtctagtactaattttttttttgatgatgtggagtttatggaaaccatgtctagtgttatgggttaggactgccctaagggcattcccaacccaatgactaggatggtgtccatagcattaaataagttgccacctatgataaaaaatgatgtggcaagtgaataaacgatgaaagagaagaaaaccatgtcttgcatgagacatggtttctacacaatatccaagacatcatgtgagataagtagcattaaattgaagtaatgaatagtggtgtttgcattagaagagtagtgtatagtacaaaccatgtctagtgttatgggttgggactgtcctaaggattggattccccgcaggacgttggttgtttccatttccgtttttgctatggcagacgctgtccttccatcaaaaaacatggcaatttcgttattgctgagagattaacttaccttaatcaaagttgatagttgctaccatttgtcagtcaacactaaatactttattagaaggtgggcatgtacactgttcattgagtacacaaggctttgagcgtttaccgatcttactataatccacaaaatcaaacatgacctggctgtttaactagaagagagtattctaaagatcaattgctgcaaaaatatgagtgtattaaccgcgtttgacacgatcttgagtcaccatgttaccagctagcattccacatggtgatctacgtaatgagagaggaatttaaactctcgatatggtgtacactcttatttacataaaacttaaatagttataaaaaagtgaaaaaaaataaaaagatgtattaacatataatatatcacttcacaaccatgcaagttaaaatttaaccttcataagtcataataaaaaaaataagttaaattatagctagttaatgtatatttatagtaaaaaaaatcgtcgaaacatgtagaaattaaatttgattttgcatgtttatagaacgatctatcacatattatactattttgtttaatattttattttttataactatttaagtgacatacaaataacgagcggatatccctcaaaagtttactatggtttccctctacgtactgcttcttcagaataaatagcagtgtacattcatcatagaacctcagctcaagctctcctcgcaacaaaaactagcagcaaagatcgaggctgccacctccaatggcggatcgaagccatgcccatgcccttgccttcctcgtcctcgccgtcctcatgccgcaaatggcgtccccgggcaagcttccacgcttcaccatgggcccgaggacgaataagcagctccgggacttcttcaagaaccatgggtcggacatggccgacctcgtcccgtcgggccagggcggccatgagcagggtggaggcagctcctccaacgggcagagccagcagggcggcggcgacagcggcggcggcggcggtggcggcaaccaggccccggccaccaacgccggcatgtacgtcttcagctacggcatcggcacgccaccgcagcaagtctccggcgcgctcgacatctccagcgacctcgtgtggaccgcgtgcggcgccacggcgcccttcaacccggtgcgctccaccacggtggccgacgtgccatgcacggacgacgcgtgccagcagttcgctccgcagacgtgcggcgccggcgcctccgagtgcgcctacacctacatgtacggcggcggcgccgccaacaccaccgggctcctcggcaccgaggcgttcacgttcggcgacacccgcatcgacggcgtggtcttcgggtgcggactcaagaacgtcggcgacttcagcggcgtgtccggcgtgatcggcctcggcaggggcaacctctccctcgtctcgcagctccaggtcgaccgcttctcctaccacttcgcccccgacgactccgtcgacacccagagcttcatcctcttcggcgacgacgccacgccgcagaccagccacaccctctccacccggctcctcgccagcgacgccaacccgagcctctactacgtcgagctcgccggcatccaggtcgacggcaaggacctcgccatcccgagcgggacgttcgatctccggaataaggacggctccggcggcgtgttcctgagcatcaccgacctcgtcaccgtcctggaggaagcagcgtacaagcctctgaggcaggcggtggcgagcaagatagggctgcccgccgtcaacggctcggcgctcgggctcgacctgtgctacaccggcgagtcgctggccaaggcgaaggtgccgtccatggcgctcgtcttcgccggcggcgccgtcatggagctggagttggggaactacttctacatggactcgaccaccgggctggcgtgcctgacgatcctgccgtcgtcggccggcgacgggtcggtcctcggcagcctgatccaggtaggcacgcacatgatgtacgacatcaatggctcgaagctggtgttcgagtcgttggcgcaggcggccgcgccgccgccgtcggggtcatcccaacaaacttcgtcgaagacgaaccaacaagcgggcgggcggcgctcggcgtctgccccgccaccgctgatctcgccggcggtattcgtgatccatttcatgttggtcgtggtatacatgtttttctgaacttatacctgaccgttacatactccctccgtaccacttagtacagtctttaagactatttcttgaatttaaaattttcatatactataatattttttaacaaaatcataaggtgaaaataaatttaaatgataatttaatgatattattagtatcaaataaaaattaaattataataaattatttattggtcaaatatttaaagagttgaattttaaaatgtctacgagtctttataactgaggcggagagagtatgttataacaccgaggtaatctctgggaaattatatatcctactttatgttgcagacttgtagatttcaccaaggtgattcattttgtcattgtcaaaaaaactgatgtattctgattgtttgttcaaagttctccaaattagcgtatgcgtgttgtatatataattattgagtgatgttacggtacagcggtcggtaccagtaccgcccggtaccaatatcatgaccgttggatctggcttgattgatccaacggctggtagagtttggtaccgggcggtaccaattctgcccctagtgcagtaccacgcggagaattgaggtggaagggcaaaaacgtaacttcgcgtgcaagtcctcttccgatccgccgtattcctcttccgcgtaaccctaaaatcccgatctgccgccgccgtattcctcttccgcgtcgccgccgtgtttctcttccgctccagcgccctcgtgttcctcttccgccccgtcgtcgccgtgtccgccactgccgtgtcctccttcggcgccgtgagatcagcctacgcatcgtcggtggcagcggaggcagaggcggatgagccagcggcggaatatgcggttgcagcggccgaggatccgctccggtggcggcaccgaagtaggccgtggctgaggcgcgacgaaggaggagacgacggaggaggaggaggcacacccattttctctcccgatcctacccttctcagattcaacggttggatgatttttggtaccgaccggtactagtaccgctcggtacattccgctggacggtaaaaaatctcataattattttgtggggaaagtgcatttaaatactttgtaaatatgcaagtttaaattcgacttttacaggttgtaataaaaatagttgtgattttatagtaactaatttcagtttgacttgtttgttttattacaacatttgaaaatcaaatttgactttgtatgtttgtggagtgatatgttgtaacgtcccgccttcccccaggccgggcccacttacatctgatagctttcataggtcatagactgccttcacagaccaacacatatcttttctgcacactttgtcctcactcgtgtgcacccgggaagaattttccggtcggtcacccatcccaaattactccaggccaagcacgcttaaccctggagttgtttggagattggcttccggaaaagaagttgcaacttgttgatatgagtattctattaatcctattaagccctaagccgggatgttacatatgtctcatattaatatatctttttttattttttaaataactttttaggtgtcattttacaaaaccggcctgaaataaccatagaaaccaaacgcggaagaaacgccataaaagatcaaaacatatataatgattgtcgacaggggatacccgtagactgattaaatagggtattggggtatattggtacgaggatctacacgatatgatatcaagcaaaacaagaagacaaggattatactggttcgaacccctcataaggtaatagccataatacaatttatatgagattgatatggaaaaaatcacagattacaatagaagaccaacgatcccaagtttactggcgagatcattgtcgagatggtttcgacgagatcttccggcgagtaggcttcacgtcctccgggttgtagactatggtggtggtgttggcgctatgattcaataccttgggaccctctagggggtgtgtctttatatcgcgaatcaccttaatttctatctaagtagaatttggagataccgaacccagcacgagtaggactctgttgttcacttgcccctgagaattgttttcataatatctcgtcgattttcttatcatatacggagacgtgtcgtacatacgaagttatgccgtacccgtatattccatgagtcgtaggatagaaggtatgcattatccataaccatgacaatgatgacattgaggcatgatatttgctaacggagtttagccgaaacctacatattggggcccattgattatgagcgtctctctccaatccaacatattacaacgtatcaaagttataacgatcctcggctggatatcgccggcaatagaactcgatctttatttaagagagagcatagaagaaagtccggctcttactatgttcataaaatctactaaaactctaaactataaactgtaaccgactatgtacatatattcgatacaaaatctaacatgatatgtaagaaatgagtagatatccactcaagcgatgaaaatccatctccctatcccgtgtctcttgtggacttattttgatttttagaatttgtgaaatggagtgaatcgcagtcacaggtctactggcaattactatattatatttcttttgttattgtgtacaatagatgcatgtttgaggtgtaggaattaatagatgcgctaaggcctattcgaagattaattctttggaaaatcacaaaagcccacctcatggtatggcatgcatgtggagtttagtaccaccttgcttattctaggagagggggacctccttaaaagggaggatgccctcctagccacttgaagcatgtgtggtggagaaaagagggggaacacacacgcgcgctcgctcgcctggcaggcggcgtacgcttcgaatagtccgcaaaattggctcctcaccacagttttgttttgctgcaggaaaattcggatttgttttgttttggaaacattccgaaaaatccagtgtccggataagttacgcgcgacttatccggttcggttacgtggagtggagatcgtgcgggcgccctgatcaagtgacctatctctatataaaccgagccgccgccttcacgcaaaacacacgaaatcaatctagggtttgcctcctcttctgtgctgcggcgtcgctcgtagactactccatcccgctcaccggcgtgcacctgcgatcgggagagcaggtctccttaacctctgccttcgacgtcttgcaccgggagaaggcggcaataaggtttttgggaagcgcttcgcgcgactgctccctgttcgtccgcgacggctcgccttcctctccgctcgcgtgttgcgcgccttcgtcgaagctcgtaaccgcgagtagttcctgtcgagcaaccggtttttccgccacctcggtacgtgttcgacatgttgcgcatatttgatctgttcatattttactgtttagtttacatgtgtagatctaatgatgcgttaatactagtataaatctgtaatgtcatgatttatttatggaatatattaaattattatatttctatattctcgaacatgaggtgctgtttggtttggccaaatttagcccgtatctgatcgcagcgtaaacagatgaaacaaaagttggtaactgtgcagaagcaatacaggtcgctcccatgcaccattttttgtctgtgataactcataacagtaacatgcaaagaagtactcccatctaccagctgaaatcaagagattaaccttgttgttgcagccgtaaaaacacactactaatctgtctgactctaataccatccgaagagatcaatgtggtaatctggctaattggcaattgacggtgcaaccgagacgagacacatcgtttataaggattacatagaacacgaaactctaatcccaaatcaacctagcttgcttgcactattactgaccagtggtcagcatggcgaccagcgcttcacacgcgcgtgcaccgcttctcctcctgctgctgatgtgttcgtgtttgcttctctctcccgtggcggccgaccgggcggcgtacatcgtccacatggacaagtccgccatgccggcgcatcactccgaccaccgcgagtggtactccgccaccgtggcgactctgactcccggtgcgccgcgcggcggccgtggcgggccgcggatcgtgtacacctacgacgaggcgttgcacgggttcgcggccacgctctccgcctccgagctcggcgcgctccgcctcgcaccgggcttcgtctcggcttaccctgatcgccgcgccgatgtgcttcatgacaccacgcactccacggagttcctccgtctcagcccgttcggtgggctgtggccggcggcgaggttcggcgagggcgtcatcatcggcgtgatcgacacgggtgtctggccggagagcgcgagcttcgacgacggcggcatgccgcccgtgccgtcgcggtggcgcggcgagtgcgaggctggacaggacttcacgctcgacatgtgtaaccggaagctcatcggagcgcgctacttcaacaggggcctggtcgccgcgaacccgaccgtcaccgtctccatgaactcgacgcgcgacacgctaggccacgggacgcacacgtcgtccaccgccggcgggagccccgcgccgtgcgcgtccttcttcggctacgggcgcggcacggcgagcggcgtggcgccgcgcgcgcacgtcgccatgtacaaggccatgtggcccgagggccggtacgcgtccgacgtgctggccgccatggacgcggccatcgcggacggcgtcgacgtcatctccatctcgagcggcttcgacggcgtgccgctgtacgaagaccccgtggcgatcgccgcgttcgccgccatcgagcgcggcatcctcgtctcggcctcagctggcaacgacggcccgaggcttggcaccctgcacaacggcatcccgtggcttctcaccgtcgccgccggcatggtggaccggcaaatgttcgccggatccatctacctcggcgacgacacgcggagcaccatcaccggcatcacgaggtatccagagaacgcgtggataaaggacatgaacttggtgtacaacgacaccatatcagcgtgcaactcgtcgacgtcgctggcaaccctagcacaaagcatagtcgtgtgctatgacactgggattctgctcgaccagatgcggacggcggcggaggccggcgtcagcgcggccatcttcatctcgaacaccaccttgataacccagagcgagatgaccttcccggccatcgtcgtcaacccgagcgacgcggcgagcctactgagctacatcaactccagcgcgcggccgacggcgacgatcaagttccagcagacgatcatcgggacgaggccggcgccggtggtcgccgcgtactcctctcgtggaccgtcgcggagctacgagggcgtgctcaagccggacatcatggcgccgggggacagtatactcgcggcgtgggcacccgttgctccgctggcgcaggtaggaagcaccgccctcggcagcgacttcgccgtcgagtccgggacgtcgatggcgtgcccgcacgccgccggcgtggcggcattgctgcgggcggcgcacccggactggagcccggccatgatcaagtcggcgatgatgaccaccgcgaccgccgtcgacaacacgttccggccgatcggtgacgccggccacggcgacgccgcggcgagcccgctggcgataggcgccgggcaggtcgacccgaacgcggccatggacccggggctggtgtacgacgccgggccggaggacttcgtggagctcctctgctcgaccaacttcaccgccgcgcagatcatggcgatcacgcggtccaaggcgtacaactgctccttctccaccaacgacatgaactacccgtccttcatcgccgtgttcggcgcgaacgacacctccggcgacatgaggttcagcaggacggtgaccaacgtcggcgcaggcgccgcgacgtacagggcgttctcggtgtcaccgagcaacgtggaggtgaccgtgtcgccggagaccctggtgttcaccgaggtggggcagacggcgtcgttcttggtggacctcaacctcacggcgcccaccggcggcgagccggcgttcggggcggtgatctgggccgatgtgagcggcaagtacgaggtgaggactcactacgtcgtgctatgacggtcaaccttggtcttctagtcatgtcggacttctgtgtactggtcggaataatgtcgtggaacaaacatccattcttatggattgggatcctctaacatgatataagaggaacatggtgattgacatgttgccccaccactcatgggcccacctgtcagtgatcacgtcagatagcagttcatattaaaggatccggatctctattttacacgccattacggttacaaaaggctattacacaagcattaagtgaaccccgtcacaagcattaagtgaaccccgtcacccaacaattttctttaagtttatataaacttgagtttattacaagagttcttatcgtcctttagggaaggcagtactaaatccaggccgtctatctcgcacaatctaagagttggaattgctttgtaccaggtggtactacgtccccaagagaggatttcgaactatgggtgggagggtaaaattgtactttcgcgtatacactctcgtttctatcggtttatctgacacaacctcagcgtacatcgccgccgccgcaaatcggggatgaatggagacgcctcaaatccggcttgatgctagctcatcgatgcattcggtgccaatgccctacaggccgctacctatatcgttcacgggctcaacccaaatcgaaagccccgccatgaagttcgatgacgcggacggccaccatcagcaccgatgccatggactgtgaggacgctacatattcatgaggagttatatggcggaatggattttgatacctcgaggggatgttcccttattgtgtgcatgctactcaaatggttatagaaaaaaaataaaaaaaattgagaagatgtattaacatgtgatatagcactccacaaacatgcaagttcaaattcaattttatatctcacaacgaaaaaaataaatttaactgtgaatatttgttaactagttgtagtttaatttgtttttttcgtaacgagatgtataagttgaatttgaatttacatatttatggagcgatgtatcacatgttagtatatgttagtacatgttacatatttttttaatttttttcataatcatttgagtgacatgcaacaaatgagggatatacccacgagggataaaaagagttacccttaaatgacaaccgactactatcatcagcgctgagatagcgtggatgctgccgatgcccggtatgctcttttttctcctcaatactcgcgtattccacattcataaaaataaaaacaaggcttctaacgacaccaaacaattcataacaacgaattcaagacactgcgggctatgatcgatccatcgaggaaacaaagcatgaaaaacgtatatttagcacacttgcacagccgcttgcctttgctgatcccagcctaatgtggccttataagccttaggcccaaataggtacgttttttttttctagtttttccctattttgtgacataaaaatagatcgaaactttatatccaaattttgtatttaaagactttgatttcttttactattttagccgttttaaatatttttaaattcgagtaaaattttgtattaagtagggcgagacaccacctctccccctaagaacatgcgcggattagcatccccgtacgaggaattgttcaagaccgcaagctaatctagtactccctcaatactcgtaaaggaagacgtttaggacaatgtttaagtcaaaccttgggaatatatattatgaataactctcaagttgttgagtttgaaaatgtaaaaattatatgaatagatttgtcttgaaaaatacttttataaaagtatacatatatcacttttcaatgaatatttttatagaaataagaagtcaaagttgtgttttggagaccatgtcaatgtcctaaacgacttcctttgtgagtatgaagggagtacagttcatttatgcgtccagggatcagttactacatctgtcttaaaatataataattttttgctataaatctgaacacataattattttgattcatagctaaaaatatttatattttaagacggatgaagtattagttaagctaccgcgccgtgcatggcaacacgacgaaacaccagcagcacccccgtgattttgggtgttccccggtacgcctcatggcgagacttgatataagtgcatctgtgcatggctcgcgagacctgaaaaccgtatatgtgggcgtgtggttgagaacttgattgggatgatgatgagacccggtgggtcgaacaacaagcgtacgtagacgagccaacgcgcgtacgccatttttcccggccctgcgtcacacggcattcttgtcccgtatccgcgccccgcgttcgcatcgatcgatcaaccggccaaccgccccagatatggcctctcgcgcgcgcggggacccaagcaaccaccgggcaaatccaacgcccaattcgtcgagagatttttcagctggtgcgtagacgtcgctaacccccatcgcctgctagtataataagatgacgcctacgtcgttccgtgcctgaatccgtggcacagctacgtacgtacgtgcgtgctcgttacacgtatatggcggcgtcgctggcaatcgttgccgtggtcgtcgcgctgtgcgtggcggctgccgcgtcggccgagacggcgacgtacatcgtgcacatggacaagtcggcaatgccgagcggcggcggcggcgggaacgggtcgaccagcctggagagctggtacgcggctacgctccgggcggcggcgccgggcgccagaatgatctacgtgtaccgcaacgccatgagcgggttcgccgcgaggctgtccgccgagcagcacgcgaggctgagccggtccccgggtttcctctcgtcctacctcgacgcccccgtgacgcggcgcgacaccacgcacacgccggagttcctcggggtgagcggcgcggggggcctgtgggagacggccagctacggcgacggcgtcatcgtcggcgtggtggacaccggggtgtggcccgagagcgggagctaccgcgacgacgggctcccgccggtgcccgcgcggtggaagggctactgcgagtccggcacgcggttcgacggcgccaaggcgtgcaaccggaagctcatcggggcgcgcaagttcagcgcgggcctcgccgccgcgctggggaggcggaacatcacgatcgccgtgaactcgccgcgcgacacggacggccacggcacgcacacctcgtcgacggccgccggctcgcccgtcccgggggcgtcctacttcggctacgctcccggggtggcacggggcatggcgccacgcgccagggtggccgtgtacaaggtcctgttcgacgagggcgggtacacgacggacatcgtcgccgccatagaccaagccatcgcagacggcgtcgacgtgctctccatctcgctgggcctcaacaaccgcccgctccacaccgaccctgtggccatcggctcgttcgccgcaatgcagcacggcatcttcgtgtccacctcagccggcaacgacggcccgggcctctccgtcctccacaacggcgcgccgtgggcactgaccgtcgccgctggcaccgtggacagggagttctccggcatcgtcgagctcggcgatggcaccaccgtcatcggcgaatcgctgtacgccggctcgccgccgatcacccagagcactccactcgtgtacctcgactcctgcgacaacttcaccgccatcagacgaaaccgcgacaagatcgtgctgtgtgatgcacaagcttcctcctttgctctgcaggttgcagtgcagttcgtgcaagatgccaacgcggccggcgggctcttcttgaccaacgacccgttcaggctgctgttcgagcagttcacgttcccgggcgccctgctgagcccgcacgacgggccggcgatactgcggtacatccagaggagcggcgctccgacggccaagatcgcgttccgggcgacgctgctgaacacgaagccggcgccggaggcggcggcgtactcgtcgcgcgggccggcggtgagctgcccgacggtgctcaagccggacatcatggcgcctggctcgctcgtgctcgcgtcgtgggcggagagcgtggccgtggtcgggaacatgacgtcgccgttcaacatcatctccgggacgtcgatggcgacgccgcacgcggcgggcgtcgcggcgctgctcagggcggtgcacccggagtggagcccggcggccatccggtcggcgatgatgacgacggccgcgacgctggacaacaccggcaggtccatcaacgacatggcccgggcgggccacgccgcgacgccgctggcgatggggtccggccacatcgacccgaacagggcggcggacccgggcctcgtctacgacgccgtcccgggtgactacgtcgagctcatgtgcgccatggggtacaacctctcggacatcagggccgtgacgcagtggtcgacctacgccgtgaactgcagcggcgcgtcgtcgccggacctcaactacccgtcgttcatcgcctacttcgacaggcgcagcgccgccgccgccgccgcggagaccaagacgttcgtcagggtggtcaccaacgtcggcgccggcgcggcgagctacagggcgaaggtgaagggcaacctgggtgggctcgccgtcagcgtcacgccgagcaggctggtgttcgggaagaagggcgagacgcagaagtacacgctggtgttgcgcggcaagatcaagggcgcggacaaggtgctgcacgggtcgctgacgtgggtggatgacgccggcaagtacacggtgaggagtccgattgtggcaacgactttgagctcaacacggctgtagactcttcttttcactcttgtgtactgtagcgtgcaagttgattcacatatctgaagttctgaacatgttgttcgtctctagctgttgggcaaataatgcttttggtggttagttagtgcagtccgtgagttttggtatatgctgctcgaatgccccagtaattggcataagtatttatgttcttgcttttgttcaaaggaactgttagaagccctaaaatatgtcctctatagagctaaactattggaattatgtcaaaaatcacgtctccaacaggtttccaaaggtgcacccagtttttatgcacgtccagtcctgatgccctcgtaagtatagacttcaggcacctcgcggcgcctcattttgatgtcaacgttaatataagaggatatttggccagaaacagttggagaggatttgcctaccctgatgccatatttctaagtttttgagaaccaataatatgtgatctcttgaaggaggagatgatttttggacccatgttttttcacagcctcaatccaagattattgaaagttaaattttggatcactcttggaggtactttaaggccccatttgaaatacaataataataaacatatgaataagaaaaacttaatgttttgataggaatacatatgaaaaacacaaagaaatacaaaacaaaagaatgaccatttgaataaactagaggaaatatgtactcctaggaattagacggaattagacgagagagagagagactaagaataatagctagaggttaaagctcttgctatcttttttttaaaatttacgcacaaagccattcctaagaaattttgtaggatttatgaagttccaatcttttgttgcaaagggccgaacagaaaaaaattctataaatttagatcctccaaaacacatccacaaatcccttgaaaaggaggtctaagaatcgttgctactgtgctgaaacggatttggcccgtcatatcgtcaatcaacaaagatgcccaatgcccgcatgcatgtcgttccggatccccgtacagggtgcatgtgcatgtgtggtcataagcaaacatgattgtcgatagaaagaaacgaaatgaacgtgctattgccagcttgtcacctaaagcaatagagcatgaaaagttcaccgattgaaagggaaggtgctaattggatctaattcttattctaagcatcctggtatctagtcatttttcatcatgagataaataccatagagataatgcaaaatatatgcagctgggatgaactatacctaattcgaactatatcttttttttttgtgcaatattgaaactgtacaaaactgtacataccagcaaagcgctcacaacttcaaatatcaagagtgtaagttccattgcttaaattcatatacgtatcagtagattgtacactaccagattgtgtttgctgcgtagattttggtgggagtgtcttgttatgttgttcgccaccgtcctcatatggtaacacgaccacaggagcagcatgtatagattcccaccgttccttcatgaagctcatgaacgccttgaccatctccctccggaattctagttccctcgtgaattgatcaaacataaaaaatgcaagaacatatttgaaaggaaccacaagaagaacagcagatgatgctagaagaacaagagcaacctgagtcgttacctgtcatatgatcaaacaagaattatcaagaattacttactcgtatttgttatttttagttgagaatgagatttatttcatcatacctcaggttggcctgctaaaaagattgtgcgtattttaagaagagagagattcaggttctgaagataattctccactgaagccattgcctctttaagagctataatcttttggattgtgtttgaaggtggttgatcttttattgtcactttgccaaaagatctacccaaccgaccttgttctttcagccctttcagggcaagcatggaaagagccaacatcatcaaggaaaatggaagaacataagaaagcatgttcctacatatcataataaatacagagaaatgttagaaaaatgatgcttgtacaatactggaagacacaatatttagttggaaataaagataaaacatgtaaatgaaccagcaaatgatgatcaatgccctgccaagcattttgtctataattgctcaaaactttcattttggattaactgtacacagtttggatgcagttggcaaatgtcccaatcagtgaaatttgaagatattcaatttatatggcagggtgaattttcaaatattgagtatattttcctattaatgcagcaatacttttgaattataatttacaaccaggcacaacaaaaaaaaaaagaagagtcaaacacgataactaccttagcaaggaaaacaatctacaccccttttcacaacacatataatccctactctgaattactttaagttgatattcaatgcattggagcagtacaacaactcaacaagaaaaggatacatgcgttaagtgaattacctgaagataatagtataaaccacaagtagaaaacaagcggttgtacgagaattttcccagcgtttgagcttgtagaatttttcactcactattgcaaaaggaagtataagctcctgattcatgaaacaagagatacattataaacatgaaccccctgcctaagaacaagagatttccaactcaactgaaaataaatcggtattttttctaccaaaacttcagcaaagaaataatatttccaaagctaaatctctgattgaaatgagagtaaccatgccaggacaaaccacaagtataacgaaacctaaataaaccatattgtttttgtaagccatgcaactggatgacagacatgtaccttgaagaggtcaatgttgcttggaataccttcaatagtagcggcaacaattgtggcctgtgtcctttcaactattttgctcttctctttacaggcaaccatagccttttctacaagatttttatcagctacaactaaagatttgctcaatattacaccatgcttaactgaggagtttctccaaaagttggccgagtggctggatgtccaactgggagatgtcatccacttgcgcaagtatacactaccatctatgtcaaaaatatgagcatgggcgctagatgagtcttctgaaggtctatgccactgagatgctctttgacttgctgctttggagttcgtaacaagtggcccgccccagaacttaaccgctaaagtctgaagcacaacatcaccaaaaggtgcatttgacaggtatgagaactgtactaacttggctggatcttcataaagtctacgtataaattgcagagactgaagccttgcaatactatttgctgcactacttacagctcttttcttgcctctgtgggcaccatatacatgatgaattgctggatcatcatcccttggtccatattcattaatgaacctatacacagaaatgatttcactaatgaatgcgagccatacatctcgtctcatctctccaccaaaatcaacaaactccaatgtccactcatttgacctgtcaacaatcaatcagttactttgagattacactaaatgcattttatcattacaattaaatagcgcggacaatatgctaacacaaatctacaatttataatacaactacaaaccaatagaataatcaatatgtttaacaatattgcaccaatagagaaatggtaacaaatcaaagaaataacagatcctcctgactatagtgaaatgccaagtatttgttagctaatagtggccagcagtgatttcacaaatggagtactatggtgtagtttggtatggttacaccaatcaatttggcagtaatcagttctagtgttctcctagcaatttgtagatagcaacttaatagtgaaaatggtcaccgtggggtcattttttttttcaatagtgaaaatggttcctctagagagtaaccaggcatactcacactgaaccagatgaaacagatacggcagagtcgaacaatctggatccaaatggtccaacctttgctttctcaacccttgaattacgatctgtaaggtcaagcttcaatggtttattggtacttgtcagtccaatggcctgccaatatcaatgtaaaggtggaggagttgggcccaaagtcatcacatcttgcgaaattccaaaagaagccacaagtagaattgttaaaggggaccatgattcacaaattacatgatcaacaaaactttcattttttaactgacttatttgatgaaagaagaagttctatcattgtacagctatctatttatatttacgtgagtgttaaaacaacatcaagtggtattacagaacatagaacatttttttcctttgctatcataacatgggaaatattagagagaaccgagatcagtatgatgcttaagcatgcttgacaaaagggccatctgtacggatagcaacaacaagtgatgcatatttttaaataacagaggaaatcactcttaaaaaaatacacacattccaagtattaattcatacctcaaaatagagtgccttgttggtcaaggttaagtgtccaggccacgcagtgttttcttcccatttcagaacaggtctttttctactagagcctatgcataggacttgctcatcggacaaaaaatgatctccacttttatgtgtttgcctcccatgatgaactctgcacaggtaccagtgatcacagaagccaaacattcagcatatagagtaatactccctaggagcatatgaaaatgatagttgaaattgtgaactataattaatagttcaaattggacacagaatctgacaacatgatcacgctttaccagattaaagtgacatataaatacattattattttgatttatgatggtggtaagagccatcaacagccaagcaatcaaatttcttgctggcctaagatctaagccaaaagtctaaataaagagatgtatcatgtaacctgaagttagaaatacatttcctgaaacttgagaagcttaagtgtgattacaatcagaaaaatcagccgaagatgtaaaggtgatcttacttcagaagttcaccaaggtatgttgtccatatatctaaagaaagccccttttcagaaccgacaagggccctgaagagataatgagccgttgaaacatcagctacacctgccacagcaggggcaattcggacaaaggcatcttctccaacaagtcttccctacatgttaacatacaaactcagaaattcatttcttgtaattccagtaaaggaactcagtgatattgcatgaatttaagttttccacaaggacaacaacgcgtacatatacagatgaattacacctcaccagtatagaatagttatctagtgaagactctgtgtcatcatcttcaccatatggatcttcccacgcaagcatagtcataaatattagcctttggaatgcaagctcctgccgaacaattcaagtaaaggtacttaccaaaaactagaactggctaaaaaataacaagtgcaacaagcatgcaataatgttgtgttaactgacagggaacttggcttaaggagtgtggagcactgtagcacatattacacttcatcgaaacaacaatactgaattagtaactattttacctttaaacttggatgcaaatcagagttatctcttgacaaatagcggaagcaacaatactcaaccagatttcgagcatcattctgaacatgactaggagcaagagcttcaaagatcctctgcaccttcctccccgttaacccattcaacctgaaaaaaaaatcatgtaaatgggtgaaattcaggacagatcccagaccatccatgagctcatattatatatatacttctccaactgcccttttgaactgttaccaattgaatccatttctcacttacccaatcagcaacatacacgaaatttagaatgacaagaccatacatggaccaatcaacctgattccatatgtaaatttgtgggatgcaagttgctaggatcaaagccatgccagtgagcatggctgctcctgtcatccatgctgctagtccttgttccacagacagcaaggtaggtatctatcaaaatctaccatctgaatttagccaaaccaaaaattgactgtcgctacatactaagtcacatactcacattgatcatgggatctagcaactctcagaccatcataaagtaggtgaagcataactgtaatgatatacgaactgattgagataggtccactcgtttttctacaaatctagtcattactattatcatcgtggctacaatgaacaatcaaccgtggaagcgcaatcggagataacttttaccaacctggcaaactgctcgatggtgacgacagcgtctagcgagagccagccacgaccgacccgccgttcgacggtgatctccggcaccgcgacgagcgcctgctcctccagcgcctccttccgccgcttcttcctcccctccgcctcctccttgctcctccccttctcccgcgccgcgttcgccgcgtcggcgatggcgcccctcgcccgcgacagccacgaccgcacccgctcctgcaccgcatctgccaggcccaccacaccacaccacaccaaaccccagcgatcagcgcggcgaccgacgcacacacaaacacacatggtgggggtggtgcgggcgctcacctgcgtcgacgtcggggatccgccactgggagcggagggcgaggggcggcgggggtgccgcggcgcggcggcgacggtggtgccccccgccagcgaccctgcggcgggggagcggcgtgaagcgcgggggctggagccgcagctggagcatggtggcgtcgccgccgcagccgccgactatcggtgggggggagctagtggtggtactgaggcgggcgtgccaaactttccctcaattccattggctgggagtgggagctgcacattatctcacactgcttgcttgcttgctaca

SEQ ID NO: 82741 - DNA, 6347 bp, Oryza sativa
gtccgcccacgacacgccgccgctcctcttctcccccttctcccccgccgccggtccggccgctgaccggccgttccgcccacgacacgccgtcgcttcggccggtgacccgccgccgcccgcccctctctgcctccgccccgccgtcgcccgctccggccgcgcccaccccactccgccggctggagacagagaagagggagagaggggtgacagagagaagagggtagtgaagatgacgtgtgggtcccaccatttattattatttgtgtgcaacatgtgggtcccatggattttttttttccgaatcgaattgccacgtaagcgccacgttggacgaagacctagtcagaggagcgccacgtcagccaaaacaagggactataccgccgagggacgttgtttgcacggttttgtaagttgggggatgcgttgtattcggttttgtgctgtagggatgaaaattgaactgggcgacaaataaagggacctaaagtgaacttgttccttcccgtgaaacatccacaaggtttgggcctcgtttctaaatgggcctgaatcccggcgttgttgtgtatgggctgtaatgttagtgggctgacacctaaagaaagaccagcgccggggggggggggggggggcatagattccccgaggccgcgacaaaggaagaacgccaccattcgtccaggtccaaagcagatgccagtatgccaccaaccaattattaacacaacagatgcttgtgctaaatggttctttcctcatgaagactcagattttatttcaatttccgttagcacgtttttcaagctacaaagttgctttaaaatgttaaatttatccatttatcatgtttataataattaaaatttaattaattatgtgttaatagttttctcattttcctttgagccaacctttttttaacggaaaacagcattagagtgctttttcattgaatagagtaggagaaaataaacacctaataataaaagaaaaagatcaccgtaagctgtacatgagcgcggagccaacctaatttttatctccatcagtttcaaacaccggcgttgtggaatttttttttccaagttcacttggcaaacggaagcacctgtcgctgcgtatctgtggaaaacggcccggggccggggaaggcgacgactgaggagggcgtagccgcgcccgcgcgcagaggcgtccatctcacccacgacagcagagcacggcatcgcgcccatcggaaggccacacaagaaaaaacggccgcgaaaatcaccctcccttccttctcgaagcgttcgtagaaaaataccgtctctcgtctcgtgtcgcggtcgcggatgccggggtcaaaaccctccccgcctcgttcccgttgagctcgccgccgctaatatcctaacgaactaactaaccatctcatcctcgaggtatccggccaagccgccaccggggtcaccaccatcgagctcgtatggagcggagggcgcagccggtgtcggcggcggtggcgccggtgacggggaggaggaagggtgcggcggcgagccggaagtggatggtggtgccggcggtgggggaggagcggagggtggagtttgggaagcaccagatcatgaagatgacggggctccccgggcgcgacctccgggtgctcgacccggtcctctcctacccgtccaccatcctcggccgcgaccgcgccatcgtcgtcaggctccagggcgtcaaggccatcatcaccgccaccgaggtgctcgtccccgaccacgacgacgtcctcctcgcctccttcctcctcgacctccgctcccgcctctccctcccggttggtacaccgtacaccatctctttttctcttctgttttctcatcatcaccacatccaggttcactctgttgcattggttgtactagcagattgcatctgcaaactgatatgacattgaactctggaatttgattctgttatcgtcgtcgtgattgactctactgaaactctgatgatgattattctgggtgaaggatgcggcgcctagcacgaatccggcggcggctgatcgcgggaacgggacggagcagggcgatcaggggagcgtgccaggtctggcgatcagcggtgctggcaacgccaagatcccgccctttgagttcaaggtgctcgaggtctgcctcgagcacgcatgcaaagacttggaatctcaggtatactgccagaaaatttgtctattgctgctgatgatgaatcaaaccaatggtagtatatattaagggggtgtttagatctagaggtataaagttttggcgtgtcatttcgggcattatatatggtgtcgtatagggtattcggatactaataaaaaaattaattacataatccatcattaaaccgcaaaacgaatttattaagcataattaatccatcattagcaaatgtttactatagcaccacattgtcaaatcatggagcaattaggcttaaaagattcgtctcgtaaattagtcgcaatctgtgcaattagttattttttaacctatattaaatacttcatacatgtattcaaacgttcgatgtgacagggtgaaaaattttgaggtgtgatctaaacagggcctaattcatgttcatctctgtctctgcaaatggtgtcagacacgctctctggagaaggaggcgtatccggccttggacaagctgggatcgaaggttagcacgctgaacctggatcacgtcaggaatctgaagagccgcatggttgatctctcagggcgcgtgcagaaggtacgcaagaacagtggactccgttcgcttgagtccgtttaagttgcagctgaaagcgatggcacctaagcattttggccacctgttcttggtctcgcatgcagattagggatgagctggagcacttgctggatgacgacatggacatgtccgagatgtacctgacgaggaagctgtcgttccaagggctcagcggatcgctgagcagagcggattcacacaagtacgcatctgttgatcatgacgacgataggtatgtcacctgaattttgttctttctggtttttggcaggatcgaaagactcgaagtaggagttgttacctgaattctttaaccggaaatggatgttgattgttgatagattgccgatccgtggcttttgttttaatctttcatttgcgcctgtattcagggaggaggaagaccatgacgatgagacagagagtggccgtgaaagttctgtttatgttaagcctgatatagaagagttggaaatgcttctggaagcttactttgtgcagatcgatggaacgctgaataccctgtaccatgtatgttcatcctcctcctttactaagggcttcatcttttgcctataataaatcagccattgccaaattttaatataaaagttaattttagagtttattttgggcacttttaacatagtttcttttttagcaatagcttttaaatcactaaaaacacgcatctaaaagtttcacctacaaactattttttggttgctttgttttatacattttttagttgctaataagctgttatggtttataatcagctctcggtcaactgatgaagttgaacattgccatgcttagattgttactgaaatggttgtcatgctaatatcaactgttttagtacaatttagtgatactgtccagtttggaagataaacatgcgatatttagcataacttctgtaaaagtctctgcagccaaaatctgacgaaatcttgttaatgtttgccattgaaatcgacactggttttatcaaacagttaaaatgtatagcctgcattgtcacgcacttgcatcgctcactactagcaaattccatgcattgcttgatgtttcattgcccccctgacatttgcctattgacatggaacaaagatccgtgaatacgcggacgacacggaggattacatcaacataatgctggacgagaagcagaaccagctgctgcagatgggcgtgatgctgacgacggcgacggtggtggtcaccgcgggcatcgtggtggtgagcctgttcggcatgaacatccacatcgacctgatgaaagacccggagacccccgagatggtgaggatgtccaacatgcacttttgggagaccaccttcggcacggtcgccggctgcatcgccatatacctcctggcgatctacgctgggaggaagagcaagatcctgcagtgatgcttcccaacagaggaagctaagcgtcaggttgcgagttctgcagcctggctgcgattttgctgggcagtggcgtagttgataggttgtgtatggatgtgatgcatttttgttgatttcgtatggtgtgggagcaataataatcgaacgatctctctccatttcctgctcttattagaagttagcacttagcactactatgttaaatttcggccaaaggaaccactatgttaaatttcggccaaaggaaccctttcagaaatgctcttgccacatttcgcattcgaagtaaatccaaaaaaggtaccagtaattctcattcaaagttaaaacacgtgctctgacttttactgactatgctgaacggctgtgccactttttccagtggccgatccagaacaaaacgaagtaacaaaccagtgttgcctttgtcaatggcaaatcgcctaaagatcaacaaatgatatatatgctcatctgactatctattttgtatttacaaggtgatatggtgatgcaaacaagattttttgtaaacgccacaatactcattatctgatgcacaacaggtattcccgacctgagaataaatattctacacaaatcagctatgtttagacttacagttgcaccttccttgatctagtacaccgaacctggccaaaaaaggggagtcattgacgaaccaaagaagatgctcgagttttcaaaaaaaaaaaaaaagctcgagaaggtaaataaaagaaccaaagaggaattctgcgtattcttctcaaattgacttacgttatctaccgggttaaaagcagttaatccagagctggtctgtgcattactcgaatccaacgctctcttgctgtttttcttgaggccagcgactcctaaagaaattggaatcgatgggtcagtatcgatgtaaatatgaaaggagacaaaagaacttcccaactggtcagtgctgacaacttaattgactgtgcagcattgccatttccaaatgaatgctgattggaacatttctaacaattcaaggcttcctagctcaaaaataaattatggaaattgttctgaaaatgacagatatttatcacttcaaaacatgcaggcattcctagaaaaccaaattggataatgccactctaagtactgtttgcttagacattgtatatagagtaactcatttacctgttctgttatttgaaaaaggctgcttcacaaaattgtcgtcaatatcaccatcttcatcaggatcactgttacaagctgagatgtgagtaccctgtgttgcacgttaggcaaagttcctaaataaatgatacataatatttctcaccagacaatagaagagccaggaagcaacatctcttgccttttgttttgagaatcagctgaacccttcccacgaactctcttgaaagaactattgaggattcaggacaagtatcaccataagttggataaaaccttgaaagcaacggctcactacagttccaacagccatgcatcttactagtgctacatgcctacatcacattgttgattctgccagttttgtacaccgtaaacaacaagagcagtttcttatagaataaattgaaaacccccttttgaaactaccaagctatatatgcaatagtggaagaataatttgttatttcattttaaaggatgaaacagattggtagagatgcacttataatgttgtacacgaaagtaccaaccagctttccagaaacctaggcttctgaagttcactcaatttcgttctgggttctagctatgcaggccaagtccagatgaatgtgtcaagtttttttttttaatgttaactgaatgtgccaagttgttattgcatgctgcaagtgcgtgcatattgtatctctccttgtgtaaagtgttttatgtaacccaatcctttgtgctataccgcaattcaagtgtgtaaatgctcatgcactaagacgagccatgcatgtttagatcaattttacccatttctccaattaccgtgtagacccaataactgacatttgcatagttaacttacaatggcaatggaactattataccaccacaaaaaagatgaatgaaatcacacagcaggaaaaggaaaaggt

SEQ ID NO: 82742 - DNA, 715 bp, Oryza sativa
gatttttaaggacaatataattgtttcaccgggactcatgcttgttctgactgtgagcctaatgttacctttacatgcccttacattgtctattttttatcgttttatgagatcttccaaacaacttgatctgtcttaatgtttttttgctagctcctttcttggatatctggtaaatggttaggccgaagtatgaactttgccttattgtttcaaagaaaatgtaacaactcctggaaaagtctaattttggttgccctttattttgctgaccgtattggcacacatctaattctgctgttcctttctggcaggttcttatgaacttagcaaatgacaacccatctggttgtgaattgattgcgtcatgtggtggacttaacaccatggcctccttgatcatgaagcatttcccctcattttgttttgtcgtggacaacaactataacacgagagatgtcaatcttgatcatgagttatcatcttctcaaaacagcaaggcacaccaggtcaaaattaagcaattgcgagatcatgaacttgattttctggttgccatattgggcttgcttgttaaccttgtagagaaggatagccttaataggtaagtccctcacatgcttccttccatttgctcaattcatatcagtgttactgttctggcagttccttggggtcaggactcagaaacatccaattaatgttcatgttctct

SEQ ID NO: 82743 - DNA, 519 bp, Oryza sativa
tattgtttctgcagaggaggcgctcttcggttgctagagaacagagtgcatcagctggtgatgaagatgatattgctgatctgatggaaaaccatcaagaattcattcatgcagtgaagtctcggctaacaaaactagaggttataacgagtatggtcatctatagcatctgctattttgagatacctcgagtaacggtaatctcaatgtgttatgtgtaggtggtttacaggtgttggcacaataacgatgtaaagggatctattgatgctacacgcaggattcaggatcttgatgtgtgtacttcttaattaccatcctgttctgttgaagttccatccattataatgtctgatgagttctaccacttttacaggttaccgccgatataattagtgttctgatggagaatgataattctatcacactagatatttgtacttgtgtcttacctcttgcctccagtgttcttgaaaaaagcagctatgacaggtacttttccttgaatatattcttgta

SEQ ID NO: 82744 - DNA, 3009 bp, Oryza sativa
aaaatgatgaggatggtagctcctttagaacacctttacaaaaatatcatgactaattttatcatttaatagaaaactcaactataattttacaaaaacaaagaaaccctaaatagtgtggatagaataaaagaagaaatttaaggattttcataataatgtgatttggtacattaaattttaaattaaaaatcgattgaaaattttattcgaatgtacttttttttctcaaggttcaataaaactgcactaattcttataaaactatgcaaaatttatattacctctgtatttaaaataatatcattttaaaaatcaacacatactccattgcatatgttttatcattgttttcccgaactatatgtctataaaaattaaaatacagctatataggagagttttcataaaaatctattaaaaagatatttacaatttaataatttaagatgtcaaaatttgaggaagtcatttttttaacaaacataatactttttttaataacacgaaaacaaatgcatgggctataaaataagcacgccaataagcgtgctcaattttctaccaagacttgaattccaagctctaataacaccggtttgaactgcttttgcatgaagcgagggtaaaaacgtaaaaatttacaataaaggtatgacccaataaattgatatgggcttaggtttataccctaggtgtttcaaatggtatcatagcatggttatatgcgtgtgactaatttatatcctaggcgttggtggcattaattgtatctagtatggtatggttacacgtgtgtgactattttaagccttagactttggtatgtcacaatggtaggtgttacaaatagtatcagacccacgattataagtgcatataagttagtatgtcacagtttgtatcgcttatagcctgctgggatgtcacaatcatgggtaactttggttacccaaaaatacgtatgaaaggaaaatcctctggctgagctgttcgggagaggaaacaaaaacttttccagcactgtgcagaagtgaaagctttctttctcataaaaaagttagcatgaacactgaataatacatggaaatttcagatccaaatctcaatctgaagctacaaaactggataaaccaatagtcaattcagattcagacatcatttttcaaaacaaattagagcagaatatcgaataggaacaggaaaattcagattgaggagaagatttatgagaataatctatatggcacctacaaaaataggaacctgtagttgcattagaagaagatttgcacccaaaaaaatggaaccaagtgatggagacacaatgcaactgcaagaggatgctagcaactcagaaggagatcggagaagagagaagtgtctctgatgagctccaagacgatgcggttcctcatcactgacgggttataaacaaaggccgtcacaggtgacctcatctgtgctacttcaacccgtcataggtgagttatctgtgacgggcatcaaggtagatacgtcatagaatgggtacacgggatgtcacctttagacccgtcacaggcgtctcacctctaatgggttgtaaccacccctaggcttgcggagaccctcacctctgatggccggaaaatactggcccgtcagatgtgactatcacctctgataggctgtccccgtcaaagatgagtggaatcataaagatgagtggaatcatcagtgaccagaaatctctgactagggctaaactcatcaaaggtgagggtttggacccatcagaaataacctgatccgacgtagtaccacgggctgatgtctgcacatgtgattttgaggtcgattttctccgctacccgcaagattgagcataccatggtcagtttggaaacgacagtgggatcagtgtttgtatactagctaaacataaattagcttaaattagatgacactttacaacgagtggtagctatgaacctcagagacaaaccatatcatgtcaaagatataatttgtagttttcttttgtttatttctaacgatacaaagtagtataatctcttctctccaactagctagactgcagagttgattgatcatcttataattaattcttcggtaagctagcggcagattatgtacggccgacctgtcttccctttattcgttacttcctccgtttcacaatgtaagtcattctagtatttcccacattcatattgatattagatatatatggttagattcattaatattaatatgaatatgagaaatactagaatgacttacattatgaaacggagggagtaacacttaacactgagccactaccttagtatcactgctcgctcttctttttatcgatcgtcttcatcagctcccgcatctgttcctcatcaagaggtagcctcgtctctgtgcacaatgtgtgtgccatcatgaatccattcggaccattcatgaaagatggagcattagagagagggtgatgaatgctatggacatgcgaaggaggcggaggaggaggaggatgtttggggatgaagaacaagttgcccattaatagagatcgacaatagatattctctatgcacgacagttgtcttttctttctttctcagtgtttgtattttgtgtacctgtctgtctgtgggtgtagttgtggtgctagccctttaaatactagccaaaggatcttttttttcctcttcttccttttcaaggaaatagccaaaatattattcgctggtgcagaataaaaatgtttgcacggtttgcattgatgtatggatttcgactaggcagtcgaccttataaggtatttgctgacaagctttctcttgagacacgttgtctgtcggaaaaaaaaaaccctttaacgacatactataggataacactatagtgcttttgacggcagatgagctatcgcaacttttaggtcacggtgtagtgttattagcttctcgtaggtaccaaattaatttgtaatttcctgagggctgcaggaat

SEQ ID NO: 82745 - DNA, 711 bp, Oryza sativa
tcactaaatagacaattgagatatgattcttattacctggaaaacacattcttatcatagtcacggaatacagttcatcttatcatcgaacatttattggagcagagagaaaataattctttctactcgattcagtggaacagaaagaggaaatttgaaaaaacgaagtgaaattaaaagatcacatcgaaatatattaattaaaataggaacacacaccgatcaccttctactggtgtcgtgtcacactgtcactttgctacatctctacctagtgcacattagcaccacatataccaagtcaaacatatatccgtcacttaagcaatcccgttgagagatatcatgtcagctcgaagtagttcagagattaacctttcacccagcggctcgaaattgtcaagtgaaccagttaataactatgcacccgtcaacaacagtttcactgtcgttacgcaaatcggaaagctcccaaacgacctgacctacgagagcgttgggcgaaacactccatcatcctgtgcgtgaatcgtctgaatatacacgcaattcatccggccaactccgctacggaatcacggatatgcatggatgatggaggcagttcatcccaggtcaactaacccttgcctaaaacggccggagtttcagttcaggccgggcggcgtacgtcgtttggacgctgcaactacatgactgggctgcaggaat

SEQ ID NO: 82746 - DNA, 5942 bp, Oryza sativa
gaaccatgaaatttgtcatgccaaataatagatttttagttggatggcaataatctgcttcttacagcaaatatcatatctttcttatagtatttagagctgattatcttttagaggcttcgatattattgccattaaaacaccaattagtttgctttgatattattgccattaaattccaaaagtaaaatttggacgataaaaatatcccctagaagtcaaacttacatttccacactccaccttacaaactgaacttcataaaaatcccctccaagttaaactttattgtctactccctctgtcccaaaaaaactcaacctaatatgggatgagacataatctagtataatgaatctagataaaagtctaaccagattcgttgtactagattatgtcccatcctatactgaattaagtttttttttgacggaggaagtaggcctctgctgcgctatgccttcctcgccaaggcagtgtttggttgcctccttggagccttccatagttgtagtgtaagggcacctttgaggcacagcaattttgtaggattttcacatgaacagttcaattttcgtgaaattcctgcaaaaatcctctgtttccatggaggaagtgtttgatctctgtttctaccatcgtttgagtagtgttccagttctcaattgaaccaagtgcacttctctctagtctccacttgtttggtccattttggggcaacattagaggttgcctgtgtggagatggcatcagtgtcacactagttagttttgttatagggaacatcctgtttagcttttggtgatcttccttaattttcttaatttgcttgtgttagaaaggctatatttgactgaaatatatattatacacacatatgcttgatgtatgggtgcatcagacatcactcagcaactaaccactaatcacaagtgagtatatatcactgaaacaaggatagtgaaagctcttgaagaaacaagagagaaatgggaaatttattcattattaaccctggtggcccttcttgatcatatcttgaattcaatgtccataatcctgggccttcttttgatctccattttggggcaataattaataatcctaggcagctttcttgcttcttcaccagctcttgacacccttcgttaggaaattgaatgctcggagaagcggcttcggctcattcataaaacttggaggatcatcaactggaggttgatgaatgctatggagatcggaaggatgacgaggaacagggatagtaggttttcctggcttgaaccacaggttgcccattaattactaatagatcaacgatactagtatacagatgatatatgcctatggctgtgtttagatggtggaaaagttaggaagttgggagaaagttgatagtttggagaaaaagttaatagtttatgtgtgtaggaaagttttcgatgtgatgtgatgtgatgaaaagttgggaatttgggtgactaaacacggcctacatatgaccggtatattagtgtttgtgttttgtgttcctgtctgtgggaggagtggttctaacccactttaaatactaatcaaaggatcaaaattattcggcgcagaataaatctgttcacattgacttgactagcgtactaagttaagttaaggtaattttaccatccttaaaaatatatcgaaagataccatattttataatacaagtatcttgaggtattaattttttatgtaaaatttagttacctcaaacttttttgtaatgccgtaatttctccaactaatatgaccggctggtcgatcactttcttgtaggtaggggtgaaaatggtatggaaactttctggattccggacctattttcgaaaaagaaatctatcagtcggaattttttggaacgggaaacgaattcagaaatattttctcggaaatggaatcgaaaatgataagggtattttctgtccggaactcggaatcggtcggaaacttttcgaaaattttctcggaatttccagaaattttgtgactgaaatagtttggattctttttttaatcactgaatagtgaataatatagtatttggctgttattttttaaaaaatatttgttatgcaaatctaaaattacataagaatatttttttttctgtattggaatttatcaacatcattactctcttaaatatagataatttatccatagattgtgttttgttatataatgttgatacttaacaattggacttatatgattgtattttatgattgattagtaaccattgagacttgagaattggatttatcagtttgaggggttttttattccgataaattttcgttaccgtattctcgccgattcgttttcgctccgttctcggtttcgataatattcaattctgttttcatatccggggtttccgattccgaaaaagatatgaaaacgaaaacgataaacatgttttccatccgtttccgtaccgttttcacccctacttgtaggtataattttaattctttcttgatgattatatatatgaggtgaacttttgactgcatgaccgttagttttaatgcaatcaattgcatctccttcgtctaatttgatgtttaggtttgctcgctgtaatttttttttaataacacgcaataagtattttttcttctaatagataagtccatttgatgtatatgagcaataagtatttgatgtatttgccccctccgatctcaagctgcataggcctcggccagcatacatgtatacgatcatggataagtccatttgatccctaaactctttgctttgtcgaaaacacatgaagacacatctcgactctaaaattgggtatttgacaccatctaactttcaatactggtaacacccaaacttatgggctttcctcgaagagggaaatgctacagtttctgtcttttatctctcgagttctaactactctatgattgagaacttcctcttctgcttccgtttctgccatagtagtgtcggtggcgactgatactgagtaagagaaagtaggaatagaaagaagaggtggatgccggagatacgggcccgggggtatgtgaggtaaagaggagtcaccttcctgtccagccacgtggcactgcaagctggccccactcacgcacctcgtgggtcgcgaaagcggcgggggaggggggggcgtcggggggccgcatccccccctcgggctgtcccgctgcttcgccccgaggccctcgcgcagctgccgcgtgggggggggagagagcgagagggggacccaggctggacaaccataaatgcgcggcgcgccaactgtccctcagtatgtgtagcgcggggagggcagacgtgcgggacgcctaactgacccctatgaatcggatgtgaccagtctgtgactggcctgttgccggtcacgtccgattgaacgggcggccgtgctcccacgtcacctttgtatccggcggagtgggggtaagtgtgacccgtcacatcggagcatcactcgaagaaaggctgccacaagtcttcacttatttatgagcgaatgacagggctgtcccccgtgtcaggcgggggacgacgccgggtcccactcaaggaccggttgctgcatagctttcgggagaaggcatggatcgagactcggtcaaagtggagtggggtccccctcccattggggggagtaggtagaggcggcgcatgtggtatccccttgagctataaaaggaggaccttgcccaccgagataaggggacgactcttagaaaacctgaactctaggagaaggaaggcgatagcgctctccggagtagaggaacccttgtaaaactcatacataatcccaaacgcaggagtagggtgttacgctccatagcagcccgaacctgtataatccgattgtgcgcaagctagccggcagtttcagggcgaacgcgtgattcccaagaggcgagcttctgcccccggccgaactcacgaaaggggggtctcacgactccccgctatcgagggtcttccctcgacagctggcgcgccaggtagggggcagttgcgcgtttcgagaagaagtcgttttcttccgccccaagtttctctgggccctagacgatcatggtcgaggtcctggaggtggaggaggcggtggcgtttacccccaccccgtccgggagtggggattccggcgaaagccgtggccctcgtcaccaccgccgtgattctccaactcctccgcgccgcgaaccctcgcggagggaggatcccacccgttcgggtggttcggccctttccccgccccctagcggagggaggccacgacgcgtcggggcacggcgccgtctcgtttacagcgacggcagttcgccccaaggcgcgcttcaggcggcgggcgcccttctgcggcatccccccgtaaacccggagccagagactcccgtttagcgctggttggatgacgtggccaacttggtcaccgctgcccagcggcatttggccacgggtggccgatccgccgccactggtacgtcgcgtaccccggttaccctctcctcgtcagcaaggaggagggctcgtcggtcggccacgacctcaaggcggtccacagctccaacatcgttgggggcctcgggaagccggaggcgtcatgacgatctctacgaggagcaggacgctcggatcaacattgagcgatgccgggatgagcgccgagctgcccgcatgggggaaggcgcctcctcatctggagtgccacgctcctcctcacgaggcggccctccccccacgctcacccctggggggacaggttgtagggccttcgtggcgagtcttcggaatgtccggtggcccccgaagtttcgccccaacctcatggagaagtatgatggtagcatcaatccctcggagttcctccagatctacaccacgattatcgtggcggcagggggagacgaccgggttatggtgaattactttcccatggctctcaagggtcaggcgcgtggctggttgatgacccagccccccgactccattcactcctaggaggatctgtgccagcagttcgttacgaacttccagggcacatatccccgcctgggagaagaggtagacctacacgctgtacggcggaaggacgacgagtccctccgctcgtacatgcaacgcttctgtcaagtgcgcaatactatttcgtgcattccggcccacgcggttgtgtatgcatttcggaacggcgtgtggcacaatcacatgctggagaagatcgcctccaaggagcccaagaccaccgctgagctctttgagctggcggacaaggtggcccggaaggaggaggcgtgggcctagaactctcccgacaccggtgcagcggccgcggctacccccgagtctgccccccgctctaagcggtgagataggagaggcaaaagtaaaccggcccgctccaatgacgagggccatgtccttgcggcagatgggcccgcactggccccgcgcaaaggaaaggccaccggcgataagccgagctccaccgctccctccggcgagggccggtcggcagacaagtggtgctcggtgcacaatagttaccgccacagtctcgccgactgccgctcagtcaaaaatttggccgagcggttccgaaaggccgatgagaataagcggcagggtcgacgggagagcaaagctcccgcgacctcaaccggtgaccggcgagaggaggccaagaacaaggcccccgccgatgatggcggtgacagtgaggatctggatttccagatacctcaggggaccgtcgccacgctcgatggggggggggggggggcttgcgctcacacctctcgtcggggcttcaaggtcatgaggcgagagcttctggccgctgttcccacgcacgaggcggcccggaaggcgcgctggttagaggtgagggctgcaggaat

SEQ ID NO: 82747 - DNA, 14095 bp, Oryza sativa
  unsure (1)..(14095): unsure at all n locations
actagtggnatcccccatagctaagggcataatagactttagcctttcaaacccaataatccatgcctccaataatccagacaaacaaacaactcacggcttattttatatcagcttattataatccagctcatagcaatctggtttaataatctagattataataatcataagctgaaacaaatagggcctaaaagaatcaaattctaactataaatctaaacttatgtttatttagatttgtagataggatctaatttattttggggctattgcgttcttacccctacttttcaagtctaattgtggtttcgcccttattttttagggtttacgtttttgcctctacttttttgaaacgaagttgagttttgcccctgatttggatggtgagtataacgatgttaagttgagcacgaaaagacatatgtacccttacttgctattacatatttgcccctacttttttaaaaaaaacttgtgtttttattccaaatttgtatcggaaacatgcaacttgttttgaactgagattttgtgaaacaattcaaatatgagctaaacatgatgaaacttgcaagttgttttaaactgggattttgtgaaacaattcaaatctgagctgaatatgaaaaagtatgacaaatacaaattgtaacaaatttttggtataatattgactgaacttcgacacaaccagcacaagtcaggtattggggggggtacaaatgtaatctcaagattcctaaatcatttttcttccttttcatttctattcttttaactcagtattatgggacccactttactctcatccatagtaggggcaaacggtggcttcattggaaaaaaccaggggtaaattcacaaacccaaaaaagtgagggcaaaattgcatttgagattgaaagttggagcattaacgcaattctcctatttattttgttggaacgaaggggtactttcttgtcacacccacaacccgtgtgcgactaatacctgttacaccagttctaaaatataagaacttctaggttgaatatatgcatggattaatactaacaaagtatgcaaaaaaaaaaaattcaaacgcataaaaagattacatgtcattttattggaaggagcaaatgatagttttgcatgacatgacagccggtatccatcgcaactaattaaagtgaatgtatgtaaaattaaatgaaaagaaatattgtaattgattgagaaggagtagttgaagaaattaaatggttgaatgttatatatgtatggttggttgacaagataattaatacaatgtaggttaagaagttgttatattttaagataaatttagtacgttataagttgcttttatcttgggatgtgggagccgagttctatactccatgcatgcatgtccccattgattaattatttctttacttaattatcacttaggttttattatgtctttatgatattgtggtctaaagcaggcgcatgtgtgtgattactattttctactactataatcatacagtaatgaaactattaacttattaattaacttattaattgtaagagcaccttttttttagcatactgataacatttttggcgatcaacattaatattttttatatatattaggtacttaaatttgaggtttgacagcaggcatagggtgtcatatatatatagtagtacatatttttgcttgaagggttccctatatttaagaatgctatctcaatgagtatactggcttatttgagtagtcataaggaccacatggtgacatggacatgaaaatactcaaatggtcgtcatacatacaaacatacatatattttttatgccacactttagtagcctgacatattttattgttaaaagtattttgcaaaagaaaatgagtggtcaaagtatgaatagtgtccgttgtcagtttatttaaaaacagatgggtactatccctaaaattatttttttagcacaaacaaagaatggatttgtttcatgtgaatcgtaacttcccaaaatgaataatctgatttaagtagttgtgttataccttggtggaaacctagctaaataaatgttgaacccgcaacaattatgatctcatatacttgagaaaatttggaaaatacataatacataaaaatcgtgaattgagcgtagctcaactggttaggttcttcgagataaaaacatgtacatacgggtgcttgtaaagggtgcttgtatttacagttaattgttcttttaagtagttaggcgatgtattaagatccgtcggttcagtctttagagatatggtgtgtgtgagtttataggtatgaatgtacgtatatctatatgagcgtcccgtcgatactgtcttttgaaaaaataaataaatataaaaattaacgagtagtattgatcatctaatccatccatatatatacatatatagagcagaattgatttcattgcatacagtatatcttcaattgattgcctctctatttcttatctgcctcgttgcatatatacccttttcttttggaaaaagtacacatgaggtccctcatcttgtcaccgaattacaaaatcattcctcaacccaaaaccagatatatagcatcccttaacttacaaaaccgggtctctaagtccttaggtagttttgaccccggttttgttctacgtggcagctgagtcagcgtgcgacccacatgggtcccacatatcaatgactacttcatttcctctctctacctctcttcctctctcttcttggcaaccgacggcgcgggaagactgaggagcgcagctgacgacaggcggggagaggagcagaggtggagacggacacggcggcggcgccaccgacgatggcctcggtttcgcctcgttctcctctctggtcgacgggaggcgactccagtgctcgcccacgcgtccccctgggtgctgcatcctccgccgctcccaacccggcggtggtggccctcattggaggcaccggctgacgaacaggatctgggcaatgggagaggaggacggcgtcgggcggcgcaaccggagaggaagacggcatcagacggtgccaacctgtagacgaagcgcgtcgcctctctccccgtcggccgctgcccctatccttgcgtcccgcttcccgccaaggacgggctcgaacgtggcggcggcgcggccggctgaggaccgcgcgtggtcggagcagccgctgccagagccgtgcaagcagcgccgccaccgggagcttgagcggcaggaggcagcgacaggcgcgacggcggcggcttgccaggaccaagcgccaccatcgccaggagctggaggggcgggagggatggcgccgggacgggggaggacggccggagcggcagctcattggggctcgacttcgacgacaacggcgaggtcttctgcatgggtcgctcttccactggggctcatatgggctcgctcttccactcctctccctgcccgtcgccgcacgtctctcggcggagctgcagcgggcggcagggcgcggccggagaaggtggagcggcagcgtcagcgggcgagcgtggctgcgaagcggcgacggcgggcgagcaacggctccggacacgggcgaaacagaggagcaggcgagtgcggctgcggaaaggcggcaggcaagaccgctctcggcgcgccgccttgttccagcgctcctcctgctcgcgcacgctgaggcggcctccagcaggcgtggcgccgcgacgcccccaagtcgtcgtcatccctcagcgccgatgaacctcgcagagcccttcccgttgctcacgtcatctcgccgtgagcggtcttaacatctcgcccgccgccgacgcgtcacccccttcttcggtgtcaccgcaccaccacaccgcccgtcgccagcggccctttcccacctcgccccatggtcggcctgtatgagaaaactaggaaagagagagggaggacgaagggagagaacacaggagagagatgatgatgacgtggtcaccctgacgtgtggggcccacgtgggtcccacactcagtcagctgccacatcggataaaatcggagttaaaaccgccgagagatttagtttgcactggttttgttaattgggggatgcgttgtatccggatttgcggttgggggacgattttgtaactcgatgacaagttgagggacctaccgtgtacttttttctttcttttcttttattttctattgggccaaactgggctgctttgcacttgggccgtacaagccatctcaacccatttgcacccacgtcgccgtgcatccgcttccgacccggcctcctccgccgcgccgccgccgaatcgctcctcctctccggccggacggcgagcatctcgccggagcaggtattgatccatctctcatcgtatatccctccctcctccccgcccctcgctcggaacaatcttggactgattaatcgattggttgatttctatccctcactgaattgtcgacttcttgcgagttgcgatattttagaccggggatggatggatggatggattaatctccccaaatggaacactgttggaacattggatttcatgtcgctgtcaatggctgccgggatttgtttattcttggtgcgaattttgtctctcggattatgccagatcccacaccctcacgagcttatctaagcctgtcgcaatcttgcttcggttcattttgtccctttgctcatcgtcctgtcggtatccgtcccccctggatgcttctgggccgtgtagattttagcttaatgtgttcttgggttgccgtctaaatttgggagtaggataacgttgcttggattggtggctagtgtagtggtggtagccagccaagaaaccatttctttccggtgtattattagcaaccggagagagggtgttgtgaattgggaatttcgggattattgctttgagaagagggcagtgatggctgaggaagaagcaaaaaagccggcggtggtagtggccatgaagggtcatccggggtctggcaagtccacggtggcgcgcgccatcgccaccgcgctctgctgcccactcctggacaaggacgatgtccgggactgcacgctgccacttgagcgcgtcgacggccttgctgtcggcatgctcaatgagctctcctatgccgtgttgtggcggatggcagagaggcaggtccagctcggcttgtccgttgttgtggattccccgctgtcacgccgcgctcaccttgacgcgctcacccgcctcccgggtgcccttgttatcgttgtggaatgccagccaggcaatgaagaggaatggcgccgaaggctggagaagcgaggggctgcagtgccagaagatggtggtgatgggtggcataagccgaagacgtggaccgagctggaaaggcttcgggatgggtaccaaggttgcacagattatgaatttggggatgtgccaaggattgttgtggatacaactgatccgacagccaattcagaggcaatttctgtcagggttgtagagtttattggatctattcttgcttgtgaccattaagtctgctattatttcttatcgagcatcaaaaatggggagtaactctaggtcagaatttcattacaaaatgatgatatgttgtcctcttcatgtatagttttcatggtttttgtgttctctttcttgtttatcctgtcccgacttattcaggtcaataggtattcctactctgtttatgaatgttatgtgaatagtgtacatatatgcaactctttctggccaagtttaaatctctttctgatcttaatttctcagaatggacaatgaagttgttgcattttcacattttaaaagaaagggaaatgggaaataagtgaaactacaacactagatcagtgtggattctagtatgcaatgtatttttatgcagtcataactgctttacgttaccattttgtaaattttcacatactttcctactctgtaaatcattcattaagtctttaggaaaatcattaatttgttattgaccattagggtatcctcttgttcatatcatcccttccctgtgttattagtttctttcaggagtcaccattaaattttgtagcaatgttgatttccatgtatgtctaatgggatatttttttctagaatgtttttcaacattaccaaacagctggtgcaaagattaatacaacaggatgtaatcatagctcataactaatggataagtgctatattctttgcaaatttttcatgcttccattaccttagttgatgggattttggaaatttcagaatgagagagatatcatttagttaacctgttatgtttatttattgaactctccagcatgagaaacttcacgcgaaagctggattttagcaatgcttgtggagttaacaagatataccacatgctctagtctttttttattattattttctgtttgacatcttgttattttattgcactgttgtaagacaattttttcctattaccttgtgcgcattccgttaagactaatataaccacctcattttctgttgtttcagtttcctggtgctagatggcatcttctgttcttcagcctggggtgcctgttaccttgcaagaactagagccttcctcagagtccttcagacaaggagcatcgcttagagtaactggagtgtaagtgtacgatgcaactattctaagcctcctatatatttctttctgaacttccactcataggtcctgaattatactaatcttgttgtattttctctagtctgcagtcgtatgatttgaactctgcaattgctgttattcaagacggcggtgcaagcctcaaggtagacactcagaacttgagagagatcagcttccgcacaaattcaacctaccagttcatcggtgaactcctgatcaaaccagataacgatgtatgccgttctcctttcgaaagtccatcagagcctatttgatgcaacaatggaagatactttgataacttatttacatctctgcaggccgttttgcaagcacgcgtaggtaggaatgtcgacggtattgacctgaacctctaccagcaatctttgctcatccgacgacaatatgaagctcaactacggtccaggagagcatgatccaaagccctgtgaatcaggaaaatgttcaatgatctgtctgcttgactgcaatggttcccagttgcaaaggggagcagagtatcataactaaatctctgaaggcagatcatgtcagtaggactaggaccaccataaacattggtggtgagaattgagatgtagagcaaattgtctggttgttttcatgcctggagatttttctgttgcatgactttgttaggaaacatgtacttttcaaatttcatcaaagtgatgcagagaacaggattaactagattggtgaaaaaggtgtcgctcgtatgcagaatcattagtttggacagtgaagtgtgaagcagaaacaaagatagtgccgcagtgtcaatagtctcaattttactacagttatttttgtttctttccttgagaaacgtaggcaaaatctgataaatcattctgaaaatgggatgataattggcaggtggcaagtggcaactgcatggtgtgattcggtaattaatatctgaaggatacagtggatattaacagtacgagaggagtatatgtgtactaatctgaaagtgggagcttacagtattcgtctatcagtaacaacaatatgtttgaataatgaataatagtacaaaccaaactggagaatatttcaaggggtccaataccaacatacaacttcactatcaatatatcatcatgtggtacccttttaaccgatataatgatatgtacaatcagttttttcttaaccggatactggtaactacagtagggctatgatctcttctagttgaaaattcttggttcagcttctacacttgtgtgaactccagtgcatttccgtccgggtcccgagcaaatattgctggtcgccctgatttgctaagtgtgtatttgattcctgcattccaacagtttaaaggcggtcatcaaattgttggcaatggaggataatggaattaatagtttgtactgcaatgcagattaaacattgtaaaggtgcaacaagtgaaatggtaatgctgacacaaagtgtaatggttctaagataaggaaatgaaataatttgtcacggcacttcataaaaatgggaaaatgtttgaaaacattatacggatgtgaatggacgatgctatgatcttaattgactagaacttttaagtagtctaatgagtattactttcaagacaacagaccttttggatgactagcaatggtggtatgtaaaatttaccaaaaacaaaggatgaggttttcaggacatctataaatttctccaaacagggcaggctttcaatttaccacatcagaaaaaaaatagcctgctgtcttagtaggttttactgtaaagatcagtggttttttaataaggctatgaagacaacaagcagagaaacagggcatttactctttatcagttgttgctagtgcactgtataagcaacagataataaagtaaaaattcattagtaccggctttgtcaaagatttcttttaacttcaacacatctttgatcgccatacaggtatgacgatcacgtcccccatgctctgggcgcccagtcaatggatcgggatttggcagctccatcaagtgaatcatctcagaaccaacccagagccaagcacctctgtaaggaagcttgtcggttggcctagcaggattcaccttaagacctaattgataaagaattagttttagtttacaagcagtgaggacatttgctcctgtgtgtcagttttactttacaagcagcatgacacaagaacatgtacaactgataactaactcaccaagcagatctttgtagaaggccattgacctttcaagattttcacataggatcccaacatggtgaatgctaacaactccataagcaggttctgcaccagaaatcatgcatgtttgatttggttcagagaaaaggggcacttactctagctatagccaatatgagtaccaaaaaccaaacaaaagctatacaaaggaaaatgtagtcagcatctcagcacccaaaatttcaaagcaaatgcacattgtgcttatatgactattaattaactttggaattattgtgatgattcttgtttccttgatggaaatagtggcttaactctcttgctcaagacaaaaaagaaagtaaggattgttgagcagttcagtctggtcatggctgtttaacaatctacacaaaaacagttttagtattccatattttgccttgtcagaaccagccaataaaaagcactactggtttgtggttttagatgtaaaaaaactaacatgaattttgcatgtttagagaacatatttcagtgtgattcttcatatcgatgtatgctacatagaactgtaaaattaaatgtatgcacggtacaagcatattgaacatttgcacctctacaacttaaccacaattgcacatatgcctatactctgtaccatcaaatcagcgagtatcaatttcatagtctgcagtctgcactacattatccactctcctccactctaataggcaaagctgcaacccccctagaacttcgaatttgctactaaaagtaatactagtgttgagctaaatagattggtgcacatcgtgatcaaattcccctaccactaaacatcaccaagatttactaactcttgttcatatgtagctccagggtacagttcagagttcagactgatcttgattcttgaaacactcccgaaatcagccagtaaatctttaacaggaacactcaatcgaacagctaccactgcaacatcaagcacccaagaactcactcactcactcaccctgggacgcctcctgcgccgtgacgagttgctccccgccggtggccaccgaaaggcgggtcccgggacggcggcgaggggcggcggaggaggggacgggcggggaggccatggccgacaccttcccggagctggagggggagggggagaggagggcgagagaagagaggcacctcgccgccattgctgctgcctttggatttcttgatttcttcagagttcagggacgcttcgcctgcacaaagctgtgggctttatgggcctctactattttgtgtggctcatatgccattttttttcctcctgcgatttttcccccctttttttaattttggttttgttttttttttctgtttttgttgtccacctgaaaatttcatgaggctgatagccactgaatgacctgaacactcaaaccacaaagctccatagctatgtccacaaccaaggagagaattgtagctaagagcagcgggtacaataaacggtttaagccagcgatagcacatccaacctagcaaaagtgatgagctggatggaaaaaactaggagagagtgccagcggacgactaaattgtcgctgactacacacgaactccaagacaagggaaacagcggaaaaaaaacttatcccatggttgcatgtgaggcaatgcgcgggaacagtaggataaggcgtaaaaaaataataatcaattcattggtgcttgtgcatatagccagcagctatacagacaccatcttctagttatctctatcgctgatgtggtcttttttaccgcccgcagtcgtccgctttattaaactcgctctaataataatatgcagaactacatgcaagagcatctaactaattctatccatcataaactaaactcctctgcattgaataattacgctaactgacgacaataatacacaataacactactgttatgtaaaatcgtgaagagatcacaatctggagggaagcaggagtgtttagcgataagcgagatatagcataatcttttcagtgctttgctgcctcgacagttagaagtagttccccccaggatgcgatcttggtcgcaacccttggaattgatcactttcgatcagttcttctaaacctgtaaatgtgtatatactccccttaatgaaatttggttggcctccttcggctgacccggcgaactgctatgtaaaatacatgtgactaaataagcacagcagaataaggatgtgtttggttatgaattaagataaccagcttagctaacttttatgcagattttatgttgagtgaaatacattacttgtccctaaacttgtgtggtgatgtcacttaggtccgtgaacttgaaaattatacgtttaggtccgtgaacttagtttaatgtaccactccagttcaaacgtcctttgactgcgtttgaccgccaacgtggcataccacataggcaacacttttgctctcagccccttccacatcacaacacgtcacatatatctccttgtagctatatagtgacaccagaatcccccaaaaaaaatcctcaaatcgttattccctctcattcttctccttgcatgtatagaaaatgtggtctcgattagcaattgctattgtgctgcctcccgccgctaatccggccgcactgtcaccgctaaccccgctgcaccgcactgcctcctgccgctaatctcaccgccaaggccgccacaaccgctacctctcgcctccttccgctaaccttaccgtcgaaaccctagccgatttagggatattttgggggatttggttgaaatgcactagtcagggtaagttatgtgcgaagatatatgtggagggggctaagcacgaaagtgttgccggcggttaaacgtggtcaaaggacgattagaccgggggtggcacattaaaccaagttaatggacctaaacgtgtaattttcaagttcacggacctaagtgacactaccccacaagtttaaggaccgggtatatatttcactcttttatgtttgatgaaaaagttctagtttaaggattcaatgtttagttagatgttaaaagtttgaatgtattttagaaacctgatgctagaaatgaagagaaccatgtatgccaatagcattactttcaacattgaaaaaaacacagagagaatatttgcgagggtcatatggttcaaaagtcttatatatgtgcaaatgctgttaatctatacaaagctactgtccaaggcataattcaataaacttgatggtctgagagtggctctgtgatccagctcatcgttcttttcaaagttatgttcttatatttacaatttttgtgtcatatcattctcatattatcagattcattggagataatttaacaaacttgatggtctgagagtggctctgtgatccagctcatcgttcttttcaaaggtatgtttttatatttacaatttctgtgtcatatcattctcatattatcagattcattggagatagttcatttggaagaaaggtgacaatgttcctatgtggttttgtgattttgtccattttcccctgtgataataaaaaagacaataaactgtagaaacctgaactttcaaaaactaataataatggaattgcagtataaagctgggtaatatcaatttgtactaaatcgatctagggataggaacatcattacaagacaacactaacatgcagatgcaacataacatgaaaacatgacattcagatgaaataaagtcagttgtcaaatatcaagggctgtagaaattgagtgaacagcaaaaactttaagatgagcttctaccaacaaccaaagcagtgaaacccacatgaataatgtaacacaagggagcctaaaatggttcggaaaataggaacaaataagttgagtacaaaaaagaataatacgcagctcgttaactcttctgacaacaagcttgcagatatgtcatattgcaattaaagttgctagaagccatagtaggtaagaactattttgatgtatgacatcatacaaacttctgagaacctagcaacgctactaatacctattcctctactcatggcaggcactcactcagaactccgttatactattctcctcatacctagccctcgtggcacgcaagcaactaaaagagccatacaaattagtcaaccctaagctattcccactcacaaaccaaagtaaactaccaagcataccactcattgaaccaatgactattcctgttcaagaacgatacagagtaaactaacagctattgtcgctcctcctacttgtagcacctcatgacttttacttctcgtatcccacaaaagagtaatctgcaatacaatagaatcagcgatatcagcaatatctaaccctaaacagcctcttccagcagattattaactctggctttcagttctcccttcatagaattcaggtccagcctaactgacagtggcggacttagaattttacaaatggggtacgataaactaatctacttataaaacaataaattatctattttttatacaatattatctctaaagaaatataaaaacctgaatatatcataaaaattggactagaaataaactaaatcttatttttatctctagatcccattgtaatgcattgacatgtaactagtaaatagaatgccgtaactcacttgaacaatatatatagctttataatcattggattcatatcaagtgtcgatctctaattcatccataaaatttgttatatgattatatattattcaatattattaatctttatagcattttagattgtgtttaacaaaaatatctttccgcttattaaaaaactagtcaggtaccttatataagtacaataatattaataaatataataattattttttactcatacaaaaacatagataatatatattacgaagcacacacacatgagttagctgctagtattcatgtgcaaataatagtgctggttgtatcaatatttattatcaaaaataaataagaatgagaaaacaacaagaagaagaagatggaacaacagaagaatataaggttaaagttttagtttcactccgtattatgacgaagaacaattttaataatattagtatattatcgattaatatgatcatataccataccatggatgtgggt

SEQ ID NO: 82748 - DNA, 12350 bp, Oryza sativa
gaatgtgatccttgggaatgaaattggttggctcaattccaaggagtagtggattgtgcgagacgcactgtcactctgtaccgagggccggaacaaccagttgttttctttgcacccccaacctctgtcagtagttccgaacttcatcagataggactgtcagaaatccccatcgtcagagagttcggagacgtgtttccggaagaactacccggtatgccgcccaaacgagagattgagttccggatagatcttgctccaggaaccactcctctgtacaagcgaccctaccgtatggcagcaaatgaactggccgaagtcaagaaacagttggaagagttgaaagaaaaggggtatatacgtccgagtacttccccctggggtgctcctgtgatttttgtggagaagaaagacaagacgaagaggatgtgcgttgactacagagctctcaatgaagtcaccatcaaaaacaagtaccctcttccccggatcgatgatctgttcgatcagcttaaaggtgccactgtattctccaagatcgatcttcgttccggatatcaccaattacgtattcgtgatgaagatattccgaagaccgcattcaccacgcgatatggactgtatgaattcacagtgatgtcgttcggtttaaccaatgcacctgcctttttcatgaacttaatgaacaaagtgttcatggaatacttggataagtttgttgtggttttcattgatgacattctgatatactcacaatccgaggaagaccatcagcaccatctccgtctggtattgggaaagttgcgggaacatcaattgtatgccaaacttagcaagtgtgagttctggttgtccgaagtcaaattcttagggcatgtgatatctgctaaaggagttgctgtggaccccgaaaacagtgaccgccgtcactgattggaagcaacccaagacagtcactcaagtccgcagtttcttaggtttggcaggatactaccggaggttcatcgaggacttctccaaaatcgctcgacccatgacacagttgttgaagaaagaagagaaatttgtgtggagcccgcaatgcgagaaggtgttcaaaactctcaaagaaaagctggttgcctcgccagtgttaatcttgccggatactcgcaaggatttcatggtgtattgtgacgcttcgcgccaaggattggggtgcgtgctcaagcaggatggtcatgtggtggcctatgcctcacgccagctacggcctcatgaaggcaactaccctacccatgatttggagttagctgcggtggttcatgctctaaaaatctggcggcactatctcattgggaatcgctgtgaaatatatactgatcataagagtttgaaatacatcttcactcagtcggacctgaatcttcggcaaaggagatggttagaactcatcaaggattatgatgtgggaattcactatcatcctggtaaggccaacatggtcgccgacgctctaagtcgaaaaagccattgcaacactcttaacgtccgtggcattccacccgaacttagtcaacagatggaagccctgaacctaagcatagttggtcgcggattcttggctgcgttggaagccaagcctaccttgctcgatcaaatctgcgaggctcagaagaacgatccggacatgcatggactcctcaagaatatgaaacagggtaaagccgctggtttcacagaggatgaacacggaaccctatggaacggaaatcgagtatgcgttccagataacagagaacttaaacagctgatacttcaggaagcccacgaaagtccttattccatccaccctggcagtacgaagatgtacttagacttgatggagaaatactggtgggttagtatgaagcgggaaattgcagagttcgtggccctttgtgatgtgtgccagcgtgtcaaggcagagcaccaacgaccggccggacttctccaacctctccaagtacctgaatggaaatgggatgaaattgggatggatttcatcaccggacttccaaagactcaaggtggatatgattctatatgggtagtggtggatcgattaaccaaggtagctcgattcattcctgtgaagaccagctatggagggaacaaactagccgagctctacttcgctaggatcgtgagtctccatggcgttcccaagaaaatcgtatctgataggggaagccaattcacctctcacttttggaagaagctccaagaagagctgggtacccgattaaacttcagcaccgcataccacccgcagactgatgggcagaccgagcgtctaaatcagatcctagaagatatgcttcgcgcatgtgtcctggatttcgggaagacctgggataagagtctcccctatgccgagttctcctacaataacagctatcaagccagcatacaaatggcaccttatgaagcgttgtatgggcgcaaatgccggacaccgctcttgtgggatcaagttggggaaagccaagtgttcgggactgatatcctgagagaagctgaagctaaagtcagaaccattcgggataatctaaaggtggcacagtcccggcagaaaagttatgcagataaccgtcgccgtaacctggaattcgcagtggacgattttgtgtatcttcgggtcacgccattgcggggtgtacacaggtttcagacaaaagggaagctcgcacctcggtatgtgggtcctttccgtatcgttgcccgacacggagaagtcgcttaccaattggagctgcccgcctccttgggcaacgtgcatgatgtgttccatgtgtcgcaactcaagaaatgctttcgagtgccatccgagcaggccgactcagagcaaattgaagttcgcgaagacttgacctacgtggagaggccagtgaaaatcctggacaccatggagcgcaggaccaggaaccggataatccgtttttgcaaggtccagtggagcaaccacgccgaagaagaagctacctgggagcgtgaagacgagctgaaggcagcccatcctgatctcttcgccagttcttccgaatctcggggttgagattccgtttaagggggggtaggtttgtcgcgtcccaaaacgactctaaaatacatcatcaaaattatgcatagaataagtaaaatccatgtgaaagcctccaacaattaaaatgtgcaaagttaaaagtcaaataaggcttggaggatttttgtatatttcctaaaagcctaaaatgcgtaaataaattttagtggaattttcagagcacaaataataattattaagaaataaacaaagttagaaaggttttataaaaagaaaaaaaaaccctaaaaagtcctttttcccccttcccctcttgggccggctcggcccacctccctccctctctctcctctcccccgtggcccaatcggcctcctccccgcgcgcgtgccgctgacggacgggcccgcccgccaccctcgctgacgggtggggcccacccgtcatcccctacctcccgccgctcccgccgcctcgcccgtgccctagcgccgccgccgccgcgaatcccgccgcctcccgccgtccccgcgcgcaataaagagggggaaatcattccccgtgattccctctccctttccccccatttttccctctctctctctcgcgttcaaacgggcggatttgcccccgcaaatctcgccggcgccattgatggagcccgagagcgccgcgccggtttccttctcccccggccgccctctctcactcccaacactatataaacgctccccgtgcctccctccaccgtttccgccactcgccgctctctctctccgccggaatcgagctcgcgccatcgctctctctctccgccgtcaccgccgagctccggtccgccgccgtcgtcgcctcggaccttctcccgcctcggcgtcgcctccttcggctccgccgcgtcctcgccgacctcgtccacccctccgtttcgcccgccgaccgccggaacgccgccgtccccgtcgacccgtgccgcgccgccgccttcttctgctccggtcgccgttcccgtcgtcgtcgtcgacccggggtgagccgtggaccgcccatttcgtttcccccttccctcccctctctcggccgccgctccgccgtgcctatggccgccgccggcgaccataggggcgcgggcgcgtcgcctcccgtcggctgtgccggcgaggccgccttcgggcgcgccccgcggctgccatgtggggcccggccgtcagccgcctgcgccctcgggtgcggctgacgcgtgggacccacggcgccggccggcgtaagccgcgtgctcccggtccaccgtggaccgagaggctgccgcgtgggccccactcccatggacccggtccgtgcgctcctctctcccggctgacgcaataaatatgtttttaaattaaaatttaaatgaagaaattcgtaaatatccatttaaagagcatataaacttcaaatggccataacttggccatttaaactcggaattggaccgttaaagtctctaatttttccttaagaagccaagaacccatttttgtgctttgtttctgcttgttatatggagtttagtagagtaaaagccgtttcttttccgttggtcgtgtagacgctgcagcttcggaagatccgctcttcgtggaggttgaagccgacgtttgggaaagcgagcaaggcaagtcacatcatctttgaacatattgaatcccagtttgtaaaattatgttgatttaacttattgcattatcgctttatttaaattcccgcgttatcaccgttttatttagccatgcctatttacctttgttatgaccttattattattgttattgttattatttccttgttcaccctagaataaacaaaaccccaactagtggacactctactcatggtatcactagtatgattttaggtagatgcttcgcttttaattaggtaacattaggtgggtttttttcaactctagactttgggaatattcatatcacctggacaccatggaatggtttggttattgtggaattggcttcacaccgctccttctattcaaaatccccaaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctagttataaacaaaagttcacggatggagatggaagaagtcgggggtcgatggacatctctaggacaaatgaaggctacatgagctgctgcccggtagtcgagatgtcatggcacagggccggtgtcctgctgctaggggctcagtcctgcctgcctgtcccgggtgttccggccgtaggtgggattgggtcggtactcttgtctatggctaggatgggttggaaactatgtcacgtctttcgtctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtaggttcacggccttgataaataatattgtatagtactagaatcgtgtttgcaaaatagccctgagcaactaatgtctttaaatgctgtttactgcaaccctaaccctttatagtataactcctttgtactcccttgcatttattctgcacttgtgggtgtgtcttgttgagtacggtggttgtactcagtcttgctcaatttttcccaaacccagaagaggagttcctggaggatgaaggctttggtgtctagctcgtgcctgccgtcaagtgcctgtggtcgttgccctagtcttccgctgtttctcgtttgtctttgtgtgtgctgggccttcgctgcccatgtaataaattaactatttacgcttccgcttgttaaactctgaattgtatcaacttttggtgtaccttgcctcctgggacaaggattaatgcacgcacgtaaggaacgcccgttgggttatttccggtcgtgacaaaacgccatttttcctgttgtacggcgccgaagcggtcctaccctccgagctttccctagggtcgcctcgcgtcgcgctgtacaatgaggccaaccaggatgaccttcaccgcgacgatctcgattatctcaaagaacggagtaggcgtgcggccctgcgtgccgcgcgttaccagcaaagcctacgacgctaccatcagcgccacgtccgggcccgatcactacaagttggcgaccttgtcctacgccgcgtccaatcgcgcctggggctgagcaagctctcgccaatgtgggaatggccatacaaagtgatcggcgtgccccggccaggctccgttcggttaaccacggaggacggcacagagttgcctaacccttggaatatcgaacacctccgtcgtttctatccatagcatcgagattttttgctttccaggagctcgggccaacccccgcacaaccccttggtttgtgcgggcttggccgggggctaccactgtgtatccttttttccttttgcaagaagtgaatttttctactttttgtgaagaccgtctattctcttcctctggcttgacctggtttaagggataatccgcgtttactctgaaccctaagtgccgtagggcggcctgaaaacctccgaaagggagcacgaacgcgggccgcgccccgggttgcgccgaacctcgggggatcggaagggcctacacacggccgtccctgacccccggtcgtcgcagcctcggtctggctagtcccaatgggcggctccctcggggcgacggtcttgcctatcaccacttaggtaccatggaccgagcgcggatttaccttctcgctagaacaagcccgagggggggaggatggggtcaaaacggcattttgatcacaggcagattaattatacccgttttgctctggttctttcttctctctatgtcacagacatccaatggaaaaagcaaatgagtaaaaggggctaaggaagtttcagttgcagaacaagataggacggcacgatggcctaaatacaagaagtgcccgccacgggcacacaacaaaagggaattgaaagcgcgaatggtcacggggtgcccaggcccccgaggccggcgccgctgacgacgtcgtcccagtcttcgtcgcccacgttgtcgtcgtcacccccacttccgctctcctcatccgaggcgagcccaaaggtgaactggggggccaaccgggcagcctcgacttcgacctcgggctcaggaccgcccccaacctcgaccttgacctcggactcgggaccgcccccagccttgacttcgacctcgggctcaggatcacctccggcctcggctcccgagctgcgacctccctcaccccccgatcctgggtggcgttccgcatggaccctagtctcacagccgcccccgggaggaacgtcgccgctaccgttgcccgcagcaagtcgagtcccggctgagggtcgctcgggaccaggcccggtatgtggcctgtgggtcccactgcgaggctgcgaagaccccgcggccttggattggccgggcccggaccgttccgatcgttcggatttcgtcccccacgaaggctccgaccctgagaccccctgagaaggaatctcgctacaagagaacccagatcgcgttaacaatgaaaaagaaaaggagggaacaagaggccgagctgggtaagagcaccgaagtaggtgccagcaatcgtacctacggggagggcggttgaaagtccacttcggggtctcgatgaagctccctcggctcggctccgtttgccctatctttcggacccgtttcttcttccgtccgacctcgggcccggcagggcgcttgtggcccgctggcggatgatctgccgcgtgctcggtgccccctccacgcgggggagagggcggccgggattcgggcaccttccgcttcccctttgggtcgccgaccaagtcgtctccaggtccgcggctcgagtcgggcgcccttgagccaccaccgcctggaccgcttgtccggctcccacccgcagtcgcgccgccgccacccgcgccaacggcgctaccgctggcgccgcctcggctggaccggctcctaccggcgccaacaactgacatcacggccaggatgctctcccggtcgcggtcgcagtagagggggaggatcccatctgggattagcgtttgcttggcggagtccaggcccagcaccagcaccatctttgcgtcctcctccccccagtcccagcgctcgcccacatgcgtgcgcatggggtcgttgggaccagtgtattcccacgcgccacgggatcgttcctggagaggtgcgatgcggcggcggatgtaatcgccaaagaccattgcccccgtgaggcccaggcttcgcagacccctgaggcgatcccacaccgcgtcgtattcctcgcccagctccgaaaccgctagccatgcggcggatctttcaggaggaccagcgggaacccgaagtcacggatggtccggcaacgcggtgtagaaccagtccttcttccagtcctcccatttcttgcggagatgactctcgatgtactgccccgccgtgcctggccggggctggaagtagcatccccccaccaccgcaccttgcagcagctgcgggatgaagaaggcttggaacagccgcatcgtcggccgcaccccgatgaacatctcgcacagatgcacaaagatggccagcgtcatcacggcattgggtgcgagatgcaaggcatggatttcgtagaaatccagaacctcatggaaaaatctggagaacgacggaattaagcccgccatggcgaaggacaagaggtgcacggaccgctccggatatcgcggccgcggccgcgactccaccgccctcacgacggcgccatccggcatgatcttgcgggggaggctaaggtgcctgtctgccgtaatgcgggaaaaagggagcactgtgtcgccagcgtcttgagccatggtggccggcggagcagtggcgaagagcgtggcgcgcggaacagtgtgaagtggcgagaatgttagggttcgaggagcgaaaggacgagcgggcggttggcgaaaggaaggaggcaaagtccctgcctccgtcccccttttatccttgcctcatccgcgctcacctcctcgtttcacgccctcataattgcccccacgatcctcgcgcccgcagttgtctcttcgtttcccacgcccactcatcacgtgacccgttgtatccgcgtcccgcctttagtgcgcctgtcagtggcacactcgaggtggagtgcgcaacggctatgagcgcaagctgagcgaacagtcaccacaaccgccgcaggagtagcgggcgagggaatcgaggcgtggtctgaccgaccccccggttatcgcgcctcaagcatcctcatcattagcgtggtcggtggcggtcaaaccgctgctatggttggcacgccaacctggccgctcggcaatattcctttcgattccccgccgggcccacaaccccagcttgagaagtcgtgaggcaccatgtcagactgatctcaggaagccaatgtctgatatggtgccgggggcttctgtcagagatatgggcccgggggtatgtgaagtaaaggggagtcaccttcccgtccagccacgtggcactgcaagctggccccactcacgcacctcgcgggtcgcgaaagcgccaggggggggcctcggggtgcggcatccccccctcgggctctcccactgcttcgccccgaggccctcgcccagctgccgcgtggtggggggagagagcgagagggggacccaggctggacaaccataaatacgcggcgtcccaactgtccctcactgcgtgtaatgcggtgagggcagatgtgcaacgcgcctaactgacccctatcaatcggatgtgaccagtctgtgaccggcctgttgccggtcacgtccgattgaacgggcggccgtgctcccacgtcgcctctgtatccggcggagtgggggtaggtgtgacctgtcacatcggagcatcactcgaagaagggttgccacaagtgttcactcatttatgagcaaatgacagggatgtctcccgtgtcaggcggggaacgacgccaggtcccactcaaggaccgattgctgcttagcttctgggagaaggcatggatcgagacccagtcaaagtggagtggggtccccctcccatggggggggagtaggtagaggcggcgcatgtggtatccccttgagctataaaaggaggaccttgcccaccgagacaaggggacgactcttagaaaacctgaactctaggagaaggaaggcgatagcactctccggagtagaggaacccttgtaaaactcatacataatcccaaacacaggagtagggtgttacgctccatagcggtccgaacctgtataatccgattgtgcgcaagctagccggcagtttcaggggcgaacgcgtgattcccaagaggcgagcttctgcccccggccgaactcacgaaaggggggtctcacgactccccgctatcgagggtcttccctcaaaagtggcggtgatgggaggttttactgaatccaagggtcgtcagaagcacacgtcctccaggccttgaccttggagaggcctaatttggcaccctctacttgctagcgagccacagaggttactgggataagaaaggctaaggagcgcggggaggagagggccgtggacagtgctagggagaaggtgcagtggtggcaattgggaggaagaggcagcggtgatggtggtagtgggggaggaggtggtcatgggcgaaggcaggggggcgacatgtgggaagaggtgacgagaagcataggaggtcgcagtatagtgcatgagagaaatggtggagtcaaaatgaaagggagcttttcatggaaatggaaagttttcacggcttgtgtggatcggacgattgttgattttttttactttcattattgtaacttgaattttttactgtttacatctttatgtctcattatatgcaatttctaaaccaacatgtaatagatgcatccccgcaaaaaaaaaacatgtaatagatgcaaggtgaaaaaaaatcaccaactgcaaccatgaatgagagcttatattacacaacgtgtagtttgaactggcccaggaggaaagacagggagcaaagagatggtattagccttaaacactgcaaggaaactctgttcgttcctaatgaagctatttctaccactctagtctctagcctatttcttcaccaaccccattatctcaatcaatcaaaaccattctccatttaaattatttacctactttctcttctcaaccaatcacaacttcactctaatcttttttacccactttttaatacccatacccagtttcaaaagtacttatattatattatattatattttagatctagtatgaagagaataactagtcttagcccaagcatccaatgatatctaataaaatattcaccttggtgatccaactgttgaaagcatgaaagaaacaaagtgggaaaccgagaaaaagaaaagagaaaggaggacggcataaatagcattttatcactactacaaaatcgatttgcgcaggcggttgagctgcttgcacgcattcaggtgtctgcgaaaatcacatttttctatgcggccaacgcaaccacatgtgaaaatctcatttttcgcatgtggtcacctataccgaccacatggaaaaataatttcggcaaaacaaaaattccaaaacgaaaaattggtcgaaaccttaactccccaaggcgtcgtcgtcgttgttgacggttgttttagaccgatttcgaccgtcaatataactggaataaaggagaactagctatacttgcaatgcatatttgttttagaataatctatctctacttgtacttggattttatttgtttgcagggattgccaacataaatgaaggagaatcgacagaaaacaaccgaacgatcactcaaaatccgtcgagaggaaaacttatggttggaagggctcacaaatccaatgaaataacatcaattgggccca

SEQ ID NO: 82749 - DNA, 55273 bp, Oryza sativa
caccaaccgtgactaaaaatagatttttactcccggttttttcacccacaatctttagtcccggattgatagtcccggtttgaaaaccgggactacaggggggttacgaaccgggagtaaagccccgttctccaccagtgtaagccaaccctagaaactacaaaccaccataaaaccaagcaaagcaaaaaattaaaccaccacattaaagcattttcttcatcttatttttcaccagactaattcattcatttttctcatgtgcaaagtatgaaaacttgcagcagatggaatataactacctcccaaattaagtactactaatggggactgcatgcagttcatatatgtacatattagtagctagaatatgcccgtattttgttacggattaaaaagagaatcatatggtacggtattacatattcacgtgggaaaaatatatagacgatatacaataatatatccacttctctatctagttgaatcaagctgtttctagtagtcttcttattgtagagtacatttgagaacctgcatgtcattgataggggcggtggttgccaccatgcaccattgccttcttttaaagtggtataggtatttcaaatatccgaacatgaaagcacaaatatatgtacacgtttttttttaactaattaacctcccatgcgagattttgtgcagaaagaactagatttaaaagtagaacgtactgtatttaatatacatctctatctgtttacatgtatacatctataactatcttgatcgatctatcccgttataatctaatctagacctagagacggagacggagacggcgaaggggccaactcggcctccccttgtcttcaaattttacattgaattttatagctagctcgaggaaattttgaagaaaaaaactaacactattgccccctccaacatagattttttagtgtttccagcccacttagcatgacaaccaaatgatgcaaattaatatagatccttttatcctatcaatgtgataatttttaagccatccagaaaaagatgtggtacgtgactcctttttgccatctatctcttcttaatatagcacgcatgtactaatgacataaattagctaatatattgcacatatatatggatcagtcgatacaggataccaatcaaaagcatctagagggatatggatattttatttatcttcttgtaaatacagtatacctcagcgtgatacatataagcgtaagtacacgcctatatctctgacaatctttaatttggtcactaataatcgcacaggcgaccatcatatcatatatatgtaaattttgcatagtcatgatgtattaattgtacgtgctagaattcaatttcctctgatctcctctctcgaatattgaagttctgatatatatatatataggtactgcatggtttaattattagaacttgtgccactgatgatcatagctgcttacccctggcctgctggtggtggagtacacctgcatgtttgcattgatcatagtaggattatcaggctccaactcctccagctctgcaaagacctcatcagctgctgaaggttggatgccaagtccagcgccggcgccctccgtcgtcatcatcatgttggcctgttggccaccgagcacgacgtcggcgtagagattgaatggggaggaggaagaagacgatgagcttgtgatcagtgcaggctgcagctggttggtctgctgctgctgctgttgcttgtggcggctgctggaggcagtagcatgagtactgtgatgagaacgggcatatccggcgagcacattacgttgcatcggccatgggtggttgtgctccgccgcgtaggtgatcaccagcatgttggggtcgctgcggctgcgctccacctgcttcctcgccatacatccctttgagctgctgcatctgtagtaacccctgcatcatcaccgcccacaaaatcaactcatcagtgaattattattttttaattaatttcctgatcaaccgcatatatataaaattattgtgcctagatatatatatacccttagaatgcagtgtatgaatggtttgatcaaatttgaagatggcacagtaatgtcaaactgagtccactaagccagaataattgttaattcatcgagaaatttaattaattgtgagtaaattaagcttatcgatccctgtacttgaagtttcatttttaccttttaaattaatttgaaaacggcaaacatagctattttgttccaatttttgcctcaaaagtaaaagcaacttaatttgtggcagtcttgcaatatctactatttcaacaattaataatgtttgatttacgcaatttgcaattgggagtattagtttctcacaaatgacactacattgggtcataattgtgatgaatcacttattagatccccatgtatatatggaagaattcattgatgatagatttacattttagggattgcttgggcataggtgtatatataaccttcagacggtacaatgttgaaactccgacacaatctgaagtgattatatacgtttgattaatccatacatatccatccaaacccttattaggtcgttcaagtgccattggaagtttgaaacccaacactacacaaataattaatcaataatagacaagcatattgtctattatgatgctgtcgaattatttttctaaaagaaatgttttgtatacttgatttggatcattggagatttggtatattaaatgtgtattgtgcagtaaattaattttgggttctattcacgttggttggctttggctgataagttatacaaaagtaaacgaagcaaccgaaaataattttaggttaggccttttatatactatttataccattagtggtaaaaagccaaggttggaaataagtttaaaataaaaaaggaggataatttaaaattaactttaaaataaatgagtaaatgaccttttatcaccaaagtttcactttgaactaccctttaaaacatcttttctctttggactagattagtttgcctttgtttcactttgaaccatcccaaaaacttttctcgagcacataaatgactttaaccacatcaacacccataaaccgctaacttcctggctcacatgtagactattattcacaagattagagggtagatgcactagaaaagtgacttggggtggtccaaactgcaacaaagataatcttacctagtctaaagtgaaaatattagctagagggtagcccaaaaagtgaaactttggtaataaaagatggaccaaagtgcaattaactcaatttaaattgtgtcaatgacttataagccaacaagcaaataatggggaacttcatgtaatctagctaagtaataaacccaaagttgtggcttactaacaaaaaatgttgtttgaattgaaaattggggggggggggggggtgtacagatatatatgtacttccttattccatatgtaagccatttaaaacttatgtgcaagaattaaaaaaaaatagctcaagcgacttttgttaccctttatttatattgttttggaaaatattggtagtttatttatgagaaaaatataatttatttggcaagagaaaccataaatataagtttttttacaccgaaaccataaatataagttgaaattaaaagatgcctgcaaattttgaaacaacatacttttagagtttaaaaaaggctaagatggcttacacttggactcataggggatcagtatatatatatttcaaaagttgtttaattatgacaaaccaattgaaattgtctaaacaagaaatatggaagctgcttgttttttagttaattagcttataaaaaaggatggccatgattttgatgcttttgcccagagatacagtacctgcagagatatgagcaataaatattaatgaacttacataatataaaatgaatataattaatacctagagggaacataatataactaagcagtaagcacacaataggaatgaacgaaacatatatatctgatgagatatctcttgattccaataaacttcgtataaattggatcggtcattaagtataaaaatatttatgcagaaagtgattaattgtttatcaagaatgggaggaataggaatgattgaaagatatttgatgagatcttgatgcaaataaacttcatgtatgaatcgggtcattaggtacaagatatatatgaacagatcgattaagtgagcgcgtgttaaaaaaaaaaagaggggaagaaacagatgaaaatgtggccggtttaccgtggataaggagagcctttgatgggtttctggccgtacttcctccatgcccatagatcagacgggatcacctctcctccacctccacggctactcgtcgctggcggcgccgggatgcacaccactttcttcacctcattcttcctgtagtatatatgccaaaggatgcaagcaagtaattaattaattgcttgaaaataaactaacactaaatagttaagacttttgattaattggaaatcgattgatgtaagtattcctcgctcattagagaaacgtgaaaagcaaattaggaggaactgaagtcaagtatgatttagttccaaacctgtcaaagagttatgtgtacatgtacagttgctagatatgagcattaatactgaaaacggccatatgcgaggagtaaaactctgagaagagtaagatcgagttaatattaatttggcgatatgggtagggggtgcaagcatcaaatgccaatccatgaaatcctgctagcttgcttaaaggtgatgaagtcagaattaatgacgactcatatatatataatctgtcagtatatgtaatggatcgaaaggaatgctgaaaatgagagccaaagatatctgcacacacacacatgcatgaactaataaaaagatcaaagtgataaaaagaagcggtaacacaaagccgggatcgatcagagggatgcaaatcatcaattgaaggaaggaccaagatgtgtatacattaaggaagaagaggagtgatcgaaatatgaatccaattaattagagaactaattaataatgttaagagctagctagcatgccaaaccttttcatcatttgatgatgagcagacggcgtcagtggcgagatcctgatggcttcttctccatcatcggcagcgcctgcgcctccgccgcccatcaccacgtcgccgccgccacagagggcgtgctgggagatctggagagcaagcggccgcggcatcccgtagccggcgtcgccgggtgtgaggtggtggtatgagtcgacgaccgtggatggcggccccgccgtctcgaacggcacaggtgcgtcggtgtaagcgatggtggtagggcgccgaagctctccgtggtggtggtggtggtaagggatggtgatctggggggcgggatagtattggtgaggcgcctgaggcatgggaggaggaggaagaggatgcagaggtgaggggtgatggtgaggggtggagacgaggaatgcgcgtgcattggcacgggccacgacgtcggcgaggtcgccagcagcagcagcttgagcagtggcggcgttggcagcctcctcctccatcatatccatagtggcgtgctcgctctttctagtttctgtctgatgcttaattagctgctgctgctgttgctgctgcctattcagtattcactagtagctagtactggtacacacactcccactcccgtccagccttgcctgcaggagcactagtagtgcacgcactcacagtgctactggccggctactaccagctcgattgatctctgaatctctctctttttctctctctcacatgcatgcatgatagcatatgagcatgagagagcagagagttcgattgctcgatcgatgatcggtatgtatatgagtgggatgcatgcagagtcagatcgatcgatactagatatcgagaacgatcgaggtagcaaaggaaaggaagatatatagctgctaggtggcaaacgcgtcgtgttttgagtcggtcgtcgcagagaccatggatcgatcagctgatagtatttatttggccaccacacaagctacaagctacagcgcgaagcaactgttcgccccacacaccaactgtagatggatgcatccccccccccccccccccccccagcctattgcaacacagcaagtcagatatatgcggcaaccaacaagctagctgctctcgctcgatcgatgatggccacaccaccatatgcgcattcttcgtcctctgctactacctgtagcctgtagcttccttttattttcccctcctcttcttctctccttgcaatatatatttgctcctccgatccgtatcggtatgcatgagagagagagagaagctagatagcttgcttagctagaggaaaacgacgaggggacagagacatggtggcacttatgatagagagagaagagagggagagggagagtgagccgggcatgcagagatgcagatgcagtaggccatgcaacctgcctttgccttcatttgttggctcgcctgtttctttcgctacatgatatctcactttcatcccccttctttcagcaccttttgttttccatcatttcggttgcgtctcttgccaattaacttaattaggacactgctttccacattgatgcgtgcatatatatattattattatttatattatattcctatttttatacttaattatttattgacctgttactgtctaataatgtgtgcatcggtagtgttgtggttttctatacttagggcgattccattacaaaatctattatattattaaaggaataaaaaaggagcctccacgttcgttcttatggtctagaaattctcacattaatcggagaaaaagaaaaatcagagtccatatagaaatacaatttagaaatagttgaaattcggaattaaaaaataaggaatattagaagaggagactagagtccatatagaaatacaatttagaaatagttgaaattcagaattaaaaataaggaatattagaagaggagactagagtccatatagaaatacaattaggaaataatagaaattcggaattaaaaatactggatggcagtacagacagtcccttaaaaataagaaatattagaagtagagtgtatagagtccatataggaatttaaaactaactaaaatttgaaataaaaaagtgcctccacgttcactctcatgacgtagaaattctcatattaatcggagaaaaataaaaagaagagtccatatagaaatacaatttagaaatagctgaaattcagaattaaaaaataagaaatattagaagaggagactagagtcaatatagaaatacaatttagaaatagttaaaattcgaaattaaaaaataaggaatattagaagaggagactagagtccatatagaaatacaattagaaaataactgaaattcggaattaaaaataaggaatattagaagtagagtatagagtccaaatagaaatacaattaagaaaaaaatagaaattcggaattaaaaaattaggaatattagaattagagtatagagttcatataggaatttaaaactaacttaaaattcagaattaaaaagagcctccacgttcgctctcatgacctagaaattcttacattaatcggaaaaaaaataaaaatcagagtccatatagaaatataatttagaaatagctgaaattcggaattaaaaaataaggaatattagaagagaagactagagtccatatagaaatacaatttagaaatagttgaaattcggaattaaaaaataaggaatattagaagaggagactagagtccatatagaaatacaattaggaaataactaaaatttgaaattaaaaaattaggaatattagaagtagagtatagagtctttatagaaatacaattaggaaataatagaaattcggaatgaaaaataaggaatattataagtaaagtatagaaatacaattaagaaaaaaaaatagaaattcggaattaaaaaataaggaatattagaagtagagtatagagtctatataggaatttaaaactaactaaaattcggaataaacataataaaatgaaaagtagtgtttagagtccatataaaaatataatttacaaataactaaaattagaaattaagaaaaacatgagaagaagagtttaaagtcaatataggaatacaatttagaagtaactgaaatttgaaattaaaaattaaatattattgaaagatgagtttagagtccacatagaaatataattagaaataataaaaattcagaattaaaaaaagaaatattaaaagataagtctatagtccatataggaatatatataatttacaaataactaaaatttgatattaaaaataattaataactaacacgtatataaaatacaatatgaatattacacattagttgtttcgtaaagttattgcaaaatttaaaattatgttgtcattgtaatatattttaataatataatgagaaaacatatatgctattatacgagagaaaatataatgatgctaacagcgcaatctgcgtgggccaccatgctagttacaattaattaaggttctcgacatttatcaatagtcggttttttagtttttgaaaataatccattatatatttatatatgtgcaccattaacatgatggtgcaaacgtgattgcatgagtccgcccactaagaatcatatattgtgtttgtgtgtatacatacacacacacacacctgtctatccttagttggtcaagaggctggacatattagttatagaacttcttttgaaaaaaaattattgcacatgtgtatatacgtttctttttggacttcaattttaacacaagaactctattatatacaatatataaaagtaaatgatcactacaggaaaaattcactattgccacgaaaatgttgcaaccacatatgagttctggcagtatatatagtttatactattaccaatatttttttggttttgccgtagtgaacgtatcttattgcaatgtttattttgtggcaatataaatatttgttaccataaaattaaaattgtagcaacaacctaattaaaacaacgggttatattacgtaccacagctaataacgattttagaattgaagcaatacatatctattgccatgattttggctctaatgcactaattttttcgtgccaaaagatcaatttcctagtagttgaaaaaccttgttttttataataaccttaaataataaaatacattaaatacaatagatatcattgggactaattaagagaatcactacaaaagttttcctaaacttatgtcatgaaaagtatactgaatatgccagactatatatataagtccaaataagcactgaacatatatgcacagagaaaggaccgttctcaatatattgattactgtaagtctctagtgtcactagcctaaccaattaaagatgagtatgcacaggtgcatttttggctttaatttactagcattattgttgtgccactttctctttagttttagtgaatttaacatgtagtacgtgcactcaatcagaattttacaacatgctttagtcgcgctaattaacctgtactgacattccgtcacaaaaacattgacttgctagaataactatagggcatgcatgcatgtggttttttttatatataaaaaatggtatgcatgatttacttgcatttgttattattagtgttgtcctagtatattgttggtacaatatggtcggacccattaactggcgagggcgtgcggaaggtctcaaccctgcaggttattagcatgcattattattggcatccaatgatatctacaatcttcacatatgatctttacacggttagaaaattattttttttgcacaatttttgctgtcgattgattagatgagataaaaactacaccagaaaattatgatccattgatgagcttactgaagctaaggatgcattgtatgtcaaaattactgaaggatatgactacttgattctacataccatggttttgatcctagttttatttaaaattaaaactaatagctcctttgtactgaattaagtaattttggaagaaaagcagaggaactcaatccaaaggaaaaaaaatcctatgtgcacacgtttggtttgtaggactgcattaaagtaattaatactccagattttggcggaattctagcatgaagtctaactttaggtttgcaaattcctttcggacttccgatgcattctctctctttctctctgcattatttctctaccaaatcaaaatgtgaacttaattaaatatgatgtgtttttcttgtggtacattcaaacatttcggtagtattgttttctatagaatttatcatggtgtgagttgtgacattttaattccgtgttttcctattcttgtactttaagaatctagtttgcgtttcaaatgagctctaaaatagttatgtgtaggtttagttgatgcagacaacatcatgtactagtagcaacgagcaagttaattttttctttgtgatttagggaattaattaattactccatatgtttcatatcgtaagactttctagcattgtccacatttatatagatgttaataaatctagacacatggacaatcctataaaatcttacattgtgaaaacggatggaggaactactccctccttccctaaatgtttgacaccgttaacttttttaaatatgtttgaccattcgttttattcaaaaacttttgtgatatgtgtgaaactatatgtatacataaaagtatatttaacaataaatcaaatgatagaaaaagaattaacaattacttaaattttttgaataagacgaacggtcaaacatttttaaaaaagtcaatggcattaaatattttggaatggaggtagtaattaatagtgcggtcaacgagtggtaagttactatatcaggctggctcgatctggatcgcatgcatggacaccaagtcactgtgacatgatccatcgagctagctagctgatgtgatggatcaagcgacaaagcaactttggacggtaggagagggtacgcacgtacgttcaatttgattaatttattagccgataaatatttttctttgtattttttttatatttttctttatatatagggagagagatatatatatagagatcgatatcttaccacaatgcatgcatgatactatcttatattatatcttgatcgatcagcagctagctggtccatccattggtccacaactccacacacacatatcgatctcaatatcttttatctctctctttaatttctagttattactgtgcgcttggctgcacacatagcagcatgcagcaggcagcttttcttacacttcccacaaaagcaaacaaaatcccagagcatcctactgtgcccatcccagggaaatgtacgtactgtgccagagccacacttccacattattctcgatctctacaatgaaatgcttctcaatttaaagccgatcgattgattggaattttttaccttcttgaagcgcttgttagtttgattgaattaatcattattccgaggaacacgggttagtaacgacgagaagcacggtggtccacgttaggtgagcacaattaatgacttttcaagtccttgggtgtgctgtcataactgctttattggtaaggagtgttgctattttctttttacagaacacttgttcatgtagttgtgcgattagctctaagtccctatcctatctcgatgagtctctagctagttcacattatgcgttggcatgcttccttaaagcctagtcataatttcgatttctcacgtggctctcttatattaaggtagaacgaaatttctgaacgatatattaacccacataaattaataaataaggaaacatgtcctactaaataactcgttgaagtaatttcaagcagatgcatgctagcaaattaactcaggcaaattgtgttgcatggctgtagctagattgagggaagtagctagctatagctagcctacaacatatatatcgtcttagcttgcctcgtcttggcggcaccaagattcaattcaacggcagctcaggaaaatgggccaggcaccaatagttccactgaaggatgtgcagtgtggacctaattacctaaccttgctgtagttaagttgcaaaagcacattcactgattgatgagcttggatctttagctaaggtacctggagttgtgtgtgttgagaatatagaaatataatgatttaatatattccataaataaatcatgacattacagatgtatactagcattaatgtatcattagatttacacatgtaaactaagcagtaaaacatgaacagatcaaatatacgcaacatgtcgaacacgtaccgaggtggcggaaagaccggttgctcggcaggaactactcgcggttgcgagcgtcgacgaaggcgcgcagcacgcgagcggagaggaaggcgagccgtcgtggacgaacagtgagcagtcgcgcgaagcgcttcccaaaaaccttattgccgccttctcccggtgcaggacgtcgaaggcagaggttcctgagacctgctctcccgatcgcaggtgcacgccagcgagcggggtggagtagtctacgagcgacggcgcagcacagaggaggaggcaaaccctagattgatttcgtgtgttttgcgtgaaggcggcggctcagtttatatagagataggtcgcttgatcagggcgcccgcacgatctccactccgcgtaaccgaaccggataagtcgcgcgtaacttatccggactccacgccgttttcacgcagcggatttttcggaatgtttccaaaacaaaacaaatccgaattttcctacagcaaaacaaaactgcaaaaggaggctgcatctgtgcaagggtgaggagccaattttgcggaccattcgacgcgtatgtcgtgcacgcgcgccgcctgccctgcccctgccctaccaggccaggtgaggcgaggcgaggcgagcgagcgcgtgttccccctcttctctccaccacacatgcttcaagaagctaggagggcatcctcccttttaaggaggtccccctctcctagaataagcaaggtggtactaaactccacatgcatgccatcccatgaggtgggcttttgtgatttttcaaagaattaatcttcgaatgggccttagcccatctattaattctaacaatcccccaccaaatctcaaaatcccactaagatttgccttttccaatgtacttttatataccagcggttcgatggagaccgatcaaggttgaacatccacctagaactccaagctacacttactcacaacttgaacaatggactacgtcttgaattacaagtcttatgcaagcaagtttcactcagagtcttatctggtactagaccgtctgtagactacccctcgggtggagcgtataagtcatactcctaggtctttaataagcttcctaaaagattcacccaaaatcttcatagactgcgaccaacagtcaagcttacaaaggtgagttctttcaagaatgctctgcaagacagcatcttcgctaattaaagccaacagaactcattaaggcatagccaacctgccttccagctcatgagagtacatgcatcttcacttagaggaccaacacatgtcttttctgcacactttgtcctcactcgtgtgcacccgggaaattcttcccggtcggtcacccatcccaaattgctccaggccaagcacgcttaaccctggagttctttggagattggcttccggaaaagaagttgcaacttgttgatatgagtattctattaatcctattaagccctaggaaaagaagttgcaacttgttgatatgagtattctattaatcctattaagccctaggccgggatgttacaccctcacccccttaagagagatcgacgcccccgtcgatcaaccctaggctaggaacgtcctctcttggccacgtccatgtgtccagtgccagcgcagcacgcttaaccctggagttctttggagattggcttccggaaaagaagttgcaacttgttgatatgagtattctattaatcctattaagccctaggccgggatgttacatatagattggtactctcctctagtttactaatggtttgttcttcccaggttctaattcacgggatttccgatcacatagactgggttaccaccatagtataactcacatgggtctcaaacccatctccttcgatgcattatctatcatatttcgtgatagtcccttcgtgaaaggatctgctaggtttctagctgtttggatgtaatccaacgctataactccagagtttctcaatttactgacagacttcaatcgtcttttcacatgtctagacgatttcatattatccttagaactattcactttgacaattaccgtttgattgtcacagttcataagtgacggagctcgtggcccctcaccgggagaccgcgcaggcccccctttgccggttcggccgggggcttagggtgagatctcaagctctctctgtatgtggaaagatcgcttgctaggaagaaacgcgagacacggcgatctatacaggttcgggccgctgcgaagcgtaataccctactcctgtgtttttgtggatttgtgtatggacaagttacaaaggattaactccctttcccctcagccttccaaaagggaaaaagtccccctctaaatgggcaaggtcctccttttatatctcaaggggataccacatgcacctttctctttccaaactggactgttctttttctctttaatgggcggagatcggtacggtttccatccgggagcccttctgatgggacaacccacacctacccccacctcccccgaagacagagatgacgcgggaccgtggctgtctgtcgatgacgcgaccagtgccagaccggtcattcttgtccaccacgcgtcagcttaacaacgtgcatgtttgcccttcttcgtgtaacaccttgcctgtaatggttaggatgaagcctggtataaatctgaccagggctaacgtgccatctctaagagataacaccctagctccggcttgagacgagtgcctagaggctttcgtcttgacgggatggggcaaggcgtgcgtcagaccgccagccgccacctaacccgtgatctgaccggtctgtgactggtcacagaccggataaaggaacgcgctgtactgcgttgcatgcagcgtgacacgcttgaccagactgcaataaatgctgttaggtgagcacagctgtgctcacttatcccatatatgtggcgcagacttccttaaggggtcggggtccctcggccctcggggccggggcaagcgcaacccgaccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacagtagcccccggcgttatgccagagcaatttcccttcccaagggaagcggtcaggtgtgacgccacccctaaagcctggtgacaggtgggaccggtctccgtagttgggcaaaatacccaacggtctcaatccatgcacattggtattggtaactttggttgtccataatgggcggtctattcaagactgccacaccacttgagcagcgcgcgaatctgggtgagcagattggtctcgcccggagatacggtaacgccgcttcggtcggcgagcgtaattaacgcgcacacgatacaatccatttcgattgccacaaccgcatatccacttcatgcgccgtaagcgggcgaatgggattagtggaagcgtgggcacgggaaacgagggagcgagatagcgagatacgagggagcgaggtagtgggcgcgagaaacgaggagccaggcccagcgatggcaagggtataaaagcatcgagaaaaggatttgcttccttcctttcgccattgttcctcttgccttcgccgcctgagctctaactctttctctgctacgccctactttcgccacacgcgctcgttctcaatcatctcttcctccaccgccatggcacggggctctgctctgctcgacggcagtgtactaccgccttcccgcatcgtgagcgagaggcacgccggactgccacgccgcttcatgccggagtccgccaccggtcgggagatagtgatgctgggcgaggggcgcccggcaccagactacccggggcggtccatcttcttcctccccttcgcaatggctgggctggtcccgccattttcttctttcttcatggatgtcctggagttctacgatctccagatggcgcacctcacccccaatgcggtgatgacattggccatcttcgcgcacctgtgcgagatgttcattggggtgcgcccctctcttcagctgttccggtggttcttcaccgtgcagtcggtgtcaccgccgtcggtggttggcggctgctacttccagccgcgggggccggtgttgaaccgctacatcccctgcgtcctccgcaagaagtgggacgactggaagagcgactggttctacacccccctcgccaacgaagcgcgcctccgacttccaagccagcccccggcgcaggtctccagctggcgggcgccggtagatctgggggaggactacgacgccgtcctcgaccgcctggcgggcctgcgatcccaggggctcaccggggccatggtgtacggcgattacctccgtcgccggattgcgccgctccaacggcgcgcccggagcgcctgggagtacactgggcctgaagactacatgcggacccaccagggagccagatgggattgggctcccgaggacttcaagatcgtggtccaaagggtgctgaatcttagctccgtggaggcgtctcgcattcctcaggagatcctccccctctgcagcgatcccgaccgcgcctccattctaaccattatgatgggggtcggggcctcagaggagagagcccctaagggccacgacggcgcgggcgagcgccgccggggggaacaatctgccccaggagggggtcgtgcttctgggccccgcgtcgggggctcggggagcagccgccctgccgacgcccaggggaagaggaagttgggaggaacacctcccccatctcctccccgagggggcggggcggcgcgtgccagcagtcggcgcccggagggggccgcgccgacgtcgcagcccgagggggagcgcaaaaagaaacggcttcgcaagacgggggagacggaaccatgccggggaaacctgatttcccctccaaggtggtcattcaaccgaccccctcgcaggttcgtctcactctcattgcaaccatctttctcccaaaaggaagctttttcttactcattttgttcgtcttctggttttttcttctgcttcagcgatgtcccgtcgcattcctcccgccaccccaagtccggccagtccgaggccgaagatcctgcggccgcggaggagcggaggcgagaatctgaccggcgtgaagccgcagaccgccttcgggaagctgaagaggccgcccgggaggccgcccggattcgccaagcggaggaagctgctcgggaggaggccgcccgggctgaggaagccgctaaggaggaggccgcccgggctcgccaggctgaggcaacagctgctgctggcgcgtcaactgggcccactccttcgggcaaccctcaggcgacagcctccggggaggctcgcgacgaggccgcgggcacatcgcctgggcccacctccccgggcgacgcccaggatcaaacgggtccgggggacatccccgagcccagcacgtcctccggggggccgagccgcatcgccttctctccaaggcggctcttctcctcatcttccgtcgccccgctgagcgccgagcccattctgcaggccttggccgccgcaaacaccgcggtgctagatgggttcagcgcccaagtggaggccctgcgcgcggaacgagcggagctcgaggccgcatgggcacgcgttgaggaggggcggcgctcggtggacgccatggtggaggtgggccgtaaagctcaccgccgtcacgtctcggagcttgaagcccggaaggcggcgctgacggagatcgctcgtgaggtggaggaggagcgagcggccgccctcatcgctaccaccacgatgattgaggcgcaagacgccctccgccttcaaaacgccagccgggaggcggagctgaaagaaaagctcgacgccgcccagggagtccttgactccaccgctgcccgagagcggcgggtaacagaggctgaggcggcgtcccggcggcgcgaggagtcccttgaggcccgtgctatggcgctggaagaacacgccggcgccgtggagaaaggcttgacggaccgcgaggccgccgctgctctccgggaggcgacgctggcggcgcacgaggccgcctgcgccgaggaggagtgcgcgctccgcctccgcgaggacgcactcgctgagcgggagcgagctctcgaggaggctgaggccacgaccaaatggctggcggacagcctgtcccttcgcgaggtggcgcaggaggagcaggcgcgccgcaatcttgaatgcgtccgcgccgagagagccgcactggaacagcgggctgctgacctcgaggctcgggaaaaggagctggacgcgagggcgcatatcggtggggcggccgcaggcgaaagcgacttagccgcccgcctcgcagctgccgaacacaccgtcgccgatatgcagcgagcgctggactcctccaccggggaggccgaggcccttcgcttggcgggcgagattgggcccggcatgctttgggatgcggtctcccgcctgaagcgcgccggtcggcaagcgggcctctggaaaggccagacgacggtgccccccaccaatctggaaggcctcgctccgcacctcaacaggatggcctgggttctcgaacaactccccgaggagcttgagaagaccatcaagtcatcctcgagggacctcgcgcggggagcggtcgaactcgtgctggcgagttaccaggcccgggaccccaacttctctccatggatggcgctggaggagttcccccccgggaccgaggacgatgcgcgcgcgcgggtccgggatgccgccaaccacatcgtccaaagcttcgaggggtcggcccctcggctcgcgttcgcccccagctccgacgaggagggcgacgccagcggtgaggacgacggtggcgacgaggccggcgacccgggcgcgttggaatgagcccccaggcccccgccaatctccaattttttctttttctttcttctttttgtatagatcaacttaatctgcaatcaaaaatgatgaaaaatttcttatgttaactttattttgctatgcatatgagttgaggatgatttgtgccgtggtccttttgcattttagcttgatttaagggctcgtgctcaagtcccgatcctcaaatggctcgggtcggggctagtgcctggggagatccacatgtcgagactggccaggccgggaacatggtgaccgagggttatgggtgacccgattgtgggtttttgccgattcccccccggagttcaccacgccccggggcacggctcggttctgggccccgcttggcgattttagctgaccgaaccgagcccccgagggtaaggttgagcacgagtgaccttatttcaagttaagattcttcagaaggaaaaacggcacagacacaacctttaggaaattgaaactgcttttattgaaatgctgaaataagaaaagtaaggctgtgcatgtgtggtagcccccggctaaccctgcacacccgaggggggtgcggggttagcccgagcccgaaacctgacacccgatcccccccgtcaggggtagaagcgacgaaggtgttcgatgttccacgggtttggcagctcagtgccgtcgcccgtggccagccgtacggagcccggccgggggacaccgatcactcgatacggaccctcccacattggtgagagcttgctcagtccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttctaagtagtcgaggtcatctctacgaagctgatcttgatcagcctcgcagtacatggtggcccgaggagacctcagggtgagctcggatgggagaaccgcttctgcgccgtagacgaggaagaaaggcgtttccccggtcgctcggcttggtgtggttcggtttgcccagagcaccgctggtaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatcttgacaaccggataagcctcgggccacttagtgaacttgtcgaccgcaacatacagatactcaaacccgcccggggcccgtttgaacggtcccaggatatcaagcccccagacagcaaatggccatgacagtggtatgatctgcagggcctgggccggctgatggatttgcttggcgtggaactgacacgctctgcatcgccggaccagatcgactgcatcattgagagctgtcggccaataaaatccttgacgaaaggccttgccaaccagggtgcgcgaggcggaatgggctccgcactcgccctcatggatgtcagcaagaagctcaacgccttgttcctgaggaatgcacttcaggaggattccgttagccgcgcgccgatagagggtcccttctaccaacacgtagcgtttggaaatgcgttgtacgcgttcactcccttcgcagtcctcaggtagagtcttatctgtgaggtatgtttggatctcagagatccaagcaatcaatctaagggagcttggagcgctcccttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccgtgagagttcgtcggctatcatgttatcccgtctgggcacatgccgaagctctatcccgtcaaaatggcgctccatacgccgtacttggcgtacgtaggcgtccatctgtgggtcagagcaccggtactccttacagacttggttaacaaccagctgagagtcgcctaacaccaggaggcggcggatccccagcccggctgccactctgagtccggcaaggagtccctcgtactctgccatattattggtcgctcgaaagtcgaggcggaccaggtatctgaggacgtctccgtttggagaggtcaacgtgacccccgcaccagcgccctggagagacagagaaccgtcgaactgcatcacccagtgggtggtgcgaggcagctgagaggggtccgtgctggcctcgggtattgagacggtctctggagccggggtccactctgccacaaaatcggcgagggcctggctcttgatagcgtggcgtggttcaaagtgcagatcgaactcagaaagctcgattgcccattttaccactcgtcctgtaccctctcgattatgcaagatttgcccgagggggtaagacgtaaccacagtgacccgatgcgcctggaaataatggcgcagtttcctcgaggccatcagaatagcgtaaagcatcttctgggcctgagggtatcgggtcttggcgtcccggagggcctcactaacaaagtagacaggccgctgcacctttcggcggggccgaccctctttgctaggggccgcatccccggggcattcttcgtccaagtggcctctcggggcgcactcgccttctgtgccgatgtcctcggggtcggaggatgacaggagcggccttcccacagtggcctcggggccgtcctgggggtcgggggctcctggcgtcgtcggacaagcgggtaaagggcctactccggtcgtcaggggcctcaggcctccgttcggctcgggggcctcttctccctgctttctcccgggtcgagtcagcacagggttagcctcggggccaaagggcgataggtgcggccttcccgcagtggcctcggggccttcctgagggtcgggggcatccagcaccgtctgacaagcgggcagagggccgactccggtcgtcaggggccttaggccaccgttcgactcgggggcttctcctccctgctcgctcccgggccaagtcagcacagggcgggggtgcgcgaaatgaggattgtcttcatcgcgctccacaaccaacgctgcactaactacttggggggtcgccgctaagtaaagtagcaggggctcatttggctccggggcgactagaaccgggggagagctgagatatgcctttaactgagtaagggcatgctcagcttcctccgtccaagtaaacggccccgagcgcttgaggagcttaaacaagggtagcgccttctctcccagccttgatatgaaacgacttagggcggccatgcaaccggcgacgcattgcacatccctaagtttgctgggggggcgcatccgctcgatagctcgaatcttctcggggttggcctcaatgcctcgggcagagaccaagaacccgagaagcttgcccgcaggtacaccaaacacacacttatcggggttcagctttatgcgggcggagcggaggttctcaaaagtttccgccagatctgaaagtaaagtttcttggttgcgcgtttttacaaccaaatcatcaacataagcctcaacattacgtcctatttggctacccaaagaaattcgagtagtacgttgaaaagtaggacctgcattctttaacccgaagggcattgatgtataacaataggttcctacgggggtaatgaacgcagttttttcctcatcctccctagccacgcgaatctgatggtaaccagagtatgcgtctagaaaacacaaaaggtcgcaccccgcagtggagtcgacgatctgatctatgcgaggcaaggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttccggggcctgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggcaatccgctgcctcggggcggtgggggcggaggtgccaagcctctcgtcaccaccctcgggcttggtcgcagcagcgaggtggtccgcgcgctgctccatgcaagcgagcgcgactttaaggtcgccacggacagagatggggccaccggggcccggcatcttcatctggaggtaggcgtagtggaccgccgccataaacttcaccaacgcgggcctccccaggaccgcgttgtagggcagactgaggtccgccacatcgaagttcacccgctccgtgcggaagttggctgatccaccaaaggtgaccggtaggtcgatgtgacctaacggccatgtgtgccccggcgtcacaccgatgatcggttgagacggctggagcaccatccccggggccttgatagcatcaaaggccgcgggggaaaggatgttgagagccgctcctccatctatgaggacacgccccaacttcacattgcagatggtgggggaaaccaccatcgcaatctgccctccccgggcaacgcacggtgggtggtcggtctggtcgaaagtgagggcaacctccgaccaccgcgcctggcgcgtcgcctcatgagtaggggccgcggccagaagctctcgcctcatggccttaaaactccggcgagaaacgtgagcacacgctcccccgtcgacagtggcaatggtggccccgggttcctggaaacctaggtcatcatcaccgtcatcaatgtcaacggcgggggccttctgtttggcctcacttcgccgtttaccggagggaactgccgcggacttgccctcacggcgttcctgcctcctgtcctcctcccacttcctcgttcgctcagccaagtttttgactgcgcgacaatccgcgagatcgtggagggaggtgttgtggacggagcaccacttgctggctgggcgctccctgctgggagtaccagcctctttctttttgtcgctcgcaggcctcccctttcgggtggcccgcggaacgccctcgacggcgaggacgtgaccctcgtcgccggaatggaccgaccttttcttcctcctcctgtcacgccgccctgtctgagcggcggatccgggggcggccgaagctgccacaccggaaccggaggggttccaggtccaggcctcctccttacgagccactcggtccgcgagctgaaaaagctctgcggtagtctggggctctttggaggcaatcttttcgagcatgcggttatgccgcacaccccccctgaacgcgtagatcaccgcgtgtgcagggatgcaaggtatagtattgcggacttggcagaaacgctgaatgtacgagcgaagggattcatcatcccctcgctgtactgcgtgcaagtccgcttcttcacctgggcgtggataagtgccttgaaagttcatggtgaactgctggcacagatcctcccaggagtggaccgacgcgggtggcaggttcattagccaaccccgcgcctgtcccttcagggccatgggaaagaaattcgccatgaccctgtcgtctcccccagcggcctcgatcccggtcgtatagacctggagaaactcggtggggttgacgctcccatcatacttctcggtgatggtgggccggaaccttgggggccaacggacattccgaagactcgccacaaaggctctacagccaacaccaccaaccgggggcacggagggctggtccttacgtccatgtggaggtgacactctggacgaggaggcgccctccgttgcacggggagtacgccggccgttacgccggcgctcgatgttgaggcgggcatccggctccccatgctgatcctcccgagtcgaaggcgtcgacgagggagtggcagccgaatgacgtgcagccgccgccgctcgccgcgccctccgccttgatgacacggaaccggtggtggcggcgccggaggtcttggtggtggcggaccgtccaccagcacccaggcgctgctgtgccgtcatgaccaagttggccacgtcgtccagccatcgctgggctggagactccgggtcagggacgacaggcgggtgacgtaggagcgcgccaacagcctggagcgcgccctgaggcgtgctgccgtcaccgtagacgaggaggcgacgctccccatctcgccgttctcctgcaccacccgcgactagcgatgctgcggatttttcgactctctcgagtgcctccccctgcttaggattttggtgtggaggaggtgggggagtacgagctcgacggcgtgggtttggctccccgtcgtcgccgctcacactcggagagaggtcgtgcgcctttgcttgctcggccattaggcagaacaagggaaacttggcgcacacggaagagtatgagagctcagaaaacacacgctgagccccctacctggcgcgccagatgacggagctcgtggcccctcaccgggagaccgcgcaggcccccctttgccggttcggccgggggcttagggtgagatctcaagctctctctgtatgtggaaagatcgcttgctaggaagaaacgcgagacacggcgatctatacaggttcgggccgctgcgaagcgtaataccctactcctgtgtttttgtggatttgtgtatggacaagttacaaaggattaactccctttcccctcagccttccaaaagggaaaaagtccccctctaaatgggcaaggtcctccttttatatctcaaggggataccacatgcacctttctctttccaaactggactgttctttttctctttaatgggcggagatcggtacggtttccatccgggagcccttctgatgggacaacccacacctacccccacctcccccgaagacagagatgacgcgggaccgtggctgtctgtcgatgacgcgaccagtgccagaccggtcattcttgtccaccacgcgtcagcttaacaacgtgcatgtttgcccttcttcgtgtaacaccttgcctgtaatggttaggatgaagcctggtataaatctgaccagggctaacgtgccatctctaagagataacaccctagctccggcttgagacgagtgcctagaggctttcgtcttgacgggatggggcaaggcgtgcgtcagaccgccagccgccacctaacccgtgatctgaccggtctgtgactggtcacagaccggataaaggaacgcgctgtactgcgttgcatgcagcgtgacacgcttgaccagactgcaataaatgctgttaggtgagcacagctgtgctcacttatcccatatatgtggcgcagacttccttaaggggtcggggtccctcggccctcggggccggggcaagcgcaacccgaccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacaataaggatagccggcactggtttttcaacaataagcagatccattaatagatcacgcagccattctgcctcaacagtagcagtatccagtgccgtcagttctgcttccatggttgacctcgtcaaaatagtctgtttgcaagacctccacgaaacagtaccaccacccagtgtgaagacatatccactagtggctttgatctcatccacatcagagatccagttagaatcactatatccctccagtactgcaggatacccagaatagtgaagccccaattccatagtacatttcagataacgcattactcgctcaagcgcatgccagtgatcatctcccggattagaggtaaaccggctcaacttgctcacagcaaaggagatatcaggcctagttgcactagccaggtacatcagcgagccaatgatttgggagtattccagttgattcctaataattctcttgttcttgcgaagcaacaagctaggatcataaggtgttggagaaggcttactatcaatgtagccaaaacgattcaagatcttctccacataatgggactgcaagagtgtaatcccattctcacctctaattagcttaatgtccatttgataaacaagaagaccatgtgaggctgctagggaaagtagcacacgaattgtggtcaatctagcaacaggtgagtaagtgtcaaagaaatcttcaccttctttctgagtataacccttagcaacaagccgagccttgtacttttcaatagtaccgtcaggcctgagcttcttcttgaacacccacttgcaccccacaggtttacacccatagggtcgctctgtcacctcctaagtcccgttagcgataatggaatccatttcactacggacagcctccttccagtagtctgcatcaggagatgcttatgcttctgaaattgacttaggagtgtcatccacgaggtacacagtgaaatcatcaccaaaaatacttaaccgtcctttgtcttttgctccttcgaggagcttcactgtcatcctccttagtaaaatgttcatgtgtatgttcagtttgttctggtggtgtgattgaactgggaattatttcagagggttggctagagctactatgtgtatccttcattgggaaaaagctctcaaagaaggtaacatcacgagactccataattgtaccaacatgcatgtcaggtacctcagatttaactattaaaaatctataggcaatgctgtggtgagcatatcccagaaagacacagtccacagtcttaggtccaagtttgcgcttcttcgttattggtacattgactttcgccaagcacccccatgtgcgcaagtaagaaagtgatggttttctcccaatccatatctcatatggtgttttgtccttatttctattaggaactctgtttaacacatgattcgaggtcaacaatgcctcccccaccatgccttaggtaatcccgcggtgtccaacatggcattcaccaagtcggtcagtgtgcggttcttccttttagcaaccccattagactagggagaatagggaggcgtcctctcatgtataatgccatgttcctcacagaataagtcaaactcgtttgagaaaaaactctccaccacgatcagacctaagtctttttatctttctgtcaagttgattttcaacttctgccttacaaattttaaaatagtatagagcctcgtctttcgttttcaacaagtacacatagcaaaatctagtagcatcatcaatcaacgtcatgaaatatcgttttctacccttcgtcaacaccccattcatttcatagagatctgagtgtaggagttctagaggtgccaagtttctctcctcagcagccttgtgaggcttgcgaggttgctttgattgcacacaactatggcacttagaacctttgacaatggaaaacttaggaattaaacacatgctggaaagccgagacatcaagccaaaattaatatgacataaacgtgagtgccatacattagcctcatcatccacactgccacaaatatggttcacagacttattgcagaaatcagaaagggaaaagcggaacagacctccgcactcataacctttaccaataaaatatccatgttaaaacacgactactttattagactcaaaaaccaacttaaatccgtctctagtcagacgggagccactaacaagattcttgtcgatagaagggacatgctgcacattcttcagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggcccctgtatcaacccaccaattagtagactgattaactgaaaaaacagtaggtaaattaccatacccgcttccatctccagtgttgccaatggtcacattagcaaacttagaggtctgccctgcaggtgtcttcatccccttgcgttgtggacactttctggccagatggccaggttgaccacacacaaagcaactcctctcatcctgattaggattgttgttgttgttcttcttcttgaagttggtggtcttctaagctttgtatttccccttgctcttgtcctaggccttgtgcacaactttggcagtggactgcccaccatcgcccttagacgcggcatctttttcctgagctttctcctcaacatcaagagatgctatcaacccctcaaaggagtattcctgtctcttgtgtttgagtgcagtaccgaaatctctccaagatggaggtagtttcgcaataatacacccggccacaaatttgtcgggtaagacacacttaaggagttcgatttccttagccatggtttgtatctcatgagcctgttcgactacagaatggttgtcagacatcttgtagtcatgaaactgctccatgatatacagatcattgctagcatcagtagcaccgaatttagtattcagtgcatcccacaactccttagcgtcggtcatatacatatacacctcgaccagacaatcgccaagcacgctaagaatgcatcccacaaagagagtagtggcctcatcgaattctttctgctgatcagcattaagaacgcccataggcttgccagtactcacccagaagcatttcatagctgtcagccacagagtgaccctgatctgccatctcttaaagtgcacaccggtaaatttatctggcctcagtgcatcggcaaaaccagccatagtaaaatcacagtgcgtataataaggtttttggattgttgagaatatagacatataatgatttaatatattctataaataaatcatgacattacagatgtatactagcattaacgcatcattagatctacacatgtaaactaagcagtaaaacatgaacagatcaaatatgcgcaacatgtcgaacacgtaccgaggtggcggaaagaccgattgctcggcaggaactactcgcggttgcgagcgtcgacgaaggcgcgtagcacgcaagcggagaggaaggcgagccgtcgcggacgaacagggagcagtcgcgcgaagtgcttcccaaaaaccttattgccgccttctcccggtgcaagacgtcgaaggcagaggttccagagacctgctctcccgatcgcaggtgcacgacggcgagcgggatggagtagtctacgagtgacggcgcagcacagaggaggaggcaaaccctagattgatttcgtgtgttttgcgtgaaggcggcggctcggtttatatagagataggtcgcttgatcagggcgcccgcacgatctccactccgcacaaacgaaccggataagtcacgcgtaacttatccggactccacgccattttcacgcaccggatttttcggagtgtttccaaaacaaaacaaatccgaattttcctgcagcaaaacaaaactgcaaaaggaggctgcatctgcgcaagggtgaggagccaattttgcggaccattcgacgcgtacgtcgtgcacgcgcgccacctgccctgccaggctaggcgaggcgagcgagcgcgtgttccccctcttctctccaccacacatgcttcaagtggctaggagggcatcctcccttttaaggaggtccccctctcctagaataagcaaggtggtactaaactccacatgcatgccatcccatgaggtgggcttttgtgattttctaaagaattaatcttcgaatgggccttagcccatatattaattccaacagtgtgtgtgtgggcgcgcgctaggccccctttgattcaaaggaaattcatagaaattttagaggatttcattcctatagaaatttttcctatatagccctctgaatcaaaggaatagatcttatagaatcctatgaaattcctatggagtgcctaatgccatgcaagttttggaggaattttaacatgaggtagaaccttatggaaactttccttcgagtctttatctctcctctaattcctatgtttttcctgcggtccaatcaaacaataatttctatgtttttcctgtgttttgctatctctattttacacttacgttcctatcaaaatccaacgtttttcctattcctatgttttcttattcatgcgattcaagggggccctaccgaaaccctcctgccactaagagagtgtttgtgagtaggggaaaagaaaagattgagaagataagctagcgcataattaattgagtattaattcttttaaattttaaaaattaattgatatgagtttttaaagcaacttctctaaagtaatttttgcaaattaagcactatttaatagttcggaaaacgtgagcaggaaaaatgaggtaaatctcaatctactagaacgaacacaacctaaatattactcccataattaatcaatcaagattattttcattcttaatttacttaaaaaccttatacaattaataagtagggttaattgatgagtatgtacgtcttgctcagtatttttcaaagaaaggatatgtttgatagagctccaaataaaaaatggatatggagttgtgaagctaggaaaaggtcgtgatttacttttccatgtatttttcccagtagattcacctacaccgctctttaaaaatattaaaaatttaatggtgtttagtttggctttagcttcactagacaatgattcaggggatgggtcctgttaaatagcccgaaaacatccaaaacagaaaataatattgtcttaactacatagaagtaaggagtgaaatacatggccggtccttaaacttgtggggtggtgtcacttagatccgtgaacttgaaaattgcacgtttagttccgtgaacttagtttaatgaaccacacctggtccaatcatcctttgaccacgtttgaccgccaacgtggcatgccacataggcaacacttttgtgctcagccccctccacatatatcttcgtacataactttccctaatcagtgcatttcaacccaaatcccctaaaatatccctaaatcggctaaggtttcgacggtgaggttagtggaaggaggtcgagaggtagtggctgtggcggactcgacggtgagattagcggcaggaggcagcgtggtgcagcggggttagcggtggcacagtgcggtcggattagcggccggaggtagtgcaatgccgcttgcacactaggcatccccatggattctccaagctcgtccttgtcttgaagtcgtcggaagaaggtgttgttgaccaagtgcccgttgtgtaaggataatgtcattttggagcgcagagcaatggcaattgataatcaggaccacattttctatacatacaaggagaaaattgagagtgaagaacaatttaaggattttttttgggggggggggattttggtgtcactgaatagctacaaggagatatatgcgacgtgttgtgatgtggagggagttgagagcaaaagtgttgcctacgtggcatgccacgttggcggtcaaacatagtcaaaggatgtttcgaccggggtggtacattaaaccaagttcacggacctaaacgtgcaattttcaagtttacagacctaagtgacaccaccacacaagtttagggaccggccatgtattttactcgagaagtaagtgtaagtagtgttacgatccctttcggagccacaaatacctcatttcacgactcaaacgtttgtcctagaatgacattaattttaggtatgaggtctgcattcgccctctttgtgttatcctcatttctcttctcttagatagagaacacaccatcacctacctcaaaccgtcaggcgtaaacatcattaattagttagagcttaggcatgtcaaaaatctaggcgagcatatcaaagcacaggagaaccattaattcttaatgaaaggcatattcgcacattcgacccattctaatacgcattagactaacttaaaaaaaatcttttagaacgaagaaagtataggattgtaaagtataggatcgtataggatcgtaaagggttgaggtgaggggctcccccacttttcacaaccaatgcgggattattcaacaatctttccctttacacattagtgtctctcaacccttcaccgttttcctatggtccctcaggtatacaggtcccgcaggcacacggtccatcaggactttacacgtatgtccctcgagccagagatgttaaactagccaggctctgatacccattataggatcgtaaatggtctttctcaccctaaaaggtagcgaggggctcacccacttatatattgtcccttaatttttcacaaccaatatgaatctattcaacggagaccaaacagtactttgaaagtatgtagacgcatatactagaaattccgattttaataatcggtcgtctattagcaagggccccctggttttccccctcacgagcactgcacaatttcctgtagaaactatagcgatattgttgcaaacatatgtccagtaattcttttatcacaatgtatacagagctttactatcatttccatatatgtccgtagcagccatcatccctagattatatatatatatatatatcaaggaagatatatatataaagccatgttggtaaaaacaaaacaatgcaagatgcatacatatatttatggtggggatcgagtacatggcatggcactgttctaccatcatgtgtatgagacaacacgaaagtctgcagtgctaagttaataatgcatggccacaatctacacaccatgcgtacgtggggatcctttttgctaaaaatacaccatggggatcgactactgtttctacaggatcagaggacgtttttcatcttaatttttcaaaaataaaataaaatgaaaggatgtacaaggacaacttcgtctctatgcacacgcaacacgtactactattgagaaagtaattaacacttagcgctgtcggctcatttcatacgctagctagctagttagtgttttttttaaaaaaaaataatgtgaaagtcctgccatatccgctgcatcacaaatttaaagaatataatcccgacattattcatataacaatatattattaaagaaaatcctgttattaaatttgtatccatgattggcaaaaattgcatgaccattatctctaaataacggcatatatatcttacattctttgctagttcccttcacacctttgcaacacggcctagctagctagaaccgcaaaagaccaatatgcatggtcacctataaaaagtacttgcatatataatctaacataagatttatcaaaaacaaattcatttcgattttactgcaaacccccaacataatgcagatggcacaactaacaatactgacttcaaagctttaatttactgatctcgatcgcacaagcgtagtgagggcagtgatatgacgagtagccccgtactaatttcacattggatctgatgactaatactccgatccgtattagtttagttaagagagtggtggcttttcagtttaagccttcagtcttttaaaattaatttatttttctaagagaaatttttatttaacttctctgaccacaattatatagtacaacaatctaaaaagttttgggtgtcaggcatgcagcgcggccagcagctagctggcaaagtggcagagtttgatttgttaccactgatgactgatccgctcatgcatcatgcatgcatgcatatggagtatgtttgtttgtatatatatcatatcgatcctgaagagatctaccatatatctgacagatccaagcaatcatggatctcgatcgatcggtagatgcatgaacaacgacttccataagccaaacaacttgcgaagccgatcgatatatcattttgaaggactgtccacttgacttcattcacaatatatgttgagctatcttgtgttgattggcaggcagggacacaagctaggcaagcggatcgacctaggatgggctggaatttctttctttctatgagatggtccggcccaacaattaatccttccatctgctctgcataagtgggctggcttactatagtatagtgggactgaaaaaggaaaaagaaaaacgaaaaaattcgatccatagcaactaaacaacctggtaaaaaatatactcgcattaagtttcctgcttcaactagaagcatagaccaccggtttttcttcgatacgtagcactttcatcacattttaagctaacggtgttagattagagtaaagaaatttatcctcgaattattttacccttcgttttcctcttacatgaccaggtcatcgaccaagctgctatgccttgcatccctcgctctgtgcaccgtcgagcaagtagcagccgtcgtcaccccattgagtctctcagcccttgtgttgataggttgcacacgtcaagccagtcttttccgctaacgaccattctgctctacctttgcagccctcgctctatgcaccgtcgaccaagcagtcgctgttgtcacccgctgagcctctcagccctcgtgcatgttgataggttgcacacggtcaagctagtcattgccgctaatgaccaagccgtagcgccttgcagccctcgcgcaataagcaacccatgagcagtagtcgctgtgctttgctgtcacgctcggtcaagctacttgcaagctggcgctgcagttgtagccccaccgcgcctcacaagcagtagtcatcgttgtcaaccaagccgttagagattgatgccccgggagcggtgccaacggtttcgagcacgaaagcaccacccagaggcgagagggaggagctgaggtccatggggctgcaggtggagaccgatgataggggcgagagcatcggtgttggtgacgagggtcgtagatccagccgtctgtgtagacataaatgatagagaggaggtgtcgagattggcaggcggagacgtagctggcgagggcaaagaggacttggtggctaacatggaacttttggcgacggaggacgaggacgatatgtaacaccctcgtcacatttaccatttatacatgtaagttgggatgaaaagcaaaaaagactatttgctcttgcttctctctatatagcatcgtaacgagggtgttacatatcgaagaaaaactagtgacacttgctgccttctagcgaagaggggaggaatttttatgctatttttttttcttttttaccgactgttttgagagtgctaggggtgtgaaaaagaaaaggaggcgataaggttgggaaaggaggaggaaacggacgccacgtcacaagatgagagagagagagagagggtcgcatcacatcacatcacatgatgctgctggggctgcaactgaagtccacggcccccttgtgcaagaaagaggaaagaaaattccaaaattgcttcacgcacccccccacccacacaccacgcgtcctccaccgtccgatctccaccgcccacagcccacaccacggtgggaacgggaacgcggcctcccctattcggcgcagttgctatacgtaccccagcctcgtacacaacgccttccccctcccctcctctcctttcctctcgcccaccggaatcctcctcctccgcccctaggcaaggcaaggctaggattgccgcccgccggaatatctcccccaccgccgccgccctcccgccggcccacgggattggattcgcctctttacaaggcctatcctgccctctctactaccacccttatcgatctctatctggtttcctttacctttcgatttgattcaaccacatcgaaatcgattctatctctacccgcgacgcgatgaccacctcctaccggtactgcttgctaatcccgatcccaccttcctctctctcttgtgcgctccatctcttgttattttactactatcatcttcagggcttggcttcgattcgttctaggtttttcttttcttttcttttctttatatatactcttggtgttgttcttgtatggtccgaaatgatccatgttgattggggctctagactgcacaggcatatgcatccaatatcttcttctaggcacaattaatttaatttcttgtgtgactctaggatctaacctcgattggtggatgttaactgctagttccctgtgttgctagtatgttctcttcatccttcactcattacatgtcatctaaaaggtacatgtttcatgtttcggcggtttagggagcgttcttatactaaaaatcatcatacatgccctaataaaaattatatcttcccccccccccccattactgcacctattgtactgctggtgccataaataaaccaaatccgcattcatcacttgctaaacaaaccattgcaaactgagtttgatttactcaatgttatggatggtgcttatctaattggcataacaagctttgtgcgtcagggttcatcggtcatcatccagctactatattcacaactcgtgtgatggatgtgcttacgtgctttccagtgccatgggatcgtattgtggccttcatcttggtttctccaccaatgtccgtggggaggaaccatggccaacaatggaattatgttcttcttgttgctggagcaccgttatcttcttctcctattattttctgttgccgccttcttctgtgccaaccagccacaccagcagaagttgtgcttcgactgatggtggcgggaagcacaattaattgtgcccttcatttcagagcatgccgaaaaatctccttcccctcttcagatttatacttactgccaacaatgatgagtaccatacatgctaatcgtatagctcctttaatagcgagttactaacaaaggagtttaattttatgccctccatgggggcttatttttaaacgaattgattttatagttaacgttcgcatcactcaaccaggatgtatgctttaagaaatataacatgattgccatgtaaaacgcctgatgcactattatcatatttcttgatgagttgggtcctgaagaaacatttttttcagttaaaatagccatccatcaaactttttttttgttaaagaaaataaactatggctgacaagatttccatgttcttaattgctttcagtctggagtgctttctgatctctaagactagtgttctcgtaggctaggtggtcacagtagtttaacatgatgtccatctagtataacaggactcgtattttttttctataattgatgctaagatttatatatcttctcttatcttttgttttagttagtcaacattttagccttacaagcatagtttgtcgtatcctttttggaaaataaacggcctatacttttctgttgatatctgaggaggtgtatggcctgcgtcaaatttattcacctgtggtacaaaggttttagctagaatctcgtgggttggctatgaatgatatgtgcaagaatatataattgttccagacataaattaaatattgcctgtctcttgtactctttatatatacatctttatgccatctttattcctttttttttcctcttggtctcaggtgtatttcacttactcttttggatagcatggcttatatcggaactacctctatgctaacattgtctaggtctcattagctagattaacttaactgttttcacttagtggtgttagtctgtaaagaaaatgaatacccagtcttagttgagtcttttgtaaaaaaaaaaaatggaaccaaagaatgcaattgcactggatgaacatgtgctggattctactatccgcaagaggaagcgtgtgggtgctactcaatgtgctgaggccaatgacgcccccaacctctctcagaatggtccaaaacagaatctcgctttatttcctgattcgactggacataagaagtccaagatgatgtgctctgccgatgacattctggagaggtacaataacttcaagataagcgggatgcctgttcgtgtgatgtctcaccaacatggtggatggagagacttcccagaggatgttgtcaattcggtacagcagagcttccagttgaagaggccaattactagtgcagtattccagaacaggcacatcctgttggacttcatgcagatggtttgtttagattctgtgatggccataagcaagccaattgcttggatcgatgatcatggtaaatgcttctctccggattcatgtgctggagtaataccatctgaacctctgcagcatggaaaaaatgagttcttgaaaagttttcatgatctaagcagtagttatgaagctcatgaacatgatgggatgtctgcagctgaaagctcaagttcagcgtcttttgatgcagtgctttctgatgttcaggaggtcaataatgtagtggaggacaaacagaaggtactcaatgaaagtggtgaagtttctggggaaaataaaaagggccatttaagccatatgaatgaaactgctgatggggccatgcaagctcctcgtaataatcaaagtgtccagcgtgctgattcagctgttcggaatttgttgtttcaaggatcaggccatctatttactgaaaaagacatcatcggtatttatagaaccccaatgctagatcaacttgggaggtcccgttatagtcttttccagaaggaggtacaagtcacaaaaaatcaacggggaaatgcaaatgagcgttatgcatggcttgcttgcactaagggtactatggaggagatgatgatgaatggtgctttggaaatagcaaaacctctgcagggtccaatgtatggtgttggggctcatcttgctccagcaaactcctccaatatctggtaaataccttttgtttctgatttatttgttctatgtgctcttacgcctctggtgttactgcttttgttttggatgtatagtagcctatgtcttacttgaagtttgtccacagtgttggtttatctgatattgacgaaaatggaatcataaggatgatgttgtgccgtgttataatggggaatgttgaggtggttttccctggatcaaatcaatgccagccaaccagtgaaagttttgacagtggtgtggatgatctccaaaggccaaagcattacatcatatgggatgctaatgtgcataagcacatttatgctgaatatgctgttattatcaaagtaccttacatgaacaatggtactataccatgttttttcccctctcttttttaccttgtgtcgttattttccatttgccctagataacttattttatattactgtatgctatttggttacaggagatactgcatccaatatctctgagataagaaattctggtgcactagacaatccaaccaaggtatgcatattatggtttagctggtgtgctgttgttcactgaagcataattcagttctgtcatgtagtacgttttgcgggaaaattgaatttgtctcacctaggcttaatgatctattatgtagtgtagtggaaagggtgaatggatgcttagacttgaaggcgtgttttgtgcttctcgttatgggatttgctcactttattagcgaaatttccagttggcgtttaaataggttcccatttattactgtttccgcagttagtgttctttaacccgaaaaacataaagatgacaattactatatctctttatattttggttatggcctatggcagatccttattgaattccactcttgtatttcttgacttgatggtgatggaatttcatatttttcttcatttttgttgttgattagtaccttttaatgtctgatcatatatggtagtggtgtaggatgggggcgggaagatcaaagaactttgcttagttatgtgtttccttcttgctgatgctctttggatgtaaatgaaatttactgaaatggattcaggttctgttggcccaattcctctgcttttcataatttgcagaaactaatccggttgatttttctaaaagaaaaactggttcacaattgaatgattgataattggcacttaatgggcgagcttagttgaccttgattttgatgacagttttaggaaaaatttcatcttgttaatttgttgcttgcttgttgtgagcaggatgacagtctacagaccattgcgtcttcaggtgatgaacaacaagcatgtatgcttgggcgtgctccaagtccaaggtctcctagttcaccttggatgcccttttcaatgctttttgctgctatttccgctaaagtaccccgttcggacatggatctggtgcataaatattatgaagaattcaaggttatttgtccttcctttggagattttcagctacatgcaatatttgtttgctggcatgctaattatggtatggtttttgatgttaaaatagaggagaaagataagcaggcctgacctagtgaagcagctgagacagattgttggtgacaagcttttggtttctacagtagtgagacttcagcagaaggtacttcttttttactgtgctaactctttgtatacagttcacttaggatttgaagtcctccatcctcactcaatgtgaagcctgctgtgtatatttgaggaagcgtggtacatggaattatgcaatcagctaattgatttttttccccaaaggaccacatatcatgcttagtatgcagcatggaatccgtagcattgtttcataccgtctaatgtttgagtttaccatttactaatttccactatattattcaaacatatgtttttacttactattgatacctgccgcagttgccacccatggcagcaactgaacaagcgccaagagcacctggaaggggaggaggtgctagtccgtaattaaaaatgacagtttgccgacataacaagctgtggaggagtcgggttgagcaaagagagctcaaggaaatgtgtgtaaaacgtttgtgccgtaatgcacagactttagctcttgacaaacaaaactagtctaaacttccttgttgacaacatgttgtttggttgtataaccatgcatggtattctcgactaccggctgtagtgttgttctttttcgccgtcaaatgtagctgcggcttgaattcatcaatatctcctgtggatatttcgttcccgtttcttgcagcttgtgtacaccattgccttcattctgatcctggggtggcctcgcttgaacttagtaatgctaggtagtagttgcagcatgttccatgaaatggaagcaacaacttgagccttgatctaggtttacaaaaccgctcggttatcgtggttatcatatgtggtgagctttttagtttttgaaaccacgatatacctaccacgctgttgtcatggtaaccgtgaggtgaggtaatcttgtttggttaaccctagctagccttgatcatgtacctaccacagccttggtcatgcacctaccacgcaagcagaaatctttgacaaaaacttgtatgggctgatctgatgctacccacatccattgtttgcgttttggcttattagctgcaactagaatttaaattttaaaacttgattttaagttaatttaaggttttctttaacgcagtttatattctattagtattaggctttttagattatatacttagactattgaaacagattatttactataccattcgaaaaatacatattcttatttttttttactatttgttttgagttatttgttaagtttatatattaaaatatttaatttatctatacaatttagtagataatttacaactacaatctgatgaataatctgttttaaaccgagtcaaatcactaaggatattatataagagttttatgtataaattatttttagttgcttcgtttattttttctttgactttgtcagctgtaaaacaagcgttccagaagacagaaaattagttatatatatatatatatatataaaattcaaggctgttttatatactccctgtgtttcaaaataagtgtagttttgcactattcatattcaacattggaccgttcgttttatttaaaaaaaattataattagtatttttattgttattagatgataaaacataaataatattggtttcaataggactccttacgagcgttctttctatctactattatctaaaaatagtcaagttattaatgactagacgaaaccaaaaaataaccccttatgtacgaaattatagaagatcccctttaagatcaaacaattccatcgaattgagtatgactgtatgtgtgatagcatctactatatcaggaatatcaatgaaccccattcttgcaattgctcaggataccctcttttagctgctaggtctatttcttagttcaagatccctcttaataactggaataaaagaattagtagatctgttccgcccaaaatgggaatgggcgctagggttatgaacttataatcatggaatcgactcgatcatcagattataagttcattccataccggaccagaccgtgcacattcttattataagaagtggtcattcgagcctatggaaataggatactctgtttacatagaaatccccacgtccttacattctatttaggattaggaataggtgtaatcagacctgcttttgacatatctattctatccttatttgggtaccatatgcacctctttgggcttctattgaatcgagaaattggattgtatatctttttgattttgatacatataaggtgtcctacggataatgcaaatcgaagctatttgatgtctgactcaggcctatatgaccgatcgaaatactccaagactccacctttgtcatatattccatatatcacattagatagatatcatattcatggaatacgattcactttcaagatatcacattagatagatatcatattcatggaatatgattcactttcaagatgcattgatggtgaaatggtagacacgcgagactcaaaatctcgtgctaaagagcgtggaggttcgagtcctcttcaaggcataatacggagaatgccattcaatgagcattccccgtagaagtattccggaaatctgcgcctggcgctctcctctatcttctgaggtccttaaccacttccctgagaaaaggagacagtaaaagccaaaatagactaaatatagcctgaacgatcctaaaaatccctcgaaggagataatataataaagaacccaaagcagacggtatcctactgcaagggtggtcttaagaatccaaaagaggttgctcagaagagatagatgtatcccaacctctattgctctcgcgtaaagccttttttttacgcgagaggaaaaagtgactacgaattcccctttttgtttgcgaatccctgtttgtatcctttgagcgcacgcccataagtagcgatcaaggaaatcgatcaaacgatcccaataccgtgaaagagaaacttcccagatccagggaagcttatcataaagggcttcgacaaggggttctattcgttctttgagcaaaaagataaagatcggatagattcgaaccgcaattgcaaaggtaatcactactatgccagcctaaatcatgatcttcaccaacttggatttggttctctcgcgaaaatcgcgagttgcagatatgagaacctttatgtgtgactattttttttaattttttcataattttttcaaataaaacggacggttaaatgttggatacggatatccacggctgcacttattttagaacagaggtagtataattcaaagtttataaattatcacctgatcaaatgatatgtctgttaatggatagaaccgaacaaccagtccacatgcgcatccgcaaccaactaacaaaatgtgaattatatattctcaacttgagcatgtcaggggaatgtttttgtgctggagcacctagctagtactgtatataatttcggtgagctgatcaaatttagaggtggatttggctgaattattgaacatatatatttcgtcaaaaaacatataaatttatatcgatccttatatatatgcatatatgtaagtatgggacaacctagagcttacaatgctagtactagtctgcaggtatacctaaccctaaccaatcagctaatcaggtcgatggttgcaccgtcacatccgttattatacagccaccgtacgtacgtatgcaaactcctactacatgcctgcgcatgtgaaatgccagcatatatacactggcctctactactgtacgaccgtcaattgttgcctcagctgcattttataggtgtatgcatgtactgctgtacagggggtgtttaaatccagggtgtaaaatttagacgtgtcacatcgggtattatatagtatagagtgtcgtatgggttgttcggacactaataaaaaaactaattgcagaatctataagtaaatagcgagacgaatttattaagcataattaatccgtcattagtaaatgtttactgtagcaccacattatcaaatcatagagcaattaggcttaaaagattcaactcgtaaattagtcacaatctgtgtaattagttattttttagcctatatttaatactttatgtaggtgttcaaacattcgatttgatagggtataaaatttttgtggggaactaaacagggccatagtcatatatttatgctggcttctacttcctccttcaatttatatatcctctttacattgatgccatacatatgatctcttcatctgccgagccatttgaagtggatatacatattgacatggaataaataatttatatgctcgctcgccgagaaggaaactgaaacatatatttgttagttaatctgagccttggatgagcattaattcatacatgtataccgaaggaagaactacatgaaggaagagttgtgactaatatttatagactgaactaaccgcacatgcagcttaatgataaacaagcactagcttagctagctagctgcattacaatccgtgtatgattagtttgtttcatacatacatacacatataaatgaggggaaaaataaaatctgttcataattttgtcctctcattagaaggcttaattgctggctggttatttggctaacgaacccacatgccatatgaataagtggtttaatttttatctgattgcgcaggttgcaaccaaatgctcctagattaattatcaccaacagataaggtgaggccagcgggataaattaactacttgtgaggttgggtatgttgagtcttcagaagtcgttatattttgagataaaagttaaacttcagcggtatttaatttatattttggaacgggcgagtaattactttgtggatatatatgcttaagctaagttaatttgtagggtcgggcgtacgtggatggataagattataagagagggacctgagctgatgctgcagatgataggggccacgaaaatgaaatgtgatacatatatagcagaggggagagactatgtatctagctgcagcctgcaggtttatatcaacctagctctggagaagcagacagagagacagacatacaggcatcatccttgatcccatgttacacgggggtctctctgtccgaaacctgaatgtccttgcattgcgttgcattgcattggggccttctgaactactactctaattaatcatgtcgtccacatgcatgtgcttggctgaatgagcagctgcagcttgttaattagtactccagtttgctaacccggccgtcaacggatatgggagattattatcccttgccatgttcagacaacagatatgtttcgtagccgtgacatagaaactactagttcaaactgcagatatatatggataacaactctgaaatcgtaatcaatcgccttgcatggctgctatggcagtgggtcaatgcaagcaagaaagaaagattaattaacttgtatgtgtagtattcgcacagccgttccaaacaccacctaattagttgttaataattaataatgtactgaactatcaagcaaattaagctagttccatgagtgagtaggagtacgtcagtacgtggcccgtgacggtaggtaaggttccctttctttccttgtcaatcgatcaatctgctttcccttcctttcatccagggaattcaaggatccaagaatatgtacactttgctagcacttgcctttaatccatcagtccaactaattcatcacacagttcagttattagggaattatataagccaccaccacaaattaattggttcacaatatgtgtccagctaattaagatcaggtaccgctaattaagatcaggtacccaagtatagcatatgtttagtccaaattaaattaactagttcatgaggactacagcaagtaggtagcttaccaactctatgggtgaaattaaacatatgatctttttgtgtgttttgagtgttagttttcgactatcatgtctgcttgcatatatagatttttatcgatcaaattttgtgatgagcagagcagtcactgccgtgctagctaataactaacctgtgcgtagtgtgtatacgtattttctcataaatgatttgagatgaaaagaaaaagcagaggagaggagctagctaattaagcttgaattatatagataagtgcagtacacgtaagtacgtgacagggagcgatggagagacgaaagacggcgactgcacaacagatgaattgatggagtatgtatttaaaagcctcgctggcgatcgatcgattatattgactgaagagtaatctctgatggatcgatttttgaatcccaaaattaaacgatatgatatgatagagacatagcctgtatccaagttattcagttatacaactactaactcctgctgaacaaacctcatgaaaacttttaagccaaacaagtaattaatcatgcatctcatgagctcacaaatattatatgacgcaaccaaagctagcgtagctagctactcttgaagtggaggaaggaagaatatacatgtgcatatgtatgtatggtatgataaacttgactaattataccattggatcattgttaaccagaaatggtataaagaagacgcatatttttctttctcttgcgacggtgggcatgacagagacgcagcatatatagatggatggcatccgaccaactccaattggcgacgtcgtcttccttctctttccgcccgccacttcataccgccctctactcttgttgcttagctacctagctagctagctttcctctccactccatccacccacgcacctcaatcgatcgatcctccatggcggcggcggtgctggcggtgctgtgggcgtgcatgatgatgatgagcctagctccggcgagcttggcggcgtcggggttcgaggaggtgccgacgatcgcgttcgacgaggggttctcgccgctgttcggggaggacaacatggtgaagtcggccgacgggcgcacggtgagcatcaccctcaaccgctacaccggctccggcttcatctcctccgactactaccaccatggcttcttcagcgcctccatcaagctccccaaggaccacaccgccggcgtagtcgtcgccttctacgtacgtattactagcattcattctagctcggtgatcgatcaaaccatgcatgaattgatcacgatatatgtattgattgctggtgatgcatgcagctgtctaatggagatgtgttcgagaagacgcacgacgagctggacttcgagttcttgggcaacaggtacaggcacgagtggaagatgcagacgaacgtgtacggcaatggcagcacggaccgtgggcgggaggagaggtatctgatgccgttcgacccaaccgccgacgcccaccgcttctccatcctctggcactcccgcctcatcgtcttctacgtcgacggcgtccccatccgcgaggtcccgcgcaccgccgccatgggcgccgactacccctccaagcccatggcgctctacgtcaccatctgggacggctccacctgggccaccgacaacggcaagtacaaggtcaactacaagcgcgggcccttcaccgccgtcttctccgacctcgtcctccgcggctgcaccgcccgctccgacatccgcctcgccaccaccgccgacgaccaggacaggtgcgccgcggcggaggaggacctcatggagagcgacgagtactcctcgaccatggccatgacggcgaggaagcggatggcgatgcggcggttcaggcagcggcagatgctctacaccgtgtgctacgacaccaacaggtacccggagccgttcccggagtgcgacgtcaacatggcggagcggcagatgtactggcagtggggggagtccaaggtggttcgcccccgcgtccgaccacgacccggccgccgctccaagcgccgcccctcgccggaggccacggccatcccgccgcccgtgctcgtctccttgcagcaagctgactagtctttgattagaatattctattctatgatgaggctctagctccatcataattctttgattaattttgcttccttcacatgcgtacatcgatcatactgtaattagtaccccctgatgatagagattaatttattgttactgctgcttcttcacgacgaacagttataaccgtggtcttaattaaccattaactataaatctatcaataggtaatcctttgttggtttatcctatttgatgtcgatctggctatctgatcattggtacaagtatgttgttagttggattgatgcttaattagttagtgatggtgcgatgatggattgatgagaagaaagcagctgcatatacagaggtactccagttgcttatttggtcacaattgaattacgtgctactactaattaattgcggtggttaagtgtgcatgtgggagttgagagtgagccgcgcgcaggcagtctgcagtacgttcgatccaactcagatcagataatcgaaatgcgtacttgttgtggttgatgaatgatgatcgtattcgtatagatatagctaatatattccagccagctctgccctgtaaagttaagtagaggagataatgatgatgatgatgcaaattcatcccatcattattggcagtattaagctataattaggcagctgatgctgcaatgcataatgcttgttccaacttctccatccatcgtctgcatgcgctggtgctttgctgtcttccatttccacctccttttccctcaaccttttgtttttgtttggctctgcctcaggctcagctgggttggtattatgcgcaccgaaagcaagcattgcaagggcattgattcaattaaagacaactaattatacattaatccccaggaccgtgcatattattccatcgcttcccttcatcccaaatactacattacatatgtgttgtactatactataatgatgattccataatgataataatgttgataggtactctacatggggtttgtaatctctgtcccagcaggcaggcattccccttttgacaaaaatctgaaaccacttgcggtttaaagccccctttctctagtgtctagtctggaccctgcatatcgtccaatccatacacagattgataatccccgttaattttctcctaacacaatactaccacatagtatatttcttttctgtgcattccaaacagcccaaacaaacccctgtttgtagtctattctacctgccctcgttgtatgtgtgggggcgatgttcattccccccttttttcctctgcacgaaaatgttggctgggtcggcacctaataaacatcctttacgaaaaaaaaagagaaagagaaagagaaaaggaaaaagagagaaacgacgcgagtttatcttatcacaacagggtagacaataaaacaaagagcatgtgacgactgcttacattttcccgacataaagtacaccccctgtgacaaacaaatcaaactagcccagcatttcactaatcattcaatcatttttttaatgcagtatcaaacaaatactaatccacaacttttactacttaccaaaacattgacccacgcaaagctcttactcctaccaagtcaaaaaggaaataaaagcattgttgaaaacaaaggcacctcctgatgaattgcccatgctgcttttcccaatattataccaaaatgctggaaaatggactctaaaactatacagacaagaaaaatgcaaccaccatgattcaataacaatggcttctaatgctaccaggtcagtgcacagatgaacggcttgtaccacttaaacatgacattatcagttgcaagaaatgcttcaatcttatcttgtgcaagaggaaaaatacagcagaataaatgcaaatgtgttttcaaataacactggtgaaaaggacttcgattgattcaacctgtcttattaagcatatcatataagttgctgagttcagtgaagttatgagaagtgccctcactttcccgttcggctacaccggcaggaatcaatcaatgccagaatctgaaacagtcaaagttacttaattttggaatcaatacagtgtggcagactgccagtactaccagaagttagttgcaatcagatagagcaggcaagaacaaaaaaaaaaagctatcagtagctacaacacaaagtagctatcatacagatttgacaagttaccattgatcaattcttacgcctgccaaacctagatacaagcaggtaaacccctcgggtaaaccgtgtttcataggtggaagattagtatcctcccacatatagggtgacgtttcagtattgtttcagcaaaatgatagaacataacatagacataagggtaggtgatgatgtgggagtttattaccgagatcccagggtaccttgacaaatggtggctaagtatgtcctattgtacctcatcatcctgtatggtgtgatgacaggaggcccatctgttctgtaaggttagccatgttttcagctttggtccatccattcccctgttgtgtttccttttggtctagtacacctgaatcgacttcatcattatcaacagatagagggctagccaccaggaactgttcccagaaagaatcaatgatagcaggaagtttctgggtgtcatcgttgtacaaaatctcatcagtctcaatgggaacactatcatcaccttcttcaggcaaagagaatacaccctcaggaccaggcatttcaaagccccctccaggaatatcaacattttcttcagctactatatcttgcaaatctgggaattccagaatattgatatcagttgggcctggagccacagccttcggaacagaaggcaccgcactcatgtttggaacttctttgggtatgccgttgtccaaaacaactgggcactgaatctgaggagtcgaagttgaacaaatagctgaaagtccagagcttgtagctacatatggcaaacctgagttagctgggacctctgcaagggtaacaccagaattccgagttgatgaagagctgtcaagaccttgaccatttggcatataattctcaagaaggaaattatctgaattgcccatggattcaaatctatgtgaagaatctagctttaggatcttccttagcatcgctttggctgcttcattgatcataggttgatattttactatttgtccatccaatgaagcactttcagagtccaacgaaccatcctgctttggtagcctcctctttttgttactagcaactattcttcttctgctgttttcgttttgctgtacaaattgtgctaggaagccaggactatgcattgccttagccaggaaagacatcatttgttgttgccgttgctccattccttgaagacgcttgcccaaagtctgcagctgatgatctgttgtctgctgttgttgtctcagcctgacaagttcctgcattaaaacatttttatcccttttgagcatctcaatctcttcttccatcccaaacttccccacttctacgcaagcaggtacaggagcagctggcaactgaggctgctgaacttggttgtttccatgagttggtttccttctgttgatggtcttcagtagatgcttttgtcctctaagaaaaccttcgtttgcaaactcccacctatctggatcaactttcctaaatccctgctcataagtgcaccaatgagatcgttagaggccggctaacgtacatggcacagtgtatctgcccggtacaagtacttctgactgagtgttatatgattacagaagtagtaatatcattagaagggctaatgtaaatagcacagtttatctgttcggcttaagtgattctgagtgtattagcaggatcaagaaaagatgaaccaaagaaaaaacagacaagacaaccagtacaaactgtccatgattcacttaaaactgtttgtagttcacaaggaaacagctgattggccacattagggaagaaaactaccacaggatgcacaagcagtactggtgtaatagatatatttgcaaatgccataaaggccccagccaactgaataggaccaataaattgctagttgcaaaagcacatatcaaccgtgtgtttgttaattcagcttgagaaaaacttatatcggcaagaagaaagttatctatcttgcctggtaataaagttctaaaagatcagactcaaatctcatataggctcattaatccattaaggtgtagttacttctggttcaacaatcatcagaaaggtgcaaactacaaacgatctcataaaaaccgtctacctgaaatagacagtccttcacaggaggtatcacagatggtgattttgaagcagtggtagttgcacaattgatgacaaaacaagaatacctatatctatatgtgcgtgaaactatgagctttcggttagcatttaaacctgcttcgcgtgaggatgctttgttctctgtgtaacttgttcattcttgtttaaagaagacgtgaacaagtaagatgtacatactcaaaaaaaccaactttttcattcttgttaaaagaaggcatgaggaattaagatgtgcatactgtaattgttcaagagagacagtcaagcctctgcagaagtgccatagatgttggctcattaaatatatacgctgtagtttggggacgaaacctcaaaattttggactgaataactatgaataaaggtacgatggcctaacaaaaccataagatgtatcaagtgctgtagaattaaagatggtctaaaagtgtgctggattagagttatgaatccccctaggtgacatccagatctacggtgccccaaaaggggaaagtattaaagccggtcgatatgtgtgtcaccaaagaatggaatccggagt

SEQ ID NO: 82750 - DNA, 1225 bp, Oryza sativa
agctcatatataatggagtatcatatatatacatacatgtggcctctcctttgtccttttctcttgcaggaaacaggtgccattcttgacatgtatcagcaaagctagtagctagccagggtccagggcgggcatgcatgcagtagcaagctatgcctgcactgcatatcatgcatgaatgcatgtgctcgatcggaaatggggtggcagccttggcgtacgcctgccaatttaaccaagccactacatggccggcagactggccactttactttgtcctctccctgttccgcgtacaccgcccggatacatattgccacactgtttgatcgatcgatcgtcgatcgatctgctttgatttctctttttttttttactctcttctcgatcaccggctacagctaccaacccggtccccggcatttttagtttcattgtgtacatcccgtcagtcgtcgttttactgttgcttggtagtcgttctatgtgtggtacgttcggtggttggtctatgagcttcaagttctgatcaggcagcaatggaagatatatactaccagcaagaatttgaatccatctattatatacaaaggcagggctaaatgtaacatcctagcccttttgtttgtatcttgtagtgtggtgatgtgtggtttaggtccgtgtggctagatgtgtttctagtggtggtttaatgctaccttaccccagtttaacccttttaaatgaagcggaactatatgtaaccttttacacgtaggatggtaataaaaagtaagtggatactatgtaaacatgggcctgttcaacattattaagagtggactaacatggattttggaggctatgtgttgagtgttacactaaagaggccaatgcaccttctctatatgcctagaaattataccatattagttggagaaaaatatataaatttacactgtttaatcgtgactttctagaaaaatatattatcgatattagttgtatacaataatatacaattgtaattaatatttataaaaaagaagcaagagatgtttataaaatcttactttatttttaaaatctaggtccatacaaattgtacggaaaaatctgctagctagttatcaaatagatatcgggtgttcatcttttagtttttcatataattttttaaacctcaaaaccagtcttcttcaattcaaaagctttggctgattgttggctagctaggcacaat

SEQ ID NO: 82751 - DNA, 1124 bp, Oryza sativa
aagtgatgaatctgtgtcaacctttatattctcagtgaaagtgcgtcacatatatatatatatatatatatatatatatatatatatatatatatatatatatatatatatatatatatatgtattagttgggtatatctgcagggtttgaaccctgatagatagaaaattcacaaccacatcaaactaatgaaggtggtttgcgagacccacagttaagtttatttaatttgaagcttacccattaagcatgcatgtactgttcgtacgtcacggttaccgtagtaaaacattagtcaactaatagttgatgttaccaaaacccaacagtttgaaccatatgcatgtcttattatcagctacatatatagatgcatgcatgttgtctatactacatctgctaataattaagaatagaaggtacaaatataggctcaacgaaaacgttcttaattaattggtcatatttggctctacatgcatcccatcgatccttgcattaggtcaaacacatgcattataagtagactagatggtgtgcttagtggagacagtcaccttaaattgtagtagcagacgaatattagcattaattgcattgctaatgtacaaaagttcaaaagacaactagctaaaattaaagaaaaatatttcaatttgagatatgtcaacctttattaatttgaagatgagttcggttgaaaaagaaaataaggtgttcgacttcttaatttaactatttactcgtaaagatactctataggtttttaacgtttgatgccgttaactttttaatatatgtttgataatttgttctattcaagatttgtttttacaatcaatatgtaaaaaatataaaagtataagtcatatttaaagtacacatgatgataaaacaaattaaacaaataaatgataattatgtaagtttttaaaaagacatatggtgaaacgtgcgcctaaaaatcaacagctttaaacattaaaaaccgaaggaagtataatataatattttttgagatatcgttggtataattaatctacaaattaatggcatttctgtatgaaaattcattatgctttcatgtaaaataaagaccatactgatactcattatgcgagta

SEQ ID NO: 82752 - DNA, 6238 bp, Oryza sativa
ggaatacttctaagcacaatgtaaacgggaatggtcaaattaacaatacttcaaacagaaatgattacttcaacagaaattcgccagtacatataaatttctaattggaaatggaaatggccaaattaacacaatctaaaacttggatgacttgtaatcatttgcttacttcaactatatgtactggcaaatgaagagctaattacctacggtttgattatgatctggtataccttgggagttcatccaatatgtatatacacaaatatttttatgctaaagtagaaaaagtttgattcatcattcctgtaaaacaaatctacaatttcttttgtactgtgttgtatgctctctcatactaatttttcgtagttccattaaccagttcatatttatcagaacaataaaaaatatttaaaagaataatatcatgccctctcattagagatgtggttgggtagttaatagagagggatgttgaatgtggctatttataagtgtgccatcattttgttataagtcgtaacgtttattagtgataacaaatgatttggagggataacttttatatatgttcttagcgacttaaaatcaatactgaaaaataaaataggataaaaaatagtaaatcaattctaaaattaagttttaaaatttaaacttgtgacgtggttgataataagctgaagatgaaataatagaatgcttaattttggtttaaacaattaaatgcctaaaagatgtcttgaattaaaatttctttgtttatttctgggattttggttgaaagaaaaaaaggaagcataagatggaatttgccgtacttttgaagaggtgcttctccaagctgcccctagccatgaactcgtagacgagaagtctgtgctcatcctcgtagcagtatccgatcagcttgacgaggtgatgatgtctcaattgcccaagaaatatgacttcagcctgcccaaattttacataatataatccattaattagttcaacacatgcccatattccatcagtataattaagttatgtcagaatttgaccaaaacctgtaaccactcttaaaaatactaattgtttgaccaaacaaatagcatattgcagtatatatagttagttaggtggctgatcgacattatccttgcctccgggtactaaaggattttaataggagattaagtatgaactaatgatcatgagaggaagacgtggcgactttctgaagggatcacagctaactaagtagctggcatgcactaataattattcaatttgctttggagtaggatttaccacagcattgacaggattcttatgtgtgatccgatcttgtttgttgtcaaatgaagtactaaaatggacgttgcaactgtttgtgtgtgtgctcaatttgtactgaactgatcgaaatcatcgtctataaaagttcaagacgaattaattctattatgtgttttcttaaaagggaaccttgttaaaaatatacaaacgacttctttaaagacaaaataaaatcattgcactaaatcatatatattccctcccatgagtgtgaagtttcataacgtacgtacgtacgtagttaacacatttaaactttcgaccaacaacttatatttgaatattttggttcaacttaattttaagaaatggtatatagctagatttatcttcaaattaaattagtttcatgatattataactttgctaaacaaatttactagttatcaataatcaaactagtgtattcgacagtgtcgctatccaaaatatcattattttctcgtatttcttttttctgttttgactggagccagtaaatgcatgctagataaactggccttcaataatatgaaaagagattgactactgcttaatttggacttttgcagtttggccttttcttttcaattaatgcagtttcccgaagttaaattaaaatatgcttaaatatgaagtcagggttaatagcacagtcaacatcatggcccttgaaatccggtttacgaaagaaacggaagtgtcatactgtacggtatgcacgggcttaacacagcttgataattagtcccaactaattatcacaaacgttacccctattaatttcggtgaaacattaacgactaactatagtaatggggctatatatgctaactcaaatactgcgtgttgattagtaaactatcgttaccaagtcatgcgttcaaaggcaaattaaacgacatgtgtagagtggacaatttccaaattaagaaattttgtagaaaaaggtgcaattcccacaaaattgtccttccaaccatagaattccgtattgactttgcacacaatatggaaatgatatgaaaatatttacctaacaatcagtcacagataaaatatacatactaatcgattgaatttcattttgttgtgcgtcagccattatctcactctttagtcattctttgctctcaccgtcaactaaaatttgctttaaaattagtgcaaatagaagcacgtcctcaagaacaacacccactgatcagtaattagggagttctaatcttagttctagggacaattaactacaatactatgactactaattaattaattacttgacttgaaatcgtactgataatctcagtgatcttaattagtactatacatatgatgagatagtctcagtgagacttgcttaatttacttcatttatagtaacaaaagacttgatcattactttgatgagataatctctctcagtgaaactttatacttcatttctcacaagaagacttaattaattgcattgataagataatctcagtgaggctttgattagtaggtcagtccccacctaagacagtagatatagttttcataagctccacatcattaagaaactagtactagacactactcttttaatgtaaacatcacttttccatacttaaatttaatgctacttatctcacatgatgtcttggtttttttctcttttctcatttattcacttgttacattattttttattttaggtggcagcttatttaatattatggataccatccatcattggattgagaatggccgtatagtaatcaatcaatctaactaattcgccgttaattaatcaattaatcaccgggtaattaataactggatgagaaatgagattaattagtgagagaggaggagttaaactaattaccagccattccttgtggccctgggagccctcgaggtcgagcagcttgacggcgacggcctgcgcgcgcacgccgggcttgagccgctcgtcgacgtaccccttgtacaccggcccgaaccccccctcgcccacgaagttgctcaccgagaagtcccgcgtcgccctcctcagctcctccaccgtgaacgcctccaccccgctccccgccagcgactgcgacaggtcctccggcgacggcatcaccgccgccgccaccccgtcgttgctgttgcacgacgacggccgcgccggcagcggcgtccccgggttcttggccgccgccgagccgccgtcgctgtgggaggaggtgaagcagccgagcccgaacagcgagctccacgacggcgacgacgacgtcgtcgtcttcttccccatgattgccaaggtgtggaatggttgggaggaggatcggggggagttaatttataggaagcacgtcgcggtgttgggaattgggggatgatgatgatgatatatattgagggtggtgtgtttaatttgtgggtggggtgggttttgtttgtaggagtggttgttgtcatggtctatcgagggaggtttggttaagtttggtttggttgagaagggtagactagtatagtacctagctagggaggtaaggtggccttttgactcatggaagatcgatacctgggcttagttttccgatgccgagatagtgttttatttattttattagatacttaaaaaaaatacccgtgcgttgcaacaggtaaaaatatttttggatcgtatacattatactatttgctttagaccaaaagctcatttattcgttccatttcagtcctaacccagcccgctacctctctttgatctagcccacaggtgaagctgtagacccagctagcatagcccacaactgtcttcaacaatggataaaaatatttttggataactatacattatactccttggtttttggtcaaaacctcatttattccttccttttctaacccagcccagtgccttatctctttgcttggcctacctttctttgacatagcccacaatgagagctataggctcaactcgcatagctagctgactgccgtcttcaatcttcaatccccgtaagagtgtcttttctattttttttgtcgttcttccttttttttctcgtcggtcttttcactctctctttttttttcgccgtcacgttcgatctgcctctaatgtgttccgtccttattgcaaaaatcaattccccactactactccatcatttttccccatgatttttcttttcaattccgctttaatttatgggaactaatctctatttagaagtcaccgtttatatcccgagttttatggagttgcttaaattttgataaaaaggaaacagtagatcaagtgtatcaaaaaccctcaaccaattttggaggatcgaacagaaaaactcatttattccttccttttcaatcccagcctagtacgtcatctctgtgcttagcctacctctctttgacatagcgcacaatgggagctataggctcaactcgtatagctagctgactgccgtcttcaaaccccggaagagtgtattttcttttttttcgccattttttcttttttttcttcggtcttttttctctccgttttttggctgtcacgttcgatctgcctcctaatgtgttccctccttcaattgattgcaaaaatagattcctcactactactccatgatttttcccatgttttttttcctttcaattctgctttaatttataggatctaatctctacttaaaagtcaccgtttatatcgagctttatggattcgcttagattttgataaaaaaaaacagatacaatagatcaagacagaatggagaaaaaggaaaaaacacccctaaaaaaataaaaaacagacgaaaaaaaagaaaagaaaacggaaaaggagaaaagaaaggtgggtggaaaaaggaaaaaaaaagtggaggaacggtaaaaaggaaaaaaaaaagggcgaaaataaccttaaaaaagtgatggacaaaaaataccggaatccttatgtattttttagttaggtatatagatattttaaaaaactgctacaagttttttagtgaaaaacttctagatataattatagtataattgaagccactgtatctatactgtaattgcattgtaactatactacaatataagttatataaaacttgtatttaactataaaacttgtatttaactatggtttggctgattagcactaggatcttacgcgtgacatgtgtaaaaatttctttctatagcaatttttttctcttcatgctcaaatcccaaggcaatccgatgattgcaaatctgaaagttttggggggcaaaacacttgcagaagctttccagcaatttcatttatttactctcggcctctatctcaaaatataactattttactttatccgtctcaatatctatacatacaatcttaaaagactataccctctgtaattttacaacatacttctccatgattcccaaattgtacacccaatatacttctccatgacttcctaattttacgaggttctccggtatatcaagtatcatccatctataacgaatgacgtctctaaagagtgaatgagttttctcttttagataaaatgaagtttcctaaattgttcgccattattgtaacacatgggcactctgctagtataaatatatgtctagtttttcatggagttaaggagagatgtaaaaaaaaactagattgccttaatttcgtttattgtctcggttgggagctagggtgaggtggtattttgactcatggaggatcgatacctggacttagtttgcgggttgtggagatgtgttttgtttactctcacatatgtctcaaaatataactactttactctcctcatctcataatataactaatttactccttccatatcagaatgtaaagtgttttgcttttgtcttaagtcaaacttttttttcgaaagtttgacaaagt

SEQ ID NO: 82753 - DNA, 10958 bp, Oryza sativa
ttccgccacctccacgcgacgctgttcccgccccccgccgcggcggccgcggcggcgcgccgccaacgccgcctcccgagctacatcgaggtgctcgacggcgagccgcagatggcgtcgcggtacgcggcgcgcggcgagggcgccatgcttcccgaggtcccgttcgaccggttccgcgtgggctcccagttcttcacactcgcgcggcgccacgccgcgctcgttgtcggcgagcgccgcctctgggacaagttccggcagccgtgcctggaccagaacgcgtgctacccggaggagcactacttcccgacgctgctcgacatggccgaccccgccggcgtcgcgcggtacacgctgacgcacgtcaactgggccggcagcgtgcacggccacccgcacacgtacacggcggcggaggtgtcggcggagctcgtcgccgacctccgccgccccaagaagaacaccacccacgactacatgttcgcgcgcaagttctcgccggattgcctcgccccgctcatggacatcgccgacgccatcctcttcaacgattgatctccattgctgctgctctgctcatcaaaggtaatattcagaaatattcagagattaaagatttattactaattcttgatcatgttcatgaactattcatgatggaatgatgcatgccattttaattaagccataaattttgcaattacgagagcatgaaaatcggcaattagtggagcactattcaaatctgcaatcacaaattcactaagtgaaccaaggcgtcaaagcctcgaatttattttcaaatttggaaaaataaatgcttgaattaagttttgtttgctttcacgcgacagatttgtcagctccgttatcaatccacgtatatatacaaaaaagaaattaagtctgttgcttctgtgatttacaaatgaaaaggacatgtcgattagtcttagcttggtcctgcatttgggcagaaaattatgtacctttctcgcccaaaaaatagaaaaaagaatttaaaagtctctacattttgtaactacatagtccttactctatgagatcatggtacttgcgtgtcaatgtttgacaatgatatcctaacctctacttgatcagagtccttgctaatgctacgcattgtcttccattttgactaataccagttgattttttttgtttcaatcctatccatccatgcaagttttaggttaggtttatgactggttgcttgcacatttgcacagttgcataatcaatcaacctcaacagatctaatgagcctaaattatacacctttttttttccttttgcaggagttgattttgcagaagaagtggcctctgttatttctcccggtgtctgaaacctgagaagttcagagtttcagagtttcagtcccttcctcttctgttcttgccatgatacttggtgtaatcgtctgtagattagaaaaaagaaagcaagtgagcaacaacctaatgcgaagcagcaggtgttgcctggatcatctcatcagataacatgatgatctcatgatccatctatataatcatccaatgcatttgcctagagctagcagcctaaggctgcctgtgcctgaatgcattagctgatgaagtgtcaaatgtcaattagtgttcagtaatcagtactagtatactgcaattaataaacctcttgcaaagctactactacttgtcagctcctgtgcataagaagtaattaagcagacaggtttttgtagcaagtttcatgtgatgacttttgagcagaaataaaataaagaaaatggcagaatcaagcagctggagagagaagagtagcactgcatgcatgaacagatgtgcaaagttaatttacatattaagcgatgcaaagtgtgtgtgattaggggtgcaaatggtgagttgaccccgccagttgcggatcaaggggcttaatgctactatactgtattatctttcacgtcttcacctgaagaaagcaaacgcatttgcatctgattaagcaacatatatattatgcttttgttaatgtttatgtagactgtattgtactactacgttccttcttgcagatgcatatggcaggatccatcctaattaagttacagaagcatgaggtagcatcacagttaagtaggaggattattaggaacaaaagaattttaggggattttgtggagttgatgttaatccgttccgaatgagctaccaatgatccttaattttgcttatacggtgtatgaaatgactgggggctactagctggcgcgtgcgcgccagcagcgagcacctcacctccctaattatctatagtactattagttaacatccatttaactactaatgacgagtaattagggaagattctcaagatttttttttttgggagattgttgtaccaacagattaaaaatttttaagtcagttttgaaaacttttgatttaagatttaaatttaaaagtcaaattttgaaaactttccattcgaatttgaaaactttcaactcagatttgaaaactttcaacttagatttgaaaactttcaacttgagattcgaaaactttcatgtccagatttaaaaaaattgaaaactttcaacttgagattcgaaaactttcaacttagattcgaaaactttcaagtcaagatttgaaaaaattgaaaactttcaacttgagatttgaaaattttcaactcgatatttaaaaactttcaagtccagatttgaaatatttaaaaactttcaacttgagattagaaaattttcaacttgagatttaaaaaatttcaagtccaaattttaaaattttaaagttaagattttaaaaaatactagtaaactaatcactagtaaaaaagactaatctaaactaattacgttacgtacggtacggtagaaacagcgaaaaagaaaaaaaaaagagaaagaaacagcgaaaaaaaggtaccagcgagaaagaaaaaaaaagagagaaactacccagcgaagaaaaggagagagagagtgcgggccgcgtgggccgaaaatgctcgttggcgcgcgcgccaactagcttttccggaaatgactgacccggtcgtaacaggagggttgtacggttatattcattatatattttgataatgtagtatattaataaattccacaaagtactaatattttgaccaaactaatgtaaaactatagatttaattggcaattatatcataaaaatttaacatcaaaattatcataaaagcacatgtttaatatatagtattgcagaattatagatttaacactaattgaactaggggtgagaatggatcgggtagatccactccaaatccattggaaacaaggatatggtatgagattttagaaatctgacggatatggatgcaaatgtggatagtatgatgtggatgcagatgaggatatgatatggtatctctaaaatctgataggccgtttgccggataatgtaaaattatcaacacatgtaacataagttacggtcgggtcagtcatttcatacacatgtaactattgatttcatacacacgtaacatccgataaatttaatctgtttttaaccgattccgcaccatttttgatatccgaaacaatcctcgtctgtattcgcatccgtacactatccgcacttgctccgaatctgctccgttttcacccctaaatttaactcaaaactgcagctagtgtaactccacactaatgtgcatctaaactttaaaatatgtagttttctgttaacttttttacccattagtttttgacttcaccttaaatctacaggttcggaacaaatttagtaaaaaaactatattttgttatatattgtattaaatcagctgttttgtgaaattaagatgtatgtagtcttgtaaaatttaaatatttatcttactcaaatttgaatatccttacttttagtactttatccaatttaatagtagtactacatgtactatgtagaaaacggacaggtgtactcagctaaagcaatagatatagagcaggataataaaccctccatttcgtacttttctctttttaaagtttaatcaagtttataaaaaaatataatagtatttttagtataaaataaatatattattaaaatatactcaatgctagattgaaactaatttgagaatttagatatcggcatatcgctaaattttcctatatttttttttcaaactaaacaaagtttaacaaaagtgttaaacgacgtataatatgaaacgaagggattaatgagcaataactataagcaaccatgttaggtaggtgctcgcacagtctcttgcaagcttagttggggaaaatttttaagtttagttatcacatcagatatacggacacacatttaaagtattaaacgtagtctaataataaaataaattacagattttgctagaaaattgggagacgaatttattaagcctaattaatcatcattaataaatatttactgtagcattaaattgttacattatagcgtaattaggcttaaaaattcacctcgcaacttatatccaatctgtttaattggttatttttatatttaatatttcaggtaggtattaaatatttgatgtgacagcttttgagaatttgccggccgcatacgaggagaatacacctgcgttttcgaatgcaggtgtcgcacgggcacacgtacgtgtgcggcatgcagggagcgacgtatgccacgtggacggcaacgctgcgtttgctggcgcggatgcaccgtgatccgtgggtttgacctgtacgcttgcacatgcgctcgatgcattgagattcggcgagaagaagatgcacatgcgttgtgtgtgtgcacgcctgcatcgttcatgttgttggcactatgtagtattatttacctcatccatcctaaaataacaatgtttcatactaatatataaggttaattattgccagtgagagggagatattatttttatgttttcagtgatgccgacataagaaacaacacattcatttacacatttaattgatgattaaaataactcatataatccattgttctcatttttgttgtttcatacgtattatatgtaagacaaactatattataaacaaaatatgctgacttagataaatatcattacaattcgtctattcgtaaccgtatcactgaaatcttacaaaatagggaccgtgccattgtcgttacgttttgcatccatctccttccttcttcgtatgttctttctctcttcccatcttcttgcattgagatggcagcggtagtagtgcgagcggtgggggtgtcaacgaggccgggaatgaagcaggagtgttggccgagccagcaatgacgacgccgtgcttgtccaccggcacaacgccagacctccgagtagcaagccctttgctctgccccagtttgcatgctcggttgcgtcctcatgctccatccagcactcttgtcctccatagtgctgccctcgccgcaccggtcgcgtgcttggcgatgctgctaatgcgccctcgtctccgctcctccgcatgctcaccgtgtgctcggtgacaccgcccttgccacgacggctgcgtgcctaacagcgctcccaccggcccgctcctctgcagcggaaggactgctcgcactcggcgaagatgggccgctcatcctccccagccgtgcgctcgaggacggcgacgtacggcaaggccccgaggatgcggacgacgattgtgagaggtgccgctccgctacccctctcatgatgatggcgaggggttctcgctatgcagccgcgcgcaggaggacaacgaagatgaggtgctcgtggtcgttgcttctccctcactcccgttctcgcgctctgcaagggtaagcctcatatgttccccatccatgctctcgagaacggcgatgagaggtctgccatggcgtccgcgaccgctgagctcgtgctgccctcgccccagagatctggttgcagctgctcgtgaaaggaagaagatgaatttgacgggtaggtcccacgtgcagatggggggagaagatgaaaaaagtgacggtgatagtatggttctgatttatgtgattttgaatggtatggatactcataaaagaattatagtaatatttatctgaatcaatatatttacattggcatggatccaattaaccctagaggcctagagacaacatatgcatgaattcatctagatgtggcttattttgtcttccacttcattaatttctgcacatcattaaaaatactgacatggcatcctatttaatgggaataaaactcctattggttgtggcctaagacacatatgcatatatacaattaattagcatcttcctttccttttaattcttttttaaaaccttcattcttaatatctctaattttattatatgtatgtattgtatttattagaatgattagatgtgataataatatttttttacttttgcgttagagatagttacgccttatattactaaaattaatcgctacttcctccgtttcataatgttaaactttctaacactgctcatattcgtatagatattaatgaatctaaacatatatgtgtctagattcattaatatttatatgaatgtagataatgctagaaagtcttacattgtgaaacgtagggagtaaatactaaaaattgctacatttctaatactaaataatggattatcctcaacaagaagtttatttttgaaatgaacaagaaattaaaatagtaaaactgcaatcatgaaagctcaaattctagaccaacacacatggatgtgccggatttgggctatcgaaatgaggcctaatttattccaagttcttggatcacatttacgaattacgaccttgttctttgggccttcagtcccagctcatctagtacaaattcctggcctatgtacccggtcctcatcgtttggcttatttcctaataagccaaaacggcttattaggaaataaaaataaatttatgggtaaaacttttataaatgtattctttgtgacttaaaagctaatgttgaaaaagaaattacgttgaaaatatctcaaaatcaatcttaaaattaagcttgaaaatttaaaatttggctttttctttggcttattaggccatcctatgggagcctggctggaattaggcccatctgagacagaaatgggccggtatttgggctttatctaaccagccacatatgtcaattttgcttctctttgggaagcaagcagtccccaattttttctctgttatgaaaatgatttgcgtaagacctaatattggtaaaagtaaagtagtatatataagaaattttattactaagtagtactagtagatgtataacaacaactatttaattgcatcgaattcatcgttagcaagataactataagtagcttccctgtatatgatcgagatctatagttaaaaatacttatatttaggatgaagagagtatttaataacatgccactctttagttgccagaggctatggttctctaaatattatccagatttatagttaaaaatatttacattttaggacacgtacgtgcagtgtcgctcttttgttaccagatcgaggttgcgcttctctaaatgtcatccagatcgaggttgcttatattttgaattaatgacgtgccaatctttagttacgagaggttgcgcttctctgaatctctctccaaacagtggaagattgaaaccctttcaattattttgttttgattccagaccaccactgtatagcgcggcggcggcccagatgacgacgtcgacgaggaggacccagatgacgacgtcgacgaggcggcggctcggcagcgagccaggcgcggcagcggcaacgagcgaccgattcgctttttttattattatttttggtatttttgatttcgtgcggttggtataacacaaccgcatgggataatcgattatcccgtgtggttgaaccgtcctgacacgaaaatgctgattttttcagataattggctctaggcgggccagacaaccacatggaaaaatcaaaatgcccgtttggaaaaatcttgaatgtagttgtgagcgtttctctctcatgatttcagttaaacactagagatggaagcacattgtgacacactgacaacgacaatattgaatcatgattactaacagttattttttcaataaaacataaaaaaaggcatgggtagttttcctgctttttttttgttgacatggttcattaaagaaacccgggtgatctttccccgaaaaaaaaaaagaaacccgggtcttagaagttagaaaatgttaatatggatgaaaataggaaaagctggaatttagaaaccttaaatatactttctcggtaacagtaaaatttcttatagttggaatccttaactaacgctttggtgtctctatgtgatcagttcgttcttctctcaatcgatctccagttttaatcgtttgctagatctccaaaacagagctagagagcatatatagctaactatatagctatatataagccatttctgcaatgctttcgacaacatctgatcgatgtgagcatatccatgcagggccggtcctatgattttgagggccctaagcgaactcatcgcgatgggccctctaaactatatataaaattttataatatatagataataattttacttgcaaaacgataacaaatatatccatatattaaatttaacatgtctggtaattatgaagaaataaaaataacaatatatttgtaacttggaactaatatcattattcattaacttaatgaagaacaaaaccccatcatatcctttgctcccatgaaaagatatttcttcgggcatttcttgatgcaaaatcatcaataacggtattaagatcaatagtgttcaagatatccttctcaattgagcacatacccaagccatttaacctttcttgtgacatagttgatcttaaatagttcttcaaaacttcaagtttgagaaacttctttcagctgaagctaccgtcataggtacagttaagagatttcgataggcaactaaaatatttggatagcaatctgcatccataacgaacttcagaatctcaggcgcgaacatcgaagaatcacacctttaattctgaataaagatcattgatctcaacatcggatgaggtactagactactagtattaggtgttggcccctccaccatcatagacccccggcggtcacctcggctgcatagggccagggccggccctgtatccatgcatgatctgctgtgttcatctgctgtacattctgcatatggcgacaccacctgacgcaacagtgatcttctgctaaaaccactgtatactgccgttgctgctgcctctacctcgtccgtcctgcaataataatgctgcaggatcatgatcatgctccagcttaattagccatattggcagcactgcctcgtcgtcgatatatggaagaaattgtgagagcaacagagctagtacgatcgatttatgtttcagtgttgcagagatcggtcgatcgatggatcaatagtgcatgtacagtactattgatgggagtacgaggaagctgttggccggtgatctgtccatgcatccatctctagctgtattaatatttacgtactctttccgtccaataataataataataataataataataataataataataataataataataataataataataataataatcctacagacgtattccttccgtcctaaaaaagctaacttctggctatgtatctggagcctatatctggatacatagggatagagagagtatctggatatgcagatatattattagaattagatttttgttaggacatggaagtatatatatattgctacacaagagttaattggacatgtttgtgtaattaagtgtctgtactgtgtactggcaaacagtgcatgtctatgcaagcatcatcagtgtgtgagagagatgtagcagctgccagcaaatattgctagctctccaacatagttaacttctgtttgatcctgagcattatgtcattaataacagttcatgcctgcatgtatagtatatgaagaaatattcaatatagttattagatatcctctttgatcatatggatgggtattatttatctcttatatatacgtgtagtcgaaattaactaccgcctcctcctccatgtcagaatataacaattttaactataaatctggataagttcatatcctaattcttagctaaaaattaatagtatattttataacggaagaagtaattagctctagatttgctagaattaattagagaagtcagagttagctaggaatctaagctacatgcacgcccatcttattcatctcatcatatttgttcactaacttctaaaactcactagtaattattatctagagtattttaaatatcatacaaacatgatatatcatttacaattttgttgtattttagaaactcaatatgcaagcaatataaaagcattatctccacatcatttaaacatatatatttaccatttctataatatataatatgtattcatccacatatcctgcaacaaagtaaggcgtatcaacttagtgcacactgaattgaatatccaattgtatgagtgacggctaagatcagattaaccagatgtataataaataagcactccaagttgaagaaattctggaccatgcattcctccacgcatgcatttaatcttcagttcaatttacaactccaaatggttaatttataaattctaaacccttaatcgatgacgcacaagtactagcactactgttcttcgtcgtcgtaattaattagtactccctccgtattttaatgtatgacaccgttgactttttaatcaacgtttgaccatttgtcttattcaaat

SEQ ID NO: 82754 - DNA, 3500 bp, Oryza sativa
ggaagttctagcttctttgtaatcagctgcaatccaggcagactgagcttgttcgctaccgtgtgaaccgggttagatgccttctgagtggcaacggacaccataacatttgctccgaaaaacctctccgagaagaatacccagaaaacgtcgtacacaaacaggcagacgagcagcaacgcgcagatctttatgttgggaagcctcacatggctgacgaacgctatgcatatggatatccccagcaggttattcaacaaccagtgccccgataccaaccaggcaaccaccgtgccgacgcagatcgcaaccagcaacccctgcaaccgggtaaacggcttcgagcagcacctcgacacgaacgggtccccaacgccgaggcgcgacctgacgcagtttacgtacggcgacaggcagaagaagagcgccatcgccgacgccacggcggtgaaggcggtgaccaggtgcgacaccgacgagaacaggtagaacatcagcagcaggctgcaggagctcgcgagcgggatcatgagcgcctgcgaccgggcgagcgtgatggaggcctcggagaagtcgaggttcctctccatctccctgccatggtccagcgcgcgcgacgccgacgcgtaggcgacggagacggcggtcaagatgagggcaagcgacgctggctcgagcaagtagctcagcttccacagcgattccatgtgatgtttttagcagtctctataacatggcacaatttttttttctgggtgaacgaacgaactgctattagtatcaaggtttaaggtaaattgagagaacatagcttctagatctagaactgaagctagggtttacgcccgtgaaattcgaaggatagagagaggatgggtggatgctctcaccagtatgcgatgcggcggaagaagcgggagaacggcgccgggggcggcggctgcggccctcccctggtcgctcgcggccgcggagggatggggatcggcgcaggcggccgaggggaaagggaagtatcctccagccgcacgacgctttcctctgccttgtttggcacaatttacgtagggatgcccgggagtatgagatatttggtatctttcctaactttttggtattgatttttatttcttttttcaagtaattttttgtattatactcagaaaaaaaaatgtccgtgtgttattgggagttgggaaataacttgaaacattagtattgctgtacagtataattaaaaaaagttaatcaaaatcttttcttagctttgagcaaaagctcattatttttttttccttttcagctctaacactgtcagttctctcctacctttctccactcgacctacctctcttttcttcggcctagcccacaagtggagccgtgggcccagctagcacagtcggctgcccacgcgcttctgtagcgtcttcaacctctggaagataatcccatgtgcctgcacgatgctggagccagttctccctcatcaaatccggcaagtctttctcaatcacctaaaattgattgaggacttttgatccactcgatctcctctttctggtttccccaaaatcggagcgaatccacaaaactcagataaaaagggccaggagaagctcgtcgaccggccatcattggtgaccgttcaacagacattaaatttggcgaattaaagccgaatttaaaggagaaatcatggggaaaatgacgagggaggataaggaaatcaatttttgcaatcaattggaggaggaaacgcatgcgtaggtagatcgatgtggcggcggcgctagggttcggcctgggcggcggctagagattaaatccggtgaattaaagtcaaattaaaaggggaaaatgatgacggaggagtgggaaatcaatttttgcaatcaattagaagagaaaacacatgcggagacagatcgatatggtggcggcggcggagactgaaggcatgtgcctatcgagcgacgtacggacgatgtacaaagaaaagaaatacaaaatccttatgtattttttattaggtatagaattacttccttcatccctgcagctatttttggacagagggagtaccatttcctatgcgttgctgtcggagcccaagctctaataacgaaaactagtggaactccattttagattcagttagggaacatgtgtgcagttgctaagtccgagacatgtgagacagtgggaagcagagtggtgaaaatgtaataccctactctagtttcattcttctttggatctcttattccaactcttaattacaaggggtgaaactttgctagctattgctagctaaaactacgtggagcgtaatatccttttttttatgtgtgtttgtcctctctaagcagccctagctctctccttatagtccacgcaagaacagcatagtggttggtccatcactagtggaccctagtataggggttagctattgaaggtcatgttacttattgacaaatgggcctggctgttgtgcccaactagggtataggccttgccacctggctgcgcgttctgagtgtgcatgcaaggtttggagtagaagcctagagcattgttgacgccagcaggaaccttctgttaattagtctcaggtagaagaaagtgtgaaaaggttgtgcccgatagagtggcatcggcaaataaccatgctgcctaatagcccacactctttccccgcaggggtgatgatggtgcacgtgactgttgtacaggcaccatcccatcacatgtcgcctcggttgcaccctaagttggtaagcatcgcctagcattttatgcaaggcttactttgttgatgatagctatagcaccccgcgtcctatcacggttaatgcgctggcgctaccccaagctcagccttgcaagggccaatctcgagggcaagcagcaaccatgccccgagaggcgaggtcccaagctcgggttccagctagcggccatagggatgaacacgaggtcacccctaccaggggcggtcctaggttcttgttgtgtttctcctcaagtgcatatcgaccattgcatgggctagttgatagttgtgtgggctgcctgatccgatgttgttcattgggttccccaagcagccagtgatgggaagcctggttccaagtttaccaatatagcaattgaaaaaacaaaaggtggtgatataaattagagtgctatatgatttgatcacggtttaatttttataatgaaatccaaaattagctctatgggtccgaaggggccttaatcacaacctagtgcaggacaacaacatcaagtaagaaaataaataaatggtaaaataacaggaatgaaagaaagcagatgacccatcaatttttatgaacaaaagaaaatggtaaaccaatgtaaactctaatggaattggtcctaacggacctgctgaaccactcaaacaagttgattctgcttaggctcgcgcatgggttacgttcttatacaaggttaggttcaataatccg

SEQ ID NO: 82755 - DNA, 8066 bp, Oryza sativa
aaccccttgagtagtgtaacacatttccgagagtcatgaatatatatattttttagggaaccgagagttacgaatatgatggtattgttagtatccaaaaaggacatttgctttggttggaacgtggatcccggatgtagaaccacaatgtcatcaaacatgagattgatgactacggtatggaaacggatgagaacaaagcacattctcaggcatggggattcccttttttagccattgaaaggaaatgtgttggatgtgctgatgatggcgtcggccatggagacagtgaggcacacaagagctcggtgtcggtggtgcgttgctatattcatggagaagaagcagagggaaactctttggtatcaatctattaggaatatgtttacatggttattatggttcatttacattacccatctaaataattacataacataaaacctcactggtaatagaagattttagtagtgcaagcagtggggaagtatcaacggttatcatcatggaggctagggctcggcggtgtgctcaattttgcgagaaatcgatcaagagaggaatgatctgagtggcgtgacgatagaagatatgatagtcatgggcctaggatgcaacacaagtttaggctgcaaacggtcaaagaggctcacgtacgtgaagcgaggcacatcttgtgatcggattaacggatgatggagtcaagtttcacatatcaagtagtacagaagagacatgttaggtctttttggcacaactctagatccaaatttttttaagctgggtattcctaaatctacaaatccatgatctttatatatatagatatatatatatatatatatatatatatatatatatatatatatatatatatatatatgattatgttaataacattcggataaattatcttatttcattttagattaaatttttaatttttaattcatcaaaacagtggtaactatatgtcggaagccacaactttgatggaggccatgcaaacaacatcctaaaagttcttttaaaaaatgtcaaaaaaggtgatattagagaactaccggtatgaccaaacttgacttcgtccgtgagataaaaaaaattacaattactagtaaagaaaaagatgcaaatcagcaatattgtttttccatagccatttgttaattttgtatctcacgaactaggttgaattaggttgtgcaatttcgtatggttctctcgaatcatcttacctgtatgtgtgaatttcttttagatcttttgacaacttttatgcaatcgtttttaagttgtcaccaaatatatggtctccactgcatagttttctctaaaatagggtatatgttgaaagtaggtaaatttttccctagtaatggtactcgatttattcttcctgggtgcagtaaccgcgtcgtgtggtgcaaccggaccgatggcagatgacatggcatttccatgggtccgctttagtatatacaaggaaaaaatatgaattaccccctaaactattgcgacagtacgaattacccctgaaactacaaaaccaaacatattaaacctcaaactattgaaaccggacgaattacccccccccgactcaatccggagcggttttagtcctacgtggcatacacgtggcgccgacgtcgaaatcccatcaacaaaaaataaaataaaataatgtagggcccacatgtcatattaatactttttctgtgtgtgctcttatcgttggaggcgagcggctacgagcccggctgggcgagcaacggcgggcacggttccggccggcagtaggcgcggcggggaaggggaaccggtcggcggatgggagggcgcaccaggcaacggctggagcggcagggagggggcgcggctaggagtgctctccaggtcgcgacgggagcggcggggaggaggaaccggtcggcggtggtcgcaggagaaggtgccaaccggagccgggaagtccggcggcagagacatgttccactggagcgacgctgacgcgccagaggccagggccagccgatgggggatcccacgatgggacgacggccagtgttggcctcctgacaactgggtcggcggagtagatcgaggcgatgaagtggcatctgtcctccgacgacagcgaagcagggcggggtggcggtggtggagacggggccatgccggcggaactcgggcagctgtccttgaccggagtggaggagttggtcggctaccccgggcccgggcatggctagagggcggccgacggccgggcatggcgagagagcaatcgacggccggcgggtgcgacggggagggcgccgtcaccagagccatcggtgtagccaagtcgccgcatccttctcctcactgccatcatcgttgacttgctggtccccttcctgcgaggtcggccggtggcgaggagaactcatagagggcgccgatgggcatggataggcagcgaggttgcccctccctcctgctcctagccccacccccaccctctactacctctctctctctttctctctctggttatggcgggtgtgttgtagagaagaagagaggaaggagaagatagggccatagagggtgtcaggtgggccctactgccaggtaggattaaaacaaaatttcattgccacgttggacgccaagtaggatcaaaaacagatgatattaagataggggggttgtttgtccagtttgaagaattaagggtgttaaatgtccggttttatagtttaggggggtaaatcggacgaccgcaatacttcaggcgggtaattcgtactttttcctatatacaatgatgtggagtggttgtaagactcgccattttgccacactgagaagtgagaacattgtatgacatgtggactcgatgcatcattaaggtgagagttataacagggctataattttacaataatttcggccccatcaattgggcatatgtgcgcataatacattatacggcatattagccagccaggggcggagctacagtaaagggccggtgtcaggcgacactgatgactttcggcaaaacctatagcaaaactgtttatccatatgttattacactatgatctaagtataattaatatactatgacaccgatagacacgttatgacaccaacgaatcgattttctatattcgccactgatattagcagaataataggtaccggcttataggtgttggtttatttaaaaccggcacttatactttagaaaaactaggatctatacttatattacaggtgctggatctatataaaattaaatcgggacctatagtatttgtacttatttttttttaaaaaagggcacctataataaactatgggaacgggcacccgagccgagctgaaccgagcgcctatactccactcttagtccttatccatctggccatactccactccttcattcttccctccctcctcctcacctctgttgcgaggtggtggccggagtcggtggaggtggttgcggtgttgcctccatgtctgctgccctcccctccggcccccactcccttggcggaggcgaaggaggactgcggcggccgcctgcggaaggctacatccagcggcagcgatagagaagaccagcgcgggcggccattctctgctgcatccgcctcccccctcccccgccttctcctcctccagatccaccgccggtgaagaagaccgacggtagagggcgaggcggcggccggatccggcgatgacctctcctctccatcaggcgacgatgccggtggtggttttaaatttaatttttttttgctttggttggttccatatagagcaaacaattaatagaggcctccatcggtagtcgttgagttaatatcactttgggctatgttttatcgtaaaagttttagtttggaccaccctttgtccatttttttactttaggctaggtaactttatcttaatttgttgtacaatagactacctcaaaccacatctttagcacttcaatgactttgagcaaaacattaatgacatgccggcgaattttcatacttatatgcatgtcatacctttatcaaggagacgttagacatggtttgcgaagagagctagaatggtccattaattatgcaacaaatataaagttacataattcaaagtgaaaagattggatatagaatgatcatgagttaaacttcgacgataaaacatggtacgaagtgcaattcactcttaaacttgtcatcctctaaaatttacttaaaataaaataaatgccacacctatgagaactgatttggttttatttgataacataatatagatatgcgcatagaaatacggattcgaatcggaaagtcatgtacgcaagcaaatcaagaactgtttatgtgatccccagattcctattatatgataggacagtaggtccatctctatcccaagctagtgcaccacacatatcacaatatcagccaaaactcatgcaccccactcctctctgactccgtagtccagttgaaaagacaattaatcaagtgaaaattggaaccatgtcattataattttataaaatttaagatatgatatcctgacccacatgtcattgactcatatgggtcctcatatcattgaaataccgatggcatatctcaaacattgcaaaattataatggcatggttccaatttacccattaatcaacgggaaggacgccgagatgtgttcggcactgcctgctagtaactttcagaacggaaaagagttaactcattttcatataattaattatgtattagctaaaagagtaattttattggttcttgagaaggtatcagaggcaccatattttctacagtgaaatctggtacctccagggttaggaggtatggaaatttatggtaaaatttttcttacctctcagtataatttatctggctaaaaacttaaaaattagattaatatgaatttttaaaataacttttttctgattttctctaattctccacagcatcttcatgttagtacagtagtatatttgtgtagatcaaataaattatggaaagtcagcgcgcgtgcagcggcggctcaagaaatttcgctgtcacggctctctcacggcattgatcttcccaaacccataatgccaccactcgatcgatcaccacactgctgcaaataatcgactttctctctctctagtctctatatacaatatcgatcagtggagcttaatttgcaaattaaccacattcgaatttctctctctctctctctagtctctataaacaagattgatcagtggagcttaatttgcaaattaaccaacattgcattgcctacgcaagagcgagcatacatgatttccatggcgccggcggcgccatttccacgtcgtcttctactctcgctcctcctcggcgtgctcgtcgtcgccgtcgtcgcggcggccgacgtcgagtcgtcggccggcggcggcggtggccgccggcattcgccgcggcggacgcgctactcccgcgtgttcagcttcggcgactcgctcaccgacaccggcaacgcggccatcctcccggccaccgccggcgggcccttcacgcggcctccgtacgggatgaccttctaccaccaccccaccggccgcgcctccgacggccgcctcgtcatcgacttcctcggtaaacatcaacgatatgatcccgattatttttttcttaaaaagaaaaaaaaaagaaaggtcccaatcatctatgatggagaataagtgaattgtctgcttttcctcgtcgattttgctatatacttatccataaattttttccttaaaatttaacatatgtaaatatagtacaatctcagtgtaactaaggtgatgtttggatacatgaactaaattttaatccctatcacatctgatatttggacactaattataagtattaaacgtagactaatgataaaactcattccataacccttaactaattcgcgagacaaatctattgaccctaattaatccatgattagcctatgtgatgctacagtaaacatgtgctaattatgtattaattagacttaaaaaatttgttagcgaatcagctctcatttatgcaattagttttattattagtctacgtttaatacgtctaattagtgtccaaacatccgatttgacatagactaaaatttagtccccgatccaaacaccacctaaatacagtaatttgcatgtaactaccatttaactacgatataattttaaaccgttatatttgctttaaaattcgtgcaaggacggtaggaaaaaatcacaacccacacacatgtgggaggattcggtaccgttacctctgttttcacagaaatagcatgtcacctagagatttttaaaaattatatacaagttatactatagttacttgcaaactataatatattcacatcacgattatactacatttacatctgtcaaattttttagttaacaaatatatagctagccccgcaatcttagttttctgattgaacgtgcatgcagttttacttaaacaaaaccatggattaattagttaattgttatcatgtatgtaattcatgtgacgtcgtcttcatcgatcgcttgtttgtgtggactgtggagcgcatgcatacagtgaaggcgctggggctgccggagccgacgccgtacctcgccggaaagacggcggcggacttccggcgaggggtgaacttcgcggtgggcggcgcgacggcgcttgacccggcgttcttgaagagcaggggaatgacctcctccgtgccagtgtctctcagcaacgagacgaggtggttccaggatgtcctgcagctgctcggcgcatcagcgcacggtaattaagctagcattgcacaacattaatttcatgcttctgatgttaatagttacctagttgattgatagagtgaaagtaattaggccgtgtttagttccacgctaaaattaaaagtttgaaaaaattggaatgatgtgacgaaaaagttgaaaatttgaagaaaaaagatggaaactaaacaggccttaacaaaattactcaatcaggctttggtaggttattccctgatagagagagactttttttggaaagtctttcttttttgagagatcggataggagctctgccatttaaagacttttggaaactctcactgttaatcacgaaagtttaatactttctctatttcacacactgtaagattttttgggtgttgaatagattcatacattaattgatctatgtatatgcgctttatatatgtgcccaaatttaaatgaatattaataaatttagataaggcgatggagagaacaaaacattttacattttacagtacggaaagaaaaggagggagtgtatctaaacacaaaatgaacaattgggttgtctatttgaaccaatggaaaacacagttttgaattttgactgaacaattgggtcggtgaattaattcacatgtggcttctgatcgatttgggttgtcaaattgtacagttttgagtgaagtttaacacgaagaaatacaaatgtcttgcttgaataattttttaagcggcgtaacttaatttgatcgcaccgtacgtccccaccataacatgtttttaccaccaatattttctactacttcagagaagcacacaatcgcggcaagctcaatcttctatttcggcgagatcggattcaacgactactctttcgccctctccgccggcaacggcaccgtcgacgttgcggcgagcttggtgcccgacatcatcgccgtcatccgttcggccgtcactgtaagagcagcgcatactaccataaaaatattttttctgtacaaggaccctgtaggttatagacggtataacggactgtaactgtctcgtctaaaaaatggacttccattttcacagatgactttataataggagcgcatacaaaaaaaaatctattttcataggcggacctcttaaggggccgtttgtgaaaatgatcatattttcgcatgtggttctcttaagaggcagcatacaaaaatctattttcgcat

SEQ ID NO: 82756 - DNA, 108592 bp, Oryza sativa
acgcaggggacggcacggaggcggcctgcatggcggccggcgcggcagacgcgggggaccacacggcggcgagcggtgggcggccggcgcgagcggcgcgggaggccgcgcggaggacggacggctgcggtgggcggccgctcggcggcaaccggcgcggcgctggccggccggcgtggaggggaggaggggaggcggcagtggccgccggccggattttttttctttttttttgagatgtgaatctgtgatgtatttttgtgtgagatgtgaatctgtgatgaattttttagaaccctgtgatgtaatttttttaagagttggtaatgtatttggagatgatttgtttgaggatttggagatgttctgtaatatgtgatgatttggatatgggaggggatggtgtgaaatcaatattcaatattaaaagcagaaaaaaaaagaaaaaatatctttagtcccggttggtgttatcaaccgggactaaagatgctcccatctttagtcccggttggtaaagattgatttttagtcccggttatttgaaccgggactaaagatagcgatctttagtcccggattcgtagtccccaaccgggactacaggggggttacgaaacgggactaaaaagcatttctccaccagtgatatacagatccagcggtatcaatctgtggataccagcaaagactgcatgtattgctagtttttctttaaaaaaaataaaatatgcagacgtgtgtacgtgcagtcagcgtagtggacacagcagttgaacttaattagctaatgacagcaaaataaatttgtgccatcatgttggttaattaatcgcaggtccaattaactaaggcaaaagtcatcgtctcatcgatagatcgagtagtttaagtaggtagcagatggaccgaacaaacaagtagcatcgcagatgaaacctaacaagttgagcaaatggtagatgaacatatgaatgaccaatgattcgtggcacttcgcagcagcgactacatcactacaagattctctaaaaccggcggaatcaatggatcctagctaagctactaccaccagtacacatagtactacagtactagtaaccaaattaagtagcagcactgtgcagcatttagttattgctatgctaatctaagtgcgaaccttctctgcaagtaaactgaggaactgttcatatatatgatgcagcaacgccacgtagcagttgctgtcacgtcatacaacgcatcgatcactaattgacaggttagctgaaatacaaatactgttgcagaaaaggccagcgactggtttgctacttccagacttccagtatgtgcctggtcagtctgctgtttaatttaattgcccgcagatcacgttgaacagagagatacctgaattaagcagctcaatgccttgcagtagtttagtgcagttaggaaatccatgaattagcatctgttgaagtggaggataattagagcattttcaaggaggaggagtttgagacgtaaatggtattgcactttattcggtaagctgctgtactcactcactgtagtatgagcagtgccatggatccagcagcagttggcatatctgaatataatagataatacgtttctaaacatttctgatgattgatactacagattatgaggtgcatgtgtacatggcagcatgcccggtccgtccgggaaattaagcagcaacgctcacctcaatatgtaaccatggagcactagttagttgatgaattctccatgtattgccaagaacatatatacatactcatggagtacatacatttcggtggcgatcgagtagtcaaagcgagagatccgtcacccacgccaactcatgttcgtcgccatgtgcgcccatcctcccggcactaactctcaagccgatcgaatttgatcagtagcttaattatactttagtactaccacacccatgcattgctcagctcgatcatcagttcgcacatatcaaaattaaacactagctagtagctagctagacagtttaccagctgaatatcatatagtagtacacactcatgcatactatacggttactacacctatttattattcttaaattcgaattttcgatccatacatacacaggtatctcctttgctacttgcagcgaagcttccaaagcatggactagtctaattctttagtgatcgagggtagtgatggcaccaatttggatgaatcggtcgagaatggagtatttctcgcgtcagttacagcagggagtacgtagtaacagcagctagtgctcgatcgaattcgtcgacttgtagtggagtagcagctatttcagggaaggaaacggcaaggcagctatcttcgtacgcctcgttaactgcaacccatcgattgccacatctacacctacgtatacaaatacacaaataaatactgcatacatacatgatacatacatacacggccgctgctgatagctcctactccctccagcccaaaataagtgcagccataagtttccgtgtccaactcatcttatttgaaatttttatgattagtataatactttctccgttttatattataaaattttttagtattgttcacattcatacatatgaatagtactttatatatgacttatgttttttattttttaaaaatgtttaaataaaataaattggacacagaaactcacgactgtatttattttggaacgaagttagcagtagtagcagcagcagtcgtcgtcttggtacagtgcgtacacgtctcgatctatattagtttagcactctgcccgctgcagagacttagctcgatcgatcaattcatctcatcgtccatggcgcccaaggtggcggtcacggaggcgacggggcggcaggcggcgtcgttcgtgctcggctgcgtggccacgctcaccgtcatgctgctcttccagtaccaggcgccgccggactacggccgcgccgccaggtcgccggtgcagttctccacctccagagaccagctgctgctgcactgcggcggcaatggaacggcgccgccgccgccggtgatcgcacgtggcggcgaggaggctaacatcaccggcaagcctccgacgactgctactgctgtcgccgaggagcagccgccaaccaagcctcctgcgacctctactgcatcttcaccaactcatcatattccagcaaccagtacagatcttgaagaagaggttagttctcattaatctcccggcttaattaattttcacttctttaatttcttatgcgtcatctggtatcagtaatctgctaaatttgtgccgtcttgaattcactctgttgcccacagtttcctcacatgttcaaaattaactcaacagtacaactcatcataataaaaacagggggttcttcaatttcagtaggacacaactaaccctttttgggtgtctgccaaatgcaccaagaaaatgattttgtaagatatatgctacatataaccacgaattcagaaatcattccatgagacttgatctactattttgacttcgaaaaagagataggctaatcaatttgttatatattaatctcgatccttgattacctttttgtacttgtttcgagtgtacgaaaagtggcaaagaaagtcctaggatcttacaccacctagtgattcacgctaatttgatcatcaatggcggcagggcggcgagttccgggggttggcggcggcggtggcgcgggcggcgacggatgaccggacggtgatcatcacgtgcgtgaaccacgcgttcgcggcgcccgactcgctcctggacatcttcctccagggcttccgcgtcggcgacggcacgccggagctcctccgccacgtcctcgtcgtcgccatggatcccaccgcgctcacccggtgccgcgccgtccacccccactgctacctctacaccatgcccggcctcgacgtcgacttcacctccgagaagttcttcgcctccaaggactacctcgagctcgtctggagcaagctcaagctccagcgccgaattctccagctcggctacaacttcctcttcacggtaattcagtaactgtaaattgaaattaacaccgccattgactgcaaatcaagatgaactgattaattaaccaattgcaagatcaggacgttgacattgtgtggctgaggaatccgttcaagcacgtggcggtgtacgcggacatggcgatctcgagcgacgtgttcttcggtgacccggacaacatcgacaacttcccaaacacgggcttcttctacgtgaagccgagcgcgaggacgatcgccatgaccaaggagtggcacgaggcgaggagctcgcacccggggctcaacgagcagccggtgttcaaccacatcaagaagaagctggtgaagaagctgaagctcaaggttcagtacctggacacggcctacatcggcggattctgcagctacggcaaggatctgagcaagatctgcaccatgcacgccaactgctgcatcggcctccaatccaagatcagtgatctcaagggtgttcttgctgactggaagaactacaccaggttgccaccctgggcaaagcccaatgccaggtggactgtgcctggtaaatgcatccattgattttgattgtcgatcgggcagtatctggtgttgtaggctacgtacagtcaggaagatagctttatttgcacatgaaagggcgaattttgttttttttggtttgttgtagattgatgggtcgatttcaagttatattactgtatacctgacggcagacaagtatacgcatgatgggcaaactatatgatatgatatgatatgatagtactttagatgtaaagatgtcatcatgtcttcagctatgattgaatgagaagtacatccatccaaagagagaggcaacaaaacaaaattcagaaagattatactatcccatctcaaaactgtctcgggggatcagtgcaagagccacatgcctcatgtttgtttcttcttttgattgattgatggtccaaacaagacattttcctctcgcggacaaattcttttgggccctcagagctaggatttttttggcccaataaatttgatgggcctgaaaaggatcggcctgttaggccctactactaacagtgcacggcgccgcttgaagatgtgcaagttgaaaatgtggccctttcccgtccttccaaatttcttttcagttttgttacccaaaagtattcaaacaccccagcatcactacataatacagtatatctctgagtggtcttcaacacaagtgctatctttcaaatgctaaacggtaaaagcaacgatgtaaagtaaaaccatgcaccactgagagctcatatacttatgcaagtgacttactttatgacactaataatccggcgtcaccaagatggagcggccggtaggagaaacttcaccgagctagctaggcgccgagacggaggcggtcgatcaatctgttgccgccgtcgccgcagttggacgagcggatcctgaaacaaaaacgaaaaagaaaccttgatttatataagggcggttggatcatattcatattcatgtacaccctcccttttaccaaacttgaaggatcactttttattgcatatattacgctttggatctttctaatcactgttttcactttagacgaaatatttttataactcttttaaccatatacatttaacttgtcatatgtcaaaaaaaaatgatcttacatacagctatgagagtgtttttcaaataagagctgacgtatccgagatcgtacatataccagaaggctcagatcatggcacgttgcctgcggcgtacatactaatctcagaacacaactttgtactgtcttctcgatcattacagacagcaaattgttcatctgaacacacagctacagagcagaaacccatgatggagctctccttgttattgttatggatctccctactattactagtagttgcttattatcacgtacggtgatgtgatgatctacatgaaggagcgcatgcgcgggcgcacgatggactgggcgccatccacgaatatggtgctgccagtcatgtaccgggactcgtccccaaccaggtacagcaccgtggacgccacgtccttctccgggtccagccatctccgcagcggcatcacctcccccgtcgccttctccgccttctccttccccacccacaccgggaacctgtcgcccaggtgcagcccacggcacaccgcgttcaccctcatcttgtgcttgcccagctccattgctgacagctgaagaacacaacaaacatttagtacctcttacagttatgagtgttatatttcgagatcaacatggatcgaatcaattgttaactgcaatgcaagtatcgtctacagagttatgctgattcaagcatgtttatgaagaaaagcataaatatggccagctgagatatttcttcagttcagaactgctggagttgtcagccggttattgtgcttgcccagctccattgctgacagctgaagaaacaacaaacgtttacctcttgatttgagtggtgctcgaattcaacacaaacagaatcagttgttgattgaaccggaagtgctgtttatggaggattggaggctcttttctcaagaacaacatatatttggccaggatccttttttcccagttcagaactatcagggtcgtctgttagttttcaactgaaacatactgccatctaaatgtatgcatttcttcatttcaagtgcattgcaagcttaacattttcaggctttgagcaaagcatagagaagtaaagcagcagctctcaatgatgaagggagaacaatggtactagtcagttggcagtacttgaacagaagacttacccggaccaattggtgaatggcacctaaacttgtaccatatgcagcagcaccaggatacaatcctctctcagcaccaataatctgagttaagaatacaacagaccctccacaactggattctgagtcccggagtcgctttgcaattgcctttactagaaaccaaggtgtcattacattcgctttcattgtcttcttgaactcatcttcgcttatattgaggcagtcttgtacttcacctgcccatttgggaaaaacaaacatttgtaaatgaaaacaaagcgccattttgctgaagtagggggttccagattgtgtcatatcgtggttaagtttgatcaccaggcatacagggtacaagcactaaccaattgatcctttcagttgtatcctattactgacaacaatatctatctgatactggttttgtgaactaaggcacttattaagaaagctacggagaatgcgacatgaagtacatataaaaatacaattcactttattgttgcagaaatttacagtgaaatttcaacagttcatagttgacagacagactgatccacccattgcccaaggcacattttctcgggtagtaatctatgaaagatcagatagggaattttctctaaaattaaaattaggtgagcactgggcagactgtttggattgagcttagagcatggcgaaatgttgtggttctcagctacgagtacacgaattgaagtcgaccggaggaattttcttttgaaatgcagaggaacaactaagaattagctctgcaggaacagcatacagaaattcagaagtagtgtacggaccctcgtaggagtagcagttcaccatggcgtctaggccgtcgaagcagcgccacgccgtgcccaccgccgcgtcgacggccgcctcgtcgcagccgtggagatccagccccaccacagcgaccgcatctcctccgcccccaccgcgccgcgcctcctccgccgtcccagccagggcgccctcgtcgccgaccaaaaccaatctacggcgggagaggacgaattagagagggagagtggagagcacggcgaggcaagaggtccgtacgtacgtaccggcagccatgggtggcgagggtggaggcgatcccccgggagacgtcgtcgccggcggcggtgagcagcacgcgcttggcgtaggcggcgtccccctcccccatcgactcgttcagcatcgttttctaccagacaaaaatggataaaatgctactccctccacctattttccgtacctaattttaattgtccgtcttatttaaattttttttaaaaaaaaattaaaaacataagtcacgcataaagtactatttatattttattatctcataacaataaaaatactactaattattaaaaaaatttaaataagatgaatgatcaaagttgagcacggaaacttatatacacttaaaatgaaatggaggaagcactactactagtctccagttttcttttcttttcttttttttttcttcaatacaacaacaaaataaattttaggagaaaggctgtggtaagaaagcacaccaactgacaatcaaacaaagcagtgaaaatagaaatgcggatttattctatctgcaacattatttttgacaagtacatactggagcatatggatagaacattactttcgacaattacagactcactggaccaagaggataatctattgtgtgctgagcagttctatctgcaatgcacaacaagaaggccatgccaactctcatgtagagtattttaacttaatgctaacacaggattccctagttcttcaggtataaatattagtacaacagagcatattttacacgattttatgggttccaagtacacaggattacaccagggcaaagatacagataattcaccaccttgggtcctctccagcaattcacacaactgcccatgttttccttctctatagagtacaactgccacttcaatttatttctctatatcccagaaaatgatttgatcatctaaaagtgcatagagagagaaggtgcagtggcaaccttctcacgaaggttgaacttccttgcaatacatggccggacatcttccaccccaaccaaactttgcaaaaatggaagtaatgttaggagttctctgtcattacgatcatcaaaccaactttcaatagggacgccgttgtctaattggaacccaaaggcctgaaagcaagatacagatgtattagcaactatacttttggttcgtctacttattactagtgctactaagattgcaaaactgacgtgacaaaaaaaggaggtaaatcgcagctaatagcatagaaatctcaatacaggctacaagaaactgaggctattccaaatgaatagaaacaaacttattagaatttcatttcaaagaaaaaggaatcaaattgcacccaaagtactattgctcgggtccaacagaaatttcactataaggcccaatgagcaatagccctttcttaagcactgctgtactaacagaaagtagaaattctataccatatccaactaagaatgttccacgactattactacagatgaagattttgaaacctgagaggctgagaatatagtgacaagtccagtggatagatttgctgtactgccaggagaagacagagaaactgactaatacaaacatcattgatcactgacccaaaaaaaaaaaaaactttattctttttcttcatcaagtccatgtctactattagaatgttgaattatgaattttaccctcgagctaacatatgtagccctatcacccaatatttacacattacaaattataatgctaaacaacgcaaagagactattgataactaggtttgctttaacatcccactactttgttagaaattatttttaaaacccatggaatgaaagatgtgtgttttcttaaaaaggaagaaatgtgtactccttccgtactcgtaaaggaagtcgtttaggacaatgtttaagtcaaaccttgggaatataaatcatgaataactctcaagttattgagtttcaaaatgtaaaaattatatgaatagattggtcttgaaaaatactttcataaaagtatacatatatcacttttcaataaatatttttatagaaataagaagtcaaagttgtgttttggagaccgtgtcgctgtcctaaacaacttactttacgagtacggagggagtacagttttagcacatacctgtggtgaattatcaacaatgaccacacgagccaagtcacgtccaagaactgatagatcctttaagtagtttccctccacaaagagacaggactcgcggtaaactcgatggcggaacaacctccttttaggatcaagaatattaagtagctgttctgcataaatactttgactagctgtgaaaatgatgatctcaaacatgcttgctactgtctccaagaactctttcagatatggacggcaacgcacatagattgtgtgctctctgagattaaaatgaactgggaatgtgaagtcagaatcttcacagggctcaagagtagagtgcaccagtgtctctgcatgacagcataacaataatggtacattaacattgactgcacaatataaagtacagaggttacatgtaatggctaacaccaaacaacaggacagactgtatatgatcaagtaaatgaacaaccggagatattgaagctaaacagaacaggaatgtgcacacatctcatagggtggatgttctctactccctccgtcccataaaaaacgaatctaggaccggatgtgacacatcctagtactacgaatctagacagaggtcacatccggtactaggttgtttttttatgggatggagggagtactcactaaaagctaagcaacatgctttacaattatatcataagtggaataataagcaagttacacgatcctaataacaatatgcaatccattttgacataaacttataactgtgcaaaatccaggtctcatgagctttaacatttccaagctaatcacagattattgactttggaagaaacataatcattaatgattccattaaaggagtttaccaagagtctatccaagttaaagtgtgcacaacattcacatcttaccatccagatcaaggacaagggtagttctaggacagctccgagtttgctttggaagaagaacaggttgaaacttgggaaccaccaaagataaatcaggcaaatcttttatgaaggcatacggatcaaaataatcaagctctacagtttcatcaggatcagcacacccatctgttgaggtagaatcttggctttgttcatcaatacactctagctttgagtgctgcattgcaagatatatagcagacacttcaggagaaaggctgcccaattcactgaattcatcaccttcgagcgtgcttccacatgccgattgcatatgaatatcataagagtgtttgctcaaaccatcaaaagtattgcatgatatgctattggtaacatattcagcattctgaacaggctcatgtatgacttcttcatgtactaagcctgcataatgacaatggcgtattggaaaatacaaactggagaagcaatgcagcaggtatcagtatgcacagagtgcatctaaatatgcaatgtacactatcatgaagtcatctaaaaaatgttgtttttcttattctctagataaatgcatgtgaaaaattcaaacacagatctgacacttggagtgcagaaaataaatgctaaggtggagttatattcaaaaggtaccttcgctcaagcagtcagtaacatcttccttctgattgtgaaaactgggagaaaatatggaatcacatgaacgatcttcatcattttcatgagattgctagcaatagaaaaagatcaaccagacaaataagtaaaggataaagcaacagtcaatttgaggttatttcagaaacaatattgctttcctcttttttcttttttcgcttttatcgaaacacaccgtatgttaaaatgtatgattacacaaatagacaacacctgaccagctaaaaaattcactttgagcagaaagaactttaccttgtgattgaagaaactgctacttggcacgcccgcgacatcatttccagtaccagcagaatcataaatagaattcaattttttcccacccctaagagctcgatttttcttcagaaggcctccacctgcagaggtagcaattcatatttggaacaaaatcaagaaaaatctatgtggagccacaaccaatttcaagaaaactaaagataaaggaaaattgaagaataatttcccaaataataccaagcataattgtagtagtggacaaaaaaaaggcacttaaacatcaggaataagcttggatataatgagcactgcagaacacaacaagtaggatgaaaagctctggaagttttcagtttactctcccatactcatagtttcatacattcctataaataggctatagctttgtactgtacataatagtaggggaaactttaccgatctgctttttggaggaagaagtgatcagatcattgactttatgttcagcagctgcagcctgagttgatctgcttgattttcggctatttgggggattgatatgctcagtggtggcatttcttgcaaggcctttttttcttgttggcattttcaatcaagaagtgtcctaaatagcagccgatttatataccagaacaagaatagcacatcagacaagcagacagcccgtttccttggtgaagactgctcagggttattgtgcaactttcagggtgctgacctagaggaagatgagaaaggaatcagctataagcagtacaagtcaacaaactgcatttcaattttcatacacgattgtttaaaatgatgatacacaaaagttggtataaaactacagaatacttcaggacgtcaaagattggaaaattaacttcatggaatgacatacaaactcactacatacactgaacttagctcttaggtacttcaatcaatatatgtcaaactctccccacagtcatcaaaaaacaggacgctactacggcatacacacttcagtcactcggtaggccactccgtacggcactcaccgtatcggcgttcgctactactacaggagtgacccctcagctcgcggcagcgacgaaatcgcgcatacggaagtcggaggaggcggtcgctggtcatcagcgccggcggaacccagcagcattaccggaaaatccaagcatgaaggtgtcgggagtcaaagaggcataccggaacaaggagagcagaggcggcggcgggcgggacgggaccagccggaggaggcggcggaaaccaaaccctagcggcggcggccggagaggaagcggacaggagaagagggatttttgaatcgtcgaagaggggagggagctccaaaagggcgagaaagtaagcgtgtcaggtgggccccacgtcagaatccagtaggtgtaggcgggccgcctggagcttggcccattaaggcccaatcaaataatacaggcccagtaagctgaaagaaccatgggctataaatagctagctggttttcggggaataaaactccgaaccccctcgacaggttcgggaagaacacgcgttcgtatctgcaacgcgaaataactcaacggctgcatatgcagagttgaatttgaacttatatatattacatgttaatacaacttcttatattttttaaaaaaaatcatatctatatttaagtaacatacggacacaagtaaatattccctccaggactcaaaatccacttcctatatataccaccagaagctagcaggaacgggaaggcaggtcggtcatacacgtaagataggacgagtatgagagagcgagagcaatagcaaagcccagtgatggcgacgctgctctccaagctcctagctctgcctcaacaatggcagctcctcctactcctcctcctcctcccaatcgcctccctcctgttggtaattggcaggaacaccggcggccgtcgtcgccggcggcatcttagactgcctccgggcccagcgcggctgccggtcctgggcaacctgctccagctgggcgcgctgccgcaccggagcctgcgggatctggcgcggcggcacgggccggtgatgatgctgcggctgggcgcggtgccggcggtggtggtgtcctcgccggaggcggcgcaggaggtgctgaggacgcacgacgccgactgctgcagccggccgtcctcgccggggccgatgcggctgtcgtacgggtacaaggacgtggcgttcgcgccgtacgacgcctacggccgcgcggcgcgccggctgttcgtcgccgagctcttcagcgcgccgcgcgtccaggccgcatggcgcgcgcgccaggaccaggtacagtacagtacaacgatagcctgcatcttgtttgtctccctactgtgtggtacacacaatttccatctaccaagtgggcaaaatttccacacatgtatgataggcctgcttggatggtgaggtgaaggagacattttcattgtacatgcccttgatgatgacatgttgataattggttggtggtaggctggtagctagctattacctccataccgaaataattatagttttaagtattaaggttcaagaagaaagatgtccttcattaaatggtgaatatgtgagattgtgagggtggttgagggtaaaattgagagcaatttaaatgagatatcattgatggaacaattagtactctagagtgacaactgttttgggataaattttaaatcctaaaaatgcaattattttgggatagatatagtactagctactccctatgtcccttagaaaaccaatttaaaatggcatgatatattttcttgtacataaatgtaaataagtttttatcttagatttattatataaaaaacttggatttttgtgggacgggggtacggaagaagataacgagtagcagattcgcgattttgtcttcgtctgtatgtttccacctattattggatatatggaaatctcgctagctgttggggggaagttgcatgcatttgacaaaatggaaagcatcggtgcaagtggatttgacaagtgaattactttatctatacattaaaattaataatctagaaggtgcttggttctcatctccagctttaataaacataaatatgattaaaatagtttagttgagatgttataagttaatgagagagaggagacaacaaatttgcaccttaatcagatcatgtaatgtacttacatgcttcctccattttttaatatacgaagttgtttacttttaacattatatttatcatccgtcttattaaaaaaaatatagatataatttattttcttatgattttttacatcaactaaattaaaatctcaactttatacttttacatatttatactaatttttaaattaatataaatgatcaaacgttatagtatctaattcgtattggttgatatatggaggattttgcaatctaatcaagtgcatatacattcatttactcatcacgtttcaaacatcaatcaaatagttatacagttcttaaataattgacaacatttaaatcaaaataaaagattcgatcataaatattactactccgtactaccataatttttattatagtgaaatctgtagggttttaccttagatgtgttgatgattgaaatatggcagtgatacaacgtatggcttggcacttggcaggtggagaagctgatcgggaagctgacacggccggagccggagccggtggagctgaacgatcacatcttcgccctgaccgacggcatcatcggcgcggtggcgttcggcagcatctacggcacggagcggttcgccggcggcggcaggaagcgcttccaccacctgctcgacgacgtcatggacatgctcgccagcttctccgccgaggacttcttccccaacgccgccgccgcccgcctcttcgaccacctcaccggcctcgtcgcccaccgcgagcgcgtcttccaacagctcgacgccttcttcgagatggtcatcgagcagcatcttgactctgacagcagcaacgccggcggcggcggcggcaacctcgtcggcgccctgatcggcctgtggaagcaggggaagcagtacggcgatcgccggttcaccagggagaacgtcaaggccatcatcttcgtaagcagcagcagcacacgtcgtcgtcgtcagctagtcaaatacacaaacacctgccacgcatggcgatcgtgacggcgatctttgcttgtaattgcaggacgcgttcatcggtgggatcgggacgagctcggtgacgatcctgtgggcgatggcggagctgatgcggtcgccgcgggtgatgcggaaggtgcaagccgagatcagggccaccgtcggcgaccgagatggcggcggcatggtgcagccggacgacctgccgaggctcgcctacctcaagatggtggtgaaggagacgctgcggctgcacccgccggcgacgctgctgatgccgcgggagacgatgcgcgacgtgaggatcggcgggtacgaggtggcggcgaggacgcgggtgatggtgaacgcgtgggcgatcgggagggacgcggcgaggtgggaggaggcggaggtgttcgacccggacaggttcgaggcgaagcgggtggagttcaacggcgggcacttcgagctcctgccgttcgggtcggggcggcggatctgccccggcatcgccatgggcgccgccaacgtggagttcacgctggccaacctgctgcactgcttcgactgggcgctgccggtggggatggcgccggaggagctgagcatggaggagtccggcggcctcgtgctccacaggaaggcgcccctcgtgctcgtgcccactagatacatacaactataggagtacaaatgaaatggaatttagctagtagcaaagccgcgacttcggccttgattagttcctaaattattttttttccaaaaacgtcacctccaatctttggatatatatatataaaatattaaatataaataaaataaaaaattaattgcacagtttgtatgaaaatcacgagacgaatcttttgaacctaactagtccatgattagccataagtgttacagtaacccatatgtactaatgatggattaattatgcttaataatttcatctcgtggttttcaggcgagttatgaaattagtttttcattcgtatccgaaaactccttccaatattcagtcaaacgtttattgttacaccctaaaattttctttttcgaactaaacaagcctttcatttcatgcctctctcccctacgttttgctgctttgctgttcaacatctacatacttattgctccttcacagatgtactcctacttcataaattaagattgggtgattagaatggattggtaatttgttgagatatgatgaactaatatctgcgtgtaataacaaagtttatgctccgtcatgtcctaattacttgaagaattagctgaggttgcgtgaatccccagcaagacgagaaggtgattccacaggaggcagattagactagagtggcctgtaaatgtgttttgccacagatggaggatggaacaagaatagtaggagactgacagagtgaatcatataattgagccctcatcaatccttagataggcagacctgtcgaaagtctactcgcctagtaggctcttcaaaagccggccataacgcatgccaggctcagctagtctgatgatctgctctttttatccgatactttttgccattcttcggaacatgtacagtcacgacggacctgaccagggtgatggcttgatctgatccttattgtaggtgatctgatacttatctcattcctccataccatgctatgctcttctttcacatgtaccatattcgatatgcccggtcacacgagagcaaattcattcatgtggctggggaatggaacccaagtggctgaggggtgtccatccatgggtcaacccaaataagcaagcaaatgtgacaaactcgttgagaaatttgcagagaagaatataaaatccaaatccccggatgccctccaaaaagctaaggtgcacagatacacatctcacattctcacatccagcaggccaatgatccgttgatcgccaccttttgcttgtcaagggccaaatattcttgttgtgccaaacacgctgcctccagccaaagtcagaagctccttccttataaatatatgcccaggcatgcaaccatcagtacacagccacaaatgcaagtgcagatgactgactagaagagaggtcttgcatggaagtaagaggccatcttcgatagccaaggatgatttgcctgtagccccattgtcatcagctctctccgtcgagagcgacaaccgggctctactggcaagtctcctcggctacccgagtacctcttatgctatcccatgtcagacctgctcttctttaccatcagtgatcatcaaaattcacaacaccaacaatgaggtaagcaatctaagtaacaaaacgtcccagtgattaccttggtggcgcttgtatgtaccaaaggcatcctctatggctacactgtattattctgcagttctgtcattgccaatctgccattgtggtactatcagccaccaccatgccacaaaaggttacacttcggctgaaaacacacgtcttgtttagatatttagtatttctggagttcctcccaaaaatatatgatctaagctttgaaaaaatatcaaggatgatttttatttagctttgcacactcaactcgtagcctttcctttttttcctttcaaaaacacaggcacacaatctgcccatataaaacagagcagcaccggagtacactgaaaattcttcaagtgcaagactataatattagggaaccacggtatttcttgggggtgacattcaaaaaactatggtttttggataaagggtcccactcactatcatttgaaatgtatcaatgtctctcaccctatcgttccaaccttcatgtcaggccgccatccagaatgtcttaaaccaggaggtattaaggataacctgtgaggaaggaagaattggctgagtacttcaaaagaaacctctactacctgaatctggtgccttaccaatgcgattcaacttttcaaccaaaaaataatctggcagtactaaaaaataactggtctacttatttctgtcaattacaagcccataaagtcttcttttacttcaaatatacatgccatccgtacttgctcagccccccatttccaccttttagccagttgacctcatcgttaacacaagttggagaaacattgcatggtagtactagattgtacatgatgtaaggaatatgtgcaagtctaaaacatgttctagcattgaaatataagcgatcagttaagggtacaaattaaatcattatgtgtatttgcaaaaaggttattacaaataaaaccagaatttccgcatgtttctgagaagatagtcaagttatatattagcacaaccaagatataaacaaattcaacacattgaaaattgtatttgcacgataattaacatgttgaaatcattgataaaaatgaaagttaataagccatgatgaactccctacatcagttgtctgcatgacatagaaatgataataggcaaacaaaagttgaagcatgtcgaaatgtcaatgacaagtacagtggaagagcggacaggcaaacaaggcaacaatgaactgacaaatataagcaacaattttaaagatgaatattaaataggacagaaggaacacgtagctattttttgctgattagatggatggaacccataaggaacatagcctggtactgtttcaattagttcaattatgatgatatcaatcacctgccttacttttcatatgaacaccttacgggcataaaacagcatttatgaaaatagttttcaatggctttcatgccataaagttctgtttaagcattctatatcagaccaacaacggatggagataaatgttgattgacttgaggacaaagttagataccagtttctatggacctgatgttgattttttttttgttgttgttggaaatcatttcaacaaagaatagtcttccccacttgatatggaataattcctcatggggatcatgtgttgacctttcatagccttttgcaaggttgaattttatgcattatttaacaatgaccttaaacagagctcaagaggtgaacaatgtatacatgtttcgaaacatatcatatttctcatgatttctggtaaaacgtatggtcaaaatagagaaactggtcctgagcaattttgagaatatatacctaccatggtcaggaaaagattcaaaggaaaaagtgcgctgatgtgccataaaggaaactatgaatagcatattgatttttatgaaatctgtgtggctgtcttgctgcatgtgcatacctactcctttgccgagtatgatttgcgcccttcctactcgaagctgtaatcctaccttacctttacaagaaaaaaattcatgtgtcctaataagaagctgtttgaatgttctcagcagctcttgcccctcactaagcctgtatgatgtacctcttactacactaccaaaaaactgtggtgccagccagaagtcatcgagaagaagcttgctaaggtagtcagctgacaacacaaaaccagtctaaacaacatgaagtaggttagctctgacaaccgaatttaaagttgcccaatagataagcaaatagccacatactaatgagtaatgaggctactaagtagtttccattttggattggtttcattctgtttactagttgaccacataatttacattttatcactacactgcaattattggctgctttctcaaaatagaggttcgcaacgatatcaaccagagtacttagcaactggcaattagcaacctccaatttcacaacacacaatgcataacacttctagatttcgtgtgcaacaaaggtgacctatagttctatatccaacataaatttgtaggttgactaaccaaacaatatagattaaggccttcagttgtgaccaaataaagaaaggcctcagtaggcatgtaggagtcatgaggcctctggttttacagaggcatagtctgctatatttagccttttatgtcgtgcactaatcaaaatcattatcatttcatgattatttctactgggtttgagagtacaatttgacaatccgtaagaacaccttttaaatcttgaaagcacagcacaaggatcagcataggaagtagtatatcaaaaccaagtaaacaatgatcacatttattacgagcaaatacagttgattcaccttattccattcattattcaaatttcgttcaaacaattcctttcgaactagcggagtagatggtcatcaaacctatatacacacttgggttgacaaatgccataaactagcagctttctatggaaatgaaacaaaaattgggggcaatagaagctaagagctcaccaactcaggaaacgctgtcgctcctctggagcttctggatggcggcatacaacttcctcctcgacccaacggcgccgatgcccatgtccttgagatcttccaacgttagcagcgggagcacctcgtcgtctacctcgtggatctcgaacactggcgcgtaccgagagagcccaagtccatccagccacgccttcacgccaccataccccatggacccagggagccggccgttcgggagaccccaatccgccacgccgtccgactcgtcgccgctggcgtcgcggctccccgaaaccctagccctggcagcggcggcggcggccgagtcggactggtcggcatcatcatagtaatgctccgcttcttcctcgtatccgtcggtgccgggagcagccgggatccaggcggtgcgcggccggcgctgagcgggcttctggccgcggcggtgggcggcggcggaggagtggttgagggggtcaagggcgtcctccgggtgggcgcggcggggcgggcgggggtgggaggaggaggaggttttgtggtggcggcgctgcgggagcgggacgtcggcggcggcggcggagtggacgccgatgtcgccgaggcggacgctggggcggcggcggcgcttggagtacggcggcccggcggcggcctgcgctccggaggcttccgcggcggggtccccgagcggcgcggcggcagcggcagcggcggcggcggcggcggcgctgccgccgttggtgtcaggctccggcgggtggagatcggccatgggggcgaggcgagatgcgtaatccgtgggggcgaagacgagtcgtgggagagaagagtggatgattcccttcaccaactgtggcgcccgcggcttcgggagactcgcgctcctctctctcctcgattgccgctgtggggaggcacgatgccgacacgtgtcggatcggacggtgaggatccccggttgggcgctcgatgaagtcgccgagcgttgactcggtagagtcggacgcaacactctctgaactccagcttagatgggcccaggcttcagtaacacgggttacggcccatgggctttttccttttacccctccatccatttcgtgctgtactcctgctcctcgagtctcaacaagcagttgcgaacttgcaattgcagctttgagctttggtaaatagtagtaataaagtttacagagttggtgaataatcatctatgcgtacttatgttattgatgatgaactacttgttgtctcctccaggaatgtgatgagcatgattgcatggagagtgtcaaactgctgagcaggctgcagcagcagcaccaataatccataggagtagccattagtgattagtgtttagtcgttgttgcaggtaggtaaattcgtccttggacctcaggtgtctccttcaaggctcgaccagttcacgtggtcctggccggcctgaaaaaaacaaacctgttgattttgattggattttgatatgatcagacgtcctgtacccggaactgggactcggaaaatctgggcgtcgttggtcattgccttgctgtttgggcgcaagagaatggatggatatttctgaaacaaacaacgggtgtgtgcaagagaatatctgaagatcactcgccttcctgtggccactagtaattcggtgctacagtttctcttcccatcgatcatatgcacagtgcatggaaatgacctcaatgcatgaatgatgccattggcacagaacactgtcgaaccaaaaacagtcgatccatccactgattgatctgggccaatgtacctttcaaccaaatctatcactctctaattgcctgtccttttctctcaaggctaaataaattataccgttgttttctcttttactagttggcatcagcatgaatcagtttatacattatattatatagaatacatgagtatctttcggcaccaggaatcgcagatgagcttcttacataaagcataagaccagtattgggtctttttgcccgtcagacaagtccactcttgcttcttgtatgcatgaagaatggaaaatactgcagctcagctggcatgttccaagcaggtcaggcctaacagtttgcacacgaattttgaccagaaataatccacaagtccagctccaaccagcatccagattcagatgacgcagttgcagaaaaaagatcgaattcaatatggaaggattcttttcagagtccacaatatgtacaagtgttctgtgttcacttgttcagtctcaaccattcataaagagatactaacagagttcaagttcttgttgcatacatcttccaagtgccaatagtttatttattcacgattcacggttgtctgttcactgttttgtcccttgattcttcttttatttgacgagtgcgccatggtgtaagcatgaatgcgttgcgtattcagagaaagtgaatctgaattttctgttgatcaagtaacaaagaggaagacaccatcacaccacgctctacttgctgggttcagagaaccatgaaactttcagagtgggagtagactcagaaatcaattcctttatatatttcgggcttgttcacattgatgccaaaaaaaaccttatcaaattttggtaaattttggcaatttgccaaaattttggcaggatttcttatatagttaccaaaatttggcaggaaactaaatatagccacttttttggcaactttaccaaaatttggtaaggttgaaaataacatcaaagtgaacaggcccttcagctaataaaactcctacgctgtatatattttttccaatgctatgaaactctgaagcttgagatgaatgttcagagaaaaagaaaatggcaagacggttataaagtgtgccttttgaaaagtttatctataaatccatttttgggtgaggggcagttgctaaagacggatctttgttggattctttttttaaccagctgacttgatttccactgagcattttgtcctcctatgagcacctcatgcatcaatattgcatgtttgcaccgttgcgattttttatttctctttattttgtttgcttaagccgatgcatgaaggatgcaatttgtcagtgaaaatcaggtaagaagaatttgacaatcgtatggccagaatttttcaaaagaagaagaagaagaagaagaagaagaagatttttatttcattatatccacagtgtatctattgttgttttgttgtcttcttccaattcaatcagtatcacataaaaccaaaaaaaaaagactgaaagtggcaggtttttagattttcgtttggtgcattcgtcgatagtatatatgggtatcatttcttcataaaaagatggaaacagtttattgtctgcaagtgatatgtgcttgtcagctttcctgctgattataacaaataacagttacattgttgggtgactgatcagcctgatctaccctgcaattcagcaatccacacaactctaaacatgaagaaaaacattggcactagtaacaagatcaccatagcataaggcccagtttagttcacaaatttttttctcaaaaacatcacatcaaatctttggacacatacatggagcatcaaatatagataaaaataaaaactaattagacagttagggaagaaatagcgagacgaatcttttgagtctaattagtctatgattagccataagtactatagtaacctgcatgtgttaatgatggattaattaggctcaaaatattagtctcacggtttccagacgagttatgaaattagttttttcattcatgtccaaaaacctcttccgacatccggttaaacatccgatacgacaccccaaaattttttcttttccccaattaaacatgccctaaattaactagaaaacatactcctgagatcgagcaagtatttactgaagccatgccaatgcttaaaaaaagatgtagccatgaatcatgccaaagaaaatgtagtactactaataagcttagatcaaaatcaactttagtttagtttctagagagaaaaataaaaaatggttaaccaatcatattcatggtggcaatgttggagtgggacgtaggaatcgcaagcagtgttcccatcgacatacagagacagccggtggattccaaaacaaaaccggcgcgaggtgaagaccccaccacacacgtcgcttccaggtgggccctcccatccgcccacccccactcgcgtcgcggcgtccccccgcccacctttcgctcgcccatttttctgcgtcccggcggcggtggggccccgcgtctcgatcgccgtcggagtttgatccacgccgtccactggccgcgtaaacccaacggcccgcctctccccgccgtccgtttcccctccccctatataaccccctcctccccactccaacctccaaccacccccttcgcctcgccgccacctccgcttcgatccttggaagaggtgaggagaggagagatctagaagcttcggtcggtgctgacatggcggtggcgctccggttcgcggccgtcgcgcgggactcgccggcggccgccgctccccccagggtggggagggagcagcagtatctcgcgtgcgcggcggcggcgaggccgggagggaggtgttcgaggaggaggggattggtggtgcggtgccagagcggggcggcggcggttgtcctcaacaaggacgacgcggcgtcggtggccgccgccgccgcctcctccgcgacggggttcaccgtcgccatgaagttcggcgggtcgtcggtggcgtcggcggagcggatgcgggaggtggccgatctcatactcagcttccccgaggagactcccgttgttgttctctccgccatggggaagaccaccaataacctcctcctggtaaccatttctagctctcgctgtgattgtgaaactgaaatgtatggatttttctaccgccattctgtgcttaactgtgagtggttgattggttgttcaggccggagagaaggctgtcagctgcggcgccccgaaggcgtctgaaattcccgagctcgcagttatcaaggagctccatgttaggtgcgtttcgtttttcatttttcgtcatttcaggttagtttcggagcattcactcctgattattcaatttttcttgctttgctcaggactattgatgagcttggattggatagatcgattgtttcaggtattgtccagtgcttctttcacaaaatcccccccccctccccccaaccaaccaacacacacacaaaaatcactggaagcttagtctgtctgaagcttcccattttcctttggttggcaaaaacctacactgcaaaatgtatattccaatcttgttgatgcattgatttccatcttttggcacatgtatagtcgtcaaaatattgcgatttcacagtcctggttggtgtaaggtttagaagaccttattattttaaaggccataagatggtctatcaaaactacaggtaattcagattagggcattgtcatccactaaaccacatatctgtttttattcagtataaactaaagaccaccctctgatgggattttttttttagctacacaaacagtcctcattactatacgaagaaatttgatttcagaagttagacaatatttgtggttgaggattgtcaataaacacaagaacaccaattttcctttaatgttgtatggtggtgacaagacttgaggtcgttatcatgcattttatgtcattttcagcagagtacctttctattctgtatgcaacaaggtgatcttgtgtatcctatagcttagtgcctccaccctagttggtttaactaaagtagcggtttctaaagtaatgttcatacttattctaacaatgctttgaattcatacaatggacacataatcatcgagcagtcttaaagtagatgaggcagcaattgacatggcaagtgcaggtgatatacatcacaaggaagaaaacacattgtaatgtttgttttgttccagtttctacatacaacaaccaaataatttaaatgcagcaagtatggaaaataaactccaattaccctatttagaatccccaatctaatgacaatgaaatggaacatgtggcttctctcatgatctaaacctgtcaggtttctctacttgttttatagcccaccatgttttaaacatgaaagattttagacagctgaaacatggtatgctgcatccttagttataaatcataataccattttaaactttcaccaatcattcttcagcatattatccattggtcatcaatttatttttggtcaatgtagcatttctcgtcccttttgtctttaatggaagtactttctttagcactgtaccatctataaaagcactgtatttatcactgttaatatcaacaggtttattggaagaattggaacaacttcttaagggtgttgctatgatgaaagaactaactcctaggacacgggattaccttgtttccttcggtgaatgcatgtctacaagaatatttgctgcatatttgaataaacttgggaaaaaggctcggcaggtacatgcttctagtaaatgtgttggtgcagtagtttaattgaaggcttgttgagtgctttgtttcaatttagcttctagatccttttcatgataatataattcaaatattctatctaaaaaagcaacatctggacctgtgaaaaaaatgagagaatattactaccgtagcaaattgactaggttataggaataaggtaatttgggggacttcattacatttatcccttgctcatttgatttatagagattgtacatggttattgctagtgcaatagcacaaactaagaaatttctttccttatcaatagagctgatcactttcctttaaactgccaactgaaacctgctaagaaaaaatggcgtgcgatcagtttatttataaaatatacatgagtaatccactaaaacatagttcttttcattttttcttgtttcatagttcttttcattttttcttgtttccttttaatttctcatattcatttcaccataggaacaatgctggtgttccatagtaagttgatcttattgtgcttctatatgtgtgtagtcttttttaatggattgttattataatgagtatattttaattgttatttggtacctttttgttccatcaacacctaaaagttcctaagcatgcagcgtttacatgaagtttcagtgcgagcagttattggtatatgatggtggtccaggttttagcttgacgctgtctcaactaaattttgcttgattgcagtatgatgcatttgatattggctttataactactgatgatttcacaaatgcggacattcttgaagcgacatatcctgctgttgcaaagaggttacagggtgattggattgacgaccctgctattcctatagttactggtttccttggaaaagtatgcattttcccattactcatgtttaaggccatcgcgcctattcttttgcatttatgatgctgcacttgaattagatttgttatatttgtgtttatgataatgcacatcaaattgcagggatggaaatcatgtgctgtcaccactttaggcagaggtggcagcgacttgactgctaccaccattggcaaagcgttgggattaagagagatccaggtttgtgttcctaagtttgtgataattacctgttgaaaatccacttgctcccagaactcattcaacacctttaagcttctatgtgtaaacacattttcttagatcattccttcagttttgtgttcgttctggttctgcaattgaggaagttggttagatgtttaaccatatcagctgaaaactacagatatgctttgtggtgtctctgaggttttaccggctgttataactctttttctttttaaatctctaacaggtatggaaggatgttgatggtgtgttgacatgtgatcctaatatttgtgcgaacgcgatacctgtaccctacttgacttttgaggaggcagctgaacttgcctactttggtgcacaggtattgtagagcttattaccatgtgttgatacaattatttgacactctcacggtgattgagatagcatggtcaactactgttgccctaacagaaatacgtttgccaattgttaggttttgcatccccaatcaatgagaccagccaaagaaggtgatataccagttagagttaagaattcatataaccgtcgagcacctggtactgttattactaaaacaagagatttgagcaaggttcggcatatgaatagattttgatacgtctgtttgtaaatacttcttgttaatttctgatttgtgtacattatttttcagagtatattaaccagcattgtattgaagtcaaacattactatgctggatatagtgagcacaaggatgcttggccagtatggttttctggcgaaggtattttaatatgctcattgctcttcctgtttattttgttgacttatgcatattagtaatttgttcatatttttatgctcttgtgcaggttttctcaatatttgaagatttaggtatctctgttgattgtgtggctaccagtgaagtcagtatatcattgacactagatccatcaaaactatggtgtcgtgaattgatccagcaggtgagtttgagacagatcacgtttcgatatacatgtgtgatgtgtcaaacattgggtttgggggtatgaataaaatattgtacaaaagcctgaagtttgaattgcttgcgaatagctgaatgtgtttcatttttagttttctttggctttgatgaatatagatacttggaacagtagatagcccacatctagaaacctgttagggcaatttaaacttaaaaagaacagataatggattcaagttgttctgcaggattagcactttgctgatacatcctgaaaatacgtactgcaccagctgttctcttaattcaatattcatttgttttcttgggatgatgtggcaggaacttgatcatgtagttgaagaacttgaaaaaattgcagttgttcatctactgcagcacaggtctatcatctcactgatagggaatgtacagagatcgtcattgattcttgagaaggttattatctcttagccaccgaaaactctggttggacatattgttgatgaacacgattacttgcaatcctgtatgctagggtgtacttttatttttgcagggcattgactggtttgttttttgcatctaatcatttacatttgttgctgtacgccaggctttcaatgttctacggagaaatggcgttaacgtccagatgatctcacaaggggcatccaaggtatccatctctcctccccagatgaacgaaattcttttgtgcaaatgaccaaagggtgtatgacaatactcactgtgcgtgatcaggtgaacatttcattggtggtccatgatagcgaggcgaaacagtgtatacaggcccttcattcagcattctttgagaacggtttcttgtcagaagttgaggaagaggatcttcaacacaatggctctcctgtgagcccaaatggtgtcatttacggaaactagtcgacttagcatttcctgctattgttgtatctttggaatttggataggtttaaaggtgattcaggcatatagtcatttaggccacctaggtgaaatggtgaattccctggtgttgtaagagccctacaaggagcaccctgtgttaatgataatcacgcatagcaggctcacttataatgttaagtttgctgcaataccagcggtgcgatcgtaaataacattgtttgttatcttttggaataaagaatgatccggtgttgaaacaattccctgaaaaaaacattgatatcaagtttaaaaaccctatcacagttgcggaagcaccagtgatgtgatagttgtatttgtatggtttcacttactaaggtttaaacgctagtgatcataaatatcacgcatataatcataaatattccacgcagacaaatatagtctcaatataggattttagtgagtctaggttgtgcattctaccgttagtgggccaaattataaaagttcaccggaggtcccatcaacttaacagcgagcagtaaattttgaattttcaattttcaatttagagttgattttggatttttttattgaagtttatttttttagcatttgtttttagatcactatgaagacgtgtataaaaattttatttataaatcatatttcgtttgtaaatacgatcgaggccgtatctttgagagtttgagttattttagagactgattgtgcgtctatgtgttaaaagcgaggctgagatgccacgtgtgagtactaaaacgcgagagttctactagtcgagtcgagtcgagcggcagcgcagcgcctccgcctcggcaagtcggcgacggttgcctggctgttccgcctccaccgcgagaggctacgtcggcgtcgctccgcgccaccaccaactcgcgaggccgcgacgccgtcgtcccgctcccgagctcgctccgcaagtacggcgacgacgcccgtggcgcgccgacttccatctccggccgccaactcgcgaggccgcgacgccgtcgtcccgctcccgagctcgctccgcaagtacggcgacgacgcccgtggcgcgccgacttccatctccggccaccgccaactcgcgaggccgcgacgccgtcgtcccgctcccgagctcgctccgcaagtacggcgacgacgcccgtggcgcgccgacttccatctccggccaccgccaactcgcgaggccgcgacgccgtcgtcccgctcccgagctcgctccgcaagtacggcgacgacgcccgtggcgcgccgacttccatctccggccaccaccaactcgcgaggccgcgacgccgtcgtcccgctcccgagctcgctccgcaagtacggcgacgacgcccgtggcgcgccgacttccatctccggccaccaccaactcgcgaggccgcgacgccgtcgtcccgctcccgcgtgctctcctccgcaagtcggcgacgacgcccctggtgcgtacctctcctctcctctccgcctcctctctgaccgctcctccgccttcacagcccgccgacgagcgccctccgccgtggcgccgcccctccctctcctctccgattcttcgatcgtgttttggtgttcggctgttggttgagaatttctgtgtacctcgaaaaaaaaattcggctcgcttggttgagcattttggaatttgctgctactcatttgattgtttcctgtccgatgatgctatggttttgttcgtgctactctctccgttgttgttttttttttttgtgtgtgtgtgtgtgtttcttcgtggttttccccttcgttgatgctagggtcgttcgtggtactcatctccgtcgattttgcgtttttttggtgctccgatgaggcgatgatgctagctagatattgtcgtgtgacgactgcgagtgcgagctgtcagtttttcgatcgcggtgttcttcttcttttcgcaaatggacttggtgcttttactgagctatcttgctcgaacatatttaatttcggaagtctttggatcgtttcgtggcaagattttggatgattgctgatcttgttgttagttttacgttcctgtctccaccacctctccaaggcgcttcatgcgcgtacatcgtcttctggcttctcttccgttcgtgctccgcctccgcccaaaaaccgccgtggccttggttcacagtttgcaagccgcggcgagtgccgacgctgacgcatcttctgcactgcgaccagctacccatttgattttgttgtttggttggttttttcgatgagttctcttcggttttgcgctatgcacgctcgcgatagaattccgccgaaaagacaccattcttggctacttgtggttttctgcgtctctcccgtgctccatcgaactcttgggttgtttttctttttttaacctattcgtattaaaggagagggaaacactatacaacagccgtgaggctaggagcttataaaattgaaaaaaagagagaaacagtacgtggttggggagggggcgaccactagaggagtagagggtgcgaaaagataaatttcttgattacggattattgattgtgctaccacgggtatctggcagtagggactggattaccttcgctccacttgcgcgccatagccatgtttcgtcaattgcccggttaatgattccttgcggtggctcttgggttggttttttgagctctcgtgacccaattccgtcgagaagacgctcaagatgccatgctcggcaactagtgattttctgagttgtattgcgctcgatcgagatgccatcctcggcaacttttctgtcgctcttgcgcttgatcaaactccgcaagacaacgccggagacgccatcatcggcaatagttaagctagcctattgtttgttgggctttgggttttttttagtgaaatatatggccggcccctaaacttgtgtgttagtgtcacttaaatccgtgaacttgaaattgcatgtttaggaccgtgaacttggtttaatgtaccaccccttgtccaaatgtcatttgactgtgtttgaccgccaacgtggcatgccacgtaggcaacacatttgttctcaaccccctccacatcacaacacgtcgcatatatctcctcgtagctatatagtgacaccagaatcccaaaaaaaaaatccttaaatcattcttccctctcattcttctccttgcgtgtacagaaaatgcacgccctattagcaattgacattgctctgcacttcaaaatgatcttatccttgcacaaggggcactgcacccaaccccgctgcactgcgctgccttctgccgctaatctcaccgccgaggccgccacagccgctacctctcggcctacttctgctaacctcaccgtagagaccctagttaatttagagatattttgggggatttgggttgaaatgcacgggtcagggcgagttatgtgtgaaggtatatgtggaggggtcgggggactgagtacaaaaatgttgcctatgtggcatgccacgttggtggtcaaacgtggtcaaagaacgattgaactgggggtggtacattaaaacaagtttacagcccacaagtttaaggaccggcaatatattttactctttttgtttgtactctcttgtttgtgagatttcattgcatttgtgatttttttttcagtttttctaattaaatttccaaatccaatgatttcttttacgcttttatgagatttcgttgcatttgtgtttctttttcagtttttctaatacattttcaaatatttgatccgtaggctaaagcataatgtcgtcgactcttaacaccctaataagaactttcctacgagggttctttagggaagtaaaagaggaagtcaaaaacaaccctgatattgttcgagaggtgtttgagaagaaatttctgatgagggaaagttgccactgccaagcgctgatgaggctcttcagctgcctgaggaggttattcagctgcctcccgaggtgcttgagcgaatttctaatgttcttaaggaaaccatccagactactccgatgtcagagaacattgagcttattactccttcagagatcaccactcttttagagagtaccctgctcaccactcctttacaaagaacttcatcaacaccaaatgactgcaacactatcatgcctatatctctatctgtgtactcaagtcagcacattcttggcttggtcaaagagattatgtccgatgtaaaattgagaccctatatcgttggagcagtctgcgttgtgggagtcatagtagcctatattctttacaagaaaagaacagctgctctcaacaatagaaatcccaatggaggggacgacattgctgatgatttttggggcaattggcatgatgggaacctggagatgtttgatgatagcaatgaccatggttcttcagacgatgaaggagccattcacgatattgttgccattcctggagaaggttttcaattcaatattattgctattactggaggagggttccaattccttgttgaggtatttggcagtgattcttcaaacgatgaaattcagaatgttgctattcctggaagagggttccaattccttgttcaggtatttatccctgaattattttcataatgagttttcagatcatgtactgaattaatcatttggagttagtgctatttctggcttcgtgaaagtatagccctctgtccatgcttattactatcttaattaatatctttaaaattacattgcttttactctcaggttgccatacagtcattaatatctttaaaattgcattgcttttactctcaggttgccataccagtcgcccccacattcaaggtgttcatggcattgacaaagtttgaagggttcactgcacccccttacagccctaacaatagcaagaaccttcccctaacagcagccctcctcaagtttattgatgcggtgaatcaaggctccttagtgccatcagtagtcttcctcaagtttattgatgcggtgaatcaaggctccttaaagccatcagtagtcttccccagttctcaaatttctggattcaatagatcaaggctccttaccaccagtaccagtcatcctgcagtgcatgaatccaatggatcaaggctcctttcactcagtgcttagaccccagaagctgcggcatgcaggatatatatagctaggacccgacctatttgtcattcaaaggagaggaaatgtagcatagatagatagcattgttggttcgagagttcatacatatttgccgatacttgctgatttgagtgaaaggacgagtgagagatttgaagatgggcttcaggtaactgccgagaaacaatctggcttgtctagtttcgatttgatgaaaacttctgttcctagcattccttcgtttaacccaaatcatgtcaatatcacttgcatgttattgcattaacctgctggtagtttttgaccgaggtgactgttgataatgctggtgctgtggtgtttccaagctattgcctgctccttaatttgcatcttcacagtacgcgttgacactcaaatgcgtaccatattttttcatgttgggggtgttgcgaattttgtgacatggaatcttctttggtagataattggcagctagattaggccctgtttagtttgcgaaaaaaaaatttagtgctacattatatgtttgaccggatgtcggaaagtattatcggacacgaataaaaaaactaatttcataactcgtctaaaaatcgcgagacgaatcttttgagcctaattaatactccctctgtctcaaaatataagcattttattcatagttaaaaatgattacattttgagacggagggagtatgtcattagcacatatgggttactgtaaaacttatggttaatcatgaactaattaggcacaaaagattcgtctcgtgatttcccccctaactgtgtaattatttttttaatttatatttaatgcttcgtacatgtgtctaaatattcgatttgatgtttttaggagaaaaaattaggaactaaaccaggccttagttctctgcttttgcccatggagtgcagggatcgatattcactcatagtcgaatttgtcctgaatagaagtctaatctgcaagtataatgtgagcttgccttttgaacgtgtcgagatctagtcactaattttcgtattggttacgtggttacgctcagcatcaaattttaacttttcaatgggacaatttattttcatgaattttgtagcatttgtcctaaatttcgtattggttaatggcggctctagttccagttcttcaggccaaaacatcagtagctattggagatggacagcgtacttctttttggcatgactcctggctcgactgcggtcccttaagtaccaaattcacagctctgtttactcatgcactagacaagcaagcctcagtctaccaagttctttcaacaaactcgcaagcctgttttgtcccaaggctgaaactcacagcttcatcagctccaagagctaattgcttccacttcgctaatcccctccctggatgaaagaaagattacgaatagtgctgcagggagtttactctcttctcgtatggtttatgaatcgtcattccaaagccaacctctctgtgcaaactggaagtttatctggaaaagtaaagctccaccgaagattcaattctttgcctggttacttgtgaaagaacggctcccgacaaaacaaaacctcctcaagaagaaaatcgtgacctcagatatttgtgagctttgtaacagtgaacaagaaacagccttccatttctgctttcgctgcatcattctggcagaaaatggggatccaggctgctattaactcgatgtcggagctcgctcaacttcagaagccccactgtctgccggcaaagcatttccaagttttcttcctactctgcttctagggattgtggaatcatcgtcatgatgtgatctttcgagggatgtcgatatctctcccacgcctagttgcaaagtgcttagaagatgctgctcattgggcagagcgtctgaagatagacgacaggattgtggtttccgtttggaaggaaatcatttcttcctcccttcgtatctctccccctatgtaaatgtaatctgtgtacttttccgccccttttaatgaaaattcaggtgaggagcccccccccctctgaacagtactacgtggttacgctcaattttaactttcaatgggacaatttattttcatgaattttgtaacatttgtcgactcgttttttcgtgtattcatttcagattgtctttgctcactccttgatttttgtgtattcatttaatatggtctttgttcactccttgatttttgtcaactactccattattattagcttagtagtaactactaatatactccccacgttatatataagtatttgacattcaaacaatattcggtcgaactttttgaaactttgactcttaagttaatttatgtgagaataaatttatgaaatctaatatgcaaccgtagcatatttacaacacaaaccaaattatatatttccttgaaaaaacatttaatagttagtattgaagatcattttttaaagaaaaagactgaatactattttaaatattaaatatttatggccgaactgagtatcttattatatgatcaaactaccgacacttttcatcatcatcatcatcattatgagatataaaactcaactcaatcggcatatcatatttactgttatatataagactttaaaaatatatccgtgtgttgcaacgggtaaatattattttaattttattattattattatacggtttagttagggtaaaattcattatacgaattcgcttggataatttttttaagaaaatcatgagctgtgattgagtacgtatttcatctctcaagttagcatacgagtttttttaaaagtgatttttatacgacttttttttatttccaaaagcaaacgggattaaaatcgaactcaaacacagatctatatttccgaaaacgaacgaacttaaaatcgactcggacacggatgatgtaacaaatagtatagatgagactcaaaccaaatgatgtaccaaatagtatagatgagactcaaaccaaatcgacaggcggtatgtaaatatagtaccatttactcctattagagcaagtttaatagtatagccaactactagctccaatttatttatagccaatctaatagctcatttatacaatagttgcatactacactattaatatctggtcccacatgtcatacacacactgtatcttggagtccgtgctacagctggctacaaatctgtagtccgctgaccttctctctcctcatttatctgcttaaaatatgtttgcagctggcttatagcctgctattgtagctactcttatatgaatggtctcttttgataataatgataaattaattaacctagtggctagtgctacctccgtgtattgatccaggggcgtgcatcgggtgagtcgatgacgtccagaatccagtagccgaggttacctcccagcccaacgcatccagcgtagaacaagacgccaaactttaacatctcagagcggctaagcgggaatctctcatacgcatgctccatgatatcccgtttaacgtagcatgttgtgatgatcacaccaatccatcccaactcaaacgtcactctagcaaacggatccgaatctcgatccccagctcgaggcataattaattaattaattaatatcctccgaaatcttaatcttaatcttaatttcctcgctctagatcttctcttgttgaagaggccgatcaatcgattcgagaacacctcacctggctgcatataaatatccatatatcgatttgcctatgttaggtgcatatctattataaagaataacactgaagggaatgtaaaagctgcatgtatgcgttctaattaatggcaaaatctcgtttaatttatctgccaatcatattttggggaaaaaagagcaaagaaacaaacatagatataatgtaaaaccaatcgatgacttgctgtacctacggcgagcgagcgagcgatcgatcgaacaaaccaataaaattattgggagctgggagaagaaattgcggcgcgtcgaggcgaggcgagatggactccgtgcgccgcccgcgcaagcgatagatgcagcttctattctagctagggtgtcaaaacgcaagcgtatactttgagatttatatttatacagggcgaatcgacttttgctgggccgtatcgggccggaatttcgctggagctgaccggttttcgcgagtttatctgtaaactcaggacatttatatttaaattttggtttatgaaatttattcggaatctatcaaattcgaattcaaacatctactagtcggaatatattctgaatacaaataaatttgtatttgaatctcagtcagaatatatctgtatttgtatatttgtatacaaatatattccaaatttgtatttaaatctaccagtcggaatatatttgtattcaaatttggtagatttcgaaaaaatttcataaactaatatttgaatataaatatcatgagtttaattaccaataatcaagcttgtgaaaaccggtcggtttttgcgaaattctgatcagatacgacccagcaaaagtcgattctctgtataaataaatctcaaagtatacgcttgcgttttgacaccctagctagaatagaagctgcatctatcgcttgcgcgggcggcggacggagtccatctcatctcgcctcgccgcgccgcaatttcctctcccagctcccaataatttattggtttgttcgatcgatcgatcgctcgctcgccgtaggtacagcaaatcatcgattggttttacatcacatctatgtttgtttctttgctctttttttcccccaaatatgattggcagattaattaaacgagattttgccattagaacgcatacatacatgcatgcagcttttatattcccttcagtgttattctttatactaatatatatgcacctaacataggcaaatcgatctatgtgtatatatatgcagccaggtgaggtgttctcgaatcgattgatcggcctcttcaacaagagaagatctagagcgaggaaattaagattaagattaagatttcggaggatattaattaattaattaattatgcctcgagctggggatcgagattcggatccgtttgctagagtgatttttgagttgggttggattggtgtcatgatcgcaacaggctacgttcaacgggatatcatggagaatgactatgagagagtatcgcttagccgctctgagttgttcaagcttggcaccttgtactacgctggatgcgctgggctgggaggtaacctcttctactggtttatggatgtcatcgactcacccggtgcccgcccctggatcaatacacggaggtagcactaggttgtatatatatattcaattaattatgcatcaaaagagaccattcatagcaattactaatgcatgagtagtattcacgtaccggcaccccctctcgattggtttcagggcctgtttggatcagggactaaattttacttcctccgtttacagtgtaagtcaatctagtatttttcatatttatattgatgctaatgaatctagacatatatacctatttagattcattagcatcaatatgaatgtgggaaatgctagaatgacttacattgtgaaacggagggagtagttcttatcacatcagaggtatacacacacaaaggaataaccaaattcacgtatatacaccgtaaggcacagagaagataatcacatgagaacagacagttgtacagggtaagacccctctctgatcagatacccagaggagatccatcaacatgtatatatatttatatctgatttgcaactacacatcgcaattactctagctagtacattctcattcctatgtataaactgagttactactcttactgacatgtgccggtatctgtgaaactaccatacatgtacatcaattgcatatacttccttggacgtacacgtactaaagctgctgtgctggtttcagccatcggtctcagtttgcatctcgagcttctgtatcaaggccttcttttcttcttcagggagggcgttgaacataaaaactgatttgtcaccaatgtcatcctgattcatgaggatgacattgatcatcaatattgtaatgttgtaagtgaggaacgaacatatgtactcggtagtaatgaagctagatgcggagcattttaatttggaggaatctgtaccttgatgggctgctggaattttcttgctgcgaatacagtgaagagaaccatccaaactcctaaaaggccggcttttgttccgttgtccattagaccagactgcacgaggtggtgacaagacaaatgtaagaaatgatgaatgagtgctctaaatctaatgcaccctggtgctgtaacttctctaggagtgaacaaggtgaaactaattataacatattgaatttgtaacaaaaataacagaggcttaatttaccaggtgtccaagaagaaggccagggataacaaaagttaaaataccagcttccagttttccatagcagagacctgtagaagcattctttgtcagagaatgaataattcgattcagttcaatgttcaagcaattcattcatgcaatccgcatccaacgaaaaatgaaaaaggccactaaattggtgctcattcttgttggaataaatgggctaggcccaatttaattcaattaaaatctcaagagcccacaagtaatgttagagagaataatactgccttgaaaatttaggtggaagaacctcaacttaaatagggtgatattagagattccctgttgaccggttgaagtgatggttggactgccacacgcatgcgcgcatgccgagtcggcctcggccgtgggcgtagcgaggcgaggcggccgaccgagccgagcctgcctgctgctcttacgttttgtaacagacgagaataaaatcaccattaacaaatgaaattcattgtgttgtaacctccacaacaaatgagagattcattgtgttgtaacatccacaacaaatgagagatttatttgttgtaaccttcacaacaaatgaaagattcattatgtggtaaccttcacaacaaatgagatttattttgtggtaaccttcacaacaaatgagatttatttgtgtggtaatggagatctctctctacatataacgcaaggcagaggctctcaaagtgtgtgtcttcctcctactattgttccttggcgatactctccttctgttcctgcgctgtctctctgtttctccggttctgttcatcccgcgcacacgggtgatcggaacgagcaagtgcctccgaaactccgtccgcttgagaacctgcacgggtaggcaggcgatcaagtttttgggtagcgcttcaagcgcgactgctttgcatcatcttcaccaacatgtcgacaaccgatgacaacaacaacaccggagacaaggagaaggagcctctcgtcaacaccaacgaaggcaatactgcctcaaactccagcggagggtcattttcggggtataacgtttcactattaccgttcgttcttcgtttcctacaactgtctgtcgcaatattattgcgatctcttatctatgttgatgcttattctatattaagcatgctcatgttatacacatctagcactgccactagatctactcaaattacaaatgtcatgtttattgtcttaaaattttagattaaaatatgccgaattatgaccaaatttccaacaattctaacactgaacacacacaagcactcagctagggaacaaatcagcagcgacaatgaactgaaattctccgattaaatctgttcagtataaacactagaactccttaattgtcgtaccaatttggtagtaataagcaatgtgtaattgcacggtaccttccttgaagacgaggcctgtgagcgccgcaaacgtagggccgacgaaccacagcgcagccgggtggtcgagaacgtagccgacgaggctctcgtcgagcggctgcgcgccggcgacgtacgtcccgatggacccgacgactccgaccacccacagcgcctggaggaaccgcttgatcggagtgacgtagatgtgaatcagcacgagcgaaagccccagccccgccgctccggtggcgtagaggaggtcggcgccttgcctgatggcgtcgccggcggcgttcccctcggggaggaacgcggccgaggcggcggccacgaaggacgcggcggcggtgaccagcccggaccgatacagcaagacctcgcgcacgtcggagtcctcgacggtccatgggccgtagacgccgttgtagacgttccggtcggcgacggcggcgagctgcctcgcggcggcggcgcggcggccgaggtaggcgaggggaagaggccgtccgactgcggtgggggtcagccccagcctggggtgcggccgtagaggcgcgacggcgaggcgcggcgagaggaggaggacggtagcggccatggcgtcgcggcgggatgataattttttgggggagattttttggtgggtggtggtttccggcgaggtgtcgagagctccggcctgtgacgaccgcaggctcgacggacggtgcagattcagtttcggcgtcgatccaacggcctctgatccggtagagtgccgccacgtggccgtcccggcccaactcattgggccgcacggagattgcaacccctttccggcccaataagtacaggccggcaggcctgccgtcagtcaaatccatggcgctcccatgttaatttccttctttcacgtaaaaaactaatctagtatcggagattcatagtgttataatatgttgtatcgggttttagattcgtcttttataggacggagagagtacaaaggagtaatgacaacttggaacgcatgaaacacttgcgacggttcgccgccggcagcaggtcaaccacggcaagtccggcgagcggggcatttaactatttgccacttttagatttgacgattaactatttgctacatctatctcaataacatgtggatctacatgtgtctataatatatgagtctaatggcaaatagttaattgccacgtctaaaagtggtatatagttcaatatctcccggcgagcaactagatcgaccactctcttcagtgtcagtttcatcacagtgattccggtcgaaaaatattaacggctgctggtggtaatgtttgcccaattccgtgggctgcctgtgtttccctgcatctgcatctgccgccgcgagcagtaactaattaaaagttactgtctgttctgatgccaggaccaccgtacctcgtctatgagacgtactatgactgtaattcatactgtttcaacatttggatgcattgcatgcatgcttaatttcaacatactattatataattaagtactccctccgtttaatataaggggattttaaatttttcttacaacgtttgaccattcatcttattcaaaatttttttgcaaatataaaaaacgaaaagttatatttaaagtgccgtagataataaagtaagtcacaaataaaataaataataatttcaaaaaaaaattgaataaaacgagtggttaaacgttgcaagtaaaaacttaaaatctcttatattatgggacggagggagtatatgttttgattgccaacaagatgcatgctttgatgcagacgaacttgcatttctcatcaacagtgatcattcatgatcagtactgttcagagccgtaattcaatgtatatagcacgcacgtacgtcctcgaattcgtagtgtcctcctgtcccgtatacatactagtaacatacattcacgtacaccgtacacgtgctacatacataccattaaattggatctcgagatgggtgtacatacatcatatcgatcttcatgcacgcgacgcgagagctatctaccggcggcgattggattcggtggcgccattaataaggggcgagacgagcttgagcttgccgccgtagtcctcggcgaggttggagtcgtcgatggcgtcgcggagcgtggcgtggaggtccttgtcggcgacgaagacgaacttcttcttggtgttgtcgtcgatgaaggggtagatgatcttccaggccgccatgaacacgtaggggacatggatcaagaacaccctccccagcctctccgggtagtagttctgcatgatctccagcgccgccacgtacgcgcggatgtcgcagttgccgtagtacccccacccctgcaggtcggccacggcggcgaacttctcctgcccgccattgccgccgaggcgggcgcaggtgcggtcgaggacgtagacgacgtagcgcttgaactcgtcgaggtcgcggcgcgccgggaagtggcgggcgccgaagccgtacaccagggggcgcccctgccggtcgtagccctgcatgtagagcttctcctgcgccagctcgccgcgcacctcctcgtcggcgatggcgcggccgccgggcttcacctcgcgcttccactgcaggtacttcaccagcatcgccgacgccttgccgatgttgtggtctctcgcgcgcaggaaccggcgcagctggtagtcgtcctcctcctacgtatacatatgcatcatcattgattcattgtcttgctactctctctgtgttttactatattattataagttattttattctttttataattaaattttttaagttttgatctataaaaaagttatagtatatttttaatataaattgaatatattatcaaaatatatttaatggtagtttcaatgaaactaattttaaatgttgcttaatcttttttatagatttggtcgaatttttttgaaaaatgatatataatataaaacggatggagtactaattaccaacaattaagttattaattactgtagctaggtaatgctgcctgctttgctgatggtcagctcgtgttagctactctaggctggtccagttcgatgtgtactggcgggagtagtattgaccaacatttatgaagggctttttgcacggcacgggtgacgcatcgcctcatgcttcacatcgccaaattaaataatggttgtgtgtagacgtccatgctactgttcatctttttaattatactacagtatttaatactgcctcactccactccacatatttacgcatgcagctggttagttgtgtccacgaccatctgggtagccctccaactaagaggatccgcaatggtaaagtaccgcaatggtaaagtaaggtgctatctataaaacatgtatatctcagcaatagactagattaatagtaaaccactttaatggtatgtctacatgagtatctatagctctctaatccattgtctcgtttttatgtatagaccatcttcaggttagtagatagctttgctctctcttcatttaatctcttacaagtaggaaaatatgctggtatgaatctcttgtagagagactatagataaccattgtgggtgtcctaagatggtgtctatagcattaactacattgtcacgtagaactttaaacttatgtggcactatattaattaaaagagagagcgaagagatgaagaaactgggtctcatgcaagacacggcttcaacatgagaacttatgtactagacactatcaagttttgcatagggagagaatagtgtctttataatagatgaagaataaatatgattggtactccctccggttttattttaattgacgttttggacaatgacacggtctacaagatatatctttgaccttatttttctactataatatatataataaataaatgcatgtttaattttattatagtgctttaaaagacaagtctatatatgttgttctagtttctttaaactaaatatttttaaatttattgatgatcaaagttataaaagtttgacctcaactttatccaaaacgtcaattaatatggaaccggagggagtagataagagagatggtgtatttattaatggcctactttaagaaaccatgagttgtagagtgtagtttttattgtgatgtcttattgacatggcaccatagacactgcttatggacaccatgggttgggagtacctcagtgtgccgttttctactgtatatattggacgtcctaataattaatattcccctaaatgacatttgtattggtaatcaataatcagcgtgtgatggtggtatagtaaactcagttgtcctaattggatggatcgatgtagcagatggttgattaggtggagtgtcgctgatgaatgaattcctccactactggattgtcatgacgagttgagagtgagatcaatgtgatggccatcgagatgtttctgctcaaccgctaactactttggcttagaccttcaactacctggagctggagatggatgggcaagccaccagtctcaaaccaccaaaactgcccagtcccctagtcctttcccatgtacgtacggtacaatacaattcacgctgcgccgaccagccaaattgcattatactgtaggagttatatatatatctgcgaccaaattatgttgtgtgtaaccacctgcagtacggcaaacaaacccagggtgtgtgtgttcttctgtttctcctcttccaacggtggagaaaactattttcttaattctgcagtgcagttcagggacggacgtgctagattcggtttttcatgttaggcgaatcccattttcgattcggtacggatagccagggtatctcctggttgatttcattcgttttttttataattcggtccctaaggtagtgtttggttgcaaggatgggatgggatgggatgggacgaacccacttttaggggtgtttggtttaggggtgggtgggatgggttggtccctggagaggaatattcctctcagatccgggaccaaccgatccgccaaaaactggcggacaaactcgtcccacctgagacgagcgacggcgtcaccgcgccatccaccaccttcgcgagctccgccgggcgcccacgagcgtcgccgcctggtccacacctgccgccacctccgcacgtccttctccgccgccgccgcctccttgagcgccgccgcctctgcctcgtccgcgaccgccgccgcctccatgagcgccgccgcttgcccgcgaccaccacctccgcgcgtccacgagcgccgcctcgcctccacggccgccgccgccgcctccacgagtgccgccgctcatccgcgaccgccacctccgctagcaccgccgccgctccactcagatccagccgccgcctcgcctccgcgcccggcgcctcctccgcttcgtccatgactgccgccacctccacgagcaccgtgaccgccatctccacaaactccgccacctctgcctcgtctacgaccgccgccgccaccttcgcaagcgccgccgccggtcctctcagatccgggcgccgccgagtgcctccgcccctagacggcactaacggtgagtacaaatccgtccatcccatcccacctcaatcccttctaccaaacaaaaaactataaccatcccataccataaaccaaacagacaactggaaccatcccatcccacaaaactaggataggtctgacctatcccacttcgtccccaaaccaaacactacttaagttaattactactctgtgatccggggtcgtcgctacatagttggaaattaaataaagagggaaaattacaaggaattaactgattgagcttcaagaaattaactactgctactcctaattgccttcgcgtttgtgttcttagttgattgcttcatagctagctcgtacctctagttgtccttccatccacaagaacataagaggaaaaaaacaacgaaggtgtgaactatctatctatcataccattggttcacatcatcatcacaaggccatggatggagggaaagctcctaagctaggtgagtcatacatgcgaagaagatgaactaattggggagaaggagaaggagataccttgcatgcagggtcctgggcttcgacgacggctctcagctcggccaccttcttccactccgtcacatcgccatcgtcgcggtgcccgtctcgctcctgctgcttgcagtaatccatggctgccttagctagctctcctctcctctcctcttgaattgctcttcaggcgatgataattcagaaatggaaatcgagagctgaagccctttttataggcagaggagaaacagcagcagctccaaaaggaagctaagctgacgatgcagagtcgctgacccccactatttatggttgcggtctaaccgtgtaccaaagctgctgtctcgcaaacacttgcatgacatataatcatatactattaccccctccgtccaaaaaagaacctaattggacggagtagtaccttctttgcacagaaataaagaacttttttttctgtataggtataacattggcatgttgctgctgctgcctaactaactaaatatgacaactcaagagattactgactgacgttaatgacgatgatggcgaagtctaacagagtgacagaggcaattttcttgcagaacataagtaggaggttggacggtccactcctccgttgtcgaaacaacgaaattaggacttgtttgagcagcagaagcaatcacctgaaagaaggtgttaagctctgttatttactctgttcgatgataaaaatggacatcttaacaacgttggcggcttatctccttcgttatctcctctctctctctctcccataaacggtaagactcattaatactgaccactggctgcagatacaatcatacaaatactagaactcttgttaatttcgtagttctgtttttgctagaagagagagagacagacagagagtttagggggaaaaaaaatcttaagctctactagtacagtagttgtacctatcagaacttgtggtagtaagcagtagcagagaagtagtgatgcgtacaggaaacggcgagcgtcaactacaaacagcaacagggacgttagccaactactcttggttttcagccatcagaaatactaccaaaatcatgatctggcagtcaagtcacgttattagactagtagcagtatccgtttacaacaaaatagtggtacgactaattattattttaaagattgactatgtatctattggcttcgttaatattaaaatatatcggcatagggcctatttagtttgaaaccaattcttaccctaccaaaatttggcactaccaaattggatagtattgaatttaaactattgttgataaaatttggtaacaaaccaaacatgcacttgctattattgaagttaccaaaattttggtagggcaataagttggtatcaaaccaaacaagcccatagtcttctgtagatgcttatatcagtaagatgtgtgttcatatggatgcatgtggagcattctaaacgtctgctttgctttgtcctgtctgtcttattggttgctcgtattctctaataaactatttattagaaaataaaaataatttatagataaaatttttatatatgtgttcaatgcagaaaaactatgtaaaaatatctttaatcaagttaaattttaagcctaaaaattaaaactttaactttattagggacgatggggctatgtgtatgtaaagaaaaaaaaaggaaatggcgagatgcatgggacgcaagaaggaattttcctcgtgccattttgatgcagagtagccaaatgctaaccaccacgtacccccgaattgaattgaattgtatctttcattgatttggccatgaatgctagcagctgccgagctttgtgccttaccgacgctgccccgggaaagtagtggctcgcacacacgcgcccatggcccattgggcccatgcctcgtacacgcccgtacgcgcctcctgtgtggctcacctcctgccacgacgccatccaaagcggcatgccaatatgatttctcttaaaagataacgaaaatgtattacatccagttctctgctttaagacacacagtcgattatagtttttattgaaataattaacaagagtggtgggataaaatccgagctattcttaagacataaaaacagctaacatgttacgtcacatataatgaaataagatatttttggcaactgattttaagagcgtattcactcctcctgtttgatatgatatgatatgatatgccacacttctgttgattgagtaatcactcaatagttaaataaaacataaaaaaacaaaataatgtcagtagagtaatgaatttgttgacaaatagagcgaagaatacaatattagatcagtatacacataagcaaccccccccccccccaaaaaaaaaaacaaaaaacaaaactaataaacatatatatcaaaatattcaaggaaaattttccaggagcccaacttcgtcctccaaccccatgcggtggttggagactctccagctcatgttataatttacaaaactagacaattagacaatgcgatagtgttatataaatttcggggttttatttgattcataccaatttatttctgcaaattcatgtcctattgaacctctagtagcctaccagtatgatcgatggtcctggctttatgagtaggggtggatctatctagtagacgtgcatctggatgggatggccttggcagacggcgagatctgtgtcgcctctctttgatctgattcagtctcagtaatcatcatgtttatttttacttacaccccgtggtccattgccagcgcattatctatcttcaattcaattcttccatcatccgtgctgcaatttctgcacaatgttatcgatcctactagtagctactagatcaatgtagaacacaacccagtcccacctcacctcaccttcccaggcaacttactctgcatctcctatgcttttactgtaaccacatagtgaaccatatttatttcacttcatccgtattatgagtacggttctaagaaacacatgatccaaatttattacacaaatgatatatggtccagattagtttcacctgtttgcacaaaactgtacatcccgcaaactcgcacagtgaatgttttgaatgtgatacttgagcacaatacagacagacgattagcagcatggtggccatactaattaaggtcttgggtctcaccagataatagtagaatacagctagcctctcagaattctctcctggggaagaagcccttatcatgcccagcaacaggttcagagatgagggcgttgtcgttggatgtttcagtctcatcacccttgccgaagcagtattcaggtgcctgccattctgcgtcctccagcacagcaccctcctcaaagctcatcacatggctagtcctccctatatagtagtagattgcaaaatgttagtactacaaaagtgatacacaattatacacataattataagcgtttggttctcatgactcatgacgaattcaggacaaacagacatctctgtggtaccaaatgcagtggaactgggagtgtggaaatactaacttatagtcacctaagagtatcttgctgtcttctttacctgttgggcagctcatcagcatgacaaacttaacggagactacaagttgtatcactttggcaaacctaaacaatgagtactattaactattaactgaagtgtacatgccggcaatacagaaggcatactctactttcaagggaagatgacacaggactggtgactaacgagaaattctttaattcttgaccagcaagaggcagcaatacctgcagacatggctcaaattggaacatttcccaggcatatatttgggtctgcatatttctatggctaggctcaaagttgcagagccgagatcgaacattggggaaataaaacttaatggccagatggccacagtttcatcacagagaagacatcacaacacttaaagataatattcccaaaagctacattgcacaatcatctataagaatttaacatgcgatgaaattgctgagaaagttttttggaaagtaaaattgggcagcatttcagaacataacgactagcgatcagtggaaaatggaagtaaagttcaaggggcatgggccctttcatcaaccattagtttgtgagtctgaaaccacaagcatactaagtagctagcctataggcactaaacaagtgatagatagtagaagttaagaactagaatgtttttgttcgaaatgcttccaatgaaggattgcactactgggtgaagcagatcccctatgatttcatcatacagctgtagtctccttgatggatacagttcatagtgttattgcctcttcccagcaaaaagaaaaaaaaaaacagttcataatgttaattgattacatactgtatatgcttcaagtgagctgtttatagcgctattcatcggtcctggttgaattgtatccatcaaaagtgtagcatcattttcaatttttcattcaaaaaaaatgcatcctcaacatactgaaacaatgtactaactactagcaacagatcaatatgcagcaattccctggatatatgaccaaagcataagaagggacatggactctgaatatttgcatcctcttgtgggctctaaccttaattctgaactatacaggtggtgcacatggatgagaagggatggaacaggaaattgccgcggaatagggttcaaaattaccggtgtagaagacccatttgacggggcgtttggtgagggtgtcctcgtagtaggtgatgaagtcggccttggcccagacgtggcagtcgaagccgtcggcggggtggcggccgaggtagacggagccagggacgagccagtttgggggcaggatgccgacgccgacggcggcggagcggcaggcgcggcgggccggggtgtagaagaaggaggtgccgttgttccactcgttgtcgtagaagggctcgtcggcggcgagctggtagcggatgacgtggaggttgcggccccccggccagtcgtaccacaggtccgccagcgacaggttgccgtggaactccatcaggagcttcgcgtggaactgggccggccatggcgtcggcgtcggcgtcggctccgatccgtcgccggcgacgacgaggaacaaggccgccgcgaggaggagaggggccgccgtcttctccatcttgtgcaagtggctgcgctgctgcgtgggagtgagatggcgtagtacggtttcgagggcttgagtgaaattgtgtgattttccaagggtgattatgcaaaaattcgtccatttttagtacggtttgggcccattaacaaatggactttgctttgtccaattgctacaaattgagcctactttcttttcgtttttgctgctttaacaagtagaaataggcccaagtggcagagttacctacctttgctaattttggactccaagcacacaattagtactcatccgcattgtgctaattcaggttattgagaggggaagaaagtggttatacgagatcgatggaggacgcagcagctaacggtcgctatacgatggaaatgagattgtaccggacatattgtgcatatatacaaaaagtataggagtatgttccagacgatggcaacttgacctctttaattcaaagctagcctcaaacgtacttaactattcatgctttgacgtcaaggcaagggtcgagtagtaagtaacacaggctcaaaaggcaggctatcttaagctacctatacgttttgagtgtagtatacgagccgatcgatcgatcgatcgaccactgtaccgcactgcacgcgccaaattgaaaatcggattagtggctcaaatcaaaaactaaagttagtctgaactttgtctagtgtgcaaaatcttttgacattaattaatcaattggtaggttttgtgcgttgtgtcttgtgtgatttccacacttggttgacgccgacgtcgttgtaaagtttgcacgcggcaactgggcgtggtctctgaacgaaccgtcaattcattcatggaatgaatttgatggaaacatatcccgactttgtgcagtctgtaattgtgctatgttagtgccacaaagtcgatatagcacaactacaaattgcacaaaatcgacatgggacgactgcagattgcacaaagttagaggagtttctttcgaatttgatatatggtccgtccaaaaaaaatcatgggattggcgcctgcctgaatccatggtgggtcgttggccaactcctccatttctcacggcgccggtcgccgccccggccctacttcccttcacgcctccactgacctcgccggccggccaccaccaccgcccgcgcgccacacctataaaacctcacctcctccacctccatggctcaccaccacgtacagcaaacaccaactcagctagctatactctactcatcttctctgccagctgctactacaccaaccagagctaatcaagtaacaatggcgggaagaggcagtgccatggcggcggttggtgtgctggtgctcctctgcgtgctcctccacggcgagatggccgagtcggcggtgttcaccgtcggcgaccgcggcgggtgggggatgggggcgggatcgtgggcgaacgggaagcggttcaaggccggcgacgtgctggtgttcaagtacgactcgtcggcgcacaacgtggtggcggtgaacgccgccgggtacaagggctgcaccgccgccccgcgcggcgccaaggtgtacaagtccggcaacgaccgcgtcaccctcgcccgcggcaccaactacttcatctgcaacttccccggccactgccaggccggcatgaagatcgccgtcaccgccgcctagttcttcttcttcctcgtcgtcgtcgtctccgtcgccggcatggcgccatgccgtccatctcaaccagctgcttattatatctatatacaaatgtttgtcgatcgtgtgtgttctaaccaccatcagctgatttataattctacgaatgaagaatacgatccaatgcatctatgcatgcatacacacatggatcaatatataatagttgtacacttctttgagtgacggatgttgtatccggtgaaatttatatacatataaatatgaataaaagccacattatgcaggttcttgaatcacaaatagtacgtttgagtttcaggtctgtttggcatagctacacctccacctctcctgaaactggagctcagccaaactgttttacctccatctaaaatggtagtggagctaggtgaagctctctcacaaagtaaacttgagaggtgaaactgggtttagtcagctccacaactccactccaaactcaactcatgaagttaaatttagaagttagagatctaccaaacgggctattcaggcatagaaattcggaataagttcatctgaggtcccttaactttacaccgaatccgattttcgtccttgagttcaccaccgagggatctcgtttgcaccaattttgacagttaaggactggctgatctggttttggggttaaaggacgaaaatcggattcggtataaagttaagagacatcagatgaacttattcctagaaattcccactcaaaacttccacacgaatacgaccgggccagttattgtagtacagtagtagacgagatggttgtgggccgggcccaaacctttgggccggcctgaccgttccatatatggaaaggcccaggaattcgtccacaaaaccctataatcctcgcaccccccaacacctctcttctcctgcgccgccgccgcctcctcctcctcccgcatctccctcctcgcctctcgctgccggccgcgcttcgccaaggtgagactccccgcctctcctccgactcattccacaacgcgtattcggcggccagcgaattggcttctttttttttatttcctttcccgacgcccgatgatggtttatcctagtgtggctgtgcgcttcgattcggatccatctgatctcttccggccgcattctggttgcccagatccatgccactttcctcgttcatgttaacgaggagattttcggttcgttttgcagatgaacaaggagaggcttatgaagatggccggcgccgtccgcaccggcgggaaaggcaccgtgcgcaggtgggtaaatcgcctttgtcgcgaaatgaaatgaatgtcttgttctttgcttctcgccgtgtcgcgaaatgaaacaaatgtgcttcattttgtttgttaggaagaagaaggccgtccacaagacggggaccactgacgacaagaggctgcagagcacgctcaagagagtaggtgtcaacaccatccccgcgatcgaggaggtcaacatcttcaaggatgatctcgtcatccagttcgtcaatcccaaaggtataagcatccctcctgttttgcctaccgtaccatggaaatgccaactgcttcttggtgttagattacttatccatgttcgatccgacctgtgcagtgcaagcttccatcgccgcaaacacatgggtggtcagtggctccccacagaccaagagtatgtgacttctccttgttacatttgatcagttcgttgtgcgagttcaattcttttaagattagcggctgttctgtttctcttatacactgctgagttgcagcaaccatcccatgtagagctctgtatgacatctgaataatcccatgttcgtctttagttttatctctgcacactctctaggagattttatgcattcagctgcaacattgtagggtttactatatatgttgattgtggggtggagtgaatattacgatgaacaaaactagcttttagcaagactcaaattgccttttgattactttatttcagtgattgtctgttattagggtgttatttttatcttcctgacttgtgatcactgtttgacttgtcagagcttcaagatgttcttcctgggatcattaaccaattgggtatgtcctcttcttggtttgctgttataaaaactacttttgacttatgcttctgcacttaatattcaattgatagttgtcttaattggtctgaattggcttgttttttctgttataagaactatgttatcagtctcatttcatagctgcatgactccaatttctctttcctgtcatgtatatattccagaaccatgttcacaaaatgtatattccaaacatgagctctttcgtatggagtatctcctagcctacccatcatgtaaatcagcgatgaagctatgcaaacattagtgtttatctatttttgatctccataaaatgtaactcttattttttttctggttttcttgctttgtttccattgccaattatctgttggttgccatcagcctttattcctgctcatcactggacttgtctgattattgtcaaactcattcagtttatctgcagtttgtccagttactgacagtcaaatctttcttgtaggtcctgacaacatggagcacctaaagaggattgctgaagagatgcagaagcaggtagctgctgcaggtgccactgcccaggcaaaggaagagaacgatgatgatgttccagagcttgttccgggagagaatttcgaagaggtagctcaggagacaaaagcctgatcatagataccacaagtagtgaaatgttacttgaccgctgttctgaggtcatggttttctatgacggccctgttttgcttctcctcgtaggccaatctttgtatttgcaattggaaacttttagtttctccgagtttttacctaagttatgaatgctgagatgccatggagtcctttttacctggttttgatgttcacatttctggttggttcagaatatactagcatcagggtttgcagatgtccttcacgtctcaactatctactagtatcatttatgtttggagatatcctgcaatggtacagtgttgatttttccccaaatgaaaaataatgatgtgttttacctgctcagatttcagttctgaacttatgttatactagcatatgaaccatatgaacatgctacgtgctctctcttgaatactaaaccccccagcaatgctctcttgaatactctaaacctctcaatgagaggcagacgcccagttcgtgtttgtactatagtgaactatgattagcaaagggtgttaattgtttctgtctgtaaagagagagctactattgattgaaatttgaagtacagtttaaaacagcggaaatattggtataagaagaagtcccactgaaaatagtgcaaactgggaagcatatggttgaaagcgatgttcaacacgccagcatatgactggtttgaataatcttgttctcgagacaagtttgtattcaaatgatatatctactccaaagctcatgatgatgccatttaaaatagacttttgcgtctattgcacctattaatagttcactaatataagaatgtacagccaaggtgatggaaatcaaaactgaagctcttgcgcgtgcgcatatcagctagatgatcaccacataaaaggcttaaaaactcaatctttgtacactgttctgcgccaatttcagagtttgagtttgggcacagaaaataatcaccgcaagatggaagacgaacaaaaaatactctgcctagcaaaaagctctctctgctcaaccatggatgaacagcaattggcgcaatgtatgtgcctcttgttgctgcttgccatgtcaccagatgctacgctcgccggcggcggctcggtgaggcgccgggcggacgtggccgacgggtacgcggaccaccctgccggcgaacatggcgtggaggtcggcggcgtacttgacggtgtaatggtaagcgtcggaggaagacaccaccctcgccggcagccagatcacgaggcagcacctggcggtgatcttcacgtacctcgtgcgcacgtacacggcggtgccgcacgtcagccgccgcgccgggtggacgctacgggtcacggcggcgaccggcggctccgagaactcggacgccggacgcgccggcttcctggcgaccaccgtcttggggttggacgacggcggccacggcctggcggcggagggcgcgtccggcttcttggagattgagggcggcggcggcggcggccgcggcttggcgacggcgaggtttgacgatgacgtcgcgcgagcgatcttcttggcctgcgcggcggcggcggcggcgggagagatgaccctgggggcggcgagcgccgggaggttgggcgccgacgtcgtgcgggacatgatcttgttggccggcgagtgcgaggagatggaagatggcttgttggcggcggcggtggacttgacgcgggagttggggaactgcggcggcattgcttctcctctcgacggctacgccgccgccgcagccgccgtcgattccgcttcttgatttctagggcttccaaggatcgatgagatgatgtgaacgctaccctccgttgattcgttgcgttgatcctaacttgggaagagatgtgtgtcgtaaaaacaacttaacaagtgacagcgaaattaacccggacgaattgacatcacagcctaactttgcgagatagtcgccgtgttcatctcacccggacgaattcgcattgttcattgttagatacgatttaaataataagtttcagatttcagacgatttattttatcgtctcgactgaaatcctattagttatttttcgtcttatagcattgatgattatttgattgaacttctacaacttgagattgttgctctgcttataccattgactgaaattcttctacagatatagattgtttttccgccattgatgaactcaaatcggcaaagatgtttttcggccattgatgaatgaattcaaagtggcaaagatcatgcaagatgcggcacatatcggctgcagtcttccatagactgaaagcaatggctagcacattttatgacgactgatcacttgatcagataagtcagccatgtatccggtgtgaaacttgaaacttcaagtacacatcgataaagtaaaacagaaaatcatgcgagagaaacatcaaccattaagatgcttatgatgaatctttcttatttagtcaccaagctatgggcaaaaaaacgtgttaagatgactaaacgcgttgttatacagcaacaaccagacatggaaaaagaaaagcaataactagttcggaatggtggccgagccaacgatccctgcatctcatgaattcagagaagatgctctgcgagtccctcgctcttttgctctcatattgccggtcggatagatctgattccctatgaacattcatttgttactaaattcgctacgcagaaaaaactggaaacagatcagctgtaaactttggaaacaactccggcaccaactgtcctccctccttccctcagcgcaaatctctggcctgaatagcataaaatgaaacaaatgtgttcacttcaattgcagaaaaccataccaaaaggtcgaaatgtcaaaaatggtggagcatacctggctcaaggggaacaggtgatatcaactcaaatcctgcagttacattatcaccaggcataaccatttccacgccatcaggtaacacaacttttccagtgacatcggcagtcctaaagtagaactgtggactgtaatttgacaagaaggctgtgtggcgaccaccttcatcctttgtaaggacgtaaatttccgcctcaaacttttggtacgtcttaacggtaccaggtttgcacaccacctgaaagcagtacaaaaaatgacaaacataggagcatcaataaaagggtcaaagaattgttattgcaccaagagtagtaatatatcaatccaccagttcgctcaaagaccacaaatgatacgaatagaataaaagatgacttggatcagacttatatgggtcccgctcagagttaggtatgctaacctggccacgctgtacatcaccacgcttaagaccacgaagaagaagaccaacattgtcaccagcctgcaaacaagttgtagctataagattccacattaatagaaaacaaccagtaaatggtttactttcagaacagacctctccatgatccagtatctttttgaacatctcaacaccagtaactgtagtcttcaagggaccactctgtgaccaagaagtgctcatcaaaattcacaatgcatcaaaatagcaacataacatacaacatggaatcaacgtatgacagttccaaagaacctagaaatgtcaagaggctttatgtagcaggcttacatttttctttcaataaccatagttggtaaaaaaatatattagcttaacccattatgacatatacatattccattccgatatttgcgtgaagtcaaatgtgcatatggtgtaaaaaaatcgtgggtaagatataactacaaagattgtggattctcgaatcttcagaaccaagcaggtcatactctcaagaataaatttgtacgtctaggaggcggtataaaccacattactggacttaagtaataaaagacaaatcagatattttactcactggagtcaaacctaggatctcaacatcttcaccagttttgattgtcccctgctcaacacgccctgtcacaacagttccacggccctgcagattgaaatcaattggtctgtgtcatccttatacttgccaaaaacagtaaacagtgttctggcacactaaaactcatagttacaagaacaaaattaacataatataaacaatttaatcatatgacttctcttccagagacttaagggtacaatggttaaaatcttttcaggagttaaatagaatgcctattgacagaacaaagtataaagtgtcatatattcttgctgtatagtttctaggttcccagcagcattcatccatcaacttcaatggctaattttgtataaacagatgctaacaagtacataattcaaaccttgagccggtttcagaattagaacactaattatatccatagatcaagataggttcgctcattgtacttggcacagaggaagtaaattcaatttttaattgcaatcagttcaaaactacagtgaatatgaaaaaaaaatagctgtataccatagcataaagttaatcacctggatagagaaaacatcttctatcggcatcaagaaagacttatcaagctgcctcacaggatcagggatatactcgtcaactgcatccattagtttcaaaatggcattctttccaatctcatcattagtcccctgtaaggctgacaaggcggatccacggatgattggaatctcatcaccagggaacttgtagaaactgaggagctctgcaggaaaaaaagggaaatataccttagaacaagaacaaaacaattcatacaacaatgtaaagagatgcagaatgctagcataccacgaagctccatctctacaagctctagtagctcggggtcatcaacagcatcaactttgtttaagaaacatacaagtgatggcacaccaacctaaaatgccgagaggaatgcttgagtaatcagtaaccagaaatgaaatgatatactaaaattcgcactgaatgtgaaaaagataaagaattgtcagtgattcaaaacctgtcgggccagaagaatatgctctttcgtttgtggcatggggccatcaggagctgatacgacaagaataccaccatccatttgagcagctccagtgatcatattctgaaaatgtgcacattgaaacagagatgtcattggtcattgctcaatattaaggattctagcagttccgggacagtaactcagtaagcctgagtatcagaagagcctactggatttaataattaatattgacagcgcatactacaaatgtgctcagcaatttcataatatccaatgaattagtattacataatatccatggttattgttcgtgaagattgtcaatatataatcttgataacttccactttagtaaaatagaactacttaccttgacataatcagcatgccctgggcagtccacatgagcataatgccttttagcagtctcgtactccacatgagcctacacaaccacaaccacataactcagacttgatctacacatgatgacatacaaggacaccatctggtccaaatgaagaaaaaactagtgctaaggctcaccgttgcaatggtgattcctcttgctttctcctccggggccttgtcgatctcgtcaaaagcaacagctttagccttccctgcctcagctaacacctgcaaagagcataaaaaaggcatttcacgcgttgaaattgtttggactccaaagaaaacaactgaacttgcactatatgtgacaaatcagaccttggtaatcgcagcagtgagtgtggttttgccatgatcgacgtgcccaatggtgccaacattcacatgaggcttcctgagacagattcatacaacaaattcaaaacacaagtcacacacggatcgatcgctagatgctaaccacaggaagagagaaaaccaggcgcggagagcaacggatctgatccaagaaggactcacgtgcgggtgaaggtggccatggacctcgcccacagggttccagccagaggcggtggctgctggggcgccgccgccgcagccgccgacgcatccggtagcgccgtggggcccgagatcacggcggcgcggagggtggggtaggagaggatgcggcgggcgccatggctccggagcactgcggctgcggccatcgcgttcgcgttcgcggcggcggcggcggcggcgctaggtgagaggaggagagagacgggtttagggctttaggagtcgaatggggaggagaggcggccacctcgtagctgtaacttgtaaccaacccgtggaggcgcaaatgggccgtacggcccactagggcccataggcccactagggcccataggcccactcccagtttctcctctgccacaagaaagaaacactgcggaaattacaggtttgccctcgtatcaccacagccaccaactctccctctccctcgccgccggcgcgcgagcttcaccagccatggccgccaccgccgccgcctccgtagccgcgatttcgcctctccccggggcatccctcccgcgccccgtctccgcgagggttcctcttctccctagggcttcccctcccacatggcgcctcagcgtcggctcggcgcgcgcgcggtcgacgcggtgccttgcggcggcggggggtggcgggctggcgccggagatgagggcgacgctggacaaggtggtggggtcgcacaaggtggtgctgttcatgaaggggaccaaggacttcccgcagtgcggattctcccacacggtggtgcagatactccggtcgctggacgtgcccttcgagacgctcgacgtgctcgccaacgaggcgctccgccaggggctcaaggagtactccagctggcccaccttcccgcagctctacatcgacggcgagttcttcggaggatgcgacatcaccgttggtacgcaccccgcctccccgatttgacctgacatcacgcaagctcactgttaaggaattgaatctttttaagcagcattgatttgttatgagaagtttgacatgccaattcacctcttcgatccaacacattgtgattatcccactacgattagtctaatgctgaagacatgctgcggcccgcttatcgtgtctagtccattagaatcctgttagaaacttttcaaggggaccagacgtccctgttgtttactgtggttctgaattttgatgattccctatcctcataggcatagttcagagtatataaatttgagagaatttatcagagtatataaattttgagagagaattttcatggcatgagatactcgcagtatctgaagatctgatcatctgaacgctggttttgcgttaaatcaagatatgctacttgtactggccataaaagagcagcttgtgaaccctgattcatatatataacccgagacgtggctttcacccctctcatcattaccagttaatcatcaccaatagtgatgtatcctaagtatccatgcctagtggcgaaccgagaacaaaaattaacagggtccaacatactaattacctaattgttaactgatatattgatcagcatgatataatttagtttaaattaccagaagctgcatgtaggagcgccactgtctgtgccaccattggttataatctggtttagtgttcttcactgaacaactagcttgtataggtctgctccatgcagttttctgagtgttgccacctatatactcaagaacctactataatgtaagaaataactgttaaaaaatatgtatacatcttgcccagtagtagaaattaagggagtattcactttaatgcaattttcaaccttaccaaattttggcaggatttcttgtatagttaccaaaatttggcagcaaactaaatgtagccacttttttagcaactttaccaaaatttggtaaggttgaaaatggcatcaaagtgaacaggccctaaggtggatggtgcacttggcgaccagctgaccagtgagaacacaaatccatgatgtagcaaatcatcacttaaaatgttcatcatggtagtatatttagatacttgacttgagtaaacccaaatgaataattgacacacaagatgtgaggatgattaatgtgtgtgttccctactgaatgtttgatatgatcagtgtttcagcaattcagctggatttaatgtttgcactgttttatattttgcagatgcatacaaaagtggagagctgcaggaaacactagagaaagcaatgttatcttagtataaacgtcgaaacacaccatagagtacatataaatggtatatggtcctttacgatgtactcttcagccatgacaaagaactggtgatgctaagattgtcaacagttcaattcatcaagcagtgaggtccaactcgaacgtgcaattgtactcatgactaataaattttaatattgatgacaaatacttcctgttgcaacactcggatgtcacagctctaaatgtctggatctctaaatgtctggatggtattctcttatagagctgaggcgatgatcttgtacctaaaaagatccaaaacttggagcgaaatcttttgcccaagtagtccaatctatttgtttttcatcgctcttaaatgtactactccttaactgatactccctccagtttgatattaagtgacgttttggacaggattgcatataccaatgacttattaattagtcaccatattcccttgttatacccttattaaatactctcggatacacatcaaatcaggaataacttctcctcacttggttaaagccaccatcccaaagcatatggttccgtgttcgagcgcttgtagcgctcgttttcatccgattttgcatggtattgtagccgtgcatgcaggattttttttatgtcattttcgctcgcgcgcgcgctgaagttttgtaagctgattttttcgctcgttcgtgcttggtatagaaaattttttggtgcatcttgcagctggttttgagcgttttggcgcctgctgcctcttgcgcatattctctgtgaacaagaccacaacgagagcatggcctcctacgcgcgcatcggatcttgtcaagaccattctcgtggactcggccgcagtgaacgcacacttgcgcgagctgctccacctccatggcgtcggcgctgttgtcctcctgcgcgaggtggtccacgatgccgcccgtcatcatgtcgtccaccggcgcaacctcagcatccatggcgccgatggtcacttcgtcttcatgcgcgacggcggcgtcctgcagcttgacatccatgatgctggtgcgcgacgagcggcgttgtcaagaggcgaagcgacgcaatggccagaggcgagcaactagcagcacacggtggctatcatggagtctttccgcttccgtggccagagtattagtactccaggcattagttaatttttgccttgggacttttccgctggatggagacgaagcaacagcatttactgtttgcatgcatgaatgagggtattctggacaaatacaagggagagagttgtggagagcgctaaaacatcaatttttgccagccaaagaggattaacccatagcgtcagttaatatggaactagagggagtaactgataacaaggttatgtacctccatgcagatatttgtaccattagttaagagcacccgcaatggtaaagtaaggtgctatctataaaacatgtacacctcaacaatagactagattaatagtaaaccacttcaatggtatgtctacatgggtatctatagctctctaatccattgcctcgtttttctctatagactatctccatgttagtagatagctttgctctctctcttcatttaatctcttccaagtagaaaaatatgctgacatggatctcttgtagagagcttatagataaccattgtgggtgccctaagtagcttggataactctgctctaaacagaagatagccctgcccccaaattcaattacttaggcacgagttcaccgtgcttcatgcaaacgacaagatctccagttttatcttctccacatatgatgcatctccagaaacttaaaatcacaacgaacgcgttacagatcagatcatattgagaaccagcgcatctgcagaacctaaaacaagccaggcatctgattgaataatctagaattcaaataatattcgggaagatacacatgttaagcaaattggaggacagcgattgaaccccaacaacaaataatatgtcatcattctgtggtcacagtatttaagatcattcacgcacgagttcccaaagcaaacaggtgatgcttgagctgagaaaagcttgacgtcctgtgattgtaaaatttgaccatagaaggccaggcagagaacctaagcaagccagccaatgcaaaatggtttacagattaagctttcaacaccgccttatggatcatcgtctccttgtgtatttggtgacagctcttctcaacaagatcgaggagtttctcgaggttcgccgcccaggaattgagtataccattactgtcttgtgctgtgcggaagcatacaacacccattggcctgtcaatcttcgcaatcagcgactttgagtttaccatgtccgaaaggtgtttctctgcctcctgaatgagaaaaatgtggggcatgttagatcttggtaggctacaaagtaacaagaggaatacaagtgatgctaggaaggctgggaacacaaacctgcaagctcaagcaaagaagatctgcgagcctcttcagggtaatccttgaatagtacttcgaaacaaccaagatattctgaacaaaagcaaagaactggaaatcaactgacaaatacaaagcaaggaaccaaaagagaaatacgataaagtcaagtaagcaatacatgttcaatgatcctcaatttcagatcctctgcagctttgtcacccaaagctcctccgagaaaattcttctcattcgcatattcatctttaaagaattcccacaagcttgtccactgaatcacctccatggttacaagttgcttcagcagtaacctattcccatccaaacagcaaaagtaggaattagaaagaacattaaaaaccatgataatttgtaatcctgaaagcaacataacgtaccggaaatttggtatctcggagagatttttgtcttcgagtgtggcattgagaaggcttgattgcatcggatcatgaggcgccaacaccaaataccaacagatctttctaagaacctaaagcgaattcaggcagtcagataaccattatagcgtgagtgagtatgcgcacacaccacaccaagtaagacttgcgaatgagagagctttaccggtatccactttgatggatcctcttttattgatggaatttcataaatcgacttgtagcaacggcagatttccaggtaatcattgttgtgcgagtaatagctgaatagagacaaacagaaatcatgtttcaccacatatatagaaaaaaatatatactcttagcaggttataaaatcagttagcgagaattcaaacagcacaaatacagtattcataattgtagcataaaaaaaggttgatggatacaaataaggcattcaagcagtaaccataacatgatgatggtaaacaatcgcaaacatatttgacaggtaaccgcagaagaggaattgatatttcctgagtaaataaaatacaagctacataaacaattgtctaatagcagtaagggatatgacaccacattagttcttttgtttaatcaaccaagcattagattgacttagcagaaaactctaaatagttaactatcactatgtattagatcatgaatcaaacagtcgaaagcaattctttgctgaacaaaatagaactccctccatcccaaaatatagctacctttatctgtgaatctgaacttgtccatattcatagctaaaggtagctatattttgcgacctgagggggtagcattaacttcaaccaacattactagaagcgacatgaactcatgatgaattagtctcactgagcaggaagacataccgaatcatcagttcatagtagatgcgcttcagttccaggagggaaggtatctctgctggggcttcctgaacaatattatcaccttctttcggtttctttttttcctttgacgggtctgcatcaaataccctaggactgattttcctggataaaatctgtgcgcgtacataatcttgacgatccaagcacagccggacctgtgatcatgattacagtaagattccagaacccaggcttttgtaacaatttcaagctttattactgtatttcttcatacctgctctagaatgaatgcaatcttttctgtctttgccatggagccaaatgtttcaacctgaggatgaacttgttagacattatgtagatgcgaagacaacactatggtggttatagtagatgtaactgtgtgccatgattatagtgcagcttgaacttacagcaacttcttgcattaaatcagcagcctcatcaatctgtccctgctcctctttgatttttgcaagtcttttgatcaatcttgctctctctatctccacatatatctacagttgatgcatatcagtgagattacacacatgaaagggcattaaatcttataggtaagcaatatttgagtagccatgattctcacttttccagcagatacactgctcaacgtcttgattagctcaatacgtgtgtccatgtctggcgttaagtcaatgtactccattgctttctgaaccatggcagtgatagcctgtaaaaataaagaattagaagagttgagacatgccacatgtgcataaccaagttataatgcagcagcaatagtattgcatacataaacaggcatgatttatgaaatattgttcaacttgtaaataataactggatatttcaggaagacctaagtatgggatatggagagacaatgctgaaattttggggggagaaaaatgcatgcaaatattgtttcgaagtgaaatatacaatgcactcgattagcactcaacaaaacattagttgaaactcaacctaaacacataatgctttgcaaagaaaagagtaatcttacacaacactatggcatgccttccctaccaccagtatcccttagaaataagggcatatatccaattacatcgagcaaaatatgactattgtctttcagtgagcgttgataatttgaattgtgtaatctatttaagatcactagaacttagaataactctaagttcataccaagattacaaaaataaaatcaatggctggtgattcagagtgacaacataatagcaggtgggtatgctatgttagcctcaattacatgtgctcctcggaaactttggggtttgcatgtgcctctagtcagtagagtataactttgaagatatcagttagatagctaaatacagctagtaattcaactagaactactaaacgaagtccaaagataggagaggacgagagcttgacctgcttaagctggcccctcctcttggagaggaccacgatctgatcgttgagcgtcttccaggcgccggccttgtagcagagctcgacgatgtcgatggcggccttcctcgtgccggcgacatcgccggccagcctcatctgcttctccacgttgaggagcgactctatcgccgcatcgaggttggtactgttaccctcctgcatcggtccacaagaaacagggtcagattgcaaggcatcagatcaacccgcaagagatcgaaaccctagatgagaagtgcgggccgcggcggggcgggcgggaaggccaaaaccccggagaggcgggcggagggtcggggtgggggaggggaggagggaggtgagctcaccatggcgagggagggaccgtggggaggcgccggcggcggcggcggagtcgaggagatctaaggcaaaggcggcgtgcgctttgcttgcgggagaggaagaagaggagagaaggggagtagggctctcgggctctctgtggtgtggtggtggccgttttgcggggaaaccctcgcggcttctctcaattacgcggcttatagcagccggccgccctacctacaccgtaccggcctccttgcaagttgcaacgcacgagttctattaggatttgcattttcacatgattatgttattatccatcgtttcaagatctcataaaattctttatcccattggttagcactcgtctaactttatccaaaataacaataataataatctgatgcagtatttctaatagtgtcttatatactaaaacaaagttttaagatcactgctggttacatatatacacatcgtaaaagctagtttatgacctgatatcattgttgttaaatgtcaaggtaagtcgctttgtattttgttgtgaaatatgtggatgcatatatgttaaatattgtggaaatgatagatggtatatgttaaaatattatggtaaagatatggaaaatgattatttgtgtgcttacatattgagttctaaaatataataaattgcagatgacgtggcatgcttgtatgagatttaagatatatgattactattgaatgatggagtgacatgtttgcatgatgcgctttaaaatataatgtgttacaactatgtagaagatagatactctatttccacaaaaattatcatctgaaaagaaaaagactaaaataggcctgattcttatgacatgacatgctttgtattgtgtcgataacatgtacttttcctctccatctcctatttcatttcatctatcatattgcatgcgttgtatttgtatttgtcgactacaattgtgaaaaaaatggtggcatgattaattattaactcgagagtggtagcatgatgatattacgatggataatatgacacagttatattatataagaagttagcattcaaattagttgtctataagttatttttctatgttgtgtatatatgatttcatacatggcgttttcgtttgttacatacttcaaacctatcgaagcaatcgacctcactattgcatatacatttatatcaaatgaattttgctatcgaccacgtgggctatggtaaggaatatgggtgttaagacccatattacattattttatttcatcctaatgtttcgcgtatgggctattgcagcatgggccgcccgaaggcttggcccatgttgggtctacacctttgcctcttgtactaccacatttaggcctcatggttttctatgactttagttgtacttgtgttgtgttgatcatgtcgcatgcattttttcttagaagcaactactctattgtaaagttagaggggcgtgagtccctaacatgtggtggcccatcgtcatgggcccacatgtcaaaggtacacatcggtccaacgtatgttatgggagactcgtcgcttcttctctctttcatctctctagtttttttttgtatattttgtgccatgcagttgttgattaaacttgtgaagaagaaggggtagcgtgattgattgttgatctgaaagtggcagcaaaataatattatgatggataatatgacacaatctataagaagttaacacttaaaccaatcatttatggagtcatagaagatgtttttctaaggagatgacaaaagcgcacgtatacatgagcacaatgctgatgtacgatttgatttcataccttatcttacatatcctagatccatcgaattttatcgttatgcatacatttacctcgagagtcatggataggagtgtgtgtgttaaagcccatatcactttatatttaattttggaaatacttaatataatttcgttatagtgtttcatccatgggccgcacaaaggcttggcctatattgggtctactccttacctgctacagttagtttgtctttgtactatctcatggtttatgtatttgctcatcggtgggacatcacctaataatcatatatccactaacgattaatatctaggttttattttagagtgtgacttacttcttccgtccgaaaaagatagtaggtttaaaagcgtctataccatatctgataatgtcgatagcatcaactcatgtacaaccaaaataatttatcatgagatacctctattttcagtaacaaccaaataatatactcaccgtggagaacatagaaatcgggtgctcacacaacctccatatttgactagatatagaaggtggagcaaatccatgaattttgtaatagagtaggactagttcataatgtcgggacactaatgttgtattcggttaggtttttttttaagtcctatccccaacctatataagatgggtacacatagcaataataagcataacaccaaggtgaccaatgatatgctcaaaatcttaatggatgttctaaattagactaatttaagtatcttgacaaattttatcgtgtagagatagaggagctagtaattattactagcaacctgaaaaacttaatttggctcctccgtaaaaagaaggaaacggcgaaaaagcggctgcctctgccgccgtcacgctgaacgcgcctcaccggctcaccgccgcggctgacccaacccaacccaacccaacccgggctcgatttcacttgaaatttggaccccacccaaacctgtcgtcgcgactcatctactatccattctattcatccccatggcgccgccgccgccgccgccgcctgccgccgccgcctcccccaccccaatgctgctcgccctcacgggcctctccaccttcagcgacaggctcgtcgagttcttcaatcactggaactccttcatccgctatgccaccgccatctccgacgacttaccaccccttcccgccgccgaccaaccgcccaacctcgccgatgtcgccgagccagaatccactaccccgcacagccccgtcgccgtcgatgagccagaatcctctaccgcgcccaaccccgtcgccgtcgccgtcgccgagcccaagcctgcacccgtgccccagcccgaggagcccaggccgaaccgcggcggcgacccatcggcggagcatatgggccgcatctgcgagcgcatgggctcgggggagctcctccgcttcgtcatctcccgcatgggggacctctcctggctgctccgcgctgtcccgcccgcgctccgccgcgcccccaaccccgcggagctcgtgctccgggctatcggccgctactacatccgacccgggggcaggcacaccgaggccgcgtgcgagctcctcctgctgtcctacgtgcgcgccggctgccccctccgcccgggccaggaggccggggacgaccacctgcgggcggaagcccgcgaggcggcgctctcgtggcgcagccggcttgtgcggtccaaaggacgggttgccgctgccgccgccaacgatgcccgcggccttcttctcctcatggctgccttcggcgtgcccgtggagttcccgtcgcaggagatcttcgagctgttgcatgctgctggcggcctggcctgcgccgaggtgctcaaatgctccaagcatttcttagataagctgcgtggtgagggccacttaccactgaatcactgataaacccttgtgacatttcacctatgcctaattattccagttccttgactaactggctgcagctgttttgtcttgcagatgttgttgctcatatgctgaatagaggaatttatcatcaaaccgttgctacaataattgcatttgaacttcaggatgcattcccgctttctgcgatagcgacttgtgtcattgagagagttgggcgtacaaaggatcaagacagtcaagaacagcaccatctgccaggatcggtacctttgtcgtttatcacactatcagcttattatcatatattccttctgttaatgcatatatttaattactgttatatgatgtgttattttcaatactcaactcctgctatatgtactttgcactaccagtaacctattacaagtggtttacatgatttaatgtttgacatgatatattctttccgttagtgcatatatttgattaccgttatatgatgtgttatattcagtactcaactcctgctatatagtgtagattacactttgcaccacctttttgtgtttttgtgtcaccttgcgccaccattaaggatttgtatcaccctgcaccacattttactatcaatttttcaacctgtgccacatttaaccaataggcgttaacttccaccgattaatgcatccatccaattgatgtgcgcaccaataccttcaacaggtcctttttagcgccaacaccagacaaattgcacaattagatttatatgactgctgaaatgtaacaaacttcatgtcaccatacctataagcaataaactaaaatgactgtagaggttcatattgtagcaaagactaaataaacaccatgccaccaaattcctccagtattatgtgagccaatcccttttgcatctgttggctgttgctgaaacactggtacttcatcaatgttaaacacatccaagtcagcattgacatcaaacaggtcttccgcatcagtgtcagtgtgtcacttatggtccttgtctatcctactgctcatctaagcaatctgctttaagttctttattctcctcttccaagattgataagtcttcatagttatcatcaaaagattgatgatcagctagcgaaaccataggttgcaactaaactaaattctccaacccattccaaccaacaaaaacaaaaagtaaattggatgccaaccatgtttatgaactaatctcttcccatcagagaacatcttcttgagagtcgctgtgtgatggtggtaggatctgaagtggggtgcggaatgctgactgctcgcgccgttgcttggcagcggcactgggaccagggtcagggcatgggtgcggtacccatcatgtgttgtggggcacatcggtgggttgtgctgattcagcactgatcgaacaataggaagaaaaaagtggtgcagagtgatgcaattccttaaaggtggtgcaatgtgagtatgtgacagtgtaaattaatctctatgtttctatatagtttgtgtgtctctgtgtgtgtgtgtgtgtgtgtgtgtgtgtttccagcctcatccctaatgttgtataaccatttctgtgcagaaagagaatgatgaagagaagctagctctactgagattactatccaaatacgtggaggatccaaaacaatgttccacagagaatttcagcattgctgataggattgcgatgctggaacaaagcctcgcaaagccacatcaagcatttacaggaacaaagcgcaagaggacagcacaggaggacagtgtagaatgcactcgagggcctaaatgttcatacactccagctgcttctagtgcctcacgtaacaaaaatcttgaaggatagaagcagcatatctgttcaattaactcagagttcgccaaactttgttggggatccagttgaaccctgtggacaatagaattgctctacctagcaaggtgtgaaaagtataaccatgttttcgtttaattttcttgtggcaagcttagccagacttgcctagtaagcacattatctttctacatgtttgttaagggatgcattttggggttgggggtctgaacctaggaaatgtgcatcatccttagcatcatttcaatagtggcctcattaagaaagctccgtttacttattcctatattagtgagtcgtacaacgttgttgtttatgtttctaactataatacttatgatatatcatggacttacgtatttaaaatcattttcatcaacatccactagtatttggccagacttgttaggccttattagttgagtaagggtcttttaaaatatcttttccatttggagaagatatggatgagttctggaatataatcgaaactttgtatgaagtgcattttcatttcaattggcacaattttctgtcaatttttaatctgcaccacattgaaccaaaaaacactactgtttatttgatataccatagtggattccattactggttcatggtaaaaaaagaaaataaacacgatgccaccaaatcgtccaatctttgagccaacccttttttccatctgttgctcaaaattcaagtcagcaatggcatcgaacaagtcttcaccattggtgtcaccctcacaatgaaagtccttacctaccctacttttcatctcagcaatctggttcaagttctttttttccctcctcgaaagcatattctgcatcatcctcatcagaagattgataatcacctagctgcaaggtatgattctcctaatccatgtcattgtcatcatcatcttactaagggaagcatgctcttgttcatctatagtaacaatggtcgatgatattgtagaatcaacaatatttttccagtggagataaaatcctattgtcatctatcaccatgtaaaacaagactgaaacattacaattcaactacatatctaaaaaggaaaattgtactccaagctgaaaccccaggttgcagctattcttttttttttatctccaatccattccaatcaaccaaaaaaaagtaaatgggatgccgacctctaggttttgaaccaatctcttctcaccagagatatcctccttaagcgttgtctggcaacgtcagtatctgaactagggtgccaaaagctggctgattgtgctgtcgcttcgcagctctcctgggaggctgggaccaggggtcgggacatggggtgtgtgcatcatgggtccttcatattcagtgtaaattgaacaatgggaaacaaaaaatggtctagaatgacacaatcccttaaaggtggtgcaatgtgaacacaaaggcacacataggtggttcacaatgtaatttgctctatatttttttgtagttgtgtgtgtgcgctcacgcgcatctgtttgttttgctgtaatgtgcgtatgtgttttgtcggccacatccctaatgtctatgtgcaataatttgtgtgcagaaagagaatgactaagagaagtcggctctattgagataactaatatgtggaggatcagaaacaatgttccctagaggtttcttgtttcagtattcctgatagggttgcgctgctagaacaatgcctcggaaagccacagcaagcctttatatgggaacaaagtgtaagaggacagcacaggagggcagtttagggtgcactcgagggcctaaatgtccattcactccagctgcttgcaatgcatcacctaacagtaatcttgaaggagcaaattgctcaacctagcaaggtgtgaaaaatactaccacattttcatttaatttcttgtggcaagctcggtgagacttgcctagtaagctcaccatatttctacatgtttgctaagtgatgcattttgggttgggctgttgggttctgaaagactgaaactaggaaatgcacatcatcgttcctttttttttttttgaaaaaagaaaattagcatcagtttgagtattggtctcattaagaaggtcagtttacttggcatatcaatgagttgtacagctttgttgtatcaatttctaactatagtacttatgataaaccattggtttacatgttcaaaaatcattttcatcaacatctactagcgtttgactagacttgttaggccttattagtggagttatgtttacggtcttttaaagcacctttccatttggagaatctatggatgaggatgagtcataatccaaaattacaaactctgtgaattgtgaagagcatttttcatttggagaatcatgcatgagttctgggatataattgaaacttaatgcaaagtgcatttttaatttggagaacctatgcaatgcataagttctgaaatataacccaaagtttatgcaaggtacattttccatttggagaagctatgcctgagttcctggatgttatccaaactctatacaaagtgtttttttttttttcattttggagagggtattcatgagttctggaatgaaattcagactctatgtcaagtgcattttttgtttggagaagctatctgtttgttctggaatataatccaaactaaatagatgcacatttttcatttagagaatctatgcatgagttctggaatataacccaaactcaaagcaaagtgcattttccatttggagaagctcgctccgtttgctgctccgtttgtcaaaacttgcttatctttcgatttcagaatttacattgattttgtttgaagagtgcaattctctacaaaacacatgatctttgaatgttttttaagaattcatgttcatgcattttaattctttttcaagcaccccctatctgcacactggtctggaaatctggttcacagttcacacgttttttgcatgagggcacagggagagagtggtagttgcaggctgcttccaaacttccacctacctccacagtgttagagatcccttcccatttgctgagtaggaagctttcactctctagtagtaggtgtgtcctttacatttgctagtctccactttccgagctcgatcgatcgagcatggaagccacaacctccagcttgctcgtgcgccccgtcgacacgcggctctccgccgcctccctccccatcgtcgtccgcgcccgccggcgcgtggccgtcgtcacggcggcggcgccggagcggaagccggccgcggcggcgagcagcagcaactacgtggtggtgccgctggacgcggcgccgtcggggatcacgcggccgctggtggaaatcctgcgcgacctcaacaagcgcgtccccgacaccgtcgtccgttcctcccgccgccgcgcgtcgccctccgatccggtcatcccctggtacggaacaacctatacatccttggcctttgcttgtgctactggtaaagcactgcagatcttgctgccatacacatttgcttgcaacaaggagcactcgcgatattcaggctcatgtacagcatcgaccaatgacgctcagatcctcacatttctagtggcacactctcaagagtcaagacacaaaaagaagtttgttccttgctgatgtttcacggtttcttgtaggtatcatgccaacaggatgctaagcttttatgctccaggtaagcatatctcgtgtactctatacctgaatctaataccgagctaacggtgctgaacattaatttgtaatcacaaaatcgatgccagtcactggttcaccccttctgtgcttgctcttttgaaagcaacatgagcaaataaagttacataagtagtatgtgttgtatacataacctacatatgtactagcttccaggatgctgaataagtaccgtgtgttgtacacataaactgcatatgccgttttcaggatgctaaataagtagtgtgtgttggtacacataacctgcatatgtagctttcaggatgctgaatatgtagtgtgtactgtacacataacctttataggcagcttaaaggatgctgtcatgatgaataagtgtattttgtacgcataacttgcaaatgctgcttccaggtgctgaataagtagtgtgttttgtacacataacctgcatatgcagcttccgggatgctgaattctctctcatttcaacttataattgtttccttctgatgattgtcaacatttacttgctctacctgtcctatgtctgttgaaatactccaacgactaccaaatttaacacctttaatcatttccagtggatgatagtcacatttccttgcttgatctatcctttatctacttgaaatgcactggtcatgccaactcttcagtcttttacaccgttcttggatttccactcatattatcactgttttttttggaaacatcaggctggtgtggagaggtccgtgatgttatttacactgacaatgggaaagtgacagtgatatatcgtgtcacagtacgaggaacagatggagaggtaagtttaaaggtgttgcctcttcttgaagtcttgtgattttttctctggaagcttcactttctctattgccattctcacttacatatacatgggatgggccctcttcaatagatgggctagcacacaagacacacacacataactagtctatttacagcccaacactccccctcaagatgggtgatagatatctatcatacccatcttgtcacatgaacaattacactctttaacacctaagccctttgttaaacaatcagcaacttgtccaccagacgttacaaatcctaattccaacactccctcgtccaatttttccttgataaagaaacgatctatctccacatgctttgttctatcatgttggactggattattagcaatgttaatagctgacttattatcacacaatagcttcatgggagtgttccccaaaattttcagctcaactagaagatttcttaaccacaacaactcacttaaactcgctgccattgccctgtattctgcttcagcagttgagcgagacactacggattgtttcttgcttctccaagataccaagttgccaccaacataaacacaatagcctgaagttgaccttctatcatcaagacagctagcccaatctgcatcacaatacccttctatcttaagatgtccatttttcttgaaccataagcctttgcctggacttcccttcagatatctcaagattctatacaccgcctccatatgactacttcttggatcatgcatatatcgactcaccatactgacagcatatgttatgtcaggtcgtgtatgacatagatatatcagtcttcccaccaatctttggtatctttccctattcactggatctccagactccgcacataacttatgattttgatcaattggtgtagagactgggcaacatccaagcatacctgtttcactaagcaagtccaatacatattttcgctgtgaaataactatccctctaggagatcttgcaatttcaatacccagaaaatatctcaactggcctaggtccttgacctcaaattctttgcttagattccgtttcaacctagttatctccaagcaatcatttccagtgataatcatatcatcaacatagacagcaagaatggttatatgatctccactatgatgatagaaaactgtatgatctccattacattgcttatagtccatagcacacattgcacgcctaaaccgatcaaaccatgctcttggtgactgtttaagaccatacaaagatttcttcaatctcaacacctttcctttagtttgtgaagtggcaaatccaggtgggacatccatatacacctcttcttgaagatctctatgtaagaatgcattcttgacatctaactgatgcaatggccaatcaaaattagctgcacaagatataagagttcttaccgtgctcatctttgctactggtgcaaaagtttcatcataatcaattccatatgtttgactatatcccttagccaccaaccttgctttgtatctttccacctttccatcaggattttgctttactgtataaacccacttacagttgacaattttcttccctttaggaaatggtacaagatcccatgttttgttcttttcaagagcctctagttcatctagcatagcttgatgccaccttggatcttgctttgcttctctccaatcctttgggatttgcactgaatctagtgatgctataaaggccttatatgtggatgacaaggagtcataggaaacatagttggatatattattttcatcatcaccctcatcttgagcttcaaaaccataccttagtggaggtttacctgcattgcttctcacactctttctaatggcaattggtaagtcagattcttctctaacttcctcttcttctccccctgactccaaagatccttgctcacggcttacatcttcctctacctgattatcctcttcaacttgttggattactggacaccttgttctccttgtgtatacttgaagatttttctcttcatgtggcttcctccattcttgctcctgtgcaacaggaccacccatgggacatggaattgaaccaaccacaagcttttccttctttggttgttcatctccctttggacccaatatttcatctttcatttggtgaccatcatgaccactagttgaatcatcaagatcaatgaataaagaacttaaatctgtcttctcaccatagaatgggacagattctctaaaagtaacatccatacttacaaaggttcgtcgttctgatggactccaacacttataccccttctggccagatgaatagcctacaaagatgcatttgacagcccgaggatcaagttttccaatggaaggtctatgatctctaacaaaacaagtgcaaccaaacacttttggtggaacaacaaattcattctttccaaatatcatctcacatggtgtcttcattccaagtattcttgatggtgtgcggttgataagataagttgctgtcattactgcctcactccacaagaatttaggtacattcatagcatacatcaatgagcgggctgtctctaagagatgacggtttttcctctcagccaccccattttgtggaggagtatcaggacaagaagtttgatgcaatattccttctgatgaaagaaagctactaaattcattgtttatatactcccctccattatcagttctaataaactggacccgagcattaaaatgatttttaatgtatgcatagaaatttagaaaacatttaagcacctcatccttatgtctcataagatataaccatgtcatgcgagagtagcaatcaataaaggtaacaaaatacttcattccactcatagagaccacaggtgaagtccaaacatctgagtgaattagcataaatggtaacatacttcggagtcctctactcacatatgatgttcttgtatgttttccatactcacatgcatcacatactaacttatgtttatccactctacttagttctgctgggaacatcttactcatagtttcaaaagatatgtgccccagtcgacaatgcaaaagtaataccttagcctcttcttcacttgtaggagccatcaatgcaagacatacatcttcacttgtctcctttcgatccaaataccaaagtccatcacgcctgacgccaatcccaagtttcttccctgtttccctctcctgaattaaacaattctcacgatcaagggagacccgacaattcatatgatcaacaagagaacttatcgaaaccaaattcactggaaaagaagggacatataacactgatgataaagtgattgaaggagtacactgtactgtaccctctcccttaactgggcatgatgtcccatcagcagtttgaattgtttcttttcgtgtaaatgggtatggtttatatgatgcaaattctccacacatacccgtgacatgtctagatgcacccgagtcaagtatccaatttgaatgagaactattgatagacataaatgcttggtttgagttacctgaggaagaatgaacaagattggcaacatcaacatttgtagatccagaacaactctcttcaagcgtgaccacattagctctgtgatcacttctatactcatagcctctacctctgttacctctacctgcataacctcttccacctcttgctccacccctatcaccaaatcttcctctcccataactaggcttgcgaggagcgcgataatcacgtataaggtgccccatttcaccacaattgaagcactccctggtctctttactttgtgcaactacataggtggggcttggtgaagatggtgtggcactaggcaatactttcttcttaagctcctcctgtgccatagctgcaatagcctcatccaagctaggaagggtggtttgatgaaacattgcatcccttcttccttcaaactccgaatttaagcccttcaagaactcaatgacccttctacgctcaatccattttctcatttttgctatacaatcagggtgctctaacccaagaggatcataatgatccaaatcagaccacaaatgcttcaattcagcaacatattctgcaacagaacgctccccctgtctcaaaacacttatcttctcttgtgcctccaccattaacatcacatttccttctcctgagtagagattagtaagagttttccacatctcacttgcactagaaatggtctcaacagttgtagcaatagcagggataagtgaggttaataaccatgctactactaacgagttggtagtactccaagtcttccattcaacacttgatatgttctcaggctcctttatctctccggtaacatatccttctaacccctttgtcttcaaaatcaataaagctcttcttgaccaactcaaataattttttacaccctccaacttaatgtcattttgcatcaactcaattttttgcaccgattcagtatgaggaaccactgcactactcgtagttggagcctcattaaacttctttgcaagcatctctaccaatttaccattacttgttccagtccctgattttcccccattttaatcaagcaatacttgcagtagaaagttccttattctcaccttctataagttgtagctactccaaccagcagcagctacacaggcaccaaatcctcccttttcctttcaacagcaacagcacaagcacctcacctcctctctgtctcctccctttttttgttttttcctttcaacagcacaagcaccaccgtcgcacagctcttctctgtctcctctcacagcacaagtaccaaatccaagcagcagcaacagcacaagcacacttactcactccttccttcacaagcacaagcacacctagcactgcaaccctgctccctccttcacaccggccgcactgcagcagccgtcgccgtctccggcgtcgacgtggcctctccgcctcaaccgtcgacgccgccgctccgcctcagcagtcgacgggtgcagcactcttccgctcacagcgccgccgccacacgtcctccccaacaccagcgtctccctcctcgacgagctccggcgaggctagggtttagccatcgccagtcactagccggttggctctgataccatgaagtcttgtgattttttctctggaagcttcactttctctattgccattctcacttacatatacatgggatgggccctcttcaatagatgggccagcacacaagacacacacacataactagtctatttacagcccaacacttcttattacaggataatcatcatatgaatagagttgtacgcacacacctatgcacaccaacacacaccacaatcaccaccatcttgctgcatttgtcctcgagctcgcttgctgccggtgccctctaggctccagcttgagctcagctgctgctgtgacctcaagctctcccgcttcctgccttctcccaagcgggtagtgccacaggtctgcaatagagctggccgccgatctctagcacatggaagaaggggaggggagggggcagaaagaaaggtagaagggggtaatgtgtggtagagatttatttcgcgaacgcttttttttttcgcgaacgcggtagagatttaactgtggtttaacagaatgctatatgagaactgtgataactttcagtgctatatcaaagtgaaccataatcttcgggtgctataaaactaaaatgatggcaccgaaccaagtttgcctttgtttgtttgttttatgtgaattgtttctatggatgcaggttcatagggaggcagctggaacaacatcactgaatgatgcacgatttgatgatcccgtggctgctgcagaagaggccgcattctgcaaggcctgcgcaaggtttggctttggtctgtatctttaccacgaagacgagactccgtagggaagtggcgcagcatccacttcataagttctgcgttggttctcgcctgatttggttcaaaaggctgtggttgatccatctctctgtttatcaaggttttcagtctgtatcaggagttgaagtatcattcatactggaattctctttatcttctgaacctcttttcttgtagatacgagtcaatgaggccccgtctgccacttctttcctttttggcactgttataaagagcaaatacacgagtactcctacggttctggttccataatttttgatgttttgaacaacaacacgtgtttagacgtgaggcatggtaatagtttaagactaatctatacattgtgttctaatatctttaaactatatagttattaatagttaaagtttttattgtctgatctaaactttttcaaaacgtcaagagttatgaagccggagggagtaatgtgcaatagattaaggctacataaaatccatgaaccacagttaagttccttggcgcttgatatagatttaatggatgttcagtgtgttgctacaatcaatttcgaggcacttacatgttactccatctgtttcacaatgtaagtcattctagcattttccatattcatattaatgttaatgaatctatctagatttattaacatcaatatgaatgtagaaaatgctagaatgacttacattatgaaacggaggaagtactaaattttgatagtgttagatgtgtttggttaccaaactttagagcttataagagaagaaactttcaaaaataccaaaatttgaaagagcgatcatggcaagagaatgcttaatttgttgttctaccaaaatcggataaaaaatggacaaagtcttgcacaagttgaacaatccttaacgccttaggctccgtttgaaatagattgctgagaggattgttgctacggattatctatttaattatataaatataaattaaattaaatgttttaataaataaacctaagatgtgcaagcaatatggttgaagagattcttttaagaaaaaaataattttaatcatgaagcaaataagccgtttaaacaagtagtagtatgggcatgttttgatcaatttgttgtggcaaaagttttggcattgaaaatttgctagttggtgtttagatgcatggtaaagttttatcattttattagtaaagtgagagagagcacggctcccaacgcacttttttggtaaaatttgctactctatatttctaaataacaaatgccaaattgacaacttttactatttgttattttggaggaactaatgtaagatttttaattgtggcgttacaaatgtctgtgacttgtgaaagcatttgataatcacgttgtaaacacggatcatcgggaatcacaagcttaaaccagagctgcaactccaacgaaattcatgagtgaacggagcacggacacaagaatttcttggccctgtgccgtgcgcccgcgtgcacccgtgcaggcagcagcatactcctacagtatatacagaggcagaggcaagcgagaggcgagcgagcgtgcggcgcggcgcgagtgcgcgacgcgactattggcagaccagggtctgtgtccacccctggtcggtacacgcgccgcttctcccctcctctcttccttcctcgacccgcccgcccgcctgctcgctcgccggccatgggcgatcccccggcgctgaagaggcccaagctcgagaaggacgactacgaatccgcctactggccccgccccgccgcctccaatgcctcctccgcatccaaacccccccaatcctcttcctccgccaccgccaccgccgccacgcaggaggatgaggaggatgacatcgcggaggaggcggtcctcgccctcatcgcccaccgcgagcgggacgtcgagcgctgcaagctcaagctctcgcactaccagtccctggtactcccccccccccctttcccctgctattttgtctgataaatgttgcgatcttgatcgattctcatggttcccggtacgccgccgtagctggacaccgcggagaagaagctcgccgaggcgcaagatcggctcgcccggtatcgagatcgcaagccgcctccgccgccgacccatagggaccccaagccgtcgctgccaccgacgacgacccagagggaccccaagccatctcctccacagcacaaggcgccggagcggccgcagcttgtcatcccgggggcaaacaaccggccacccccgcgcccagagcccatgcctgggttgaagaagaccgccgctccatcatcctcctccgcatccgtgccgccggagcggcccagggcactggagaagaagcccaagcttaagatcggtactttcttttgattttcctctttaggagaaccactaccatgatgaaattatttcctcagatgtgctcatacatcaggctgcgtttttctctttacagaacagaaggagcatcagaacttgattcagagcgtgaagaaatcatctgcaacggtgcttaggttctatggcggtaccgtaatctgtagccaacacaagaggaagcttaggtgtcttgagctatgccctgtcaatgatcagcttgttgctactaggtatgtttcatgggctgtttaatgtatgccatcaatgcaactgattacggattagaggttagcgatgccaagttctccgcaaaataatgatattccataacaattcagtcaaatttcttgttaatttggaaagaacgacggatggaacatgcacagagaaccaatatctgttgtggttgtctggttggcttccgcattgttcatcctatcagttttatcacccggaagtccagaattttaaaatttgacagccgtacacgcacttgttgaattgttattattttcaatacagagcaatcttctattgggtcataacttcttgcttgcgttcctgcatgagtgaatctaaaattggactcttgcattgatgcaatcttatatttagctgatcttccattttccatcagttttgaatgaaatctctagctgacctttcatgttccatcagtttccagttgtgtttcatgctccatcaactgtttctatctatttatttcttcttttcgaacatacaagtatgaagcattttccgtgcacagtcatgttttgtacatatgtctttggttgggtgtttgccaacaaccaaagaattggttgttgacgttacatcctaatgaactaacaagctatcaaagttacagtctgtttgaggttggtaagtccaaacaactaacagtaccgatcttttaaaaggatagctacacaactatctggatagtatgaacatggaatggaattgtttcagtgcaggatgccagcaatgatgtgtttgtagattaggagttccgagtgatatactatctgtttagacggatatgcttagctaaatggtggcctttttttgtgtgtgtgttgatctccagtcacctatgaactgtggtagatttaatttaatcgccatagcttgtttccttaccttttctcttttaagaactttaatcttacacattcttgtgatgcagtgcattggatggaattgttactctgtggcaagtgcagccaaaagggtaggcctcatattactcatttcttatcatactgtagtttaagttgctattgactgactttgctgcgaataggagctctaggcaatgtttttactccatggttattttggcatgaggcctgaaagttcattcatgtgattggcatcggaaatgtggatttaatctttgtttatgaagcacatattgtgaaagcatacttaaaacccaccttagcacttatgtattccttttttgcattgcctcatgaagcatatattgtgaaatcatatttaaaaacccaccttagcacttacatatttttgttacctcacacaaaagccaagttaattggtaaatcctctcacttttcctttttttttttttttgcattgccttgcctgatgcaacttcacaatgctgagatgttaaacacagcaacttaagcaacataagaaaaactctctggttcgatggaaaacctgtaattgcaacacagtaagtggctgtaaaagaatatgccaacacttctaccaagtgacatttttaacactgatatgaccaaatcccccaaacagttggcttatgaatttaagcaaattataatacctaacttaaacatggtgtggcgtatggacattgaagtcatgacttcatacactactgttggcactaaatgacttcttgcttcctgaatctcattggacatgtagcaaaaaaaaactcttatgtggagatataaaactagaaattgatgtagaaactatagtgataatcctaccataaccacatttttttgtccatttggttttaagcatgattttacaatcacatatattttacttgcagacccgtcatctccttgctcagcacaacagattgcttttctcctaagcataggtggcctgaagatgtagcttggcatccacatggtgaattaatttttgctgtgtacagtgctgataacggcgactctcaagtttcagtgatgaatcgcaacttatcaggacaagtaagaactccgctagaagtagctcacttcttcacatcccattgcaaggttttctccatgcgacgagaaaagtcattagttgttataatccaactaaattggttccaccgacagtatagttgcatgaagtactatcagtttagcttaacttgaatgtgcaaactgataaaaaaaatataatgacacctgaatgattttcctggtggcattctatctgcaaatttgattctgaacgtctaatcatcttaaaccaggttatcacacgataggaactagagaggtagtcttttaagttattcatgtaatcatgctcagagcttcacctcttaacatgcaacttattgccagctaaatttgtactgtttttggtgcttgatcctatcatgattggctgctgatactttcttcattgtattaacagtagcatcacattaaatctttctaaatgatcacacaaaagtcataaatcatttgactatcttgtgctatttcccccgggcaaggatgcatcaagggctactgtaatgtgttcatgtcaatttgaaatactgaggaatccatcataattgtttttagggtacctttttcttaagagtaacacatgactgtgtgtattggatcattactaaaaggtgtttctttaactaatcccctgaaacagaagaaagttagttttctaccagtgaagcctcataccaagggaattattaacaacataaatttcatgccatggtctgatgtatgctttgtgactggtggaagtgaccatgctgtcatactttggcaagaaaaagatgattcatggaaccacaagaaagtgcacaaggatttgcattcttctgctgtcatgggtgttgctggattacagcagaaaagtacaatattatcagttggcagtgacaagaggattatatcatttgatctggcagctggaaggacagagtccaagaacctaattgattacaaatgcatgagtgtattaccaaatccatgtgatttcaacttgtacatggtgcaaacagcgtaagtaaaaactcaaatgctatttctgtgttactggttggttgggtttcgttttacatatcagcggaagtaaaaatgctgataaactagcatgtgatagtcctagcattccagttagagctcaagctcctgttttagtcaaatctatcaactgaaatcatgtaattatcatgttcttatgtcgagtcatttcctgtatgtccttttgatgcttgtgctgcatttctgaaaccttgtatgtgcgtttctttcttgtttcccttacagggcaccaggcaggcagcttcggttgtttgacgttaggcttaggcagactgaagttcatacactcggttggaaacaagagagcagcgagtctcagtcagctcttataaaccagtcatggtctcctgatggttggtacttatcatctggctctgcggaccctatgatccacatctttgacatcaggcacaatgggcagaatccctgccagtcagttcaagcgcaccagaagcgagtttttaaggccctttggcaccgaacggccccagttctgacctctatatcatcggaccttaacattggaatccacaaatattcatgagagaactatctttccggtgccatttttgatgcaatggagaggcaaacctttttgtagggaagtagaactctcagagaatcaagtcataggaattttgtttgttcacatattgcgcatcagtagagttccaaatggagagacttagcctactagccgcttggcttccaacattgcttcttttacttgcaacatgtgcaatttttgagctactgtgcatgcttagccatgagctttccaatcagccattgttgccttgttggagtgatactccgaggagtccccatctgaatgttttgctcctgttattacttgtgcaaactagatgggggaatcccatcccatatatgttgaaagaaagctactgtttcatgatgtctgtgttggctgtaagttggaaatgatgatatcaagtgaaaggaaccaaactgttctgtggtctgaatatctttgtgtgtactgacttgtccaaagcttggcagttggcacttgcccacttgcccaactacgttggcaaagtctagtagttcctatgtgatgtgctgactaggctgacacgtcgtccgttgtttagtttgatgtggcacatcatatgcctcttgacattcattttctttcagtcagtcgccaaatgctaccttacagatatacagtactgggcatccaagtatgacatgttggctgaagatgtagaaaatattttgagttaattttcacaaagaaaacacacccattgaaagctctttcaaattgactgaatttaagtgaaatcacaataatctgatttgggacatgcaagatgtacttgtcactggacagaaaccaaatcttgtcgcattagcaaccaatgcatttgtaagagaagcaattccatccacacatttgttatcgacatccctatctgacacctatctctcctggattctccatgctttctttcgaccttgcatggcatgcaagcatggcacctctctcccccaccaatctactaacaaagttgctctcaagatactatgcaccacaccctacggaatgaatgaaaattctagaacaacttaaccatcaactacctactgtcttacacataatcactatcaactaaacacttaaatacatctcatcaatgcaatacttagactgatttttgccgggtcaatacttgggactgattaacaagataactgaaactatgtatttatgcaacaacatttttttctttaaaagaaaaactagagcaatactgtatttgccactgctgtttgtagtcacaagaaacactaatttgcaggagagagtaatcgatgtgtacaaattgcagtcacccaattaagttaagcgtttgatcgatgtgcggtgtctgtgtccctggctatataaaccggcaggcgaaaaatacaccgggaaaccaagcctctggttggtcgcactcactcactcgcatcctctcctctcaaatactcctccaccttatcatcatcaccaccactaacaacaacgccactgcctgaaccaagaacactgccctcctccacacgacatggcttctcaaggtcaaaagaactgatttgctgtttatttcttcaattctttctttcttgtttgatttgctccggctcaattctttctgatactgataagagacgacatgagtaattgtgtgcgcagaagagaagacgagcgtcaagtcggaggaggcctcgtcggcggcggaggagcagccacctcaagctgcagctccgccgccgcgcaggggtgtgccgccggccaaccccttcgacttctcaaccatgatgaacttgctcaatgtaagcttacctcgctgccgacttatttcactaattgcctactcgtttcagcgtaatttcctcaactatattttgggtataatctcctcttgaacctaagttatccgataattaattaattagcagctacctgttcaagattgagttaattaagcaactcactatataaccaaccaggtgttgttgcttattagctgagatggaagctggattgattaattatacagttcatgcaattactagtaataattagtgagtccattgatgaaatgatgagcagaaaaaataattagatatgaataatctgcatggtaatttgtttgtttggagcaggatccgagcataaaggagatggcggagcagatcgccaaggacccggcgttcacggagatggcggagcagctgcagaagacggtgcagtcgccgccggcgcggggggcggcgcaggaggctgcggcggcggcggcgccggcgctggacccgagcaagtacgtgtcgacgatgcagcagctgatgcagaacccgcagttcgtggcgatggcggagcggctgggcagcgcgctgatgcaggacccggccatgtcgtccatgcttggcggcctcaccaaccccgcccacaaggagcagctcgaggcccgcatcgcccgcatgaaggacgacccctccctcaagcccatcctcgacgagatcgagaacggcggccccgccgccatgatgaagtaagcatagttgcaattggcgccatggctggttgagttcatcgtcgtcgtcgtcgtcgatctcgaaagcaaatgagcaatggcaatacttgttgcttccttcaggtattggaacgaccctgaagcgctgcagaagttcgggagggcgatgggcgtcggcccgtcgggcgagggcgcggcggcggccggcggcgagcacgaggaggcggaggaagagggcggggaggagggcgagtacgaggacgagtccgtcatccaccacactgccagcgtcggcgatgtcgaggtctctaaatcaattctcacttctattactgcctactctctccttttcaagacaagatggtcaaaatcaaaccattttaaatttaactaaattatagacaaatatagtaatatttataatactaaattagtttttttcttgattatttatagagtaatatttacaatacaaaatcaataattgaatatattctcataataaatttgtttaggattgaaaatgttattatttttttctataaacttgtttaaatctaaagctgtttcactttgattaaatttaaaacgttttataatctgaaatcagagggagtactaattatgcgcatttgctcaagtaaaatctgcatcttttccttcatcttcaacacgcattggcatcgttcagggcctgaagaaagcattggaggaaggcgtggacaaggacgaggaggattcggaagggaggagaggcctgcatttcgcttgcggctatggcgaggtaagcatcatgcatgcagttctcagtgaacatcttgttcagttatctgatcgattcgttgcttgtgtttgcgcagctgaaatgcgcgcaggttctcctggaggccggcgcggccgtggacgcggtggacaagaacaagaacacggcgctgcactacgccgccggctacggccgcaaggactgcgtcgccctcctgctcgaccacggcgccgccgtgtaagtccatcgcatctgcaattctgcatgcatatgcccatgccatccatcaatggacatctgactgaaactaacccggtttggttatgcaatgtgcaggacggtgcagaacctggacgggaagacggccatcgacgtggcgaaactcaacaaccaggaggaagtcctcaagctgctcgagaagcacgccttcgtatagaatgaaacaatcgaggccaggccaggccaggccagccacactcctctctctcaattcagagacaaatgctgcatttctgctctgcatatgctcctgttcatccgcaaatgagtacctgtatgcttctgtatgtatcgaagagtgcactagattattttttatttcacttgggagcaaggttaaggtgagattggattgctattctattcatccttccagagttttgtttaatgaataaggaagaaaagtaaatttcatttcagtgtttaactgtttatgtctgaatttgacatctctcattggatttggatccgtcaaaatgttggacttttaggccttgtttagatgccttggtaactgtcacatcgaatatttggacatatatatatatatgtagtattaaatataaacgaaaaaaataactaattatatagattacgtgtaaattacgagacgaatcttttaagcataattgttccatgatctggcaatatggtgctacagtaaacatttgctaatggcggattaattaggcttaataaattcgtgtcgcaatttacatgcggattctgtaattagttttgttattaatctatatttaatacttcaaacgtgtctccgtatatccgatgtgacacgtcaaaactttacacctctgaatctaaacacagccttaattccaaaaaacagattcaaattgagtagggatgcttccaactgaaatagtatagctatcctatttggggattgagatcctatgacgttactgttcaccgtaactgacatatgggtcctactactttcgggctcacatggtcctactattttcgggctcacatgttagccaccaagtcagagggaagttacgtcggaggatctcaatcccttattcgggggcgtttttaattgtatccttcaactctactactctacggccattaccgggatgccgtcgacacgccaccgccaataccatcgccggcttccatggcgatggcggtgggggtagcgcggctggctccgggtgcgtggaggcgctgttccctgtgatcccccagttgttttgggggggcgcgcctcttcacggatccagcggtgcatggtgtgattgtgggaaggctggccgcgtcgggcatgcacgcaggttgttcgacggaatgagtggcgtgattgcaatttgcagtttgtcccttttgacatatgaactcttctccatgatttcattgataaaagaatttgatcttgcgagtatttaaaaatcttcttgcgtacgagatggcatcttctccgttggctctgatttttaaaaggttccatcttttccctcccatgtagtagtacatcgtattagactaaagctgtcaaagtctcaatttgtcccagtttctccctgtccacttctgtccgattcctcctcacctcttatcgattggacgaccatggcggcgccgcgcgagccggaggtgatccgcgacaaggcggcgatgcgcgcatggtcgcgccgccgccgcgccgagggcaagaccgtcgcggtcgtacccaccatgggctacctccaccaaggccacctctccctcatctccgccgccgccgccgccgcctccgctgatcccgtcgccatcgtcgtcaccatctacgtcaaccccagccagttcgcgccctcagaggacctcgccacctacccttccgacttcgccggtgacctccgcaagctcgcctccaccggcgtcgtggatgccgtcttcaacccccctgacctctacgtccgtggcgccggtcgccgcggcgccgcctccggaggcgcgatctcctgcctggaggaggcggccggggatgggcacgagacgtgggttcgggtggagcgattggagaaggggatgtgcggggccagccgtcccgtgttcttccgaggcgtggccaccatagtctccaagctgtttaacatcatcgagccggatgttgctgtgttcgggaagaaggattatcagcagtggcgcgtcatctgccgtatggtaacaaaatctgccaatttcttctcttttttatctttccattttacatatgtgcagtaagtttttacgcattgctttgttctagtacactaccaagttctaaggctgcgtgtttacgggtacatatagcgagttaggaacaaaaggacagctttatgaacaaagtaggatatcttcaatgataacagacaagactgaattttggcttcatcgataagaagcctgaagtaaaaattagtctagtctagcggacccactggttcgcttattcggggaataatcgaaacagcttatttgcaaactaaaaataatttgtgaataaaacttttatatacgtgttcttagcgatctaaaagcaaatactgaaaaataaacttcgatgaaaaacctccaaaatcaactataaatttaaagttgaaatttaaattttggcggataaaaataagcataaacgaaaagatgaggcatgtggttaaaaggaagaaaaaaaaatcctttttacccctcaactttttggtgcaagataattggttttcatgattgcacctcttcttgtagttactagttagtgattcgtttcatgggccaacttggtatgcttagctacaactatttagagaacgggatttgctttcatttcattgccataatgtgtattttcaattgatgctccaaaggtataacttgttttgttcccgttttgatgcttcagtaacatttttaacctgtagtttttcttttccaggagaacctgtaatctttgttggttcagagtatctttcacttgctaatgttagttgattattatgctcatgctgtttccaggttcgtgatcttgattttgccatagagataataggatcagaaattgtgcgagaagctgatggtcttgccatgagctcccggaatgtgcacctatcacgcgaggagagggaaaaggtttgtctctctttcactgtatttcagaaacagcttccgcaacaaaagtttgctttgtgtgattcagttacagtattccttgtgtattacaaataaccagcaagatgatgatagtttgtaaatgcacaattttcttttgagtattcgccagttgcacagtttcgaggtgtcatatctgcctcttgtttcaattgagttttgctgtatttataactaccttgcagaactgcagaaagaaccttttttttttcgctagctcaccatgaactttgccaatggttgtattatttcttttgtaggcattatccatcagtagatcactggttgatgctagaactggcgccttgaagggaaacactgattgcaaacaaatcaaaaacaaaatagtacagacactaactgaaactggcggtcaggttgactatgttgaggtaatgtggaaggcctctctttgttgtttaattgctactggcttctgttcttagagcctcccgttactttgttgatgctggctttcttctagagagcctttggaatctagcacttgcaatatcttgtagcatatgagacggcaaaattcagtacattatcttttctatgatctagcacaagtgaacaacatactggcatactgctgaacgagtttctgattgcaatgcagatcgtggagcaagaaagtttggtccctgtagaacagatcgacggccctgtggtcatttgcgttgcggcgtggtttggaaaggtcaggctgatcgataatatcgaaatcgatacacgatcctgaggttttggggggattcacttgctgtctgctgtgaccttggcattgcgtttgaaataccttttgtttcgcgtgatgattcgcgtcatgttgtacgctgtaacaatcacagagagaaaatatgcaggagtacactgactgaaggcaaatttataagtacaaactgtagaggcctgatgctgtaacaggggaaatcatgcttgttgattacagattccgctgaagtattgctctaatttccgtgatatatactctctccgtccctaaatatttgacgtcgttgatttttttaaacatgtttgatcgttcgtcttattcaaataatttaagtaattattaattcttttcatatcatttgattcattgttaaagatacttttatgtatacatatagttttatatatttcacaaaagtttttaaataagacgaacggtcaaatgtgtttaaaaaagtcaacggcatcaagtatttagaggcggcggagggagtatatctgaacgtatgcttcccaaaattaagcatggaaatccaatacactaatgtagcaaacacagaaatgttccgttggcttctcctccatgctccagttgtcgccgaagccgctgccgtcctgtacaccgaacttacaataaagcaatacgatcttttcgaaaaagattactacaattgcaatacggagctcatcaacccttgcaccgatgattggatcgagttgccgccagcctccaccctacccaatatcgaatcgttcggcatgttccgtcgtaacgccatctctaagatattgtgctatactgctatgcaagacgtgcttgcattgttttatggagataggtacagtgatcatcaggatccgatatggtttataccaacattacagggctattgctaagcattgtgatttataaatggtctggatcattcattctagaacacatcatgtggatcgtggaacgcatcatggattttgtatgaacatggaatgttttcgattgatattttattttttttttcgctggaagttactttggttggctaagattgtcttaagaatcatgtaatacttataacaccaaccctgtcatcttccttctaatctcccgtcatcactgaccaggtatccagtcgacgagcataaccatatcaacaaaaaaaccttgagcataattggataggaattaggaagtcataagaatatgtgcgacgcaattgctcgaatcacttatgttttgtacggttcagtgcattgtacagacggcaagtaggttctccaatcttattagtgctttcgacaattttttccacgataagaaatgaaataatggtactataagggtctcgtctgtcaaacggacggagcagactgcgaaacagtgctgctctttgtaagaaccgaactctgctgttggagggatgagtgcacacgctcgacgcgctccagatacagtgaggtctgcatttctatgagacgggatatctgtgaaacagatgaacattgcagttattaattcaaagaagaatgatgacagtatctaactcaaacatggtgtaccgccgacatgaaaacacgggttagaaattgaatacaaacatgtccagaaattttggaaagaaatataggtccagacaaagtcatgactcatggacagtgctcatatcttagggtttgttcagattgtagccaaaataaaccttaccaaattttagcaatgccaaaattttagcaagatgataatattgtcaaaattttggcaggatttcttatgatttgccaaatttagcaacaaactaaacgttgacatttttttggcaactttaccaaaaaaaatttatggttgaaaatggcatcaaagtaaacaggcccttatactccctccattttaggttataagatgttttgattttggtcaaagtcaaactgcttcaagtttgaccaagtttatagaaaaaaaatagtaatattttcgacccaagataaatttattataaatatatatttaattattaatttaataaaactaatttggtaatgtaaatattactatatttgtctataaacttagtcaaacttgaagcagtttactttaacaaaagtcaaaacatcttataacctgaaacgtagggagcatgtgttattttcatgcatttagaatgcagatattgcttaacgagtgtaccttctaaggagttactgtgagaaggagttactgtgagcttatattcagtaaactggataataaggtaagttctgaacgaaattcaactccccagtgctaatgatacttcactagtgcgtttgaactcaagcaagtagctacaatcagaaagtaaaaatgctatttacttaccgccctacggaatgcaaacatctcttcttggccagacaaaattgccactaggcctgtaggagaaggcgctgcaccaacattaccttctgctaaaacatccctcctaagctttgccccttcagcttcaccttcgaactgaaaactgcataacatgacctcccatgtcaaaaatcactctgaattatgttgcaaattaaaaacttctgtaatgcgaaatattgcagacagctggaagcaccatgtacaacaaagtataaatgcaaatattacctctccaagtcaaaaagaggtccttcatcagttccttgaaaaagatcatcaatggatgaggcagctagacatacaagacggcagtgatgattgtagagctcatcaataagggtgataaatcttcttgcctgaatgagaccaagaagttcattcagcatcaaaataaacacagaaaacacaagcatctggtataattgttaacttctcaatgtcatcaccatgtttaaatagtacagacaccacacgaatccaaatgattctagaaaataaaaaaaatggagcttgaaaccatgagatatactaagatagtttccatttctcttgtcttgacgaattatttcctctcagttttcatgtgttgacacttttgaattataagatctcttccatcttccaatgttttatattcaattcagtattcacactccggaagcacaattaagtagattttagcaaactaaaagaatcagaaaaggagatagaagaagaaatactttgtcacgaatcttcatactcatagctggaatatccgatatgaaaattgtatggtagttcctggctattgctatatagtctgcagctccaacctgataattaaaataaacagtggattatataatgagctgcaatatatcacatgatcccagctcaaaataacaaatactcctgtatataacaatagaattcagttccaagtttagacggtttaaaggatggatactaaacatttttttgtcaagccacaagtgcctgatcatgaaccaattagttcccctcatctacttgcatactaaataaatgtaaattaagaagacaagatattactgggcggccacacagatactcgaagtcaaaccttgccactccattgcaacttttaggaatctcaagatacctattcataatatcaatgttaaattcagttcattttcaacagtatagagatgctttatgctatgtgcgcacctcccaaacattactggaatggtgacagaaataatgtttcctcctgtttgtctagttatatcgtgccacatagcctcatacatactccgaatgtcagaagtgagaggccaaaagtagtgaatctgtagataagatggagaaccattagttgttacatgaagatgaacttattgtgaagatacaatccagttatagaaaaggatacacctaacaattgcattgcattttatggagtcctacagtacaagatagttttagttataggacccacaaaaaggtagttttatggtataccgcgagatttgcaaaagtagattgaagttccatgcttgcaacatacatgataactcatgccatagtcaccaagagatgaatacatgattggtgaattatcaaactcaggttactgaagcaaagcagtgctatcttaccatttaccaatacattgcactgagattcaaaaaaaaaaaaaaaagaaaaagacattgcactgaatggcaagagagcgaagtcctagtgtcctacaatatgatgaagtccaatggccaccgtaatacaaaccaaaagttcttaaaagaatgtcaacagtcaactagaagattttgcaaactaaaattgaggtactgatcatgtgatctgctcacccccagcttatcagcacaaaattatttctaaaaaatctaaaaagtgtgcaaggaagtgataagataacatataaactacttattttagtctctagcacatgaaaactagaggtgtatcattttatgcagacaagtgtcataaatctcctattgctacaaacaggtagaggttaacctgagttaagccgtcagttggaattaggcggcgataatctgtttcggttccaacaagaattttgttgcagttctcgtccaacttagacaataagtcaaggaaaatttcccgctgcatcccatcctacaaaaccaagagaaaaacaaaaggtgaaagggaagcacaccattgttttaacttcaagtcagcaccttgtaatttctagtagatgaatgttgtgccttgaaaacagttagatcacaagaagatattcatgtataaataggtagtagtagtttaagccatggaatgatactttgatgaaatttaactgctaaattcatcattaactagaagaaacaaagatgcattacaggaattatttagtgtctgcacctcttggcttagttggacaattctagtttagctcctctaaaaatccaagattgctacttgagatactctttccatcatcttatatatgtgacaagttgttctgatctctaggagtaaagttgaaaacacctactgaagttcatccccaggttaaagttttttttgggccagaatatgaagtatttgataaaaaagtagaaaaaaatcataaaaaacgacttgcctgattcagatcttcaggtgctttattactggtcgaaacaagcacagttcctgtgcttaacaatctgctgagaataccagacagagctacaacggcaaatacatcgattgtctgcatagatgaagtttcccagtgtattaaaaaaatactatggataccagaaattattacattaacaatggaa

SEQ ID NO: 82757 - DNA, 3999 bp, Oryza sativa
atgcatataggccgtgtttagtttcaaatttttcttcaaacttacaactttttcatcacatcgtttcaatttcaactaaattttcaattttggcgtaaactaaacacaaccatgtgctactacgtggtatttcatcacatagaaattaaatgcaagcgactactccaaccgtatttttttttaaaaaaagtcaacctagtaatcctcctcctagatttttttttcgacggagtgtactaagctcagtatagttcaccttacctacactgattgggtgatttgatgtcaagcaccataaaaatataatattactttagtataataaaacataaaataatttgatcagatgaaatacattctaataccacgaatctaaataaccacgtgtcccatccaactcaaccaaagtctggcgatcctctcaacaggaaggacagttcgtccgtttggtccgtacggaattaaggttttgagatttaacagaagagctttgcaatagagcatattctgatttattacactaaaaaaatagagcatattctgattattggagttcacatatcatgggtagatccatgtaacatatatagtagtgttgaggtttcattggaagagctttgcaatagaggattttgactgcagtttatacgatggatagataagggggaaaaagaaaggccaatacctgattgtagttaacatgaaaagataaaatttaaaatagaggattctgattgcagtttacatgatggataggttaaggaaaaaaaattgccaataccgtacctgattgtagttaacatgaacagataaaatctgcaatagaggattctgattgcagtttacatgaaatagataaagaaaataattgccaatgcctaattgcagttcgtacgtgaaaagataaaaaaaactaaaataaaagaaattgaaaacaataaaaaaaagaacaataaaaaaacaagaactaaaaaaagaacttgaaaataaaataaaaataaaaaacaagagcttgaaaataaaaaacaagaacttaaaaaagaacttgaaaataaaataataaaataaaaaagaacttgaaaataaaataaaaataaaaaacaagagcttgataataaaaaacaagaacttaaaaaagaacttgaaaataaaataataaaataaaaatagcaagggcccaaccgggttcgaaccggtaacctattgatctgcagtcaattgctctaccactgagctatggacccttttgtgttgaatatccttatcaaatttgttcctcatttcgatgcatggagctatctacgttttttcttgagaattttctgtgacaatttacgtgacatacatatttattataatgtatatatacatggatcattaaccactcggatgataagtttaatcacgtagtccctacgttcagaagtactatatatgagtcatattttgactatgtaattttaattaagctttcgccaactactaacccccatcaacaatatttagttttttgaccttaaaaatgatattgttggattttcatcccacgaggggatttcctctacagataaaatttatttttttaaaaaataacaatataagttaatacgggacatatcactccacaaacatttaagtttaaatttgacttatacggattacatattataacttatgaaaaaattaaactaaaactagtatacatacattcgcagttatatttgttgtagtttataaaattcgaatttgagcatgcatatctgtcaagtgatcgatatttcttatattaattatcttgttattttttaaaaaataactatttagatgattaaaaaagaaatgagtggatatcaattttttaacttatatgttgactattggatataagtttaataaaaaactatgtaattatcatttatttattgtgacatataactaatttttatatttacataaaatttttaaataggatggatggtaaaaatggagggagtatatgtatgcataaattataatcattgatttaccatgtccaagcgtgtcaatgttggtcagaatgtgttgcaacttaattggaagcgaccaaaaaattaccgaccgggaaaattcccgtatatatatataacaccaacgagatgatgttggcatgtgcggccggtgtgccgtttagataggttgagaaaacgatgatgtgagatgaagtactcaatcgcgagccacgcgcgtaatttcctttttaaaatatagaacaaatacaaacattcgtatacacaataattgtgaccgtaaattcccgattccttttattgtgatatatatatatatatatatatatatatatatatatatatatatatatgtgtgtgtgtgtgtgtgtgtgtgtgtgtgtgtgtgtgtgtgtgtgtgtgtgtgtgtgtgtgtgtgagtgagagtgagagagagaaagcctctcgtgagagatgaaaaatccatctccacaagtctatattagtggaggagtttttttaataatagaatacaatattaacctttaatcaagaagctacagccaattattacaacagtgaaacacaatcttaaaaaaaaaatgagcgcaccaactactaaagacgcacacaacatgaaaagtttctaaaattattgaattatatttgtgaatctgcatccaaagttaacgaaaaactgtataaccgttgacttaagattgtgacatacagccttcactaactttatatattcatcacacttcagtagtttgagcccaagctcagaagccagtatattagtggagtgaggagagagataggcgtcaaccaattcaaccagctgatcagtggccaaacctagctataattaattagcgtagcacgtaggagtacgcgtatatggccggcggcaggttattgccgtcgacttccggcagcaggcagccatccatggccggcttagacggcggcggcgcaccaccggcggcgtgtgacccaaacaacttgccggcggccatcgttcttgtgtttccggtgatggtggtcgcgctgctgtgttggagggcggcgaggacccgccggaacaaggacgagtgccggcggctggcccggcgccggcgctggcgaaggcggcggcggtgtcgtcgaaggtcagggcggtgctcgccgggcaggtgcacgcgtgggtcaaggaggcggagagagtcgtcctcggctgcacgagcagccgctggccctgccggttcgtgaggtgcgaccgccacggcgagcagctgagcgtggtgaggatgaacctggacgaggcgtacgaccgcatccttcccgtcgtcgcccagatcgacaccgcgcaccgcctgcatcacttgctccagctgcaggtatatgtacttcttcatatatactagtatttcacattattagacgtttgagttttgaatagattcatatatatggatttatgtgttacttatatatattcacatgtcagtgaatctagacgagtgatggatatgctaaaatgtttgtaattcgaaatgagaaggtacttcagttttgatttatagtatcatggtattctctctgtctcgaaatatactatgatagtactattttttatctcttatactttatgataaagataacagtactcctcaaaataaattcactttttaaaccaagtacctttagcttttaatagataacgccattaactttgagtacatttaaccattaatgttataaaaatatataattattgtttatttggttgtgatttattttatctgaatatactttaaatgtgatttacattttagtatatttaaataaataaattgaataagaagaatgattaactgatagtaaaagtgaatgatcatttattaaaaattggagggagaattaattaatcaatacaaactttctagatattcgactaaagccaatataattctaaacataaaaaatcaaataggagtatctaatgaagcatctgtccctggcatttcaggtt

SEQ ID NO: 82758 - DNA, 2070 bp, Oryza sativa
agtaattattaattcttttcctatcatttaattcattgttaaatatacttttatgtaggcatataattttacatatttcacaaaagtttttgaataggatgaacggtcaaacatgtgctaaaaagtcaacggtgtcaaacatttcgaaacggagggagtataaaagagaaaaaaaatattatgttacatacaccactcccatggagaggactcggattcgctatgatacatattcgccaatttgacagatgtggatggaaatgtggatgtcctccgaccgtcttccgtatcgtaagcgccatggcgaacttcggagcctcccttctcacccttacccccatctcaaacgggtgaatgccactggttttttttggtttgaaggatcaactggagctgctgcttcatattctcaggaattcaaccgtgctcaagacaatgaggatagaaccaaagcagacggtagttgctggattttgtcctctgacctcagtagatgcattggcttctgcagatggttacaaagttgctaagaaatgtatctttgcaaggaagatcaccgtggtgttgtccagattgcaggagttcggtttgcgaatgctccattgtaccattgatccacaacggcttcatgcaggaatcatgcctggaagctaaatacatagggtttggttattttgatggagctgacaagatctatgcctcgtttctgtgatttgatttatgccatgaagtatagcaattttatccctttgatgcatcatttttttgtttttttagacaaaatcagtggtcaaacatggagaaaggagacgaagataaaggtccatgaacactgcaatttttgtttttggcattcctcattatcaaaaagcgctgaacatcatcatcaacaaaataaaataaaacaaataaaaaaatagaaaagtttaattgctatacatcggtgtttgatcttcactgaccagtataaacaaatttccatccttttttttttccacctccaacaaccaaccagaatgtctgccatccgtctctctcaactcgttctcatgacaccttatttcttcctcttaattaagcttatgtaaaaccatcatcaatttgttcgtccattcatccatccaaccaatcatcatctgtagccttcatttcggttcatgtttcagcgtcatgagttgagcaaaaagcagtggcagatatacatatttgtccatcaagccattgtcgtagtctattggcagctcgcgaatcgcgatcttcggcctaggaagcccatcacttggcatgccccttccaacaacttccctgcaacatgaagcaaaatgatttttaggagatctgaaaggaattttaaaataacaaaccgtaaagccatggagatagatgacagcaattgtatattagtaaatactaattagttgcagaatcagtactgtgtctttatattgttgtgtcggtgttaaattggttccatcaaattattggtactaagtcacatcaccccctgatgacaataatctatatctatcaacagtgacccttgtaatctttgcttgtaatctttgcttgcaatggacatcacatttggctattccataatacttctagaatattatggcacaagtagcaagcatctctacattacatcagtgtcaactactcctgtttttcagttgtctcccattttctttacatcccataacacaattcatagctatgtcaaaattcaggccacgatcgcatagtagtaattaataataggctaatcgctatgtcaaaattcagatattgcaaagtagtaaatcggataaaacaatggtgtttcagctgcatccattccagcgactgtgcgagagagagacagaggaagcgaggcccagacaggtggagtacagccctcccagacacagacgagcggggcccagcaagaacaacaaagcgacaccaacccgggcccacgagtcagcggcgtaactacccccttcccgaatcacgagggcaccatgaaggcatgaatgatcgatccaccaacgcacggaccgtcacactgacagctgggccccatctaag

SEQ ID NO: 82759 - DNA, 1584 bp, Oryza sativa
aggacagcgattgcgaggtctggtggcgagggtggtgatccggtgactgcaacgacggcagcggcccccttggccctcccccgtgcagatccggcgacagactcgagcaggaggccggtggcggctctcccccgccctcccccgcgcggatccagagttgggcggcacggtggtggcatgtgcgggctccggcggcaggcgcggatccactgtcggcgacaacgggagctacggatccgccggcggtggagatgggagaggcggatccgccagcgatggcagcggtggcgattagctagggttagggttaggtttttgtgttttggatttttttttttgcgatttttcatttttcgcttgcacacggcttaagcgcttgcattccgcatgcggtgcaccacccgcatggaaatattatcatttttatatgccctattgggcaggcagttggtacaaccgcacgcaaaaaactatttcgacagtttgaaaaaaatatgtttttgtagtagtggcccgctcgatttgattcgtggccggttgctttgcttacatgtcttgcaattgagttgtgtgtgtgtgtgtatatatgcaggccgtgatcgccgccggagcaaggacggtggtggtcgccggcatgataccaattggatgcgagccggagatgcttgccctcttccccggtggcgcaggcaactactacgacccggcgtccggctgcatcacgcggttcaacgacctcgccgagctgcacaaccgtgagctgcagcgggcgctccacgagctccgccgagcccaccccggcgccaccgccgtccgctatgccgacctttacggtccagtcgccgcagctgtcgcttcgcccaaagaatacggtactctccccgttttatattacaagtgacaacgatatctttttatcctttttccagacgtgtatatttctataaaaccggtagaaaaagatatatattttcaatttctttttcaatcggcgacagaacaatctccgcacgcgagacgaatccatcatcatcgtcgtctcgctgctgatatgggtggatgttgttttcggcagggtttgggagctcgccgttggcggcatgctgcggcagcggcggtgagccgtacaacttcaacgccaacttcacgggattctgcgccacaccagggtcgacggtgtgcgcggacggcccatcatcgtcggtgtcatgggacggaatccactacacggaggccaccaacaagctcgtcgcccgtgccatcctgacacgaccgtgaaatcatcaactatatactccctccgtcctaaaaagaccatcgttttagttagtccaggcagggacggatccagaaacagaaaattggggggcctcggttacatggtttcttcgacctctagccatctaaaaacctttaatttagcatttacggtgaaaaaaatcaaaggggtgctccgaggggtatccataggtcttgtgggtgtaggggggactcgagtccccctgcacccatgttggatccgcccctgagtccagacatattaaacatgcattttgttaatatgctctgcattaatatgaagag

SEQ ID NO: 82760 - DNA, 8548 bp, Oryza sativa
  unsure (1)..(8548): unsure at all n locations
cgccgactggatccacatagccgactgccgcccggttgaccggttccccctcccatcccgcccgagcctaccgccggcgtcacgggcgccgcgtcacccccatgaggtaaggaaggcagtcgtgtcggaggcgctcccactcgagtgtccgccactctcgcttccgcgtccctcaccgccgtccgtcgttcgccccagcgcgccacagtccgccgcccgcccctccacgccgccgtgcgtacctgcacccgtgccgactgcccccacccacctgcgcccgcgccgaccgtccccgcccaccacccatccccgcgccgttgtgccgccatacgagagagagaggagaagagtcgtgcgagagagtagaaagagaggaagtagggaagatgagtatgatatgtgggtcccacctttttttaataaataaaatgctaactggattgtcacgcgtacgccacgtagaacaaaaccgctctgaattgggttaagaggggtaattcgtctggtattaaaagtttaggatgagcaatgtctggttttttttagttcaggggtaattaggtcgaccgcgatagttagggggtaattcgtacttttgctaaaataaaaataaggtcacatggtcgtaccgttaaaaaaaaaaaagtcatggccgtgtcccttctggaccgcgtcggctttattggttgtgggccaaacccaggctagcccaaccctcctagcttcattaattctaacacggcatcaaagggagcaaaatgtcagggaaattaaatttggtttgcagtgttcgcgaaataaacacgattattacatgactcttcctccttgtcgtcgacgacgtcgttgatcctgcgtcttgcattcttgtgttggacgtgtgccattttaattttggaagtgtgaaatcgtcaattcattgagatctcggtcagttagtcggtatccgtcacgtctctcgtcgcaatcccatcggtgtccacaccacgccggaggtgtttcgttttgttttgaattttttttccctttgaatgaacgttacctcattttgtacccctcgcttaaacacgattgaacattttagagtatgtttttataacactacatgaattttgatgaaactattgtaaaattacagatttaaataattgtatcctaaactataatttagcggtaaattatttccaaaactacatattctagaaatcgtattataaaattagacctagaaattgtattataaaattagacttagcgatattcaagtaactattaagattacaaaagttttagttttctttacaaaactgatgttaaatttgtagttttataatacgatacctttaaatatgtagtttactgaaaatataatgttaaatctataattttgtgatacacatttttaaattgataggctaatcaaagtcttgtagttttgtaaaatttattcaaaactttaaaaaaccatggtgagatagatcaatatgtgtgatgtgttgctttacaatcatgtaattttaaattcaacttaaacaacaagaataacaaaatatggttgggcatgaactatagagtatagacaatctcatttgtttttcgattctgaatttgtcaaaaaaattatgacttagaatggacagctaaaatatatacataaaagagagagaaaaaaaagactttcctactggacgccaattacaaatagatagaaccctcgccgagccggtaaccacgggaagcatatcgatgacgccattttccccgcatctcgtcgccgccgccgccgcgctcctcggcgtcctcgccaccgccgtcgccggaggcgggacgggcgcctacacccgcgtgttcagcttcggcgactcgctcaccgacaccggcaatgcgctgcacctcccgtccaccggcggcggcggcggcccggccagccgccctccctacggcgagaccttcttccgccgccccaccggccgcgcctccgacggccgcctcgccgtcgacttcatcggtagccaaccaccaccaccacacattcattctcaaaaccaaaatggcaaacttctgatcacgacgtgacgacgtgcagtggaggcgctgcggctgcggcacccggcgccgtacctcgccgccggcggcgagacggcggcggagttccggcacggcgtgaacttcgccgtcggcgggtcgacggcgctgccgccggagttctacgagggccgtggtctcaagccgttcgtgccggtctctctcgcgaaccagaccgcctggttctacaaagtcttgcagattcttggatcttcagatcacggtaaaaaaatcaaaaaaaaaacattagaaataattaacgtggatcgcgacgtgccatctaccggccgaaatgttcgatcagtgtatcatcgagtgcttttttatttttctctgacatcattaataaacgcacgtgccggaaaaatgcgtgttggttcacttttgatagggaggaggaagatcatggcgagctcgctgttcatcgtcggggagatcggcgtgaacgactacctcgtctccctcgtcggcaacctcaccgtcggcgaggtcgagacctccgtcgtgccgcacatcgtcgctgccatccgctccaccgtgaacgtacgtaagtttaattggtacgatcgttgcgttgtgaacatcaactctctgacgtgtaatctttttgcgcgttcacaaaaaagagcagatcatcttgatcagtaatgacacatcgaccagtgtcacgacacgtaggttttcgatcgatctcatgtgtgtgtgtgtgtgtgttgcaggaggtgatcgccgccggagcgacgacggtggtggtgccggggatgatacctctcggctgcgagccgcagctgctcgcgctctaccagggcggcggcggcgtcgccggcgacgactacgacccggagtccggctgcatgacgcggctgaacggcctcgccgagcaccacaaccgcgagctgcgccgcgccgtcgccgagctccgcggcgcgcacccaggcgcgtccgtcgtcgtggcctacgccgacctctaccgcgccgtcgccgacatcgtcgcctcgccggggaggcacgggttcgggggcgcgccgctcgccgcgtgctgcggcgccggcgccggcgcgtacaacttcgacatggcggcattctgcggcgcggcggggtcgacggcgtgcgcggacccgtcggcgtacgtgtcgtgggacggcgtgcacttcaccgaggcggccaacaggcacatcgcctgcgccgtgctggaggccggcggcggcgcaccgccggccgtggcaacgccgctggcgacgtggtcggcggcggcggaggctggacgtagtaggatagggtgctcttagactgagtatacgtggatggctgggatagcttccacgtggaggcccacggtgagcccgtggccctacgccctcttgctgaacatgtggatgaattgatccatcacctttctgttttgttgaccagtgaagcagactactgttggctgttgccgtcagacatttgggcaaaagatgtattcagtgatgtcatactgatatattggaaattactttgtcacaatgttacaaaatcaactgataaagactccctcgaaattaattaaaaaaacattagttgtgccctatggtagatagccagctgggtaaaacattttaattgtctaagaaagaactactctgaattaaagtgatttgaccgacgtatagcaaaccttacataaacgtttagggctcattcatttcaataaaggaaacatataagaatatccattcgtttcaaaggaatccagcaaagaaaaaattttctatttctccactttttgggggaaaacacacgaaaaaaaataatccacttcaagacaatgttttcaatatcctttggttggcttgctaaataatcaaagataagttttctatgtttttaatgggtgaatagctaatacggtccctgaagtttcgcttcgggcttaatttagtcctcgatgtttcaaatcgtccaaacaagtcctccaaatttattatttgggttaatatagtactcagacccacaaaaaatgtaacgtaagcatgccaagtcatccttacatgcagtgggtatgaataaaantgatcattctaccccttatatatcatatacaaaagaaagaaaagacacaaacaaaaagaattgtggagggtggccaacaaaggaatttacactatcagtgctggctacagcaatcgtaaatgacgattctaaaacaatcatacacgtgtgaaacatttatcttcttttttttctttcttttctatatggtatataagggtacaatggtcatttcattcataccgctgcatgcgaggatgacttgtcatgctaacgtggcactttttgttggtccaaggactatattaaccaaaatgattaatttggaggacttgtttggacgatttgaaacctcaaggactaaattgagcccgaagcgaaacttccgtgactatgttacctattcatccatttttaattctcagacttgcacatgtattttcatactatttctatgtttcaaaatcctataaactaaacgagcctagacccctttggctcggtgaattcataaggaaaattaaggataattcaattctatatttctcattgaaatttctatagaatgataatcctatgactttagaggaagttttccatgaggtcataactaacggtttctttcctttttcttacttcaaacaccttttttgaagttttgtgtttttcttttttaagcaatgtagaaaatggagaattgacaaagaatgtttggaagattcaattttctatggacttttttcatatagaccactttaattcacgggaaaaagattgaaacttttccatagcatttctatagtcaaattccaaatgaaaaccagcgaacgtttagtcttcttggaaacattttttggttcaatgtgtcttatggcacaatcaaaggtcttctcttcttgttgggacatggccgggaccagtactttaaccatgggtgtacgtaccaagttaattaaaaaaattatcaacaatgtattgttatatgtagaaaaactaaaatgacagcagtttactacatgctttgaaatcggttttttggcagtgttacgacaactatctagcctgttaggtccaaatgtgtgtgtgtgtgtagttttgtgcaaatctggatttgaaaagtataattggatttgacatccaattcttgttttcacttttataaacagatcgaaccataccttgtacacaattatactgaccaatttatgtttttataaatgcaattgtagtttgtatacaaccatatcgagcaatgtacaccgttataatctaaatccaccacaatcgtatagggcatatgttctttttttattattatttcacgtggtaatcattagagaccttgagatctatttttttgtatttatgcaatttattaacattgttttttaacatttagtacacgtttaaaaatatatttcgtttatttggcctctgtataaaaagcacacgggcactacgctgcggtcaaaaagagaaaagtaacctcattttcttttcttgatttgtgacgttcagttaatcagtttgcatgagtatcgtgtctaaatcaacctaggctagctaccaacctcatgataaaacataaagctacacatgccaataaatattgatcgaccaaaagtgcacactacatatatctccatactaacttggagaagaattctatcaccaattaattaagcgatgagttcggcatgttgctttttatgcacatgtgcatgcatccagcttaattagtggaagaaaacgcatttaggcatcttagagtataggttaaagtgcaacctctatgtggatcatatcactgatcttgaggaacttttggatcacacgagctctttaaaatcgtgttttgcagaaagtttacatcacgacgaccatggcacaaacaactttcacaaccaaaaagaatgtttagggccaactccctaccttatcggtgcaatgtttctttacaacaaaaaaattcggcagatatatatgcatgaaacaacatttgccttatagggcaagcaacacgtgacagtgaggatataaaatgcaattggatgtacaaaagttattatttattgcgatggatgaagttgtttgcttgtgctgtgtaagcatggatgaagttgtttaatttgcgtcgtgtgctgtatgagcattattctcttgaccatctagtacatatgaatattatagaattggaaatgtgggatgaaaaataaatgtagtgagaaagtgaatggctttttcttagcagaaaaggaaaattctaaacccatgtaaaagccatgatcacgtcaaaagttaaaagcattcctcttatcctttttcatccatgaagtagtcaagtagcatacacaaaacatgtggggaaatgtaacagctatattgcaactcaacatatgaaaagattatgtacaccatatgagcttaaaaagttagagcagacaaaacgacagcacatgaaaagaacacaattaggatatgacaatctaaatcatgcgttggaataacaaaaaaaaagttgaaagacaaaacataagttgttgaaaacattcagctgttcttattgctggaattgtgcttcagtacgttttcttattgtaaggttgaattaatatttaaaagtaaacatacaaaacatattagaacaagtggcctaagtaatgcacaataagatctttatttttgagaaatcatatttttagaagcatggagcaaataatctacggtagtgatataatgaagaagctgaaaaaaaggggctatgttaccatggacattctgaagatagtatggacccataatgtggcaatcagtacatgaattcaggaattaaagtaaaaagattttgttccacaacacgattcatttttatatagctttctaatgaattcatatgaattagaggtccaagctaagtaaatcccttgcttttgtataaaaaaaaattggcggccggcagaagccaacctgagcatattcaacaatagcccctatagtttaaatggaggctgccccatttattcaagatctaaaagatgcctccaatctagtagtagtctccatttctcaatccttatttttttagttttctctttcatttcaatatacactctatctttatgactagtttaacactacaataattcaaacataaatatttctaacacatagaattcaaccatatttaaattcacaattgtaaacaccatgttcacaatttatattcaaccatattcaaaatcaaaatttcaaatggaaatgaaaatgacatatcataccatgaaagtctcgacatattaatcataatcaggtttattctaattaataacagatcaaaacactgaacaaagttttagacacaacatgaagttcgatcaaaaattaaaagcaaagccatgtaacactgccaaggacatgcaaaagatggcatgggcagggatggttcaaagggcggcggccatggagcacacagctggtgttcatgtgcccggcggcatgcagcctgtcaggtgaggacgataccagcgcctacgcaggagatcaccaggagcggtgaggttggaaacaatggcattgtcgcaacgtcccctggatggaggtgacacaacacgaaaaggaaattgtcatctcgtgtagaaaaaatagatggggattgtggctagagtctccaaaactagaggcttggaggtgagattttggtgccttactattctagaggttgtaataaggactctgctggaatttgttttctacgctcaaccctcgaaagttgtttaggggctctacatttagaatccttgctggagatgctagctctctttgcccatctattttgcagaaaattttagggaataaatttaatttatttagttagattaattagggatgtgctacgttctaggcactaaggagtactacgtgctcgcgaattagccgatatccatcatatccttagggaaccaagcactatctaaacacgcaattgtaaagcaaagcgttctcgattggaactcaaatgatagggaaatgacataacatgagctattgcagggaaaactgaccaaagctaaatacacataaacttttcttcaacgctacacttcttttcagtctgaatgcttgagatttttttcagtactgaacgcttgagatttccatgattgctgcctcttgtacacctgtgtttgtagagtgtgtaacatcatatctctatttaataagcccagtggtttttgtacggagggggggaaatgattcgattcttggggtcacctaacgagttggaatgcagtagatatatgtcatgttcccaatcagaggaaaacaaacaggtcttgccaacaaaactgacgcacaacacgctgcgaattaatgtccggcggaaaatcggcactgtacttctcttgtactccctccgtctaaaaaaaaa

SEQ ID NO: 82761 - DNA, 3934 bp, Oryza sativa
  unsure (1)..(3934): unsure at all n locations
catttgagattggaattgacgttttgcgtacggccaagggaagctgatatgtttgattttgcctgcatcctgaaagctgctcctttgcttgaaatactggaattgcatgtaagtttatcactcacttacaattaatttcacgtaccatatagtatctgtttaatattccatatgccattttcttttctagatgtggatgccctatgataaccaacattactgtgaagatcatggtgttcttcgaagtctccccaatcacgctcactccaatctcaagctcgcctatgttactggattttacggcatgaaagatcagttggagcttttacgccatatcctaataaattctgtcatgctcaatgcaatgaagatagatccaaggccggttgtcgctgttccccatggaacggtgatgttatgtactgaagggcttaattgtttgaatggatatagagttgccatggaatatcttagcaaagcagaccaccgcaatgttcttgatgttcatgaaatcctgcttgaggatgttcaaaagcgtgaaatttatgcgattatgaaggatcgttggattcaagagccgaaagctatgctaagctatttctgatcatatcatctgcaacccttttcaagaacacagtcaagcttgcttgggagaaactagttgatattgtcaattatgcaaattaaatggagaagtgagaggatgttgtaaaattggagatatctttatagctaaactactgtaataacgtttctggatatatatttttatgagtgaatttcattttgggcgtttagcttttgttgtccatctcaaattaaaaactttgattaaagaatgatccaaagtgaaatatcgaaaataaaaagatggtgcaaagcaaaatttgctttatttttgtagctactgattgactacttgactgaccatacgctctaccacttaaacttgctcacacgtggttgtgcatgttggtcctaggcttgtttcttgggttggaattcttttattgggctcaatatataatgggctcaacccaacccgataccggactttgtcccgtacgacccacgtccattaggaatggcatgcatgactttggagtgagttgggaattaatccctctagcacgcanaacagagtgacttattagcgtatgattaattaagtattaataattttttaaaagaaaatataatataattnttaaagcaactttcgtataacttttttttaaaaaaaccgtaccgcttaacattttagaaagcatgccgcgcggnaaaacgaaggggttaagttggaaaagctagcaaaagaacatatcctcaagggcaggacagccgagtgggtatctcaaaataggagtaatatctctataggttaataattaagggaaaaaaacatagtcaagttatcaacgagttgaaaaaatatcaccaacagttcaccaactgagcaacataagttctattcctctctttttctatgagatatataccaacgtagtgatatatatatagttttattcctctctttttctatgagatgtgcatagcgcgatatcttattcagttttaaattttaaaatgtgcagcgtgttagccgtgaatcatgattcatatgagtgcccggccggcgattgattaaacgatggggaatatgaatacgcctctttagttcagaccaaaatcatgccactcatccaacaccgacagaaacgcgtgaacaccaaccaaaaaccaatgaagttttttttcttttgacaggatataatatggcgtgaataccaacataatatttttttctgttagattagtgttgttgctgaattatatggcgtcagcttgtggctaatcgatcgatatggtccaaaactaagacgcatatacctggaaggaactgaactgctgcaggatctgttcatcaatcaacatcttggctcggtaaggttgtagttcacaaatgcacatccgacgtatatatcatatcatccattcatccccgtatatatgaaaatgacgatattttggcattgacctcgcacctatggaatcaccaaagccttttgtttgttattactgtagctatgttgtttccttcgtactagttagccttgcacttttttttttagataataatcatcgaagtattaacaactgtaaccggccgcttgttagtatcgatgaaaactacgttttcatttgttgcaaataacttgataaaaatttccttgacaccatatccgtacgttttccaaatcagcatggacgaactcctaatttcaccatatccattccctccaccaatcagcccaatgacctaattaactcggcatcttgttagatacatttccatcctatcatcccttggttgtagacgaggtaatttgtcccttatcttacggtgcgtttgaacattaagttcacctgggctaatctatttcaagcaaaataagatagtagatcattaaccacgattaattaagtattaattattataaatttgataaataaatttatttattgatttgaaaataacttctatatataatttcttttacaaaagtttcatttataagtttgggaaatgtgttaattgaaaaaaaaaacgaacacaatcttagcctacttttcacccgtagatagaaggaacacctcaatgccctcagttgaatggcaaacaatcagttaaaagcagaattatgtttaccaatgtgtgatggaaaatgaatggtcaatgtatcaatgatcaacggtggtccaaacaaaacacatcctatcctacatcttgtgccaccatggcgtattattgtacaaaagttaagtactagtataccgcagcgtgcaaagcagcatggtcaaacacatacgccatcaaacacaacggatgaaagcaaaggtcaaatgccccccaaaagcacagctaaaaagttttaaaaagaagcacacgacagcaaattcgcccccaaaaaaaggttttcgcgcgccggcacaacacaacacaacacaaacccgcgccaccacgcaaagcaaacttggcccaaagcatcacacacacacacacaccaaactaatcaatttttttagagtaattagacttggtttattttttttttcaaaacatcacatcgaatctttatacacatatatggagcattaaatatatataaaaaaacaaatagcacattttgcatgaaaatcacgagatgaatcttttaacctagctagtccatgattagctgtaagtgttacagtaacccacatatgctaatgacggtttaattagactcaaaaaaaattcgtctcgcatttctaaatgagttatgaaattagtttttttcatctgtatctgaaaagctcttttgatatccaatcaatcaaccgatgtgacatctaaaatttttattttcgtgaactatattttaaagaaaaaaaagcctaaaaagtcgtacaaaaaacgtgtcgcgaacctgcacaggttggtgcagagcgccgcacaccgacacaccctccccccggccccacctgccagcctgtacccacccctccctactgttatacacaatcgcctcacctctctccccctctcccaagtctccatctctctctcctcgaataaacccccaccaccccacctccatttttactcctcccacgagacagcacaaacccaatcccatccaccaaccacctcgccgccgtcgccgccgccgcagccatgggcgtctccgccctgctgctcctcctcctcgccgcggccgccaccgccgcgccgccggagcagcccgcattgtccgctactccctcctccgccgccgccgccaacaacagcagcggtggtggtggtggtgcggcgagcaacggggtgaactcgaactcggtgctggtggcgctgctggactcgcactacacggagctggcctagctggtggag

SEQ ID NO: 82762 - DNA, 9620 bp, Oryza sativa
aactaggttttaagttttaaattttagcatgcatatatatcggctgattttgtacagagggaacgatgcatggagacgttaatgcacggcagacggcagatgcatcggcgcatcagcgatggacggtgctggttgattgtgatatatgccgatcgatgccgccgtccccttttctctcgtgtagtcgtctggtagcaccgcacaagactatacacgccgagaattaaaggcaacgcatgcgtggccggggcggctggaaagtttgtgctgctttgctagggcggaaaagcaaattaaacagccggccggtgcacacatacaacgcacgcggcaacggcggcgaggcgagacgcgcggacgcttgccgactggcgactgatgacgactcgattggttaatttggccgccggctcgatcgcccgctgctgcgcctgcgtggtgcgcgcgggtgagcaacccacaaccataccacgcttgctcgatcgggcgcgggcgggccggatggatcgctcgattttccccggctcggttgggcaggcggccgaggtcgtgtgcccaccgcggcggtcttgctctgggccgaattggacggtttgaatgttgaaaggtttgcaaagttgttgttggaaacacgttcattttaggtccctcatcaagttcgaatttcgatattacgtttttctcaacttttaaaaccagtgtacccaagatcccaaatagtatagtacctggttttagctaacgtggcgggtgagacccacgtggatcccacaagtgaggcctattttcttcttcctccaacttaccatctcttttcatctcctattcccccaccttcgcccctcccccactgtctgtcgatggagaatggaggagagagaaatatgtctaacatgcaaagcccagtcatcacgtcagccaaagctggacgctatactgcttgggatctcaagtatatcggtgcaagttgagagactctttatatatgatattacggtttgacaatgaaatttgaactcgatatcaagacgagaaacctaaagtaaacttattcctcgctggatatatcaacacgttgtaggctgagccctgtgcgttgtattgtactgggccggtcgctggtctgtgctgttggcaaagctgcatgggctgccccgtatttgccaaatcacatcgggcatcattccagttttttcagcggtttggtttgtcactaatactactttacccaatgagaacatttacagtgcagtggttcgccgagtggtctcactgaccatgcaggctctgagccggaatggcctcgcagaaggtatggtggcttactgaaagaagtgtggtcctcccagtgaaaggggaggaataaggtgtgcaccttagtcatctgcacgggaagagcgattggcaagccaataaatggaggaagaagggaagccgagggcgaagatccaccacctgcgccacctacaaagacgactccaacgacctgcgttaacaactccgatgacctgcgagagaacgaatggatctggcatgatctgtttagctcgtggccagtaccagtgattttctagtttgtgtcgcagtgcagggagtcgagacgcaaggtagtgtgtgcgagaaagatgggttcggagtgtagagagaggaagggaagggtggaaagagaaaaaaaaggtgttatgccaatgacaaatggggcacaggtctaaaaggggtatatgtgtgattcaattttgttcaagagggttcctcatgtaaaagttgtaatcaactttggtaatagaggataatacaagggctaaagcgaaaatttgtaaaggctagaaatgcaaagatgcctgtggcctttggtaattatagcacactttggccatacgagtctactgtactaaataccctaaggccattcacaggcacctaggtgtcattctcccttatacagccagctcaaagattctcctccacctaggcatagctcggagcctcgccaagaacagggagccaatttttgctccctattattcgccagaatcgcagcttttgggccacaagagaatagatgaagaagggaggggaggggagaagcgccgatgccatcgtcctccccgatctgcgtcagccccccctcccccccaaatctgcgccggccgcgatgccccccgatccatgcctgccgccgagggaggaggccggacggggagaggaagcggcggtgcgccagacggggagctccgcccggtgtggtcgaagcttgggccgtgccgccgcctctggccccgacgaggagagatggaggcgtggagttcggtgccgctggcgctcggacgatgacgtcgctgccttcggccccgatgaggagagatggaggcatggagctcggcgtcgctgccgctttgcttcgtctgcccgagagagtgagtggtggggaaagtgtgagaggagagagagggagagataaaagtgagtggagagagataggtgggatccactccaagcaacatgcattgtgaagtatgtagctaatatggttctttagcccagttagaagcccaagcgcggcattttccaggacacactgtgagtagtttgcaagatatgaacatgacaaaggtaattgttaggaaccttttcatgtcagcacgtaaaacaaaacgatttattagctcatatttaattaaatgttagcttaaaagtttttaaataaattaatatatatatatatatatatatatatatatatatatatatatatatatatatatatttaaaaatatactgttaattgttctagtagcatgtgcgtgaaaaaagagaaagcagaagttgtgcagtgtgttgtcatacgggaaaaagaaaacttcaagattcctttgaatcatagaaatgaaaaaccaaaggaatagaaaaaacataagattccgatagaaatacgagtataaaacataggattataaaacactggaaaaccataggaatggatatttaattgaaccgcaggaaaaatatatgaatttaaaaagagataaagactcaaaggattctttccatgaagttctatctcatgttaaatttccttcaaaacttgcatggaaaaatacatttcatagaaattttgtagcattcattcctttgattcaaagagctaatctctccatcccaaaatgtttgacgctgttgacttttttaaaaatgtttgaccatttgtcttatttaaaaatttaagtaatcattaattctgtttctatcatttgatttattgttaaatatacttttatgtatacatatagttttacacatttcacaaaagtttttgaataagaggaacggtcaaatatgtttaaaaaagtcaacggcgtcaaacatttaggaaaagagagagtatattagaaaaattcatataggaatgaaaccatctaaaattccataagtttcctttgagtcaaagagcgcctcaaagtagctatcccaggacatcacaggagtggttgacaagtgacaaattaactaaacgcgttggtcgatgactcgatggccgccgatagtgtactaccatgacaagtcacccaaaggcccgcaaacacactagcatggcgcctggggccattctccgagtgacggcgcttctccgcttcatcctcctcgtcgccggcgccgcgacggcgacggcgaccgcggcaaggttctcccgcctgttcagcttcggggactcgctcaccgacaccggcaacctggtgctcctccccgccggccgcgatgtcccggagcgccgcctcccgtacggccagaccttcttccaccgcgccaccggccgcgcctccgacggcaggatcgccatcgacttcatcggtgccgcccgccaatctctctctctctctctactgtttcttcttgcaactcggtcaatcatttgataaactaacgtaactgtgcagcggaggcgctggagctgccgcgcctgaagccgtacctcgccggcgagggcgccgacggcttccgccacggcgcgaacttcgccgtgggcggcgcgacggcgcgggacgccgggttcttccagcgccgggggctcaggtccgtgccggtctccctcgccaccgagatgggctggttcaaggaactcctgccgcttcttgcctcctcctgtcctcaaggtgttcgacgacgaacactgaatattactgaattttactaatgcatcagcaatgcaatattacctgatctttctcccacgtagagcaaaggaagatcacggcgagctcgctgttcttcgtcggcgagatgggcggcaacgactacctcaacgccatcttccagaaccggactctcgacgaggccaagaccttcgttcccggcatcatcgatgccatccgttcatctctcgccgtacgccgtggcacgccatgatcgatcaccaatgcaattcaccttgattaccatttaaatcgtgatgattatatatgcaggagttgatcggggttggagcaaagacggtgttggtccaggggatgctgccgatcggctgtgagccgcgggtgctcgagctcttcaagctcaagcacggccgctccaccgccggcgacgacagcgactacgacgccgcgaccggctgcctgaagagcttcaacgagctcgccgagcagcacaaccgcgcgctcaccgccgccctggacgagctccgccgcgcccaccctggcaccgccatcgtctacgccgacctctaccgcgccgtcaccgacatcgccgtctcgccgcgcagatacggtaacgtgcattgattcctcgatctcctcccacagctacatacaacttcgcagtggcgaacttggagcaaaaattaccagggattctatacatatcaattatctaattattagttaatatatactaattataaattagctagcattgagtaatttacccggggtcaaggacccggtaaacactatgtaggttcgccactgcatcttctactctgtctcgtaaaaaagcaaatcctaactacgaatctggacacgcatatgtccaagttcatagctaggattaaattctttttgggatggagggggtacatatcttcgtaagtaatgtcttaagctgtttgtctactaaaaagggacaccccatcccccaccacgacaatgcatacaacctacgacaatgcatacggtaatttggaggccaaaattcgatccgcctataaagtgaaatgagtctcgtatgctaaaatcatttttctagtagagtctccttcttgcttcgtgttcatggcggcgtatgctgcagggttcggcggcgagccgctgttcgcgtgctgcggcggcggcgggggccgtacaacgtgaggctggcggcgaggtgcggcgacgaggggacggcggcgtgcggcgagccgtcggagtacgtttcgtgggacgggatacactacacggaggcggccaacagggtgatcgcgcgtggcatcgtggaagggcggtacaccgtgccaccgatatccttgtccgtatcttcgagcgattgaaaaaaacatgcccgaaatttggagggattttacgggttttttaaaaaagtgccacgaaggtacgagcgtacggctctaagggaataattaatgattgtgcatccattagtcaattatgtgtgtgatgatgatgtcaatgcaaaggggaaaagaacattgttgtgtgatgggctgatggcaatgtttttgtttcctttgtataaaatgtactccctccttccgtattataagtaactaggaaggcaacccgcgcggatgcgcgggaatcttgttgattgtttttataaaaagaatgtgaaaaaaaatcatattgatattaaatgataggaatatttctcaaattgaaataaaaacacttttaccgagtaacatataaatcactactatctccgtcccaaattaattgtaattctaagttatttagcatatattaaggtttgagaataaaaactatagtaccccttattaaacggttcatatgtaagaatgaaatagtagttgagagtaaaataagaataaatttggatgagatgtgttaatgggtatcattagtactctactgtgacaattattttgggacaaattcaaatcctaaaaatacaattatcatgggacaaaggtagtactacttattttgtttttaaagctgagaaagatgaagttgcatatgcgccaataaaataatcacaatacatcattaataaattacaaatatccactacttggttttcatgtctcacttatttgtaaatcaatacataaatatggtaaaaataccgttacttctacccattaatgggatagcaccattaaagttaaacatgaatgctactctaatagataaaaccgatcgtagccgccaagactttctttctttattgccttgaaatatggtcctgcatcaatatagttgtgttcctcaagatcagcttggatcacaattttaatatctaattcatgattgcatgctcataaattattacatcgataagtacgaagctgagcactattagctatcgcggccaccttaacttagtcgtatgttccatgctatatacctatatagcgaactctgttgttcatgcttggtgccctttaggaaaggacaaagagaagatggaggtgatcaagatagttctttttattgttttcagtgtatttgtggtttagtgtagacacagtttgtttttggtattcatcattattacacaaatttttatcatatagataaaatactcactattgaaaacgagtgaggttaatcattcgatgatattttaaaaaattaaaattaaatatgcataacaccacgataatatccagagcaccatattattgattatattttaacaaatatctatagtttagtgtctatgttttaacctcatagtcacgtcagtgaagtttatggcatatatccattaattatgcctgaaatattgaaatttcttaagtataagaaaatatattatgagtagtttattatacatgttgtttcactcttcatttgtgttaaaaatatttggcaaaaaaaatatgtgcccataggtctcataatggattatagcaagatctttggcaggaaatattgttgatagttttttttatatctatgcagcatgtatgctacccacttctcaaataccaattaaatagttctgaaaatatccaaaaaaaaatactttgagaatcttaatctcaaacaaattacaattaaatctcagacatactttaaaaaacataactaaattgtgatgttttcattttttttaatatgtagatttaaattagattgtatatttgtgtagtgatatttcacaccctaaaatatgatgtgaatttgttttgaaaaattatcatacaactaactattatatgtcggtccaatgtgtcgtgatgtatttaagatcacaatataaattttataatttagtttaaataatacatcaggatcacaaattagatatctgatctaaaataatttaaaatacagtttaaagaacgttgattggatattttttatattttattatagatcttagtttaactacatattttatatttctgaagtaatatattttatctttatattgtagaaaaaatcctattttaaagaaggttaatttttttcccaacagtatcacatacgtatgttttttttggctttgtcttttttatctacgtgcttttcttcccttccgtcaacagtaggtaaggtcattatattatattgtaggaaaacaatattttaaagaccgtcaattttttccccgatggtttcatggtcgcatgttttttaaatctaaaagtaatttaaaagatggtttaaagaatgttgattggatattatacatttttattatagatcataggttaactacatatttatatttgtgaagtactccctctatcccattataagtgcagctaaagtttccgtgcctaatgtttgaccgtccgtcttatttaaaaatttatgaaaaaattttaaaagttaagtcacacgtaaagtactattcatattttattatctaataacaacaaaaatactaatcataaaaatatttcaaataagacggattgtcaaagttaaacactaaaacccacaactactcttatgggacggagcaagtaatacagatctttatattttgtagaaaaagctattctaaaaaccgtcatttttttccctacggtaccatagacgcatagtgctttccttccggtaaatcaatcgtaagtacgaacggtaacggtagtactgtttatattgtatatgcaggaggaagctattattttaataataaatctaatctaatgatgtaaaataacgggtccaccaatttaagtgaaaatcgacggtgagatttaactgtgcctgtaggatcgaatcacaataactaagccaacagagggggtgaatggttggtatacccaaaaacctaaaacctaaaacttttagcggaaataaaagttaccctcgaaatcgacggatcgcggtctgactgaaggtgttgcgccggtctaaccgcctgatgaacgtcggtctgaccgatgtagatcgatcggtcgaaccgccgaagtcgcctgtcgtgcctgtcgccgccgccggtctgaccggccgtatgtcgtcggtctaaccgccgcttgccaccagtctgaccgccggtatatcaccggttagaccgccgaaatccagtaaacacaaatcgaagaactcttaaagtagatgacgactttattgattctctctgtgtttacaaagtgcaccaacagcactccttgcaaaaatttcgactaaactcgaaaccctaactcaaaactcaactcaattgctctcaaaagcgatactgggaagcctcacgctccccctctatttatacccgaggtaggcagcctaaagccacgaaccaaactcatactaggagtcctaaacaccttaggaaaccctctagtacaagaaacaaactttacataaccaatcataccaaatttggactccttccaaattcgactcagcatcccatacgcacacaatacctccatcgtatgccatatggaatctccatcaaccacatgcatcaactctagcctaagtatcccgcatgatctctgaccaccacggacgtcgtcttatccccaagccgactcttggtccatcaccgcaaatactctcctgaggcatcgagtcacctacacatgaaataaacaaagaaaccatattccgagactaagttatctccaacttgactcattagtagcaaacaacagtattacatacggatatccaaacaaacaacccgaaactgaaaccgacacagagtcggccggtcagaccgcaggctggccggtctgaccgcacgcatactgccggtctgaccggcaacacctgcccggtctgaccggtcacatgaaataaaagtacctgcgattcacctgtaaattcaatcatctccaaaaccacttcgtgaataaattccaaataacaaaaccaataatctccaatgccaattgttcatcacataataataatcaaaaacacctttgattttacagtgccatgtggcggcttgagagcgtttgtaggagtgccacatggtgg

SEQ ID NO: 82763 - DNA, 5733 bp, Oryza sativa
gtggatcccccagtggaatggtcacatctaaatttgtttatttaggtacagaacagaggatttcaaggtaataactttggaagctatgacatagcttccagaaatcagaggacatcgacagccatgtacccaatgccaaccagtcagcagcaagtgtcacctatacgtcgtatgcacaattaattttctcatgattttatttcattgatctactaaattatggggtttattttttatttctctatataagcatgcatgcaaaatgggtatatataatatagttaaaggttatatttactgttctaggcttctaatgtataatcaaaatatattatagtaatcaagttcatgcatgagctatatatgaacctgatcacactgaattccagtaaacattagttttttccccgtatacgcatggagctgtgttagatttcccaaatgatcaatctataggtattaacacacacacacacacacacacacacatacatacacacacacacaatacatatattatcagcttgcataatttattaaattgccttgttcttctgtattcacattatagctagttttatgtattatatatatgcttgtataatagatttaaaatattggtccttttttcttctttacagcccctgagaaaagacagcgtgtcccatctgcatacaacagattcatcaagtgagatttcaagccacacatgcttgcttgaataagtatattttgacaccaaattaaataatagtataaggtgctaaatatatattgataaagaaccataaatagtcgaagtgcaggtacaaactaatccccacttcaaccttttggggaatatgcatgagttcctaagacagattaattatatttctttctatctaccgcagtgtgcaatcaaaaagctccatacactactatatactcgaccctcaggtcgattgtggacacacacacaaaaaaaaaagagtaaaacctgaatataatgattgggtgtttgggggaggggggggggatatttgaactccgacaatgattaatttgtgggcacttcgtaattatatattattatgtctaggctactacttccttttgcgctcctttaatttgtacacataatctagttagggcttgttcgctttcccttcccatggggattcaaaaggggatggggtgtggaagtaatccccgaaatcccttcaatctccatgggcatgggattaaccgaacaaacccttagtgaagtgatcattttggaccacaagttctgttggtaaattttgtggaaatgtactttacaaagttttatgatcggtcgttgtttggtcattggattttggaactttttgctactagattttttttgaagtttatacttttggaataattattcttattgctaggattttgtccggtgaattctttattttgaaagaacatattgcaaatttaacttcttttgtgtgaaaagaaaaggaatcttatttcgagtaatttttttcagtaaatatgaaactctagatattttcaaaaaggctagttattgagtaccataagaaaggtaccaaaacaaaactcacaatgtaacatatgtggttggatatttatttatatttgatcttgagtttttcttcggtttttagcagtatagaggtatatacctctaccgacatgtatacacctcatgcctaacactatgatgcacaaatacctatctgtacctcccaagaaccagaaaagttttgatgttgttgaactgtatacttttattctaattagttcaactattagggatgaatatacttatatattcaaaggcaggagaaaacctcaattaagaatggggttagtgtaagtgcatgttttatgactttggtagaccttagtctattcggaaacgggaaccaataataatatttactatcatcattttcacaagcctttagtctattagacaatattttttatttaaatacatttagtttgctaaaatccaaggaacatatacattatattgactgtggcaatgtagacatacaaatattgaactgagaaaacatgtttttttaaaatggagaaaacaatttaaaacccccagtgtcaaactaagaattcatggaaatgcaattcatatattaagttgtcatacaacatgcattgaccaaaccattttattagagtaatataaatacgctagtttatctagaggttcatgttgcaagattgtaaataagatttcagtaatatatatatgagacttgttcttttaaaataacaaatcgtgtatatatcaaattgttcaatgccacatatatatatatgatgaatgagtaaattcaacttcatttggagtatgtatagctatgctctaattaattatgtgcaccgatttttttttgtccttttggtctgcagcgcgctagctatcatgtatgtacatgtatatatatgtgatgagatctattttagacgcatgcatgtaatatgtgtgttttcttaattggatcgttatgcttctctaatctctctatatacacagacgacagaaacagatatatgtttaaatgcaaaagaattaaatgcaagtatatatgttaaattaagattaaatctcaagaagctgatttaatttaattcttgtcaatatcaacagggaggagatacagaggattaaaaccagcaatcctgagattagccacagggaggcattcagtgctgctgcaaagaacgctagtactctaattgtaaatacttttctctaactaattagatgttgcaggcagtcaggacatactatactccttcatccccaaagatagtgcataaatattttctttcttacttataatacgtccatacatgccaattaactaacaaccccccccccctcctcctctaaattcgttattttaattttacccacaaaatttttttattttaattttattattgttatacggtttagttaagatgaattcactataggaatttgcttagatatatatatttttttagaaaatcatgaattagtaatccgatcatcttttgttagcatacgagtttttttttaaaaaaatatcttatacaactccttctatatttccaaaaggtagcgaacttaaaacctgactaaaaagggagcgaacttaaaaccccactcaaatacggatatgtatttccaaaatcgaacgaacttaaaagcgacttaattatagacggatgacgtaccaaagtaccggcaaaaacatcttcaatttttataatagtagagattaggtgcatgctttgtgttcattatgagtaatctaaacagatcaaagctatgataataattagtatttcttatctttagattagtggtggttgttacttatattttgtgtcttaaagaaaaacttttgtacaattaagctttctgcaattaggatcaactaattaattatgatatctatctataatttctcatgcgtataatatgcagtgggctcatcttccccggctccattttggcctcagcgtcgccgacggcggcggcggcggcggcagcaactaatcgcggcggcgcggcctgccggccggccaccgatcgccggcgtgcacgccggcgcgcggcggcggccggtcgagaatgcgcgcgcaggagggacgacgacgatatattattatcgcgtgtgcccctctctcttcgccgcgtaattaattaatcagttaattaattacgtacgacctactgtgttatgctatcgatccgtgttaattaattacctacgtatcttgattaattagtctcgtattatacgtactattatacgtacgtgctgtgctatgtacgtagacaacaaaaaaaaatgtgcgtgatgagttctactacgtacgtacgtactgtgttctagtgttttaatttgtatccgaaccaaggagttgtttaattaactgcatgcacatgcactggacttgaatctggagtattatgtaagtgtgcatgcatgctggattatgcaaaataaacgaattaatgaatagaactgtttttgttaattaattaattaaaatgtttggttcaatttttcgatgtgttgatagtgcatgaattaaagctgtgtacatattgatcgaatcccatcaaaattgaacgtgtgtagctatgaattaattaatgaactgacgacgctagctaattcattcggggcaaccaacaaattgtagcctagatagactaattgtttgccttttgtttcaagttgttatggccaaaacttatactcatttcttatatagatacaactgaatgtgttaactcaacggtattgtgtgtgtgtctatatatatatatatgtgtatatatatatatatatatatataaaatctgtcaattgttttgtactccctccatttctaaatatttgacactgttgactttttagcatatgtttgaccgttcgttttattcaaaaacttttgtgaaatatgtaaaactatatgtatacatataagtatatttaacgatgaattaaatgatgggaaaaaattaataattacttaatttttttaataagacgaacggttaaacatatttaaaaaagtcaacgacatcaaatatttagaaacggagggagtatttcttaagcattataatatattatcatttgtgacatatatatagatagagaattaaagatatatcaaaataaaagcagtttgtcacactaataaaatccatgtcaaaaccaaacaaaaaaacatatatatgtacaggctacaagtaaaataccaaaaaatctctttgcttcctggtgccacgcatgccgttaattaactagtacattcatgttgttgatggatttgggctgggaaagaaattcccctggttcttgcagtttgtgtacccacaaaacagttagtttgattaattggtcggttgtacgtacgtaattaacagttaaccaatcaattgggcacaagctaaatcatattagatctcttggattctcatgcattgaattattgctgctgacaaaacaaaaggcagctgcatctgcagctagctagtaattgatatcgctcgatacgtacagatcagtgagctgcaggcatgcacgaaccccacacacgcactatctagctctagattagcttgattcatgtttgctgctgctgcttggttcatggctatactccttctgtcacccaaaatattagggattttataggtggatgtgacataatccagtgttgcaaatctagatatgctatttgttcagattcgtagtattagaatgtatcacatccagctaaaatctcttatattttgggatgaaaggagtactaactagctaaaccaatacctgtgcacttgatctgtacatcgtcgatcgaccatctaaggccctgtttgattcagcttagaattattataatctaacttattagaagtaaactgaaacaaacaagtagattattatagcagattattataatctataagccagattattataatctaactacaattagtgaaatcaacatattgggattagggttttggcgattcccgggcgaccgggagacgccggcgatatcccacattgtgggatggcttaggatggagttcttctccgatccggttacgtcgtttgcagggttttcgcctgccttgtttaacatcatggaggggttttcgtctcgggatcttacgtccttgggacaggtgattggttctcgactcggagg

SEQ ID NO: 82764 - DNA, 2114 bp, Oryza sativa
caaagtgtattcatttgtcaaatgtatctctgttgaatttttgtgctgtatgctagagatgaaataatgctaccgatgcttcacaaggtctgtttgtttgaatgctacaagtctgggtgtgctatggccaccataaaggaaatagcacatgttttctacagatgtatgagaatgctatgaatatacaattaatcagttatacatgccttccccagttaattacactgctttaataattcctgccatgtctggactcttgagttagacttgacgagggccatgagaaattcctcatggggaaatttgtatgctggtatagacaagcaccaccaatttgttgagataagcttctgaccttcagcttccttgcgtgcaagtactcaatggcagttttctacagtctacagaagctagcatgggtatttctttctggatgttctgtcagaaaataactgtagcacaattacttatcaaaatgttatacggttcaggaggtttagtggtctaaaacttttaacataatctaaaatctgtgatttgattcaatcaagtacaagcatactcttatgtgcagcagacatactcttgagtacttgaggttttagcatgtcttcactgcgctttaagatatgccattcacaattatatcctaacataataatcccttatttcttttacttaaataataatcccttaattggtagaacaaacaatcaaatttaatgaagcttcagttaaaaatttatacatacaaattagtgaatatggtaaaacatgtacgcttagattatttttatttggaaggttatgaatgcttatattattgagtgaagtgatttatctatatctttcaaactgttcatgatctccaaatacaagattgatggctatgcaattttgttcaaacaacagttagtgaatacagtttccttaataaaataaaacgaatgtacataccatggaggaaggcagatcaattcccatttgtgtatacaagtcatctgtccctctagtacttccactcctgtatgtccatccaaaattgtccagtacagtagctttccagaaaaagaatttttcctatacatgcctgcacatctatgattttccaatgaacagcaagtcatcaatatgtatgaagaaattacattggtggtttactgataacaaaatggctatcagccatcagggtaaaaataatgcaacttcgccaggtaaaaagttaacataatttaactgtcttcacttttcagagatgaacaagagattgagatgaatttagagtgcttacgcaggtttcttaaggttttatatgaagtctaaaacttccatctcgtcgtatgagtccctccgattcttcaaaacccttggtctgtcattgattatttctaggacctaattcaatagagttgcacatcaaactccggggaaaaaaattatgggcatcaacatattgcctgctatgctgctacttgataaatatgccaaggaggatagaatttcaaacaagagattcagcatatacccaattaatatgtctgcattaatattcctagaaaaatttcatggctttaatatgtaggttactgcaaataagttagtatacatgttgcgcagaggatcagaaaaactgaacaacacactaccaaccaaatcagtaactgtttcatgacaacacagctattaacagagatagaaaatgaactgctaaatgtctatgaagaaccaaggcataccaaatttccaggcaaaacgaaagtttacctctggccttgaatagagaacaccataagacatgcccacatcaacacaccaaaccttgccatcgcatttgctgggaaaaagaaataatcacctattacttctcttgatgttttttcagttgtaaattacccaagtgagaacaacagataccaattcactccacgagtctggggtgtgtgccctacaaccatcccttttgctcccacagatttcagtgttcgttcagcaaccacagaagatagctgaaaccaacaaaaataatttgacaagtctgtgataatcttatcaatagtgctattgatatattttccatagaccatagtgcaaaataagcatatgttttatcgata

SEQ ID NO: 82765 - DNA, 1000 bp, Oryza sativa
tttcctcccaaatagtttggaaatgaacttacaaacaattagtttctacttccttcgtttcaggttataagacattttgactttggtcaaagtcaaaatgctttaagtttgactaaatttgaagaaaaacaaataataacatttttaacccaagacaaatttattataaaaatatatttaattattgatttaatgaaactaatttgatattataaatattactatatttgtctataagcttaattaaagttgaagtagttcgacttttgacaaagtcaaaacgtcttgtaacctgaaatggagagagtattttttttctaaagatgattcccaatgcaaatagaaaaatgaactgatgtagcacgtataaacatggacaataaactagtttttatctataccggaacaagtgttcggcgagcacgtatatatagcataccggcgacgatgcggcggccgggcgcggtgacgaacgtgggcgggtcaccggcgacggtgatggccggtcggccgccgccgccatcaccagccgcaccgcgcgagaaagaagcccgcccgctcgcgctgatggccacgtgcacggcagcgcggcctctaggaccacaacgacggcaaccagctggcgtcgccgccgccggcgacgtcgagagcccgaacgtggtggcggcagccgcagccgcaaccctcaccggcggcgggagcaccgccatcgctggccgtccgtacgcccgctgttttactcgtctaatcctctacgagacgtggtggtgaaaccacgctgtaactggagtggaggcagtgaaagggtcgagcctcgagtctcgagcgcgcgggggcggcgtctcagccaaccgttttgtggatggagtttcgcggcgccgtgccgcccagccacgtacgataggagaagggccggcccagaaacgacggtgttaccggcccaaatcaggcccggaaaaagtacaccgaaagacctcgagtgaccaaaagcggggtcttg

SEQ ID NO: 82766 - DNA, 1731 bp, Oryza sativa
aaccgttttgtggatggagtttcgcggcgccgtgtgccacccagccacgtacgataggagaagggccggcctagaaaacggcggtgttaccggcccaaatcaggcccggcccggcccataatgatgtacgccacttgcgtgtcgcgtcggtcaccatgacgcaatcacccgtctcggagaagaccagaaataggggacttccatgtgactaataatatatatccatgcttagtagtagtaacatgttaggctcgtataattaaaaattgatatgtatggaatgaaaataaattaataaatattacaggcacatacgaagaagcggatgtcgacctccaatttactgtgagaaggccggcacgaaagaagaacgattgtgcttttaaaaacaaatacttctatacataccagtgaagcactgaagcatacaatccgcatccaactctgccacattcaccgacccaccgtgtttttttttttaattatgctggctcgacaaacaacagctgtgaccgtgcatacttagtcttatgcaggttgtatatttgggtcggatgcatagcaattatttcttttaaatagtagagaaagaaatgaacttctctaacaaagttgtgtaatcattggtaggtgtgcttgttcagttaggtccatgcacgcatgcgaaatgggctatccatcgatcgatcgaatcggctgtgcaaatgggatcctacgtacgctttggcttaacaggccagctagctactgtggagtggagcatcgcttcactaatcactagtgcctgcaatgcatggcgccgttgactatcacggatacgtgggtgattagcaggagcctagctgggttgcagttaggtaagatcggattaccttaattgggaatgtgagcacgtaatttttggatttttgtttctaagcaacatgcatgcttacgcggaccacgtcgatccggttgacctgatgttgctacagctaatttaaatttatatctatgctcacaaatcaaaatttagggccctttgatttaaagaaaattcgtagaaattttagaggatttcattcctatagaaattttttctatatagccctttgaatcaaatgaatgaatcctattgaatccaatgaaattcctatagaatgactcttcccatgtaagttttggagaaaatttaacatgaggtagaacctcatggaaagaatcatttgagtctttatctctctttaaattcctgtgtttttcctgtggcccaatcaaacagtcattcatatgttttttctgtttttttaatcctctattttacacttgcatttctgtcagaatcctatatttttcctattcctccgtttttttcattcctatgatttaaaggggctcttaaagggtgaatagctaatatggtccttgaagtttcgcttcaggctcagtttagtccttaagattttaaatcatccaaataagtccttcaaattaattatttgggttaatatagtccttggaccaacaaaaagtgccaggtgagcatgtcaagtcatcattgcatgcagcggtataaatgaaatgaccattctgcccttatataccatataaaaaagaaaacaaatatttcacatatgtatgatcgttttagaaattatcgcttacaattgctgcagccaagcactgatcgcataaattcctttgtcggccaccctccgcaacaatgttgggtctgggttggcctgttatttt

SEQ ID NO: 82767 - DNA, 625 bp, Oryza sativa
actatgaggtatcaaattttgtagcataaattttgatagcttcacatacctcccaaaaatttgacaaagttggccctttcatcattgataaggacgttgagaaaatcctggactaggagaacagcacatgaagcaagttgaatcggagatggatttaaatcttccgggtggatgtccacccgtttattgcatgcatgccaactaaatggttttgaaaaaaatttaaaaaatttgacaagatagattaatgcataatatataggcaataaataaaatgtaacgagtttacatatatttgcagaaaatttgtaattttgttaaaacttgtagaaaatgtttttgaacttgcatctttgtggaatgatatattccatgcttgtggatgctatagcaaactaggcagtgacccaaacaaaaataatcctctggtacttgtggaccttgttaggtcattcacagggcacatacgtaacgtgtgacaatgttggttcacatagacaaattgcttgcgtgtaggagagaggggagtggggaccgctccttcaccggcttcgcgtgaccatagttggtcactagaacctcccactcttgcagcagttctcgatcagaaaaagtggtcatctgc

SEQ ID NO: 82768 - DNA, 9014 bp, Oryza sativa
atggaaatcctacgggcaaacgtaaagggtcaggtgggtccacacctaaaagtatgcaaggccgattagacagtgattgtatcttccaccctttgggtttctcctagatggtgtgttccaaactacgatgaagacaacaaagcttccctaggaacaaaaatggaacaacaacctctgccatcactgattgttcttgctacctaagctgattgctctcaaaccaaccacaggtgttcaacaaacccagtggtttatgaaccaaagcacctcagaagtacaagaagttggcagtaaaaactttcgtagtcgtacatgggtgagcacgatcatgctgtacgccatctctgggttttccgtatttggcctggcagagttcgaggatgacaacttcacagggcacatgaagagcagagcacatggaacatgtaccttctttgagagatttacagggtaaatttgaaactaagagaatggccccctttacctgagccagttccaactcaaataaattacaggtaaaaaaacatttttataagcagaaagaaaagggtatctcttaatgcactgagcaaaaccgtttccacatgaagcaactcaaaacaatctttgcatgtgcctataatactacatgggaaagctattttcgggtagcattgctggtatctttagaacctccatggtttagcaatatatatagaattacacgacaaaaagataaaagcttgtcattttagagctcaatatactaattacaaacacgaatgccagaaaacagcgacaagacttagcactttttaagcatagcaaaattagcacttttcgacagcagatattatctgatgaaaaaaagctcctgtggctagtcaattgggagtagtagtaaacaagcaactcaacaccacaaatgcattccatggatcggaccattttggggcccaagtgatcagaaagaagtaaaaaagcatccgcctttcccacaacaaaatacactagtaccaaacaaacaattgaaagaagatcaatgctatcacaccaagagatctcgactcaccatctttatcggatccagccgtcgcaccagtgccgccgccgcgcaccgaatcggagcgatgatggtgaccaccgtggcgatggtgcgagtgggacgccgagaacgaggggcggccgcgcgggggagggggcggcggggacggcgaggcgccggggccctgctgctggtggtgcggcggcgcgcggcggcgccacccggcctgctggagcgcgtacgcgacgtcgccgacggggaagaactgctgcatgtggatcacgggcgcccagtggtggcgccgctgctgcaccgcggcggcgacgtgctcgaactccccgggctcgccgacggagcggaggtggagcagcagcaggtcgatgatggcgttggccgccgcgaactctccgcgcagccatgaaatgaagccgtcccgctcgtccaccacccacccagcgctctcaaccgcggccgcacctgcggcggcggcgccgggcgcggacgacgggatgacggcggcggaggccatcgcctttcctcactgagagtctccggtcatagaaaggcgaaccccaaccagcaatgcgagcgaaggagaacgaaactagcgagagatctagggttttgccgtgttttttcttcttcttcttcttctttttcttctttttcctttttcaaaaggcaagctgttttgtctctggtggtggggcgttggaacggaagaggagagcagcagcgcgagatgtgaagaggaggagggaagaggcggatctgggaacggaagattcccgaaactggaggcgaggaggaggaggagcgggaccggcttgtcagtggctcacgtagccaccgggttgtgagaaacctaacgatctcgcgaggtggaggcttttgcttcgagattcggaaaccggggagatggccgttgaggcgattagtgagtggttggtggccaggccccactgtcagcgccctgtccccgcgtggttaactcgttaccgcgcgtgcgtgtacgtaggagagaaaaacggggttagcagtaagactctggtgagagtcacggtgccgttagatcgctccgcgcgcatcggaacggacggccgagggatgcggggggttgcgcggaggaggcggcgggctgggtgggtgtcggttggcgagtctccacgccataatgcgggtttggtggttgcgggatcggattcatggatggatcaccacattcacacacggtcacggggcggtggcgtcgcgccgctttacgccaccacacccacgcgcgcggcgtcagcgacgacgaaccgcaccgcctgctccccacccaacccatacatgccggctcgcgtgcggcgtcgcggcggggccttcgtgtcagcctccgttggtgaaaattaatttcgtgctggcttgggtagctcgcgcacagtacgtaccaggccgtgtcgtttcctcctcggcgcgggctcggtttggaatgggcgcctgctttggtgcaccaggacggcacggacaccagcccgaaaccttagccaaccatccgatctacttcgagcctacgagtgtcactgtgtcagtgtgattagtttggtttaattttagttttgacggcaacggtggcgcgtggacgcacgagccgtctggtcttgacgagcgagtgatcactgatcaaggtggtggcaagtctggcagataggttggacgactgtcactggctcgagcacgttggtttgcagtggaaaccgcgaaggtttcttgcgaagcaatcttgctttgttgacgatgcaaggaacggtttcgggtttcgactttcgagtccccgggttcccttttatttaaaagtccaagtcaatcgagcgatcgtgagtcctaccgtgtaagagaatggcaatcggaccgtgagcgtgctgtgaacgtctcaagttgaacgagcaagtactcgttcagaaaatgtgatcgttttcagaacgattcagtaacacgtgcttgcgctggcccggtaataggaacgtttccgaaaaagacttgcaacagcgactagtctggcagcgggacgtgtcatgcacgaacagaacgaaacactgctgtcgtgatccaagtataaattcagtacacatgcctatccatcgcttgagaattccgatcggtgttcctcttttggcaggtcatttgctgcggcggtacgacaacagggtcagggaagagcacaggtccaagtccaaccgctaccacagtggagtaccactgtaggcttaacttccaagggcgatggatgacaatggttgccacacttgcgtgcaatctgctgcactgctgatgcacggcggaatgggcaaaagtcacgcgcctaactgacggagcgccaaattgctagcatatgttctgttctgtgttaaggaggtatcactaatcagttcccctttatttccattggccgaattatggaagttttgctacacaaatgtaaaaccacgtggattatcttgatatcgcggtcacaagcaattacaaggaaggtgggatttggaggctttttggttggcaccatgagacaaatatacctagccagggacaagtatgagaaaatttaatcttgtttggtttgtgtctgagccattgtaattagttttgttattagtgtccgaatattttagtgacaccccatataatatccgatgtgacacactaaaattttacacccttaaatctaaacacctcataaggtggtgttcttttttcctgaagatgaagatgaagattaagtttttttacacaaaacgatgtggtattaacgtatgattgattgagttttaattactacaaacttgaaaatatattaatatgacattttagagtaacttttattttttattacacgaaatgcatcgtttagcagtttgaaaagcatgccacgaaaatcttaatattcatccaactctttttttttaataatggaatagagcattccagtctttactcaaagagctatagccaaatcttgtttgagaaaagaacggaccgatgatcaaatttggtgggctgagttgcatgcactgccaggcctcttgataaaagtaattctctcacgctgcagctggttgcttcttttgcatgctgaactgctctccacttgattagctaaagatatgttatgagactaaaaaaattacttgttaaatctttcaagtatctatattggatttgtgattaaactccaagcttaaaagagaaagatataaaataatattagttttaagtgttctccggcataggtcaccaaccaaacaggtttgtctcaggcaggcacgaaccactcctacctcatgcaacactcaagcaaaggtcaccaatcaaataggctctcaagccagtttggttcgaggggatatcccttgtctttaaataccatctaaaaagtcatagtttcttgttaacgttttgaaacaatattgagatagatcaatattagataatgtcgttccacgatatgcttatcttgtgttcggcagcagagttttccaacccatctttctcgtttttcacgcgcacactttttaaattgttaaacgatacgtcttttataaaaaaagttcttaaaaaaccatattaatccatatttcaaaaaatagctaattatgtgctaatgagtcgcttggcgcgcgggagattagttcccaactgcaaggaaagaacgcagccttacttagtaaatactccatagaaaataaatgtacaaaatatgaatatagatattgtccgtttttttaatatatgacaacattgactttgaacacacgtttgactatttgttttatttaatttttttttgcaaatgcataaaatataaagcatgcttaaaccttaaagtacttttaaggataaaacaactcacaacaaaataaaagataatttcataatgtttttaataagataaatggttgtcatacttgtgttgaataattaacgattatctatttaaaaacgaatgtactagtatttgttatttttaggctgctaggggagggacgcgtagtacgcgtcgccggcgcgcactcttccgacaagcccacatgactacgtaaggcccatgcaactagcgggacgtgttttgattttttccgtggatttctcaatcatacgcgcataattttttttcacaaattttttctcagcgtgaatttttttaatcacgtgcacacgaacgtacagtaactaatccgtccagataatgatgataattaagataagatttttttttaatatttttttaagtaatagattgaaaagaaatttatacgtgaagtcaaattctgaaaaaattcaacctagatttgaaaattttcaactcgaaatttgaatttttgaagtcaaaatttgaaaattttcaacttattatctcggttttgaaaactctcaactcgagatttgaaaactttcaactcgattttaaaaactttcaactcgattttgaaaactttctactcaaatttgaaaaattttcaactcaaaattgaaaaatttcatctcaaattggaaattttcatttcaaaattcaaaaaattcaacttgaattttgaattggaaactttttactcaaatttcaaaatccttccactacaaatttagaactttcaactattttaaaagttgtaactaaattatgtatacatggtttttctttaaaatagtgctaatgatgacaattgacactaattacttaattagtgggtgggcctgagcgctagggagtcgacacggcaaaagtgcgcgctgcttctcctcctcgcgcatctgcgcgaagtagggtgtagtaggtacacccgggagggatcccgtctaaggatgaggaacacataatacttttagtgaaaccttgtacaaatcacaagtgcggaattgagcggcttaaaacaataaacaataagtcacgtacgaagtgagcgtaacttaattggttaggtttcttgtggtgaaactaacccaataaggttaagttataaacttgacataggtgttcataattataattaattattcttttagtgcaaggtaatataggtgtgcatgtgcgtgtgtttataaggatgagtcatgtcgagtttcgtgtctgttacgatccattttacaccgggccgggctgccaaagtgccaattgatcgagggccggatcagcttttgccgtggcccgtgaggcggaggtcgacgtacgtgacgtgttttttcaccgcctccgagcgcgcgtcgctggacagaggtggatatggtgccgtctacgaactgaccaaagaatggcacgcagaagtaggaagttgtgagaacactatgaccaatggcgagctctgcaccggtggcacacgtcagagaccaggaaactataatcacgtacgacatcacacacggcacgatagtacagtcgagcacgcgcgccaccatcgcgagcggcgctgtgcggatcacagaatcggtcagagcgcggaatccacgccgccgccggcgcgccggtggcgcttgccgtgcctgccgccgcggcggtccgtcgacctcgcctcgccggacgggaggaacgcctcggcctccgcgccgacgctgcactccggcagcggcgcgtggtaccggacgcggtcgtagcagtacccgtacgtcatgtgcctcgcccggaacctctccatcgccgaccgctgcccgggcggcatcgtcgcggaggcggcggcgccctcgcacggcggcggggagccggcggggcagccgtggagcaggaggtcggtgaactcggcgacgtagggcgcgtacttgtagttcaccttgtaccggccgcccgaggtggcccagctcgagccgtcccagatggtggcgtacagcgacatgggcttggacgggaactgcgcgcccatggacgccgtcctcaccacctccctgatcggcgtctcgtcaacgtagaatctgcataatggacaggacagtcagtacaaccgtgcaacgaacaaggaagtgaaggttactgatcctgctctacattattgcagtgtcacacatgacacagttttactccgtagttctgtaggagtagttcagtaaattttgattttatgattgacagttggttctgtaggagtagaagggtaaactagattactagaggcagatgaaccctgtatctctgaactcttgaactctgaaaccaataggttggcagtgaaaactttgagaagttcagactttggccacgtgtagtggctagtaatgaatttcggttttggcaaaataaagacgtcattgtcacccacgaatctaacagatttcatggagaaaaacacggaggaaagtgggtggcagtttttgaaacaatggatagaaagtagctcccggtgctgacatttccctcctccatcatgcgacacagatacaaagaattcagaagttcgcctatgaccgatcgcacaactacagaagttatgcaggttagcggagaaagtaggttatcaaatgcaattatatgcgagaaaaggttggcacggggatctcggtggaaggatatcagatatattgatagagagttatcatgcacatggtatgatcaatgctcaggttcagtggaaactgtaaaagcaaacgcaccacatgtgatgtcaacttttttcacacgatctcgcgtgtagcagtataggatgcatcaatgttttttagagcagttgcatcagtaatttgcagtgatttggttacagaatttcagagtccagtgattgctgtggttaactaaatcagaaaaatattgtgataatgcccatctcagttttggggcctctacttattactcctatcaaagtgtaaacagcacaaggaatctataagctgtaaaggaagagcaaactgatatctcccaatcatggcccatgataaccagaaaataaagaaaaggaaggaatgcaagcatacaaaaagtaatagtgatagtgaatatcaatttgttgaggtacacaacacaccataatagaaagaacacaatcactatgcagaattgcactattactagtttagcacaatgaagaactgcaagtatgacaatatgacatcagagggtagttaactgacattgtactcttctaatcttttatgggaaaaggctatacatactaactttttcttactaaattcttactaaaacaatgtgtcatgctaggaatgcatctagatttttcataacttccatctacctaaattaaaccgttaagatgattgttagtaaaaatttagtatggaaaaaatagtacgtataggagtgttctgcttaatataacactagcagacgctggcttcgttttcagaagaagaaaactgtcatttcaccattctgctatcagcgtatcacagaataatgttatcatatattctgatatactgatgacagatacataactctagtgagtctgcagaatatatactgagtatctctgaagttcgtgaagcgtttgtgaatctcaacgcttgtgaagcgtgatatactgatgtaggcaagctcttatggcgagccagagactgcacagtgacatctgacacgctgcattatcgaagagtaaaaccgagctaaaatggcggatcggttatcttacatgatcgtgtcatggctccagcggatggcgtagcggtggaagtcctgggtggggtcgaaccagaggccgtacctctcctcccggccggccgccgtgctgccgttgccgtacacgttggtctgcaccctccactccctccccctcacgttccccaggaactcgaagtccagctcgtcgtgcgtcctctcgtacacgtccccgttcgacatctgcggccaaaacgacaatgccgtcacaaccatgcatcgcgataaacccaagctatcgagtgctaacttcagtattaagatttcttgccgcattgcacatttgcacctattggttcgcaaggagttggtgatacttacgtagaaagcgacgacgacgccggcagtgtggtcggcggg

SEQ ID NO: 82769 - DNA, 12272 bp, Oryza sativa
ctaccaatgttgcggggcagttcagatatatctgtgtaccttagctccaagtatctcaaatgtttaaggtgacacaaggagtcctgcaatatagaaaaattggaactccttacatgtattgtccgtagagatggaagaattctcaaggaatcgccaggtttcaacttgatgtttccgaacaatatcaatgttcttagacaatgctgattctgtaaattgctccactctatttgctctgctgatatagataaccgacgaaattttgatgaagagagaattccattgttttgtgggtcccgaagcaccagtgcttcatccctggcaacatgctgagcaaaggagtgtacaacatcatgcatgatacaatgttcttcattgtagtagtcattctgaggttctaaaagattcctcttgattaactccttgtagtaatctagaccagctgactgtgcggaatatccatctttaccaatgaatccttcagctatccacatggaaacaattttgtcaataccaatgatttcatctttaggaaatagtgagtaatacacaaagcactgtttcaagttatggctcagatcttcatagctcaggtatattgccttgtttagttcttcaggaagtcccatttttgaccatatctgattgcgtaaaacctcttcccaagcattttttgttgcatttttgttgcatttttcttgcataagacaactcctattactttaattgccagtggtaaaccatcacatttttctgcaattttcatcccacattcttgtactatctcgatctctgatacactcaaggcagcctagacaaacaaaaacgtataatatgagcaaaatagaaccataacttgaaacattattgtgtaaaataattgtgcttatttccttgtctacattattgtgtaaaatttgagttacagagagccttaatgtgcttactcacttttctcatgatgagaaacagttatagaagttccttaattaatcaacaattccacattctagagtaaaataaaaggcacaatttgttaaaagaaatataagccagacttgtaacagtgccgtggtgacttttgatttttgataatttgccaaggggaaactactttatttcataggtgctgctgaaatcacatatctgagatgttcaacaagccaccaatcaaggatatatgcatcgaaggcaccattcagtcaactattttggccatccaaaagaacactatatacttatgtaccttgtgtaaccatgccaccacctatcctgccagccatgttggcgatatgcccatagaggcagtcaatctatcacgaatcatatttatgaatctcttccaattatttatactgatctgtgagtatgacttatttgtaaactatttatatatcaagatgctatttctaaatcatctctgatgatcgtgtttcatggaagatagatatggatatatcatatcaatcagacaataatataagcatgcttcgagaacataagttagatcgatccaccatgactccatgagatatttaccgagattaatttagttgtaagtgttattaatttgaatctagtttctatggttaacatttaggataaattccaaattacctccaaactattgtggtagtccgatttattcagtccagccacactacagcagctagatcacaagtaaccccttctcaggatgtgtatggttttggagacatcaggtgcaattttgggctacaacaataattgctattcattcgattctatacccttggcaaaactgactgacatatagaactcaatgttatatcagagctaaaaggtcaatagttcgaatctaacctgcaacagcattacagaaagtgttgaagtgctcataatatgttaagaatttcaatggttactctcattgagaagaggatggcactcgagatggggcaattttctggttttcttcattcacaaaacacaaagccatatcctcccaaagaggattgggtacatatttatagctgcttgtagcagccatgctagggcaatagggtgctgtcctagagcatcccaacaaactgtcctagagcatcccaacaaaatgtcctagagcatctcaacaaactgctgtcctagttgtcctagagcatccaaactgaaagtagagatgctgtcctagaaagctaaaaagcaagaaaaagcaccacaagaccaagaccaaccagccaagacttattcctacactctccccctaagtcttgtgcgtcgtcttgtgggaaagttgagccatcccgatccgggagcaaagctcaaggaacttgatccttccaaggggcttggtgagcaaatccgcaagctggtccttggtgttgatatagctcgccttgatgctcccttcctccaagtagcttcggatgaagtggtacctcacccggatgtgcttgctccgttcgtgaaaaacggggttctttgccagggccagagcggacttgccatccaccctaagctccaccgctccagtatctctgccgaggagatcactaagcagtcgagcaagccagagcgcctaggtcgaagcggcggaggccgccatgtactcggcctcgcaactagacagggccaccacctgctgcttgactgactgccagctaacaaggcactcgccaaggaagaagagaatcccgctcgtgctcttgctggtgtcgatgtcgccggcgtggtcgctgtacccgacgaagtgtgccttgccaggacaccttgggtagtagagaccgtggtcgagagtccccgcaacgtagcagatgatcctcttcacagcctgctggtgctccgttgtcggtcgctgcatgaaccgactgacgtagccgacggagaaggccaagtccggccgtgtgtgggtgaggtagcgaaggctccccacaagacgccggtactgtgtagcatccacttcctccgtcgtgctatcgcggctcagcttcagtctctccatcggagtgagagctgggttgcaatcggtgagcccagccagctcaacgacgcgcttggcgtatgcggtctgtcgaagcgtgatcccggagtcatcctggtacacctcaattcccaggtagaaagagagaggccccagatcactcatctggaaggtggccttcatctactccttgaacgccgcgacctccgcattcttggtgccggtgatcaagtcgtcgacgtagacacccaccagcaaggcatttcctccattaccccgctggtagatggccgcctcgtgcgggctttgctcgaagcccatccccttgagcgtggaatccaacttggcattccacgccctcggtgcctgccgcaagccgtagagggccttgtgcaagcgtagcacattgccctccttgccggggatcacaaatcccggtggctggtgtacgtagacctccttcaagtcgccgttcagaaacgccgatttgacgtccatgtgatggacgccccagccttcctgagcagccagcgcaaggagtcgcacggactccatccgtgcgacgggagcgaaggcatcgtcgtagtcgatcccctcctgttgcacgaaaccgcgtgccaccaagcgagccttgtgcttgacgatggctccggcttcatccctcttcagcttgaacacccatttaagggtgatcgcgcggtgaccacgagggaggttagcaagctcccaggtgcagttctcctgaaccgcgtccatctccgactgcatcacggcaagccacgcggcgtgtttctcggcctctgcaaaagaccgaggctcaccgtcgtcgcacgcaaggtgcaactgcgcctccaggtcgcggggcaccagtctcggcaccggctggtcgccgagaaggtcctccatcgtacggtaccggagctgctcgccgtcgtggtacgcgtcgatgcgctccccgtcgtggagagcggagtagctaactccaccgggctgcgctcaacacgagctggcgtcggagtagacatgcccaggggagtggctgttggtgctggagtgcgtggggtcgccggctgtggtggtgctggcgaagaagtcgtcgcagccgaagtcgaagctcgagaatgtgtcgctgccggagttggtggaggctcggggactggggtaggcacgctcggtgaggaagagctgcctactcccccagctccctcgaagtggacgtactcgacagtgaagtcgtacgtcagagtcgaaccatcgtccaccgccttgtcccatacccaccctcgcccttcgtcgaacactacgtcgcgcgccgtgcgcacacgctgtgtctccgggtcgagaatgcggtaggtcttcgagccctccgcgtagccgatgaacacccctggggtgctcctatcgtcgagcttgccgatgtggccaagctccttggcgaacgcgaggcagccgaagacccgcaggtgggagaccgccggcttgcgcccatgccaggcctcatacggtgtcctgccgtctagggccttcgtgggcgagcggttgaggatgtagacggccgttaccaccgcctctccccagaagatggccggcatccccctctacttgaggagagcccgagccatccccacaaccgtctggttgcgccgctcgacgacgccgttctgctgcgagctgtacggcgcggtgtagtggcgctgaatgccctcatcagcgcagtacgacacgaattcagccgccatgaattcgccgccgttgtcggtgcgcagcacgcacagcttgcggccgcactccacctctgcagcagcctacgcgcgcctgatggcgtccgcagcttctcccttgctgccgaggaccatcacccacatgtagcgggagaggtcgtcgacgagcagtaggaagtaacgtcgtcctcctggtgtggccggtgtcactaggccacacaagtccccgtgcacgagctcgagccgctccttggctcggaagctcgtctgctggggcaaggggagccgcctctgcttcgtcaccacgcaaacgtcgcagagctgctccacgtggtcaaggcatggcaggcctcgcaccatctccttggcgctgagctgcttcagggcctcaaagtggaggtgcccgaaacgctcgtgccactgccacgcctcgtcgtcccgacgagcggcgagcaaactggttgtgcgacctgcgcgctgaggatgtagagtcgattagtgcttctggttaccttggcaagaaggcgacggcggcgatcccaaatcctcatgactccgtgcttgaccaacacgtgtgagccgttctcatccagctgccccacgctgatgatagagttccttaacgcggggatgtagtagactccggtgagcagcctgtgcttaccggacttggcgatgaaggtgacggagccaacgcccttgatctccacgccggaggcgtccccaaacttgatggagcctcggacgctggggtcaagctcggtgaagaactcccgtcggccggtcatgtgatgggtggcaccggtgtcgaggtaccacccatcagccttgtcattgctggagctgttgcagagggagacgagcaccttcggctcatcaaggtggaggaaagccgctgtggccggtgtcgctgggggtagctcgatgcttgcgtatgccaggagcagagccggctcttcctcctctacctgtgcgacgtgggcctggccatgtcgtggctgtcgacagtctttggcccaatggccaagcttgccacagttgcggcaggtgtcgtctcgtgccggcttgtggttgccggcggcgccgccctgggcgcctctgcgagcgccaccctcggcgcgtcttcgcgcccaccgcagctggacacctccacacgccttgcgcggcttgcggccgcctgtcgagggagaagactcccccttcatcccgtcaccttgagaggcctcccactgctcccgagtgaaatggagcttcccgccaatggtgataggccccgagaggggctgtggctcatcaccgtcgacgaccttgaggcgacctaacgcctcctcgatcgacatcgtggagaggtccagcagagactcgatcgagcgagcgatctgcctgtacttctctgggacgcagcggaagagcatctcgacagctctctcctcgtcgtaggtgtcgtcaccgtactgcaccatcttctgcaaaagagtgttgagacggagggcaaagtcatcaacatcctcacctggcttgaaggccaggttctcccactccttgcggagtgcctgcagtgtggacttgcgggcgcggtcgctgccgatgcgtgccgcaacgatggcgtcccaggcctccttggcagtccgcttctgggaaagcgagaactgcatctcgggcaagactgcagcgatgagggcatccagtgcccgccgatcctcgtcgtagtcgacgtcgccgtaccggactgcctcccacatgtgctgcacctggagcctcaccctcatcatcgcggcccactcaatgtagttggttttggtgagggtaggccacccacagccgggaccaaagtccctgaccaccgtctggacgccgtggtggccatggcgtcggtcaggggagggagagccgcgctgcctgcgaagccgcgcgtgggctccgggctgctgccggcacgcccgcgcccgtctgggttcccatcggcgggcgcgcggtcccttgggccgccgccgtggaggtgggctgctgcccaccgctctgcccgctcccgtacccttcctcttgccagctcctcaagctccctgtcggcggtgctgtcgccggtgatggaaccgttgatgctactgcgcaaggtttcaacctctacctccgccacacgtgccgcatcttccgccgcctctgcttccgcctccgccctggctgctgccaactccattgccgccagtctggccgccctcgctgctgctgcagcggtctaagccgttgctcgcctgcgctcttctactgcggcgagctcggcgtcctgctgacgccgagtgctcgaggcgaccgaacgccgagaccgaacgtcggacatggcgcaccttcggggggctgctgcctggagagggggaagggaacggggaaggaggagcagccagtgctgctgctgctgctggctgagagctcaaccgagcttgggaaggggtggaacaagagatgtttagcctacaggaaagtgtggctctgataccagatgttagaatttcaatggttactctcattgagaagaggatggcactcgagatggggcaattttctggttttcttcattcacaaaacacaaagccatatcctcccaaagaggattgggtacatatttatagctgcttgtagcagccatgctagggcaatagggtgctgtcctagagcatcccaacaaactgtcctagagcatctcaacaaactgctgtcctagctgtcctagagcatccaaactgaaagtagagatgctgtcctagaaagctaaaaagcaagaaaaagcaccacaagaccaagaccaaccagccaagacttattcctacataattggaaagcattcaagtgtgagtttttttcctcgaaaacagcattgaaatatgaggaaaattgagtttttggtgaactggcttgtgtatataattcaataaattttttcctcatggaaattgaatcccaaattaagagaaacctaaagagtgaaacctgtgcagtactattaatctgccccgtggtagtaaatatagtgtaagtattatctatatattaatatagcacagtaagaggctctcctgctgttttaagtaaaaaaatggattacacgattctttctgtgcgttgaagacaaaaattgggacgaatttttcagaagttctcatggaaccacctttaccacctatgtccggtaatatctgtaaaacgtgcagaggtaatcttactagttttattgattacgtacactgcttgactttgatgaagccggattgactacaaaaggaatgtgacacagaaacatttataaaacaggagtcatactgaccaagcttgattagaaaagaagtacctagctaaccatgatattcttttcttgtgtgtgcagagctaaccatgatattgaatgagctagctatcaagcagagtcatataattaatagatctgctgccctaacctgtttctggagcaatgtccaggaatcatcgagtcttagtttggtgacttggtgcgtgtgagcagctttcatcactttagcaacatcttcatttcttgtggttacaaggacacaagtccctggagcacaggctttggtgattgggactctgagcccattgtcccatgccttctcagtccacatgtcgtccattaccagcaacagcatcttacctctcagggcttccaccagggcatcctcaagcagggccatgtcttcaacggcagggatttgttgcttatctgactttgccatggcaatggcggttttgagaagatgagcctcattgaagtcctgagtgacactcaaccatatctttacatcaaaggtgtcttgaatcgcctgatcatggaagatcttcttggcaagggtggtcttgccgatcccaccgacgccttggatggcaaccaccagatacttcttgtcatggttgatgagccagtccaccagcatcctcttatcttcttcaatcttgtcaccgacgatgtcttcgtggatgatcccgggggctgtcctcctagggttgccactatgagggttgccaggggttgagctggatttgagtcggtcagtgtcagcctgctggtcagcttcagcctgcttgaagaggccatccatcctctcattgagctccttcactcggcttccgatcctgtgggcgaagaggggatcctgcaagcaccagagcaaggaggagttggagcagctgcctggatacggagacgcataccgctcgcgccgctgctccgacttgagatgaacgtcatcgacgatgtcggtggcgtcgtacatggcatccttgagcttcctcacccactcatgcacatattctccttccttggcatcggtgatgtgccgcctctccgcgttggccaggaacttcttgagcctgctcagcatgcctgtcagcttctcgacctcgccagaagcgccaagcagcatccctgcctcgtctttcaccatcttggcgaactgctcgccgaggtaggatgcaagggcatccaggatcatctccatgatgtatgtcagcttgctcttctctcagatttttcttgctttcagcttttcagggtggctctgctggtaactagcagtgtttaatgttggcttcttacatcggtcagctccgttgatgtatgttatgggattatcgcagcaaaagcagccaccgtgcacttggagcgatgtcttccttgaaactagagcatggaaccgatgcctgtcctgcccagctaccttgccacaacatcaatcctcaggaatataggcacacactctctccgacatgcactcaaccactcttcttttgctttggttattctgtacaaaaagaaaaggttatcttcgtgtgaaaagcatcaaaaacaagaataacataaagattcactaatcaaagggaaaaggtggaaaagggttattgtgcttatcttcgtgcgatcacacatcggtttctcgtctgtaaacgggttataccatagtagaaagttgtatctgtagtattattttcctttagtacactgatactagattatggggatttcatttagaaaaggaaagcatccggcttctacaccaaagcacacacgaccaaaaaaacaatcacacagtggaagaaggaaaatgtagtagtagggtaacttcttttaattgcactggattaaaactactaaataactggcctgcttgggataaactggaaaattttaacccttaataaacttaccactgcaattgttggttaccaaaggtaacagtgaaatgaaaatcaaacccccttgtatacatgctgtttgggagaagaacatcaacaaaggtcttaataactctgtggttgcatcaagccatgaacattgcattatccatcataaatatgcagtgcacattaagttgaaactatacagctataaataaatatactagcatcaagaatcagaggaacaatctaatagttcaagaccgaaaaaacaaatggaacaggactattgatttgggggaaggggatcatcagaaggtggatcgaatctgagcgacgccagcgacgagggcgaggtgaggtgatgcgagcgaagccaagccaccacaccgacggtgaatggaggctgagaagacgcggatcgggggcgggcaacccgggaggatcagttcgccggagttgcgcatcgcggccggcgatggcgagggggggagaaggccggagagcgaggtcgccgccgactcgccggtggctgcgcacgtggcagggctggtcttgggcaatgcggcgagacgaggaggcgaaaaggcttttacggcccatccaagcgcagatcttttttaccgaataaagtttattttacctccctcaactataactggagtttgattttgctctccctgaccatagacctgtttagggagctttaaattctaagaagcagttgtttgataaccagcttctgagaaactggaaaagctctaaaacccagcttctccagcttctagtttcttggtttatttttcagaatctgtaactacagattctcagaagctgtggactgtttggggcaacttctagcagaaacagcttttgggaaaagctgcagctgggaaaagctccccaaacagggcccatatatgcctcagctattaaaatcagcgtaaatcaacttctcaaatattttcagaatggtttttggctgaagtgatgcgttgaccaggtccacagtgttggcttatcgatctacgtggcatttagctagcaaaagaaaaaaaaacttgtggggctcacgtgtcatgcaccaccactttctcccccaactgcttgactgcttgcgcacggtgctaaatctagagtgaagtttgaggaattggtgtgctcaatcagagttagggcatcgccagcgccatagaaaaggagtagcctcactagaattggaggagaaggcctagaaaccatattagttctgacgatcaaaacctatcaagatacaaaagtaaaacccgttaggaaaattgttccttatatgtcaatgtcatggaaattccatcaggactatctgcaaggatgggctgcagctcaagatctggacatagatcatgtccataggggctgcagctacagatcgatgcatggacgacctctaatccaccattaagagtaatccctacttagtggagggctacagaatataggagattcgagggaaaagacgattcgaaggaattgtaatatgggaaaggggaagaggaagaagctaaaggggatgagaagagaagctagcttggtgacaggttttgtgtccatccattttctcatgatgttataagctcgtcatggaaaattgaattttgctgataggaaactgtgtacatgtaaaattaatggttgttggggttagtccctttttttttgttaattttgttgtttgcaacgttatcattgctaaatttcaagaaaataattttccttgaaatccatctgattgacagaattaattaggagatgtggcttcttctcagccgtagaaaaaaatatatagtagagatttagctaaatctaccgcttcaactccactggatccaaacccattacggtcttacggagctcttctctctctactttcccccatactaaaaactaacttttgacaaacttgaaacaatttcttctgctaaattacttatccaatccaccaaccaattataccattatattctttgcattaaatatctataacaagatcttactcgaatatattttgctgaaaaaatatgtccgttgtttcatcagttgaaaaaaaattatttcagatcactacataattaagagagaagtaacatataaagtatacttactgtaacatcagcaccattgtttctaacattgaatctcaattggtgaaacatatgaaaaaataatacaaataatacaatatatttgcaaaaatgtaatattgttgaaacattttttatcacataaaaactttaaattgtaactgttgaaacattatattcaacattataaaatacctgatgaaacattcaaaagaacaccacgtgaaatatttgcgaattaagtagtgaaacatcatatgaatacttgttgaaacattaaataactcctct

SEQ ID NO: 82770 - DNA, 16572 bp, Oryza sativa
  unsure (1)..(16572): unsure at all n locations
catcacatgttaatatattttcataatttttttataactatttgagtgacatgcaaataatgaggggcccctcgagggattaaaatccactcccgataaacaactgtacacacattgtagttctcccaaaaaaaaaaagaaaaactgtacacacattgtctaccttcgaatgtggatgtacatcagatactcctatagtcctatatgaccttatttctgaagaaaacttcaggtgttttcatatttggaggtacagtcttgatgaagtaacctaatcattcatgttctaatacagctacaaatatgtttatcacaagatgcaggtgaaaaatggatttttcttaaaaaataaatgggataataaaatagatttacaagatcaatggatgtctctcactctgcaagaatcaagatagcaacctatagtcagcagccttgtcttggatcacttcatttgttctgcagaatactgacaaatagaaggaacaagcagcagaaaacaagaagaggggacagtcttagcagaacccttgaatttagggtggtggattgagactgaccaccactagtaagtgtgtgtagtgagcaatttgggatggtccatgaggccatgacaatgccacaatagctcttttggaaggtattactgtgtacacatgtacagctaaatccaatgccggatatatagaataagaagattattagaggttcagaatacccaaggtctgacggaattatggcgctgaatttgtctcacctcataaattgtatcccacttgttttgcgatttgaagcacacttgctttagctgttcttcattccattaagatactcgccacttgcattgttcttccattcatttgttaagcttacaagccctgaagcagccaaaaacaacgcccaatgaaacgtaacgttgacgccagcctctatttacacttgcttcatggccacgtatgcacaaatctaatcctccctaaggtggtttcacagtgaatttgtgtttagctgttcatccaagcaaattctagacaaattgatctggtattgtgaatttctgatcatgaagagtacatatgtatagttacaggaagtcaggaacagtctgtatcctagctatactgcagattatatacgaacatttactcaggacagaataatcaatttacattacaccctctctgtctctctgattctctttctctagatctctcatcctcttcttccactgatcctctctctgtttatctgcaagaaagcatcaaatggtgtcgccgaatctcgcgctgctggcggtgccatcctcccggagcaggtcggcggcggcgctcctcccgccgtcgaacctctccgacaggaagaagctccgcagcgagttgaggttcctcctcggcgcccccacctccacctcgaacagcgccctcaccggccggtggtccgacagccgcgactcgcaccggtcgtaccgcttctgcttcagcccggcgccgcgccatagtatccggtcacacctgaaaagaaaaaaaaaaagaacggcggcggccgccggttagccgcggatctcgccggaatctcacgctatttcagccgtttttctttttctttctttctctggcttaccacgccggcgcgcgccgcttctcgcctttcctgccatgggaggcgcagccgtagtaggggtcggagttggggtagtacttgtacgtcggcgagaaggcgatggcaccctcgttccagccatggaatgcgcctccttccgattccacctcgcttcgcagctgcaaattattcagaatcaacaacacgttcagtatgattggtactaatttaatttggagattgattgattgattgatttggattcatgcgtgttgcatgcctggtcattttcgagcagcgtcttccagtcctgcctctccaccagcaacctcgtcttcgcctccggcagggagatcctgtagttgaggtccccaagcaggatcactcggctgcatccacaggagtaaacgaagaatcaatcattaatcatccgtcagatattcagattagtcaaagcccgcctgaatgcctgatgattgctttgatttgaaatgtcgtcgtcatgaaggccggtgaaagaaactaaacgaacgatcaaaagcatgttaattgccactagttaattaccgtctaaaatcgatgcgattttatactacgttgttgactaccggtgtcggtatataaaacagtcgacgatacggcagatatttgtagtgcttggaagaagttaattaatttactgtgcctaattgtctactgtatgctacgtatgcaactattaccgctaatgactagtatcttatgctacgcaaatcctagatacagcaatacctaatcctcgatttttaccggtaccgtggacggttcaaccaccggattaaattagtacggttgccgtcgtgtgcacaggccgtaacaacggtcgctgtatggtaatttagctgacggatatacatgcatgcttgggtgtctgtcagtcagctcaatgcttcttatttccagctctttaattagtcagcgacagcgatgtgtttcttccctgcaattctagtatgcttcgattttcagcgtgcacaaaaaaatgtgttttaatttgggtcaaaaatgaaaggaaaaataggattttgaagaggtcgatgaatgatcaagtgggaggggtgtgtgcgtttgcttactcgtggtctagaatcttctgggggaggttgagcgagtgcccccgggggaaggtcgtccgggagaggatctccgtggcgtcggcgttgcggtgcgcctcgtcgccgtcgcggccgccggacgcgaggtggcagcacgccacgcagaagctcgtgtcgtggagccagaacctgacggacacggcgccctgcacgtccaggcacagccatgcacccgtggcgatccatcgatgccgtgcgtgttaggtacaattcattcccctcgcggcgcggctcgccgcgcgcgcgcgcgcgcgtggcgtgtggtgagcaatggcggaatgataggtcaggggtagggtaccttgttgccgaggcagcccatgacgccgcagccgacgcaggagacgctggcgcggcggacgaagcgggcgaggtcggcgcggacccagacggtgaggaggatgccgaccatctgcttgctcaccacgcaccggtagtccctgcaggcgagctcgccgccaccgccgccgatgccgccccgcaccgggtgaaccttctgctgcgccgcctgctgctttatctcccctcctccggctgcggctgcggctgcgccgccgccggtgcccttggcctctctctggtcacgggaggagttcggcgccgacggcgacgaccggttcagcgccgcgcgcacgagctcgttccagcgcatcccgacgcgcttcttgtccgcgcccagcacgttccgcgcgctcaacggcaccacctcctggaatctgcatgcgccatttgcgaccatgaatccatgatcagctattgatggccgccaccggcatgatcgagctccactactgcacttatggttgcttacccgaggacgtagatgtcgtaggcggcgttcctcgtgtcgagccagtccgacaggtcgaggtcgtccggtggcgcgacgccgccgacgttccacgtgctcgcgaacagcctgcagacgagacgacgacgtcgcgagtgagatcgactaattaatcaagacgccatgagtagtccaagccaactaatggctggcgcggcgcgctgctacatcgtaatgaaagcttgaccgatcgagcgccatatgtacctgtacttgagcgtcttgttgctcgctcgctgctgcggccgcggccgcggccgcttcacgctgcggcaggcgtcggcgtcggggctgcaaccatcgtcgtcgaacgactccaccgccgccggcaccgcctcgccatcgaagtcgtcatcaacggccatcgggaagtcggcgacgaaggcatggctgccggatggcttcctgaagagcttgttcgccaccagcctcggccaaagaacctagccacacacaaacacacgaatcagctatcaaacgtgagctaccaaatctcacaccgacctcgtcaagctagctaagctagctaggtacatacctccgcttgcctctggttctctagcatggcgaccaatccgtagggaggtaggtagggatggacgggtggtgaggtcgaggagacgaggacgaagggaagaaacttcaggcggggaagagggagacggcttaaataggcgaggagggcggaaagtgacaaacaaaaggagtctcccgtcccgcgcatgttcatgcgcactgttaaccagcggtggatggattgacggatcgacgctgatcgatgcatgcattcgcatggcgcgtgcggtgagcggaaaaagggggagagggtggtcgactctcgactggcggactggcggtgacacggtgacagcggaggataaaagcacttttgactgtagagggattcttatggtggggtacgatctgtttggtaattagttaaggtcgaacttctaaatttaggtttagtagttggatctgtagtgaagttttcacaacctaaacccagttacacatttctagtttattttatgatagtgctttaggtgagtggactaaaaattatttggctggacttcagctccagaagagatagagttagagctagagctatgcaaaatagaactacatgctttcacttctcaaattattactccctccgttcatagaaataagcatttttaggttgtttaagtaaaaaataaatctcgagtacaaagagagtaaaaggcattttttttcagttatcttattggtcaaatttgaaaatttggcttgcttagattcatgtacattgaagtgtcctataaatgcttatattgtctacaaaatttaaatcttagaaatactacctccatcccccaaaaaaagttactctctctggtttcatttcataatttttgacgttctggataagtttgaggtcaatttttttgtaactttgaatatcaatatctttaaaattatttaaatgtctaaagaactagaatgacatatatagatttatcttttaaaatactatagtaaaagtaaacatgtatttattgattgtatatattataatagaaaaacaggatcaaagatatattttggagattgagtcattatctaaaatatcaagaattatggaaccggggggagtaatatattttggtacatacgtagtacttatattcggaaatagagggattagaagtaaatatatgtataagattttcaatatatctactagcatatttcttctgtttttagtagatgatgttgttgactttttttttacataatgtttgatctttcaaacattcagtgtaaaatatacaaagatataagtaatgtttaaagtataataataaaataagtcataacaaaataaacgaaactagtatgatgaatagtcaaatattatgtatcaaaatcatcagcattatctatttattatttgtagtcagattttattctgtacgtatatatcaaatctaatatagacccattttcgctgaatggtgtattacccttcttttagagaatggtctttgcatattctattaatgatgttaaaaggtttcacaatttttatagctttttgcatgatatttgtgagaaatgggtgggcatcgctataagagagtagagctnttgttttgaatgttgtctagcggtcaaaaagcggaatcacataagagataagcacgattatttggatagggagggatatgttgggaatctttgtatctgccaagtctgttcaactacagttacaatgagatagatgtactggctcatgctattgtgcagggttaccaaatccttttcaagttttctaaataataataatcagaacatccgatttctttagcagcgataaggacataagattaactttttgagatattttagtccggagtaccataatttattactatctacgtcattgactttttaaatacatatttaatcattcgtcgtatttaaaaagttacagaattattatttattttcccatgacttgatttcttggtaaagatattctaagtatgacttacattttcgcataattgcgtaaaatttctaaataaaatgatcaataaacgcatgttaaaaagtcaacgatgttatctattcaaaactggaggggatttatcattaaaaaaatatgatgcacgcctctcaatttctacttaaggatctctatcttattttgttgttaaattatattcatcgtgatggatgaaaagacttattatatatccaatagaagtatttctcagttagggcatttaaagatttacacctgaaaattattgcgccttttagcaaaaaaaaaaaagccttcgaccttcataaagcatagtttatagaatcgttgcaccacccattggaaaaatctaatcttatacatttggccaatgattaatcaaattactaatttaatgtaaaaatatatcaacagatttatatttctattaattaagtgttttccatatattagttttgtaggtaatggagaaccaacaattaaagtttagtcttaaagactttttataatgaaaagatgtcctatagaaacaaactgagaatggagcgtggagaccaatttaattagctgtacatgtttatccatctggccatctcgtattctcgtatctacaactaactattatttttctactaagcacatacatataactatttttctaacacgtgttttaagtattgtgcctagtatatagactcaggatagggaggttgagacctatagagtttttggtctcaacttgagcaacttgtgttcggtatcacacctcttataactggttaaaaaatcacaacatatgttgtctgtttatctcacatacgtttgtcaatattcagtttgaccttttaaatatctaatgctttatcttgcttgtgttattaattccatatcacatttgattatacatatagatcacagtgttctttatgattttacgcgaacatgtaacactaaatcccattcatttttcatagggtatgattgccttccctctcagacttgaagctgcaacacatctaaaacactatactctatactctgttttaatttactcgttgttttttaacattattttttattaaaataattatcgttctcatattccaaaacatttttagagatgcttttctttcttaccttaatttcatcaatgtagcatgctagtactagcactcttccaataaaatttagtgtttgctgcgaaaaagatgattgtgtagagtattaatgtaatttgccatacttcctaatttaatgtaatatttgttagaacgataagtaaatttttttaaaaaggggtacatatggttgatattcttccatgaatttgttttagtagcaccttaattttacaacatcatagctagggttggttaagctcgcacctcacgcggcttaaaatgatattcatcccacaacttattcatgactttgcttcattttttttgtttgcttcagaaaataacttattcatgactaatacctcagtagtctaatctgaactggaatatgctttcttcccttccttatcttttcagagctttcaaaatacatacttgcttggcttatgttgtacacgttacgttctgaattttaaatttgacattagtactatattgtatatacattgcatgcatatacaagagcaagtgacctatcgatcatgggcatcatgcaaaaacaaaactaggagagagtaaaaaaaagttcagacaatgatgatctgatacacatcgcccacgcatagaaatcgaatgatatatggtggtggatgagtttctgtcacacaatgttacaaatttaagagactactcacccatatgatctcgcatttagctcttctttttcatcacattttgttgtccttgttctttgtcgatcagccggccaatcattgtttggaacaggaaaatggcaaaacgcaggtggggaaagggagctgctcttgacgtttagcctgaggctatacaataatcatgcagaattatctaacgaaccatgttgattaatccacaacaagctgagtcattagtgactataatgatccccatgggtacggcgattcctcgttaattccattttttatatatttcggcgaaagctctatcattttttttaaagcaaagcgactccctactcattccttcctgctactcttttgtgtttgtatcagtttctgaattatcattgcgctgcaacctgcaagatacttcctcatgtctttttttttttgaacgactcgcacgagacggtgcgaagttctattgatagagcaggaaaaaattacaagattacaaccctggagggtcgtaacgaggaaaaaggaaaaaatataccaccacccacacatcgacagcgccaacacacaagcccaggagaaggcaagcaccggaccggccgccgctaagcgtgaccgaccgccgctagaccaacaaaagaacccagacgagatcgccccctaggggatgctaaaacgacgtcttcaagaagagaagcgacggaaagaccgccgccgccgtccgtcggggctcaaaggagccaagactggactttcgcccggtaaccaccctcttgcgaatccacggctggtgcctcgatgctccaccaccattcaagctctgccgacatgtgggaccccagcaccggtgccccccgccggccagccttcgtgcgccaaagaccgcgccacacccaccggcagctctccctcacaccgaggtcgcctccttcaccgccggccgcacctctcgcgccaagccggcctcctccaccggacgcgcctctcgcaccagtccgacctccctccatcggccgcgcctcttgcgccacgccggcctccctctccgctgcccgcgcctctcgtgccaagccggcctccgctgccatcggccgcgcctctctgcgccaagccggtctttgacccctcctccaaacaatgccgcgccagccagaagtagccgtctgccacgccctcggctagccaaccgaagccgtcatgcctccggtgaccacagacacggtcaccaccaccgcagccgctgctgccgaacgcccgtcaccatccacacctcgcacccgactccttccccgcctccactagctatcgccggcgatcgtctgcatgacgtcgccagccgctgccgcatccggcgaccagcgggggagcacatcggcgacggcagcggggagggcgtcggcgtccggtgagaggcggtctcctcatgtcttttgtgatagccttctgcaaccttcggcttataattcagaaagaagtttctgccaagtattagatagcatacataataaagttcacacaaacacccaaattctgtatacaaaaaggagaatatattttgcatgtatgtgaaaaagtcttgttggactatgatatcttattaggttgtacgtaaacaaacctgcaaggctgcaacccaatataccaacccagtgttgaaatctatgtcaaaggtaaggtcttgaagtgttagtcatatagtactacttcccacgtcaagtagctttgatttgcattatccttaggacacccttatatgtatcaaaatcaccatgcgtgaaaatcaaaacatgtactgtactatctaatttatcaatttaatataatttttcaaagatagaatgatgaggatgtccaatccacatagtacttatctttatctagaaagatacgtacttatagaagaatatttaatctaagcaaagagattccatagtggcatagccgaaggaagggtgaaatatatttcaaagtcgataatatattagtggtgtttttttaaaaaaaaaactttcatatttgcataagtgaactttccacatttatctaaaagcttagcattttaggaacaagttgctaatacatgcaactcaatacgatcaggctcaagagtcttgagttctagttatggatatatagcatgattaaaaattgcactccacctctaacgtttgagaattgaggagcacatacatgacatgaggctgggcgtgtttaattataagtgaattgccacatatataagataaaacctcacagggaaagactacccgcatagcttctcaaactaagaagaaaccttagccaaagacgtccgagaaaaaccacgaaccctaacccctttgacacgcatatttgcttcccatgttttaaacaagggggaaatgagtggtcttttctaaaccaactctaaaaattcgctttcgagagaagtcgaactaagaaactggtatgtgctactaaagtattgtaaccactaggctacaaatcccttcaccggtaaactggattctagattacgcattaataacctaccatttacttaaattgtcataaatttgatcaacaaaggtgttcatgctggcgaaatgccatctgtagtttccttcaacaacaacccaaaaaaaaaaaagaccctatcatttactttatttctatcgcttcatgaagaaatctctttattaaaaatatttgaaaaaccttactttatactctttcagattcatattataacttgttttgacatttttttagttaatttttttaagtttgaccaaaattatagaaaaaaattaacatttacaacacgaaattagtttcattacaactaacatttaatatattttaataatatgttcattttgtgtcgaaaatactgctaaattgttttataaacttggtcaaacttaaaaagtctgactatgaaaagaatcaatatgtaatatgaaacggacagagtatacgattagtgtgtaagatatcaactaggctcttgatattgttctaggcgccacatcatcagaagttatagaaacattacaagagacggtcatctgagacttcaatcaagatgccctgccttgtcttccttaaactttctgtagattattcagaaaatggattcacctgcattcaatgaacagagcataaaggtcaagccagggagcgatggtgtttgtataaaagattggtcatagaaaacctaacaacaaaagattctgcaaacaaattgcttccgtcacaaatagcaatttaactcatagaccaaggtccaaggaacactctgtgtctgttcagattgatgccaaaataaaccttaccaaaatttggtaataacaaaactttggcgaattggtaacattgccaatttttagtaggatgtactcaatataatgttgtcaaaattctatagacattaccaaaatttggtaacaaactaaatatagccgcataattatcaatttaatcaaataataacatggtttgaaatgacatcaatctgaacaaaccctctttttaaatgtggcctgaaatgctgtgaaaattttatcctaaagtactgctgctacatctatttctttctgtataaggattaactcataaaaaaattactccatccacaaagttttaatattcctcaaccaatcaaatcaaataaaaatgacctaaaaaatttctctcgttttttctcatccatttcaattggatcagagattggctagtatccagatgcccttgccttgtatttccttaaacttcctgtaaattattcagaaaatggatacacctgcatccaatgaacagagcatacaggtcaagccaaggatcaatggcgtttgcataaaagattgagcagataaaacctaacgacaaaagattcttgaaacaaattgcttccatcagacgtagcaactgaactcatggaccaaggaattaattgtggcctgaaatgctgtaacatttctcttaaagtactgctgctatatctgtttgtttggaaaacaactagctcagaataaaaattaccccgtcttcaatgtattattttttagataataatgtattaatattcttgatccaatcaaatcaataaaaatgatctcagaaactgctctctcttttttttttttttttttttgctcatccatttcgattggatcagagattggccagtatccacgtaagaatagttttgaggagatatttacgaaagggactactggagctatgcaagccagacatctacttgattaacaaatgttctccctgcaagttgcaaataaagttgtcgtgtgtgatatcaagagacaactaaaactatggcactgcgtgcttcagcagtcaataaacccagcccactgcttgttattctaaccaaactgattggattatgtatttagtcagaagagagagtaagccacagaaatttttagtaacccagcaagttgccggtgatgatgcctgcccatatctgtttggatcttcgtcgacagcaaatcatcacaggttaagtaacaacaacttctacttgtaacatatatatactaatgaccaagaaataccagggattattaactagtaaaaatgcctcctaattatcctacttatgggtttagctggcatggcatctcttctctcaattcatatgaaagttgctattgtgttaggtttcacattgacctggaaaatcgtttttcttggcgcatcaacttgccaccaggtcaaactatacttccaatcatgctacaacaaaacggccgtcggctagtacaagaaaacgcattcgatcgccatcactgggagcaacttgttttgctgctactaccacaacagaatttaggcacaggtcggcattgtaatctgtgaaaattggtcacagtctagcatgcagggagtatgacataattgttcaggcatgttgcctgatcagccgattttcttggctgggtcgcaatatatctctgaacttggacgacttaaagatatataactatttctagttcttgagaccgtatttgcttgattgcaacacaagcataaactgcacttgtcatgggcgccacacgaagtaagttctagaggtaatactgttatcatggccattgccttttttcctgaaccttcgagtcttcaacttgctaacctccccactgcatgattctgtcacaaatccatctcaatcttttacaacagtattgctgttcggacaatctgaattctgaagtttcttatgctcactgtgatatacggagtagctagcaaatgtcaattgtcaagtagcataacaagcttaaatcttcttttttttttcagcaacagttttggcaggagctagatagttgctctgtgtttgtcaggtgtgtctgtcggatacaatcacagcagtgacagcacgaacactaagcttatttactcctgttaattatccctcctcatgatgtaacactgcacaggtgatcacacccagctggccccatttcgtcagtggacgccgccggtgatcgctcgtaggtcggagcaaaggtaaagacaagcagaattagttagttgataaccgaaattattgccgactaaggaagcatcaaactgcaattttgtgggtgtcttgttgcgccaaggcttgctaattacggacttgggccatgtgattttgtgctgcgcctcgtgattgagacagcaatgtcgtggtgcagttaagaggattatatcatcataaagtaggcgtgttaagctaactaaaatgtgagcctagcagctacttagctagctaggtttgctatacttttacaaaggatcattagctggtggtgacaggaaggaggaacagagctaatcatgcaagtaaactaaagcatacgccttgtcgtttttatggacatgctaagggccatatctttaaaaatttatcggtgtgttttgtccggttgatgctagtttcaaatttgttattgttgattgtgatgcacacgaagcaccaaaattgtcgctggaataacccgcgggtgcagccgcgctcgaccgccgcctcgccggtgagctgtgcgcctccgtcgccggccgccggcgcgccacctgacggcattctctgtccggcacaatgaaaccttattagttactccctccatccctatgatataagagatttttgagtttttgcttgcactgtttaaccactcgttttattaaaaaaaattagaattattttttttttacttactttattatccaaagtactttaaacacaaattttcgtttttttatatttgcataaattttttgaataagacgagtggtcaaacaatgcaaacaaaaacttaaaatcccttctattatgggacggagggagtagtaatgtaagctgcagttgataataagtagtgaagggtgtggatgcaaaaagcgtgttccctcctcgtaatgatattcgatctgtgccgtacaaactgatgggccgatcagattaacgcccgggattggatcgcaagcacatgttgtactaattaagccatagtacacgggcttatccgtaaatctgccgctccttcctgtttctatactacagccgggccgcacaagctagtgggtcggtgggaggaggccccatggcaacgtggcagcgatcaaatttgcggcccaccttcattgacaggccgactccgccgtgaaaaaatggcccaaataatcttcggggcctagtacgttggcccaacaggatttcagttggctttcgtgggctcgcgttgaaactatggcccaaataatcttccgggatctcgaaagcctcgcgcctctacattatgggcttaattgccgggtgataaacgggccacgtaaacttccatttgttttcgtgggcccagcttgcggtagcaggccaatcggcgcttctgcgatctcacaagtgacaagtctcacttcttcagtctccacagcattcaagggaagagtccatttcttcaactgcaaaccaattcatgaaactccttaaactatgtgatggactcaggccccaggtaaactggatcatgaccaagcatcaccaagagattatgtactccgttctcatttatgaatttttgggatttttaatcaaaggcaaattttgctacaggacatcgtactttgcgattttaactataggacaccgcacgaagtgacttttgagagaaaacactcccaaaagttggatagaaagaagagagataggagagctgacatgtgggtccaagggcatttctgacatttcgcgtgatttttctctcttctttaaccgaaaattattacttcaatgcgtgtggtgtccatcagcaaatatccaacttttgggagtgttttctcccaaaagtcaactcgtacagtgtcctacacctaaacccgcgaagtcacggtgtcctgtagtaaaatttgccttaatcaaaaggtagctccaaccgtttccctattctattgccaaaaacttggagttgccatccccgtatttcgcactctcgacttgtaaggaacgaacgaggttcccaatcacaccgtcctgcctcgttcaaatcataatcgtctaggagaagagtagtttcactttcgcatggggctcacttttttgtttcaaggagtcaatgttatccaatcttttggagggatgtttagagttctcataaaggaaaattttgtaatggaatttaattagtcaatatcttggtgatgctctaaggcttgggtggcaaagcttatgtaaacgtatgtattttcaccatatgattttcttcttggtccaataagcaaaggcatggagcaatcttgtgtccgcctatgccctcgactattaaaactagtacaaattccctcgacaattttgcgaagtgttttttttccaaagaatttgcaaagtggttttgtccaaactagctccaattgttgggtcgtcaccaccgtctcggccacttctctaagttggggctcaccggagctcgacgaagacgaagcacggattttagagcagatctgaaggttttaaatttggttccatggactatgaggcccaactgttaactgcagctactacacaaacagtaatggtagaccattcccgtttctgagacaaatgcgcagggtggtagtatactactcgacgattgatagagtctggtatagtcttaatatctcctttgcagaagggtcgtattttcccgactagttttgttgttttttttataaacttcacaaaatcttaataaactggccgtagatctatatcgacggctcagcaaaaaataaattactggagctgttccgacaaggtcacacatcgcatgtgcacgacaaaactctcgcggtgaatggacggatgcagaggcggattcaggaagaaatagcagacgtctgaacaaattagaacaaagctacatccctcttttccgtctgtgtatggcaaaaaaaaaagagtaaatttcacaaaactatatgttttatggtttaagttggagaaaaccacacacattttgacacttgacacttaagtacatatattttggtagtttagtttcacaaaaacacactatcgatgaatggattcacccgtgagatgacgtggttgctccatttaggatgatgacgtattatatcctattaatttcgtgagatggct

SEQ ID NO: 82771 - DNA, 7556 bp, Oryza sativa
tatgagtacttcaatagtactaatattagtagtggaggctcgaaccccacctcccggttggatccgcccctggacggatggatggttaggatggatcatgacgactcgactagtgctggagcacacagagagatacggcaccaacgaatatcccaaggatcatgccaagtgaactatggtgaaagtgatcgaccaaaaatcaagtaatcaacccctcggaacatgcacctcgaatattcgcaccgggacagcaacttcaccgcttgattacaaacttatatacggacacgacgattgcttcggcaaaatgctaccaaaaggtccaaagtaccaccggttcaggcactcgtatactcgtattctacaagcaacgaaaaagttgtaatagcacagaaaaagatggtgataccggctgtatccagaaacggcgatcagatgcaacgcgcacggtatttctacaacccgtataaggagaaaaacactagtatgcgttaacgttatggcagcaacaacttgccaaacctaacatgatccaccggagctccaacttgcgtgcacatctcgcctcggtttcgttcgtaaaatatataaaaagcgccgtctccaacgtgcaggatggcgagccaattggctcctcggctagttcttacctgtccgagctgtgttctccttctaccgttctctcctctccctgaccggcccaagtaaaggccgcgataccatgcgatgcagtaggactcaactgagaccgggtaaaaaatacttttctctacaaaaaaataaaaggactcaactgagcaagtaaaaccacaggcagcgtcgtttgtccccgacagcgatgctaacatggctcgagccgcacatggtggtggtcacccaagacccattttttttaggagtactattattgcgaaactacaaaaagacagccgctacgcacacacacgttttgtttattgcagggaatgtccaaaacgtgactggcttcgctggaagataacccaatttttcccatcggcgcaacgcaagttgaggagcccggcggcccatacatacgctgataataattagtagcctccaataatgcgcgcttatgcgcgcgcgcgcgcgccacacgcgtgttgggaaagggaaagcaaaaccataattaccgtggcaatagacagcgatcgtggctgttcgtgacacgaaagtgaaaacgacgttgacgtcgccggccggccggccagacaaacggcatgagaatactctgtgagcctgtgttgtgagttgtgacgaggcaagcaagcagggaaaggcccaaacacaaacacaaacagaaaggggagggagaggccacgtcgtcagccagccagccatttcaatcaccagttgctttaatttcttttcctcctaacaactacgcttgcaaaggcacctaacctaaccaggtgataacttgtccttgcaaatcactatcatctacatactccagtacaaatagcctcctaacccggagcctctcgttaccgagagagagagagagagagagagagagggcagtgcaggtgtcgctggccatggcgaggaggagcagcagcagagcgtgcgcggccatggcgacggccgccgtctttgcgctgctggccgcgacggcgacggcgtcggggctcgtacgggtggagcacccggccaagagcgacgggtcgctgagcctgctcgtcgtcggcgactggggccggaagggcacgtacaaccaatccagggtcgccgagcaggtaaaaccaaacgccccctcctcctccgtcggccgcgatccgtttcctcgcttcccgggatttaactctagttgttaaattttgctctaattgctgcggtaaatccatggtttgagctggccgttttaaggtcctaaccgcgcattacgggctcggataattggattggatggaaaagagagagagagagtgaggagacggcgagatgggggggagggagtccagatgggattcggtttggcagttgatggcgtgtgcgtacagtgctgggttggttggttggttgcttgcttgcttcgccagttggcatttcgtcgcgtatggtttaaactgacgaagtcgccggtgacgacgccgcgatggcgtgggcttcttttggtcttctgcccgccggtatgggcgcgcggccgaatgaaggaatgggaggggagaatatcagagtagaactgccaatacgcagatgcccatattaccgaactggccgatgtgatcagaaactattctcttgttgtgtgctcgagcaattaacagtttacctccagtgaaatggctaccttcatttctgggattagcagcggacagttttcagaagacatctcttgaccattattttctatttgtattattaaagtgaatactttttttaaaactgaaggtattattttttaaatagcaaagacaaacaatattaagtatggacaatttatcatgcagatggggaaggttggggagaagctaaatatagacttcgtcatatccaccggtgacaatttctacgaggatggactcactggcgtcgatgaccaggcgtttgaggaatcgtttaccgatatctacacggcaaagagcttgcagaagccatggtacctgggtaagctttctgcttcttgtcacttatgtcaccaataacatttaccaagtacccctgttacgaaatatgctaatatgttatttgaacgtgtactaaaacatgaacatttcttcagtgctgggaaatcatgactacaggggtgatgtgctagcacagcttagcccagtcttgcgaaagatcgaccagcgattcatttgcatgaggtcgttcattgttaatgcaggtaggaaaaaaaatgcagtatttggttactacttggatatgatgatagagttctgaactgtaacgtgcaaaacaacgctaactttgtatgatctgtcatcaacctttttttttcagagattgtggatttcttctttatcgacacaactccatttcagctgaaatattggactcgccctaaagaccatcattatgactggagaggagtggcacctcgacaaaaatacataactaatctacttaaggtgcgcatttggaatggaacagtcatcaatgcttaagaacaaaaaaaagctattcctaggttgctgagcaaaattgttttaatattttattttatggggtctactatctaggatatggatgaggcaatgaagaaatcaacagcgaagtggaagattgctgttgggcatcataccattaggagcgtcagtgaccatggtgacaccaaggagcttctgcaacttctacttccagttctgaaggttatacagaagttgcctcgatattaagttctgaaggatccacaaaaagagtacttccttatcactgtttcatggaatttcaggtcaatggcatcgacttctacatcaatgggcacgaccactgcctggaacacattagcagcagagacaggttaacatcatttgacacaaagtttccgcttttatgtcacagtaatatagaacaaaacatgtttgcataatcgatgaaacttgtctaacctgaatgcatgcactcctattgttacagtcctatccaatacttcacaagtggaggtggttcaaaagcatggagaggagtcttgcagccaaattctgataagctccagttcttttacgatggacaagggttcatgtccctccagataaaccaggaccaagctgacttcatattttatgatgtttctgggaacatcttgtacaagtggagcaagagcaaagcaaactacctccagccctccacctatatcactgaagcatgaggcagatgcaaaaccacaaaacggagaattagcttggctaagatatttgtatcaaatttgaatgcattattgtggcacgcaagggaagaggaccggaaaggaaataggaaagtatttaagcatggcatgtgattgatctactaaagaaatttgagacaaggccgagaccatcctactagactaggaaaagagatgttcagtatggtatccattagatctgattcatacaacttcttgccagaggaccatcgattatgccatgtataatttacaaagaaggcttaaaactctaaaagctagtagtgacctttgcatatcggcatcagggttcttcagtattgccaagcattcacatataacctttggagagagagagagagagagagagactttgggggtttctaagctggtattttcatttaaaagagacaatgaaaagaaaatttgatctatgataatcaagcatgtgtcggtgaagacggctattagttactgcttctggaaaaaggttgtaattcagtacagagttgtgtacgtgtccatttgaataaaaattgcatataacagaataaaattataatgaaaattctggcaagcaagttatgaaaggtaaaatgaggctttaacatgccatataaaagctctccaaaatgcaaagctagataaatccaacattcttgacacatcgttcttttcaaagaaaaaaaacactataatttgaaactaattctaggtaacatcatcgcgacgttattactattaatgtattgaaattatcaggtcaacatttagttcccttcagtgcatacctggggagaacaggaactgacaataaaaatggcctcactggacagccaatatggcaaaaatgtcaacagctttctctgcaattcttctgaataattctcccacatagatacggctaattcaaaatcactccattcaaaatcaatctctacattcttatgtgatccaaatatggtttgttcaaggccatggttgcatggcaatggtagttttgttcctctggattgactaacaggacagcagactgttcctgaaccaccagaagtttgtttcctctttgctgacagctcaggtgctttccagtagtaaaactgcaccacctgtttcagagatttgcaaatcatagaacactgacacgcttaacagaacaggatataacacatttgaatgccatgtttggaaagcaggaatatcataggaaacagttccttttgtaaaggaattagaaaaaaaaagcatattctaatggggcataaataattttttatttgtattttctaaaagatgtcaacttatttgaggaatgtcattctctaatacaaccacagaattttctgttgttatagcattctcatgaagatttagactataacattgaaataaaggcatcttacacgtgcagtaaaggataataaagtttgactattgtaatctaatggacatgatctgcagactaaaactacttaaaaagtgaaagtatgtagatacctgaagagcatgcaagccattggcaaaaactttgtcaaagacatcatctcccctaccaagtcgtactggcttcccaagcaactctatagggtcatcttcagcaggtgcaacagatttattgtcttcatcaatgcttgagtggaaagagaacccaagaatgtgcactctagcacatcgtacgtcaaaaccagaatggtcataggcaaaccaatacattatatcagaggctggcaaaggaatataagaactctgatgaactggttcatagttcagtgatgtctgagaaagaaaggaaaggagctttgggtcctcgtcataagcactgtctctggtgaaccaaagagttagggtgagtctttcaccttcagtcacctgcaaaaatagctgcactttattaataaacaagaaagggcacgcatcaacctcagaagaaaaataaaatcccttgacaagataatactttggccacatatgaattgattgtttacaaaaaacaaggtgcaagggaaaaggatagacataaattaggactaaatcattgataacaaaatgtagcctcaattacctgttgcaacttagagcacactcaaacaaataattttatttgattcatcaaaacaacaataatagtaacagatatactaacatcttgctgattatccaagtgaaaacagaaaatgtgacaaacaatgccaatgaaaagaataggcatgaacccagtacagaaacaatcaactggcccatgcaggaaacagaaatgtacctcatctacacaatgggtattactattatctgcagtgtagatgacaacatcctgaaaacaacagtacttctcagaaattccaagaatatatattcatttaattattaaaaaaaatgcatgcatgcaaactgtaaatcaaaatgcattagcttacaccagcaactggagtaataaaggaaggttcaccatcctgaaactgcaaaattccacctttatagtccttcccatgatcgtttaagtagcacactgccttttgattgaaagatggaaatggtgcattccatgccatattttaattcagaaggaaaaagggtcagaacaagaactgagaagagtgttagtcaaaaaaaagaactgagaacagtacatttgagtaaaaagggccgcattgaaatataaacaactacaacaactgagaaaatggaagagtatattttggacaggacctagatagtcccacaaacagagataaattactcatacaaaataagattaactagataatcatacaaaaaaaatgcaattcacaatatcagaagcaccgaaatgaatgcttgcatgaaatacagtttgttggaacagacaaaacaatatgtagacatgaaaacaactataaaagttgactaaatacccaaagatagattgaccctcaccgtgaaggctctttgcctaagataaggtttgttgtcatcactgtgccacccaatagaagctcccttgcaccaactgcagacccaacagacaggattccaatacgaatagcattttagtgtcaactgtcgagtattttcagagaagaactcttgaactagctttcgggaagcaagtgagtaaggtgatgacgtttttatatggtaaaacatactgttcattcttatgcagttgctagaacaataagaggggctgtttttagatctcaatgttttcccatgtactaatagttaggaaaagctgtcataacaatggttaggaaaagttttcccatgaaaattaccacgattccacaatagaactcaaatgtgtctcgctggatacttaacaggacaggaaatcccacaaacccagtgatatttccacttgacctacggtgcttcagcaacctggaaactcactctaccacccattcactgaatatgcatggcatcgtaacggcaagcaattccgaacttacactgcacactaaattcctcaactacgaacagcaaccatttcgatgtggacgtcaagctgcgaacgtactagaatcgagtcggcaatgaatgcacatgcacatcacgtgattgctcagcacctgatgagcccggtgaactcgatgaagaggtcgaagtggcaggagaaggccgactcgacggcgtcgcggagccgctcgcggacggggacgaacgggaggaggaggtggccgcagccggtggcagccaggtgcggaagcgacgtcgacaccac

SEQ ID NO: 82772 - DNA, 2900 bp, Oryza sativa
ggagttgtcagcacgtcctcggccgtcacgtggttcacccgaccccgaatgacatccttcccaccgttgttagagcggggaggcgcttggccttgctgacgcctcggctttgggcatttatccgcaaagtgcccgggctcgaagcagttgaagcacagacgctgtggaccttgagcgtccctgcggccttgaccaggctgcacagttggcgtaggaggacggggcgcacgagtcccttgttgattctgctgctgctgcggctgtgggacgcgcaccacgaattgaggtcgaggcgcggagcgaggttgctgctgctgttgttgctgctgcgaggaggatccccctggatagggattggtgtagcggaccctttggttagcaccctgttgattgcggaaattcgccaagcggcgcttgtgcgactccagttccttgtgcttggcttccaagcggatgctcttgtctaccagacgttggaaatccggatagtccccggagactagacggacggacagctcagggtccattcctgccaagaacttctcttgcttctcctcatcttcccgcacatcctccggggcgtaacgggccaggttgttgaactcatgcaaatactccgtcacggagcggttgccttgcttcaactcccggaattcccttttcttaagggccatgactccggcgggcacatgggttctccggaaagcggcggtgaaacgggcccaagtaataggttgcccctcgggctgcgtagcctggaaatggtcccaccatagagatgcgggcccctgcagctggtgggcggcgaagatgactttctcctcatcgctgcactgcacagtgtctagctttttccccacggcatgcaaccaatccaatgcatccacggggttgttggagctagagaaggtaggtgggcggatgcggaggaactcggcgagtttagagtgttggggaggtggtggtggagcattatgttgtggcggattttggaggtggtggaggaaagcagtcatcatgttggcctgctgggcgaggatttgggtgagaatggcgttggtgtctggtggtggtggtggaggcggaggaggaggtggaggtgggctgccctggttgtggtggttgctgccttcaggttggttgccatcaccggtggcagcacttctcctggtcgtcaccatctgaaaaccccacacagaaccagcaaacagagagagctgacaattaaagctaaccatccacgactaccataattcttgaatttattactgctattaaattggttcattaaagttcaagttgcttaggcaaataaaataaagacaggctccgacacagttataccacacaccggcataaccatgccccacacgactccaacaagaagacaaacgagaaagaacacacgcgcaagcctactaactgctcgtctaccgctgcgacgggccaggacggaaggtgagcaatagcgcatcctccgtgctaccaacgccggaggcttcctcctcctggggaaccatgggcgcgggctcggcacgaggggtctcgacgaagcaagtccacgccagggactgacgaaaaagctcgggcctagaggtgctcttgcgggcggtgatcttctggctgcggcagacgcggcgacgcttggggcggcagacctctccctgggcgatcttgagctgatgcagctgcgcctccaccgcgtctaggtccttcttgagctgcaggttctcttgacacagctccaggatcttcatgttgttctcgaccatcccagggtgcaccatctgatggaagtcgatacgagccgcgtcgtacgcctccaccatgcgcgccaggtgcatgatggtagcgtcatcctccgagctagcatcccggaaggtggcgtagtcgcgggctcctccacggcgagggtggtagcggtagggcgagtgctgcaactcgtccgggtagcgctggtgaagagtgccgatggcgaggagagcggcgctctggcaagcggcggggaaagaatctccacccgcggtgactgccagcgaagtccgctcgggagagccagcgaggatcactgcagtgacctcccaagcagcgtggggctctgcatcgtcaccctcctgctccggaagcggcctgccctggtagtccactccatgtggataccccaggacaacgcacatgccccgcagctccaagacgaaaccaatcatgtccaaaccacgacgggtgacgctgccggccatctaccaacaaaaacaaaaagaaaagcaacatttaaaaaggtcagattttggcgataaatgaagcagcaagacagagaaagactagagggttttcacaaataacagaggatttttatttcgaaaatactgctaaggcttgggatctacggctcgtcctagggtcaagggggttctgataccaacttgtcacgaccggaaataacccaacgggcgttccttacgtgcgtgcattaatccttgtcccaggaggcaaggtacaccaaaagttgatacaattcagagtttaacaagcggaagcgtaaatagttaatttattacatgggcagcgaaggcccagcacacacaaagataaacgagaaacagcggaagactagggcgacgaccacaggcacttgacggcaggcacgagctagacaccaaagccttcatcctccaggaactcctcttctgggtttgggaaaaattgagcaagactgagtacaaccaccgtactcaacaagacacacccacaagtgcagaataaatgcaagggagtacaaaggagttatactataaagggttagggttgcagtaaacagcatttaaagacattagttgctcagggctattttgcaaacacgattctagtactatacaatattatttatcaaggccgtgaac

SEQ ID NO: 82773 - DNA, 1115 bp, Oryza sativa
atgttgtcaatcattcagtttctgatattgttgtcgaacaaggtaagctgaaaataatgcagaacaaacttgttcgtgacgattcatttaaaaagactgtttgtgacttgttactaaactattaaagcgcttttgctaggacttggttatgagagatatatatatattttcattttccatctttttgttgagttagtgcaaatccagttctttccttggttgtgaaaagctatgttaacttgttaagaagtttgttcttgttttttttaaataaatgagtgacactcttggtgcaatatgcttagttatctactgtactcatgtgatatctgtaggttatctccaatcactttttggtatatattcaatcagatttgagaacattggtgtccgaaagccttctagtgatgacataaagataactggaattagtcatccacatgatttcaggaaggtactaaacattttgatttatctatctcagtctatctcgagtttttgtctcattcagacatgctttcttcaggctgttcttgtccatcttttgaatacaagcaatctgaatctcagtagaaaagcttatgtacacgatgatcagcagagcacgagttctaaacctataactatgtcttcggtatgtctatttcttaatggtaccttttaatagtttaaactgtaaagatcctttgcatttagcaagccctggagctatgagatccaacctttctgaatgtgcgatagttataaaactaagaacaagcatatattttgtatatcgaggttctgtttgtataataccttaggaagtattgtattgtagatatatagcttctaacaacatacatggttttgctaagtcaagattgtatttccatattaccctattaaacttggctaatgttttcattttacagaccattttcactgatccccgtgttttgcatgatatatatacaacacattgaatttttcaggttcctcctcttggagatttgatacttgagaagcttgacgaagttgaaatctctgtgaaggtgataattacagtatcactgttaatttctctaagttttaattatcttctgttttgttctcataccattatagaaacatgg

SEQ ID NO: 82774 - DNA, 19672 bp, Oryza sativa
  unsure (1)..(19672): unsure at all n locations
attttgtcacgcgtggcgaaataacaccgctagctaatactctaacccctcgtgatgtggcgcaccgtacgtgttagcaacaactacgggtgacattgtgacgttgttttagcacgtcaggcgggataccatggtctaaaggttcagatttaaaagtaaattttaaaacagcttatttttaaaataaaaaaataaaatggttcaataataataataataataataataataataataataataataataataataataataataataataataataataataataataataataataataataataattcggatgaagtagtgagcaatcagcagctgcagtacgtcgtagctaattggtgtgatgagtgatgagtgatcactctcgtcgatcggaagctccagctccaatcattcacgttttgatgatgcaagatgagtggccgggcggtcgctgtcggggaaatttaagaaacgggagccgtcggcgaactcgatcgatcgatcgaggtgccgtgtgcgttgcagctggcggcgctgctgccaaccaagctggcaggagagcgatctctgctgcgtgggtgatcgacggcgacacgcactgccctgtcttcctccctcgccgtcgtccggtcccggcctcttcgtggtcgtcgccgtccgacacagctaagattgcttgtgacctccgacttccttctcgccggactttcatcttcgcttcacttactccctccattccatctcaagtgtaattataagtttccgtgcctaactttaatcgttcgctttaaattttttttataattagtatttttattgttatgagatgataaaacatgagtatgtctaactttaatcatccgtcttatttaatttttttgtaattattatttttattgttacgagattatgtgatagtttatatgtgacttatgtttttaattaaaaaattaaataagacgaagatcaaagtactatgttttcaaataattgattttttttctaaaatataagacacaactatttaactttagatatgttgttttatatatttgacaggaaactgaggagaaatttatccctttttttcagcagtttggatacgagtaaagattcacgggtggcgggagaaaaaaatctcacgtgcaggggctcgatcccatgtacgaccttacatccactgagctactacatgtgttgtgtggttttatgagtcttacacctaaaatatattgtaattactttctaattacactataattatattaattaaggttgtactgtagtcacattcgataaattttaattttgagatgatttttttcaaaagttatataactaatccctactactgtatctgtcttataatataagaaattttgggtggatatgacacattctaatacaatgaatcaggataaattaggatgtgttatatctacccaaaatccttatattataggacaaagggagtatttgacttttgacctacaattacactttaatgacgtggtttaagtgtttgtaaattatttgtaagaggacgaatggttaaagtgtgaaagtgaatgtctcctgtcagttatttaaaaacaaattgaaggtagtaccaatctgcctcgtcgtcttgcacgcggccaaagctcatcgtcttttcagacatttacagtcgacagctccactctccatgtcaatgatttagtccagaacccaaatcaaaactgctgataagttaatcatcatcttcttttctttttgtgcactcaaacaaagttgttctagctttgctctgaattttgggcaacaatcactcaatcagtagcagtagacctgattaaggataagatgagatcaacgacgtgagtgcttgggcaaagagagggcagctttaatttgtgatcacaagtgcgagttcgttatgaatgtctgtgtctgtgtccatgtgtggtggtggtgcattttcagagaaggggattctttatagttcgctaataacaatatatacagggatgcctgtggctgatggctactgtcaccaccaacatcttgttattgttcagactaaagtgttggttgctagctcaggtttagctagctccaaatacaagtcttcactcataataatggtgttgctggtccatgcttgatcaaccatgcaagtgtggtgttctttgagttgggtgttgtcccatcaaaatcctctgtatatatatacttccatttgattcgtttgtgcggtttaagcacagtgtttagctttgctttgcttagttgatgcccatgtctgaatcacactgagaatatgccctctttgcttaatggacatgtatatgcctgttgctggtgatgttggttaaggcaattcatttctttttttttctaaccatgattgattattctgctctaataagatgagagatgcatgtgtggtgttggcttccactgtttagtgatctcagttgctaaccacctatcacaattggccagctgttcactctagctcttggacaacaatgtcattgttgcagttacaacggtgaaggagatatcctccaattggcaagataaagatcagagatggaaccaataaccaacctgcagacaaaattaactgcaagttcttccaattcttcttcttctttttttatccaagcaaacacagattgtaccaatttcattgaatacttccaattctctatcaaccaccatcatggcagaagactgctagtcttgaaaggcagttagctagttgtagatgcaatctattgcagggagattgacagattattggagcccaagtttcgtcgaaccggagacgcaaggaataaagggcaaagacaccggtcaaccatgcatgaacgtaaccatgagcacacacgcaacttgtgcctacatgcatttttcatgccagaatatattaacactattttttatcctatttttaatgatactatagtgggaccaagatggtccaactgatttgatatattaaaaataaataaatagacagttgtatacagcattgcatctgaaattcaaacttaatatgacctattctcactttaattttgcatatagaaattgttaatacattaaaaaaatagaagatatatttcttccatcataaatccatattaattatatctctcactttaatttacagatagaaattgttagcatattaaaagatataaaaagcaataactgatacagggttgcatcagaaatttcatattatttctatctcttgcttttatttgcagatagaaatatatatgtagatggctagctaaaggatttatttcattatcttatactccctccattttataatgtaagacttcctagcattacccatattcatatagatattaatgaatctagacacatgtatatacctagattcattaacatttatatgaatatggataatactagaaagtcttacattatgaaacggaggaagtagaaaaaaagaaagctaagatgcaaggagaatgccggtccatcacgtttgccatctaggcagcacactctaccagaagcctgaatgcaaagtatgcaggcaacctacccatgcagagacaaatcaaacaccaaaaaggtggcaagagatttcaaagggagagacaaatccttcttggcacgggactgatcatggttagtggcggcagcagcatcagcagccagtgattggtactccggatggagtactaattaattagctggctaacaccaatatattgcttctttctcaatcatttttcttcggtttaagtctctctttttctctctctctctggtgctgattgcaaagccactcacacgcaccacccataatgtaatgcccacccgaaagtccccacaaaatcacatggaagtcgcctcttcccaatcacaaagcatgaacaaaaaaaggagattgttccacagctcacaaaatcagctaaccccccttattcctgcctccctccctccagtaaccaaccacctgtaccgggcgcgaaaggacgaatggtctctcgcgctcggttagttcgttcgatggtgtacaatggactgtccagatcatcttaagacggcatttgtattgtcctaagtcgaacaaatggtatactcccttggtctatcttgaccacaactccataccatatgcatacatgccttgaaactgtggttcgctatcctgatatcagataaaaatcgctcacgagcagtatcttcggattttgtagaaaccattgataaaccaaaagaaaaccgatgaaatccgaacaaatctggaaaaaaattaataatccatttttattttaattttttaacttcacacaaaaacccgagcggtttatgttttagacatggtccgaaaaaaccagatttcacgaaatcagaaccggttttctcccgggataataaacccctgctgggaacaaatatccatatcgtcgcaaaccgaccgacgtatcggacgatctcgaccgtccgataccgatcgggcggtgcatggtagaggacccggatccgggaggaacagtgcttgccgaataccgacggcacgaaaaggtaaagtgcacacatgatagtgcattacattgctactactacatgatatgcattacattacacctgtccccagatgcgccaggcagacgggcctcacgcctcctcacgggctcacgcggtcacgcctataaaacgcgccacccctgccctttccacgcatcatcacatcatccactgctctgcttctcctcttcttttcttggcttgtgctctgttttaatttctttgcaatgatggggaggcagagctcgtcggcggcgaggagggtggtggtggtggtgtgcgcggcgatggtggtggcggcggcggcggcgcagaagtacaatgcggtgtacaacttcggggactcgatcacggacaccggcaacctgtgcaccaatggcagcccgtcgcagatcaccttcacccagcctccctacggcgagacctacttcggctcccctacctgccgctgttgcgacggccgcgtcgtcgtcgacttcctcggtaactttgattctttctttgattccttcgtcttcttggtttgcttgctccggcgagctgacggcggcggctggtggttgttgcagcgagtaagttcgggctgccgttcctgccgccgtcgaagtcgacgagcgccgacttcaagaagggagcgaacatggcgatcaccggagccaccgccatggacgccaacttcttccgctccctcggcctctccgacaagatctggaacaacggccccatcagctttcaaatccagtggttccagcaaatctcctcctccgtctgcggccagagtaataatcactcactcactgttcttcccaccacacaatttcaaaatctctgacaagaattcaattcgattcgattcgattaaatttcagattgcaagagctacctggcgaactcgctgttcgtgttcggggagttcggcggcaacgactacaatgcgatgctgttcggagggtacagcgcggaccaggcgagcacgtacacgtcgcagatcgtggacaccatctccaacggcgtcgagaagctcatcgccatgggcgccgtcgacgtcgtcgtccccggcgtgctccccatcggctgcttccccatctacctcaccatctacggcacctcctccagctccgactacgacagcctcggctgcctcaagaagttcaacgacctctccaccaaccacaacaatcagctcaagaccaagatctccgcgctccaatccaagtacaagtccgcccgcatcatgtacgccgacttctactccggcgtctacgacatggtccgcaaccccggcaactacggtacgcacaccactccgcttacactgttacacaaaaataactaattctacggccctgtctagttccaaagtttttttctaaacttccaactttccatcacatcaaacatttcatacacacataatttttctatcacatcgtatcaattttaaccaaaacttctaaacttcagtgtgaactaaacacagtctacgtatatattgcccgtacgttgcaacgtgatttggattttttttaaaaaaatttgtgcacgagggagacagggggccatgtgagccgtagcaagattcctcagttttgtgccagtgaatgagcagtttgcttaagtagggtagtagtgtccgacatgggcaatccgagctcgtgattgccattttatatggggggaacagtagtcgtcttgctccaacgactagctagacacccaaattatgccagattaatggcagatacgcccggttaggtgtgtggacttatgtttgtacctacgaatccaactgcacgcacgttcctccgttccctcaccggaactcaccccatgttcccccaactaaacacacatgtgagacagtgtcaaacgactacccccgagcagtggcgttttggcagtgtgcatcctactcctttcgttctgaaatataagagattttaaacggacgtctaaattcgtagcactaaaaagagtcacatccattcaaaatcgtttatgttttatgacggatggagtagatgatacagagaccaaagatgattaaactgatgagctatatatattttttgacatgtaggatttagcacggtgttcgagacgtgctgcgggtcaggcggcggcaagttcaactacaacaacaacgcgaggtgtgggatgtcaggcgcatcagcgtgctccaacccggcgtcgcatcttagctgggacggcatccacctcaccgaggcagcttacaagcagatcactgacggctggctcaacggcccgtactgtagcccggccatcctccacagctaaggcaaaatgactggaaagaacgagccattagttaatttattactttattattaaggctggtgtttattaattaagcgggaattaattaaaggggaattgtttgggttcttgatttttatttgggtggcatatatggtgggtggtgtgacggtgaaatggtttacttgcgttgccaaaaaagcaaagaaagcgatggcatctgtagaataaatgttggttactgttgtaatttgataattgtttctcttccagaatcaaatgaatcatcaatggtattatactcagttattttttttcttttgctttttagaaagagacttttttgccatggcagcttatgtttggatcttttgcctggccaggggcatgtggtctgtgctttaggaaaagcaactgcagaaaattcactctgatggtcatcctgtctgagacggtcttgtcattattagtcagagactctgaaagtgaaagtgacagtgttttcttctcattgcaaacttttagctaactaaccactaggttgatgaacaaattggacactcctactggggaaggaaaacctgagcaaatttatccaaggatagatagatatgcagcatatgctccaagtacaataatgcaaaaggaaagcaagctactcttgcatagtgatgcactcgctctcctactgctgaatctagctagttgcatcaaatcgacttgaatacatgagatggagtaatatgcagggcatgtgggtgacgcaagtgggatggcctgaattattcgtagctgttggaattaaatccaacggcgacccatccttggaaggaggagacgaatcttcgtatttgattgcctaacacatctattgattatgatagtgatgcacatttgcaaactaggacagggcacacaagcaagtacaagcatgaagcatcaatcagagcggctgatttatacttacataaacgcagtaaacaaaaaaaagaaataaaaacatggcatgcgtaggattgaaacacagaaccaagcctaccatagaggttgaaggatgttacgtatagcgaaggttaaaaaaatatattcaaaagtacgaagcatagaaactgtgtgttaatttgtgatgcattctactactatacaacaaaactgcttcacaagggcacatgatgagcattcctggcaagaatatactaccaagttctgaagtcataagcaaatgagaatgtgacaagaatgtggaacaagagctctgtgatcccgtgtatctgacgcctgaaatcggcggtgttggctgcctggacggcgcgccccaggcaatgattgtgcctggtgaagtcagtgaatgctcgggcaatccattcgaggcgtcagtggtcaaccattctgtcatcatgttgcctggactgtagtccgtgtagggacgataatttatcggtcgtcagattcagacaccgcagatggaccacctgtacattccttccttcgatgaagctccagcatctttacctccgggtggcatagccctggatgatgatagatttgggaacatgttagcatgcgtcagctagactgaaagatcttaggcattagtgtccttgagaaaaacaatgctttgcaagtttcagaaccagcttctgcacaagcacatccctcacttttattcatcttcctaacaagagtttggttttttagtactatgcaatacttgtgcaggttaatgttaactttattgattctcagcttcacagacctatatgggctacggcctttgtgatgttgaagttgatcaaaaggaaagtgtgatgtgataatactttaagggccacgcaaatatatagataaggaaaaaagataattcaccaagcacttccacttcaaatgacatcaatataagagtcaagaaagtaaataacctgaacattttggaatatcccaaacagcaattgaagactctgtgcactcaggtgaacaaagtgcatgtgtgttctcatggttgacgttcatagcaagcatccaggatccaatagtaacatcctcattgctgaacatacggaaactggagaaacatatgtgagaatccattaaacaaacatataacgtgactcgatcgtggatgaagtttaacagtgatgcaaaatgaaaaacatgaatgcaacaacagtcttatgtacgaaacttctactgctgaagcccatgacataaccatgtagtatgtttactttaggctccagggcttctgagtttaatatatcgtgagcaattaatcaataaccacacactatttcccttcgctcttaatttgttgagccagaaaagggaaagttttgctgaaaagaaacaccacttcttttacatgagagggctaaaactaccaagaatagctcagaattgtgggaacaaggctaatatgaaagccagtaagacagcagtaacagtcaatacaacttctttacagaagtatatggatttgcagtgcagtagtgttgctcatgttagtcatacagtgagcggtggcctcaccatcactggccatcaaagcagggaaaccatagacccaaaccaacattgaatactatttcataggctaactggtttgagaaggcaagttgaagaatgctgcttcacaataagataggatgagtactgttaattacctgttgttcctcaaggcaaccaagcttgccaccacatcggctgataaagcgtaaataggcccatatgcatgaaggaagtattctgatccgagcaaaaaggattgtggctcatacctgcatttggaaaaagagcagaaacaatatgataagcagtcattgatgaatggtacatggaatatttttgctgtgtggaacaatagaaagtctgaagtccaaacagcatgtggtatactcagcatatatgccctcacaccatttgccacagcaacatgccttggttatagaattctgtctatactaccctaaaagctaagctaacaactgtcttaaaactataatagcaaagaggaaactgaaaatcacgttggagggaatagactcacaaactgaacactttgtgcttgcaccaacttgtaggatcacaagagtgcttgcacagctaagctagcaatattttaagcacagattcaaaaatgacagctgcactggtgaattggagggtggagcgtgtgacaaaatacaaaactgatgaaggatatatatgattttctttgatcctcgaataatactgataagatgttgaacctgacaaaagtcgttaggattcaggaatcctttatacttacatagttcatccccactaagtgtagttaatgctatttctctcctctcattaagccacatcaccccaattatttctagcctttggatgatagatctataatccaaattgtctcttctttcttctctcttaaaaacatgcaatctcaattatttttaggctcaaaattgtatcaaattgttttagttttgataatcaaattacatcttatttgtacatattatgcaacttaattttccgcagcaacgcgacggagtattcatctagtttgggatacatgcgcattaacatctgaaaaacaatcaagtaaacacgttccttgctaatcctttccttcgccttccaaccctacagatcaagtgcttgctttacacaccatatctagtgtggtctgtgcttaactttatgagaaaccatccggatattgaggtaccagcagttctggttttgtacaatataacatactccctccgtttcacaatgtaagtcattctagcatattccgcattcatattgatgttaatgaatatagacatctatatctatctagattcattaacatcaatatgaatataggaaatgctagaatgacttacattgtgaaacggaggaagtaaacacgtaattacgaatctgaaactgagttattttcagttcatatttatacagtgatgaaatattttttgacaccataaaattattaacttttttgtggaggtgtgagggtcgcatctggacgaaaaaatttctttattatctaatttacatttgcttagcatgagccacgatgctgtatgcatttcttcatagagttaaactttctcaataaaaaaaacaatatggcataaaaggggttcattatgtcatacaagactaaataacagaactgaccatttcagctttgggtcagtaaaaacaggccccttcttcatgcatccaatgtatgtttgtgtatgtgaacgctccttagccaaaagcaatgaaagtctatctgcagaatagatatcagtaatgaaagtgccagccattaaaaaaaatatgatatccaagtcaaaatctgtaagaggatatgtagggcattggtatgcacctggtctcaagtagatatcatcatcagctttaacatagaagtcagagtcatacaatgcatacgcagccttaaagtaagctaacctacaacataagaataaatcagcatctttctgaagaaataacaaaagcatatgataatagttctgctatttacgttttgtacggaagcttgctatactcctcctccagatctaaaagcacgaaatcatcgtattcttgaacctctctttctaaagctgccatcttagacttgtcattactttttccaatcacaaatctgaatgccagaccagttgcttcctccaatctgtaatacagtgaacacaaaaatacaactattgtaatggcagttagccaaaatcaccattaacggaaactgaaatacagaaacagagatggtgatgatcatctctttattaagaatggttggacttttggacaacaaaagtccacttaggctgaaaccgaagcaaaacagttaatggctgctcatctactaggcagcatggagctggtttcagctggcaggccgctttagtcaaagtttattgaacctacgaattaaatatattccggaacctccatgtgcattttcatgtacattgtagacttatagttggatctcacgacataagtactagagaaaaaaaaaactaacaaatccacatgatcaatcccttcttcaagaatagcagcataattcttcctcgaaaacaatgagaacagatggaatgaattaagagcaggtacaatagcaggctataagctagctgtaaacatattttaaagagataaaggaagagagagaagagcagcgggctacagatttgtagccagctacagcacggactccaggacataatgtgtgtatggtaggtgggacattgatagtatagtaagcaactattgtatgaattggctattagattggctatagatgaattagagctagcaatgggccataccaataagcagatctcactaaagcaaatacaaccttatagtgatgagtgatctctatctcatgtttatttgacaacgaaccgtaaaattacatctaagatcatagaaatgaacaaattagattacctacgtactaaaatctaatcagtaactatttccgctccactcccgtaattaggtaaccagcaacatcaacagttgaacacctaaaactaaagccagatctcgagcaacacaagcagacacgaactagcaaactgtgataccagcgactaaccgaaggagaccctgccgatccgcggggagccacgtccgccgcagcgcgcgtcgccgcccgacggagccgaacccggtgaagatcccgacgaaggccatcaccttgtgcctcccgcgcgacccggtggcgtgcgacgccgggagatccacggcggcgcccgccgccgccacggccccggcggacgcatccccgggccggcggtcccacgcgacggagacggagagcgggcgggaggagtccgggcagcgggcgcgcggcgcgctccccggcgaccaggagaaggagagcgcggcggctaggaagcccgcgagggccgaaaaggaggcaggcggcggaaaaggccggggtggaaaggatgcggcggagcgtggcgcggcgggaggtggtcgccgaggagaagaccttctgcgagctcggcatggcttcggcgaacttgccgccgcgccgccgcgtgggttgacggcgaggcgcgccggatcgaacccgggggagacgaggagggggaaggggtggtggtggacgctgggtgcggccgcgtttgctgcttctcctcctttttgttttgagttggtagagagagagagaggggctgtgttgagcccaactggtagcccactaagattcagcccaagatgatttcaccggcaaattttggagggctgtaattcgaaatgggcctagaatttcgttcgaattttatttgaaactggaattgtacgtgatccttctgttgcgtattataaaacgttttcgttttgttctcaatcaagtttaatcaatgtagcaacaagttcaaaaaaaaatgtagcaactcttgtagtacaaaacagatatatctctactattataaaaattaaagttgtttttgcggtattttggtacgtcgttcgtatttgagctgattttaaattcgttcgcttttgaaaatacaaattcgtattttagtcggattttaagttcgtttccttttgaaaatacaaaagaagtcatataagaaatcccttttaaaaaacttgcatgctaacttgagatgaatgttgaactcctaattgcagctcatgattttctagaaaaaaaatatctaagcgaattcccacagtggatttcaccctagccaaaccgtataacaataataaaaaaattataatagcattcacccgttacaacacacgggcatcttttcaagttataaatatatatattattcggtcgtagatttaatgaaagtaatctggtgttctatatgttaatatatttttttttgaaaatctttggtttaataacttgaataaatttggcttgggataggaacgaagggagtatataattattttttctagttgcacacatacaactattatcttctttttttccgtttacatcaaatgcgtactcaagtgcttctcctaatacacgttcagggaaccggagatgaacaacaaatcccaacaaactgaattttattcaaatccacagcgattacaatggtaaaaccaagttacaacacaataattactgtattcgagccagagaaaattgtccgacaaatcaattgcagcacggttacatctctgctagctcttctgccgccgtcagctaagttagcttaactgcggcgcttggtcttgcggtggtggtggtggtggtcgtcgtcttcgtcgtcgccggcggcggcggcggctttggcgagctcgcactggtcgatccactcgctgtagacgtcgatgggctcggtgagcgcgtgggcggtggtggagtagcgcgcctggcagacgaaacaggaggcctcggcgatcatgtgcttgatgtcgatgctgcactccaccgcgccgccggggtcgcagaacgggcagctgaacgccgtctccagcttcggcgccgccttcttcgccgtcgccagcatcttcgacacccgagacttcctcttccccatctccgactccgacgccgacgatgcccttgctttcttgcttctgctcccggcggcgaatcgatcggcgaatgccaaacgattgatcgagaaagaagaatgcatttgggtttttccccccnaaaaaaagggggggccccgcgggggcgccgcgcgtgcttatatcgggagctcttcccagttcgcgtcggactcggactcggactcggactccttcacgaacacggcccgcattaagcaaattaagtgtccaattagtacggactaattaaaatcatttcttccatatcgattttgcaaatttgcagttcgttctgcggctacacttgacttggatcaagagatgatgattaattgattgattattaattaagcctagtgttttcttggtttggttcatgcatccatccatggcggcggcaggtggtgcagttgatcgatggttctagtggtgcaggatgggagggtggcagtagggtcccctgagccagccgccggcgacgagccggttcgccgcctccgtcgtgtggacgccgtcccagcacacgtgcctcgacgggtcacggcacgccgccgcgcccttcatcccgcaccgcgcctcgaactcgtagttgtactccccgccgccggcgccgcagcacgccgtcatcccgctcctgaaccctgcgccgccgccgccgccgccattgccacccccatcacatcagatcacaaccaccaactcaaaccaaacatgcctctccaagatcgattaatcggtaccgaagcgcgccggcgtgtgcagcatctgggcgaccatggtgtagtagtcggcgtacatgatcctcaccggcgccggcgccgccgccgccgccgacctgtacctggcctggagtccggcgagcctcgcctgcagcagcgcgttgtggtggatggccagatcgttgagcggccggaggcatccgtgctcgtcgtagtccgactcgttgctgctccggagcatggtcaggtagagcgggaagcaccccaccggcatcacccccggcaccacgatctccgccgcgcccatcgcaatcagcttctgcaaacgattgcaatcgcgcgcgaaagatcagatcgaccaagaaagtgaacaacattttctggatgattcattggttggttggttgattgcctcgacgccggtgatgatggtgtcgacgatcttgggcgtgtaattcctggcctgatcgacggtgaagccgaagaacagcatggcgttgtagtcgttgccgccgagcgagccgaacaggaagagtgacttggacaagtaggctctgcaacctgatgaacacttagagtaattagctcgtgagcgattgattagctgaagaaaaaatgggagtaattcgatcgatttgaattttgattcagatttagaatttgatttttaccctgtggttgtgtggcgcagatggaggggagaagatggtggaaccactggagctggacgttcatggcgccgttgttccagatcgggtagccgaggccgatggacttgaggaagtcgaagtcgagggcggtggcgccgacgatggccatgttggcgcctcgccggaagtcgccgccgccggcgctccgcttcgacggcggcagcagcggcaaccccagctcctgcgctgcattggcaatgcaggcgaatcttggcatcaatcagcaatggcggcggtggcgacggcggcggatgcgtgtgcttaccgaggaagtcgacgacgaggcggccgtcggagcagcggcaggtggggtggccgaagtaggtcatcccgtacggcggctgcgcgaacgtcagcagcagcgtcgccgccgccgacttgttcacgcagatgttccccgtgtccgccagcgagtccccgaacacgaacatggcgttgtacttgcacctcatcccaccatcgccgccgccgccgccgacgccaccggccaacgccggctgcacggcgcaccagcagaggcagcaaaccaccagcacgctgccgacgacgtcgacggcggcggcggcaagcgcgcctcctcgccgcgccatcactcgcaacgccacagctcagtgacgacgcgagacagtggcatacttacattatatacacttggtcttggttggtttaatgagcagtgacgtcacctcgccgccattgttgctgtgcttttgtacacacgtacacgtctgatatctcgtcgtcatcgttgggctaaggctaagctgcgcaacgtttgcatgttgcaaccgatagaccgggctgggccggcacgacaaggcccatgggccttactgggctatctcggccggaaagtgttctgccgtaaagtaagttcactttgactcccttaactagaggcttaatctaattcgtatccctaaaccacaataccgggatatctcgactccctaattactaaaagagaaagactacacaacggtataccgttgaatggtataccgcttatcccccatgacgcggccccgcgtgccggcttctcccgagtatgtcgcgtgctgctaggattatcatcacgcatgtttgctatgtgtatcagtgtatagtcttgttcctgacagctagctaatacccagcatgcctgtcctgcctttgatactagcctagctattaaataaaaccgaaagtactactagcttgctgtgcatgtcaaatccctgtaatagctactagtagtcccgtaccctagccatgtagggtacttattatggcagagcctagtagcctagctatgtgtttaagatgggttgcatctatttgcatgtgtcctataccatgcatggattagaccagacaaataattacctaaattatatatggatacaatgtattctaattagatatgtcatgttgggctcttggttataccacatcttagaaactctagtatgtgatatatagatgctagattatcatatctgatatccaagtactgggtcgaatacctaggtaccaagtatgaaacctataaatacaagatctgatgccgagttatcgggtctgatacctataagtaccggatccgataactaggtatcgcgtctgatacctatgagtaccagatcggatactcgggaatcgggtatctgatctgatacctatgagtatttgttctaatacctatgcgtaacgggtcgaatacccaggtaccgagtatgatacttatgaataccaagtctgatacctaagtatcgggtttgatacctatgagtaccggattcgatacctaggtcaggtttgatacctatgagtaccagatccggtatctcgtatgatacctatgagtatcggatcggatacctgggtatcgggtatctgatctgatacctatgagtatcaattctgatacctgtacgtactaggtcggatacctaggtaccgagtatgatacctatgaataccaagtctaatacctaagtattgggtttgatacctataagtaccggattcgatacctaggtcgggtttgatacctatgagtaccggatccaatacctatataccaggttaatacatattagtagcggatctgataccaaatatagggtgtgatggtaggagacttcagacgtgataccactaattctgatatttatgggttatatacttctattcaaccatcaaataaaaagatggaccatgcatagctaggccagaaagtacagccaaacttgctcatgtgccgctgagtgcttaattctaacttgctgacatgctttgtttaggctcatgctactagctctagtgcttaattctaactttgctagttgaagcaggtgtgagacccatatggacctaaagaggtgtagaagtagtgttgtattagagtatttcatagctattttgtactgtaggagaaaagagacctctcgtcagtcgtcactagtcagcagcctccatgtgaaaggacagcacacgacatgctttcagagagaaagaatcgatgagtgattggtaagtataaattataaactataccgttgagacggtacaccatcccatagtttttctcttattaaaaccggtacaatttaactcggtggttttcaagagcggtttcgttgatgtggcgtctacatgacggtattaatctggcatgtggcattgactttatgccatgtcaatgccacagaccaggtcaacagtgccacgtggacgtcacgttaatgaaagcatcctccaaaattatcgagggagttaaattacaccgatattaatagttatgagtcgagatatctagtattgtggtttaagcactggtttaagagtttaagagagtcaaagtaaacttattccttctgccgttgttgtcacgtacagccgtacaggagagaggaaattcggatggttattggtggctcatctgggtacacactacacagtattcaatggcgattcagagtactacacggcattgcatcattcaatcatatgcaacctggtagatcgatcagggagaaggcaccgcatttggaatctatatctttactcttcataaagaaactgattttaagccaaactttactctttagcatgtaacagtagtagtaagtacaggcttaaagatgcttaattttgttcttgcagaagagtttgttagccttggacagtaaggtggagaagccaaaataaaaaaaaaaaacagacagaaccaaaagggatcctgcattattttggtttggtatctaaaactggggtgcatgcatcatattcagacttaaagtttggccaaacttctttaataaagaaactgttttttttttccctgtaaataaactccaaagcaacatgcacagtcactcactctgtgtagcatagtttctgtaccagaaaaggaggtgaagcattcattcactagttccatacaagcatgtggtcatgcgatccaggattcctaacttgtattaaagtttttttctttctttttttgagatggcagcaaaccaagttgatgagcttagataagatcttgctcgcatttatgatttcatccggatccagcatgtgcgtatgtgaccatctccaaccaaaccatgcaacaaattactaagatttaattaattaattgcaacacataattaaattgcctcccaatctcatacatactacacaaatgtgcattacctaaaacaaaaacaaattaaccacccacaacgaaaatcaactaatcaccatcttattcatttcccagtcgatcgcaagatgtcttcttcttcctcttgctatccatttttcttctcttcttctgctaaacaaatcaaatcagcagcag

SEQ ID NO: 82775 - DNA, 1867 bp, Oryza sativa
gatcagtgccatatgtccccatatttacatgtcttgctggtcaatgtatgtatcgtaccaaaaatttgattctggcgtattggaaataaacgtttcagaaacacggtaaacttggttcaggtcagtatagcctcgagtatcggagaaaatgattcagtagtaagatccttcaggtaaattgcatactacaattaacttaactactcgtcacgaaaagattgtcaagcggctctacatgccagaacattgtcagtaaagaacgacgcatccataggcatcagcacgcacatttgctacacaaattctcattccccagatgctaggagcatagaatgataagagattagcaaagaacaaatgccgcagaaatggtcatagcacatagccccatatctccataagataattgccaaggataacttagagcagagtgatcatccagttgtgctacagagcagctacaaaatttaatatagcattcagtcctaagaactcgacagcgaggtctcaggccatgggcgacagccgcgacagcaacactgctgtcgatgaagctctcacttgagcgcagcatactcctgggatttctttctgtgcttgcaaccacacgatccaaaaaattgaagtttcctcatctcttcatgtctttttgttgttgtctatgtactacaaccctgcctctattttgcggcattcggctggaccttgttgctcccaaccttcttcatcccaccattctgctgctccttacttacagcagacttcttatccaccaagctactgccaccattcgagctcccattgcactctggtttctgctcaaccgcgtcggattgttttgctggtgagctctttggagaaacgtcaccgttggccatctcccccatggtgctggtgctcttgttatgcacgtaagcagatgaatctgttgaagagattggctcggcaggagactgagaagctgtcatcatctgatgaggcagtgcgtgacccgatccaggaggaaggaagacccccgtgccaggaactgggagtcgttgtggagcagaccttggagcagcttctgccatccaagctgttgttgagtttggcaaaggaacaggtgatgggaaaggcatggctgcagcagcaactggagcaggtgctacaaagagtggctgcattccatctgatggaggaatgtgatgcgctccaatggccggcgctggaagtacgccactgtttggggcatatccaaagtgtttagggcttgaagaatgacgcgccatgttagccggccttggaggaccccagggcataggaggtggtgtcaacggggtagtaaaccgtgaaacactttcagatggtacttgttttctcgataaagacttcccgaagcttagtaggatccgctgcttacatgcagcaggaatagctcgcttagcaacatcagcactcttcccatgcaacaccagaagagacctgtagtcgagaggaaaagaaaagagcatgaaaattatacggtgcttttagtgaaaaatgatactccatattgtaatgcatcttaaatacagtattgaattacagtgcttttagtgaaaaatgaaagcatcttacacatttaaatactaacggggtgtaaaattttgagtaatacaaaggggaaccaccatgcttatatccttattatatgggcatattgctacataagaggggtaaacatggtcattatgatattcttataggggactaatccacacgattatgtagtaagtaaataaaaatgaaagtgttgacatctaaaatattcatcacacatacatacgtgtgtgtgtgtgtataccaaaccacaagtattaaagatttttcaagaaaacatcaataatca

SEQ ID NO: 82776 - DNA, 1484 bp, Oryza sativa
tgaagactagatctacctcttggatagtcatcttcaggagggccttcaacgataggaatgcccagctgaataatttccctcccatgacccttcattggtctttttccaattattacagtctgcccagctgttttaccaaaaaaaatcatagtgaagtgacaagatcccaaaatgttacatggttaatatgaccctttttctctagtttgtgctcagcatctgtgtcagtttgtgttcagcgtcatagttgacatagatgctgaacacaaactagagaaaaagggtcaaattaaccatgtactaacataagtgtcagacacatatccaaaaggagccgcaaaagtaactgtcaatgattttctagttgatcaactaagcataagaaaaggctgtttctcagacaaataatctttgatggactcatggtacacttttttatatacagatatggaaacagattttgcaaaactggaatcttagtgcacaaccacgtggtgcacagtgaacacattagcacacaaatgaatagctgttcatggttatttcacccaaaaaaaagaaggtaagtctaccttcaagccctcctcgacgaaaagaagcttttgtttcattaagtaaagagagaatcttgtttttctcattctcatttaccaacccttcataaaccttaagcccttcaacagcattaacctaaagaagcataaagcatatttcatcaaatcttcgagattcaagagaagctagttgaaaaggagatgcgaatacagcactagaatttctgatctaggtaaaacagaccgtcttgccatcaataatgtcattgaccgtatactccacaggagttggaaccactttactgcttccttcagcaacagcttgcggcctaggagttttttcaccttctacatgatgcaaggacaataagatgttaagaaatgataaaaaattattgcatcactatatggaaactatcagaagcaagaacaaaaagtatagcagccagcaataaatgtactattctgcctgtataaatattcgacaatgtatcaacaagctggaaagtggaaacagtttcctagcttttgtcagtctagaaaaaaagaaaagggccaaaattcctgatcctattttaccagtattgcatcctcacgctataaaattaaggttgtaagtaatgtggtctaacaattttatgaacaatttcaaaatattccaaatgtgaccaagtcattgacatagttggactaaatttgaggtggagatagccacttaagaaaactaatgaaagtcatcttcagattgagattgcttcaccatcatttttcaaaaaaaataacacacaatagtaaaataaattcgaatttttgctgacagggtagaaatccaagcattgtgggttgcaatttattgctgtcttttttagacaattcttttcccaactaaaggtctgccctatgttctacaagattctagagaactattga

SEQ ID NO: 82777 - DNA, 2346 bp, Oryza sativa
ttcagtgttgtcactgtgtcagctcatatcatatggaattatggatatcaattctttttggacaaaggttagacctcgtgcatgaatggcagagtaaatgggcggctagtgagagatcgatgtgtcgtcgtcagcttccataactggtaatcagttttccatatggctgcatgcatggcgatgggtcattggacgctaggacccttttcagcgtttctgaatctctgactctgaagaagtgtgtgatcttctgcaagcttgcatcgctcaactcaagtagataagccgctataatctaatagaatagtgtagcagcgtaaatctgtagtgaagctgcacttagcacgcctcctaattcccagtgctcgtgttatctatctgaaatgaaaaccccaagtggttcgtagtggagcaccaacttaatcaaatcaaatgatcaagtgctgtaaatgcatgcatccatgtatatgcatgcgtctcggtgttaattaggcagcgtctatttgcaacgtgtggcacgattagttgattgggacgaatggtatggggacattgtttatcagcctgcagactttgcgacgatgtgatctgactgaatctgccaatcaaatctgtagacgagtagcagtgtgtagtgctactgctgctagctgcatgtattgataaaagaaaaagaaaacattttccacaaccgattacatctcgtgtgttgagtcttacttggaaatttctaggcggttgctgtatctcgcagaaatataacttttttgttcagattttaaaaagttgtaattcataaaatgaattaaaagctataaacctatttttaaattttttttaaattgactacgaaccaattactcctctaaacatgctcttggaatagtctctcccatcagaaagataagcatcgtgacatcatatcactaaatcagttagtgcgcacgattggttggtgcagtgcatgcatgtacgacgacagtaaagaacaccacaagtcggctagcctccactaggccaggcccgcatagacgaacggcccatgtaaggtctgggtaaggctgaactgtaaacagttttgggcttttgatgggtaagagttgtcctggacgtcaggtcgaatgggctaggtcggttcaggcctgatgcactaccaggccctcccaatcccggcccgttttcgctgtgaaatttattgattaccaagtttttgtaaaatttgtatcaagttttaagttggactttaaaaagtacagcaacgctagctcatgcgtttaaagcttacactgcaagtgttagccttctagattgccaaaatatttctcaatccatacatgtaagaaaaaattacgttacgaagtactccctctacctcaatttgatcgtcatctaaatttttgatattttttaaatgatcatctaacaaaatacttatttgttatttgtgcaaagagtaaatttgcatcgcgaaatgccctaaatgcattcaactaatcaatattattttctattggtttaacccatgcaatatttaaagtgttaattaatttttgttgaacacgacgggacaccttgattgatgaggattaatatcagaatgatggatgttttggtgccttttgcttatgggataatcaaattgggatggagagagtacaaaccaaatcgatcacataagcacaaaacaaatactgcaaatgcggaagacacatatttcacatttgtgtggttaatattgcaacaatcaaaatatctatgttgaaatcatttttttcacaaatattagggtgccttctaacctggttaagatgaaaattaagtgtagacacacaaaacaagaaaaccattagcgcataatttattgagttttaattatttcaaactaaaaaaatcatttgaattttaaatcaacatcaacttctatatataatttttttacacgaaatatatcgtttagcggtttaaaaaacgagctaacgaaaaccgaggtaaattatgtcaatcataatattggaactaaaactatgagtctatgacaactctcttaaaaaaaaaactagaactaaacagcttctttaatttgaaagcaagcaaggagagaattggagaatgacacttctgcaagttaggagtaaaattataatggtatggttccaaattactttttttttcctgtcctctcctcgtctctctctccccaacctactctcttctcctgcagtccagctctcggttccttgctcctccaagtctccgtcggatccatcctcccctaccccgcgaaaccctagcctcccgagcccctcgccgccggcggatggcgacggcttgatcggccctggacac

SEQ ID NO: 82778 - DNA, 7849 bp, Oryza sativa
tcccgcgcacgcgcgcgcggcgcgcgggcggggcggaggggggagcggggagagaggcgctcggggcggctctcgcacgcgcgagcagcgtgagggcggggaagagagagagagagagagagagagagagcgggagagcgcccggggggagagggagagatgggccggggaagaggggaagatgggccgagcgagattcggcccatcgaccttgggggaggcaaaatagacttttgcggaggaatttgattggaaggaattggattcggagttgaactcgacgatagatcggggattgatatcttgagatggcacggacactagacaacaagcaaagaaacaaatttcgcaattagggtttttaagagataattttcccgctaggcgccacgacggaacgggcgctacagaccaacccccctaacaagaatctcgaccccgagattcagcacctaagggagcaggtccgggaactcggcgcggagaagatcttcttgctcccaggttgcctcgtcttcggaatgattgctctattggactttgtagaacttgatggtcttccttcgagtctgacgttctgcctcttcaagaaccttgatcggtctttccttgtaggtcagattcttttccagctcgatattacccaggggaacttgctcttctggaactcgaagacatttctttaactgggatacgtggaacacgttgtgcacatctgcgagaccttcaggtagctcaagctgataagccacttcgccacgtctggcggttatgaggtaggggccgatgtagcggggtgctaacttgccggacatcccaaacctcctcataccacggaggggtgatactcgcatgtatacatgatctcctttttcgaactcaaggtcacgcctccgattgtcagcgtaattcttctgacggctctgtgctgtcttcaaacgttctcggatcagcttaacttgttcttctgctgacttgagtatgtcaggaccgaataccagtgcttcgcccacctcattccagcacaagggagtgcggcactttcttccgaacattgcctcattcggcgacatcttaatgctggcctgataactgttgttgtatgagaactccgcatacggcaaacaacgatcccaagtgccttcgaaatctaaggcacacgcacgtagcatgtcttctaggatttggtttaccctttcggtctgaccatcggtctgcggatggtaggctgtactaaaattcagatcagttccgagggcttcatgcaactgcttccagaaccttgaggtgaactgagtgcctcggtctgacacaattttcttgggacagctaaatctacatacgacatgggtcatgtagagttctgctagtctctttccatcataggtggttttcactggcacgaaatgagctgatttcgtgagtcggtccacgattacccaaacggagtcgtacccgctgggggttcttggcaaaccggtgatgaaatccattccgatctcttcccatttccactcgggaatcggtaggggttgcagcagaccagctggcctctgatgttccgccttgactctttggcaaatgtcacacagggctacgtattctgcgacgtctcgcttcattccagcccaccagaaatatgccttgatatcttggtacatcttcgtacttcctgggtgaatggagtaggcggactcatgagcttcctttaggatgagatctcttaactccttcttggccggtacacagatgcgtggtccgcaccaaactgtgccttgatcgtctatggagaaattggtgtctttcttctcctgtattctttttattaattcttttatcccttcgtcgtctttctgagcctcccgatttgcgactctagggtaggctgtactgtcaagctggcagggacacctgactgtaccacggtcagtcttaacttctccaattctctgcacaggtgatcttggtcaggccgtatttgagctacattgcaataggccttgcgacttagcgcatcagcgaccacgttggctttaccaggatgatagtggattccaagatcgtaatccttgattagttccaaccatcttctctgtctcatatttaactcggtctgagggtgtaacatcccggcctagggcttaataggattaatagaatactcatatcaacaagttgcaacttcttttccggaagccaatctccaaagaactccagggttaagcgtgcttggcctggagcaatttgggatgggtgaccgaccgggaaattcttcccgggtgcacacgagtgaggacaaagtgtgtagaaaagacatgtgttggtctgtgagggcagtctatgacctatgaaagctatcatatgtaagcgggcccggcctgggggaaggcgggacgttacaaagtggtatcagagccgactctcgcggtttcacgggcgcgtgtgtcgcagttgcgcaggcatggtgcgcatggctggtgtagaccgagagtggttacacagcatggcacatgcgctggcactggacacatggacgtggccaagaaaggacgttcctggcctagggttgatcgacgggggcgtcgatctctcttaagggggtgagggtgtaacatcccggcctagggcttaataggattaatagaatactcatatcaacaagttgcaacttcttttccggaagccaatctccaaagaactccagggttaagcgtgcttggcctggagcaatttgggatgggtgaccgtgcttggtctgtgagggcagtctatgacctatgaaagctatcatatataagcgggacatgtgttggtctgtgccagggttgatcgacgggggcgtcgatcagtgtgcccgggtgcacacgagtgaggacaaagtgtgcagaaaagacatgtgttagtctgtgagggcagtctatgacctatgaaagctatcatatataagcgggcccggcctgggggaaggcgggacgttacaagtagttacacctcatttatgtcccacttacatatgtaattagtatgtaatttttaaatttacatttataattttagtacttacatatgtaattttgagacttacattgtatatacactaaaattacatatgtaatttagggacttacaatgtaaatacatgccgactattttttgatgaaaaatatgacgccataaatatagctacacccatgtcaaaaatcaatttcaaactatatttacaaattaagaaagaaaaatattcaggtgtgaatattaccaaatactagtatcatacattgaatctcttttttatttctcgatacatagtttttttagacttcagattttctatgtggtatatgtatgttgtataaatgctattaaatttttaaatatttttttcgtagctatttgaatgtttattttacaaacgaaagatttcccgagcgattgaaagagttcccttcttcaaataaaagaagagtttcccaaactgatgcccttttgtttcctccggggatactgttgtaaaaaaaatacgaggcacggcaccatgataaattaagggactataataacaataaaatattaaaatatgccgtcataaatttagcaaatccgtaaatgaaataaattgatcttcaatccgttttacagtacaagaataactcagtccttcgagctaacgggtcctcctcccttaacttccattgacaaatctgcagctcttccggacctccccctggctgcccgtcagcggctggatgttccccatgttgaccatggacctggcgaagctcttgaagaaggccttctggctgatggcgaagctgttgacgatcgccgccgtgggcgcgcccggcgtggacaggagctcctggtcggactggaggaagccgcggttcacctcgatgttggcgaagtagttcttgtcgaaggcgtccggcgtggtcgggtccaggtcgttcagcgccgacgagttcccgccccgccgcgggcagctcttcgccagcgcccgccggtagccggcgtccagcgtcgggtccggcttccccgtcccgctgaagttgtacagcctgtccgtcacgaactggcactgcaccctcccgaacgtgtgcgcccctgcccatttacattcattttcacccacaattttcagtttcagttgattgctattccctccgtttcaagttataagacattttaactttgatcaaagtcaaactgctttaagttgtaaaaaaatagtaatatttttaacacaagacaaatttattataaaaatatattcaattattgatttaatgaaactaatttagtattataaatattactatatttatctataaaattaatcaaagtctaacgttttataatctggttcggagggagcagtaggtagcgtcgtacgttatctccctatctgttactctgtttatttacctgagagggcgacgaggtcggtgacgtcgaggccgacggcggcgaacttctgctgaagggtggtgaggttgtcgcgggggctggggaggttattgtcggcgccggtgaggttggccgtggtgccgtcgcgccggccgaggggcacgcgccaccgggggcctccggactgcacgcattgacacacggacattgtgggcgtcatgtggccgtgttggagtaaagtgcggcacgaaaagaagggatttggtgtgggatctcgacgtctggtcgtcgacacagccgatgccacatgatgtgtgcgaggacataatccacgtcgtaccatgtggtctctgttttttggtgctcataggattattatttttttacagacggttaatgttggtgagattatgatctatctgcagcattgcggttcaattatttggcaccgacgtctagctagctttatgtctcgctccagtccagttcccagcccagtcacgggcatattgtaggctgtagcgtcaacctttctactggagataaagctagcacgaactactagcttgccagtacgttaatttgtcactatgctggcgtgaaaagtatgtgaaagaacgtagctaaactgcttcgttggttagcttccaatgaagttgacgtgcgattgttatcgggagataatgacgggtttacgtgcaaagcatatgcacgtatatatatcttcgcgccggcagatcgatttctcgcgagcgtacacataccagttcgacggagatcttggcggcgatggcgaggatgtcggcgcaggagacgacgccggggcaggcctcctcaagtgccgccttgatgtcgtccaccaccgggtacccccgcgccgagttgttgttcggcgtcgcgaacttctccgacacgatgctcgtgctgttgtccagcaggatcgacgcgtcgcaaccctggaaaaaacggaaacgtcgcgtcagacgaacatcctgcgtggcgcggcgtacgagtgcgcgcgtgcacgccggcaatggtgtggcaatagctagctcacctggacgaagcagtcgtggaagtggaggcgggtgaggctggcgaagatgcgggggtcgtcctgccgcgccctcttcagcacgcgccgcacgatccggtgcacgtccgggcacgtcccgtcgtagtacttgtcgcacagctgcgccgacgcgccggccgccgccgcggcgagggccacggccacgaccaggaccgcggcacgaaccgcagccacagcgcccatctctctctctctctctctctctctctccgctgcagccttgagctagtaacgtatgtacactgctcactccgtgacgcacaaatgagaaatgaccaagtgttaagtcggtgtgacgaagaagaaaggaagctggctatatatagacacgcacacgcgatcaattaatctgacatgtgtatgacatatctcgccatgcacaggcttaattgtttaagtatgacaaactaactagcggcacctttgcttgaacccgaaggatatataaccaatcattcgcggaagaatcgaacgtgttaacaacgtagatagctcttcggctatcgcggcgtcgttttcagagtgcaacgcatgcatgcatgctggtgtgcgaacagaaacactgtgctttagaatagtttcccctttgcatatggccttcccttccctgtgcgttcgttgggtgcacctaattctctcgcccgatcgtgtgtgctagtgccaccagattcaggcagtacaacgctgactcccgtttagtttcagtttgttgcaggtgcagcaatgcagcagctaagctgtgatgccttgactgcacggtccctcgctctccccatcactttctgaacgaataattgcagggccaatgaaagtagtagtagctggcaatatttggagccttcttcttccatcgatcgatcagagaggtggtcgttggctcgtttggaggggaatgatttctccggttgagtggttgctgacaactagtgctatatccgtacgtggtaagcatacacaaattaaggacaacgtacctgcttcttccctctgaatattttgtgtacagtatgtagcttgtacagagttctcgtcaaactaaaattaaactcctcaccgacgtttttccatgacattttagcgaatttttcaccctttgtccttctccaaactaaaaatctgcctgtcatattcaggatcatcaaggcatgatttttggccacatcatcagtcactgtatcatgcaccacgtaatgaaaaagtagttgcagtagtagtacgaaaaagctaaacctgattggatgctggagagaaggcgaggcatcgttctcggaacataagtggtcgatgatgagattaggtggcagatcgatccagaaatgcaaagtcaaaaatctaaaagtttctttgcaacggagtcgttagcattcattccggttttttccttgcttgttcaaggagctgcatcattcagttcggaggacgtacccgagcacctactgataaaaccatatggcagttgcatattctttcttttactctgatagacacagcgcgtttgtctgtgctctaataattggtgatacacccactgaaaatgcagctgcagattcgtgtaggacgagcaactttgcatgctaattgcttattctactcgtgcattggagagagaatcctagatagcttgaacaaaacgaaacatgtagcgctccacaacacattaaaaacgacagattcacacttgagtccaagaagacgatatagcttctggcaaatccaagatggggtcatggcagatgcaaaaaatctttgcctttttgctcatcagttgacggccctgcagttcttgcgaatctggccggcagagccggtgagagggctgatgttgcccatcttgaccatggagttgccgaagtcgcaggagaagcgctggccgttggcgctgtaggcctgcaccagcgccttggtggcggcgacggcggggtcgccggagctggagacgaggccctggtcggaggcgaggaggcccttgttggccagcaggttctggtagtagtggttgtcgaacgcgtcggcggagttgacgtccagcgccgccagctggtcagcgccgccgcggcacacctgctgcaggctggacgccagcgacgagtccagcgtcgggtcgacggagttggtcgccgagaagttcgccagccggttgctgaacagcaggcagcgagatcgcccgatcgtgtgcgcccctgttcaggttcagaagagttcagatcagtcttggattgattcgtagccaaacataactatattttgaaacggagggagtaacaaattggtgcagaaactagtttttgatctgacaaatgctaaatcatgcataatccacgtaaactgctatgcatgccacaccga

SEQ ID NO: 82779 - DNA, 795 bp, Oryza sativa
actgttcatgtcatgcaaatggaatcccagaacagtaaataaaggactaacaatatgctaatatacatatgaaaaaaacttttctgaaagaactgctgcgacttctaagtcatgtagtattttcaatcagttatgctatgcctgatgttgaacattgcaatctttaaactgtcaaacattccagcaaatacactacaggaaaaaggtatgcaacaggatctcatttaagctttgctcctaatgattccgataccatctggcacacaactaggaggctacagatcagaggacagtgagtacttgggtcatcggagtgcaagttcttagtttggataaagtggggacatggagccattctagttcatttcggtttttaattacatataccacatgaactagcaattgcagaaagttgtatttttagtttggataaagtggctcaatcctgaggcataccttcaatagcaggcaaatttgtgatgaaagacatcatctgtggagaaagtcttttcaatatttcatcaatctcctttgtatacccactggctgtggttgagaagtctgggcctgacaaaaataaacaatgatattttatgtgtgagaaaagttgacaattgtgtctgaatggaatggctggaagcatttgcagcccaaactatgaaaaaaaaaagttgtcaatcccatcaagtaacattatgcaattggcagattagatgttcatggtagcaattaaatgagataaccaagtgataataattttttgaccaagcattaggcagtgtaggctggcagcta

SEQ ID NO: 82780 - DNA, 2172 bp, Oryza sativa
ttccctataaaaggcagacattataacaaaaagaagatgtggataaagagaatatcataaatcatatgtcacctcacatcacataaataaaagaaaaggagaagaagaaaaaaaatattaatttaattcttttttgctctcttttaactcctctgaccagtgacccaccctcaccttcttcaagctccctcctctgaagcctcttcttcttcctctgattcctctctccttccatcagcttaaacctctctctctctctctctctgttgtgtcagtgtgtgtgcgtggcttcgaagagcaagaagctagagcttggcgagcgttgacaatggcggagcataaggcggcgaagagcaagtccaagtcaaagagcggcggccatggccatgacgcggcggcggcgtccaagaagtcgaaaggcggcaaggccaaggcgaacaacgccgcggcggcggcgccggcgacgtcgctggacgcgctgttcaggccgtgcggcgacgtgaaggggctccggttcggcgcccagctcgtcacccgcgcgctcaccgtgcgccgcgccgcgccgctcgagctcccgcacctcctccgcgtcgccgacgagaggcagcgggaggcgccgctggcgttcgcgccgacgacgacggcgtacatcccgaccaacttcgccatcctggcgcaccacgcgtggcacaccctcacgctgggcctcggcaccaggaactccaaggccgcggtgttcgtcttcgagtccgccgccatgaaggccgccgccgacgccgcgtggccgcaggtcgtcccgctcggcgacgccgggaggcgcctcatccgcgcggcgcccggcgcgccggagatggcgaggttcaagttccgcaagggctgcgtcaccttctacgtctacgccgcgcgcaccgccggcgcccgcggcttcgcccgcgccgacgagctcagggccgtcgtcgaggccgtcgccaagctcaaggacttcctggaccacaccgccatgctcgcgctgccggggcagaggagcatcgacgtcgccgccgccgccgacgccgcggcggcggcgccggtgggcgtcgtgcattaatgcattgatgcatttcggctgcttttgtgacgaactgtgaatagagcttttatttttctttttctttttcttttggtgtgtaataattaattaattgattgatttcttgatgtgagttttttggttgagatgttgagcaaattcctttgattatgccttgtcaattgctgcattggcatgagcagatgtcaagtaattatactagcttgtaataagctgataaatttagaagttttcaggtagaaaactggaaactgatctttgcatttttttttaaattttgactcctttttgtttagttttcatgctgtgatgacttgtgtatttgagctgtataattttgtcagagctctgttcttgaatctgatttactccctctggacggaggtagtattttgtattatgtgggaagccatggctcaagacacaaatttttgcaaatttatgtgcaatcatggctcagaagtgctcagctgattgtgcattatgaattgaatcttccaacagagatgctttaggtggggagagcatccatgttgaattgaaccgaactgaactgaactctctaattgcttcaagttgagctgtactttacagccatgagattctaattctacggtcactataaataattgctttaccaatgtgaattatgtgatttgcaaggttgaaaactcgaagtctgtcattcttgctgtcgattccagggcaacatttgtgtgaccatcatggatgaatgggagacctggacagctgcggggttgattccaatagagtgatctgtggttggggcggccctgtttaaggaggggttttagtagctttttctctgcttttctgctcctggagttctgttcctggggcgttaggaaataatgtacattctcgctttctttcttaatatactttggccggcaagttttgccagctcggcgaaaaaaagaaatacacagctcatctaaacaaaagctggagtccagcagtgagggccattgatgctttggaaacacagatccaagcatcaagaatgacaacctgtccatccaaaaggcagaggaaaaaagaacagatcaagaaccaaatca

SEQ ID NO: 82781 - DNA, 1706 bp, Oryza sativa
tggagtgcttcaggaacttctcagcgcagcggcggacgcaggattcctcttgcttgtcgagggtcttccggcggaaagtgtccacgcagtctgtgaagcatcgttccacgagggagttgtacattctcaaactgtgcgttgacaacccaaaaaagtcagcatctttcagttgtaatttgacaagtgaaaggcaaatcaaagagttgatcagaatttacacatcgagaatgattgaatgaatgacataactttcatgaacacgggagaaagcatcggtaagattgcacagtgatgaggtagctgattgaaaaagcatcaaagaacacatgaaacatactaaagaagattgttttactgagctattttattgtactctatcttcagaaccatcctgtttattgactccattggttttgcctatgtcatgcatggtgacaaaccagctaaaaagacaatattccaagttccaacctatgtggttagttatcatgtacatgaacttaatggaaccatcccatcaatagacttcaacatagatttcgcaagctctgcaacaacaacaaaacattgaaaaataacatctacatttacatttctggccacagcatacagaccatgaacagaacttagctatcagaagagacataggtgtagaactagccatcaaatgaatactgccaaaccagcccaaaataaagtgcttctactcgcagaatacacttggtcacaacagcaactaggcatcagtatataatactccatactttcctattagagattatgatcaccatggctaatttgagtaaatatgcaagtaaatgaaaagcatccttagctgatactacaatcagacgggcaaataccaaacccaagcaagaaaactgggaccgaacacacaaggatgcatctttcagccgcactacagtaataaccaacatacataatcctcactacaatcaatctctaaccgcacagctgaaaaattgtagaatcctaaaactaaatccccgtggattcggagtgtgtaagttcaccaagatcacacaaatctgtcagaattttccgcacgcacaacacaaacctcacctcgcaccgtatagtataatcgcgcgcacaagaaagtagccgcaaatcggccatcccgatcactcccatccatcgaggccgcaaaaaaaaactaaggaggcaccgccgaacgaatcccacatgcaagcagagcagccgcaatcgaaagaattcattcgttaattaacatgtagtgagggggcgcgggtggacctatcgcggatctggagctggtcgaccatggccgccatgcgcatcttgtcctcctccgggagaccgtcgaggtcgccgagcatgctcttgtccatcgccgccgccgccgccgggagaggaggaggaaggctagggttttggaggaagagaggagaggaagcgagatctaaaacctcgggaaattcctttttattttctttttattgatgtaatgggcttgttttaattgggccgggccacatgggcttcgaaattaagcccagtatgagaagtgtgaggcccatttgggatggaatcccacaagtttgtgtacaactcgaatgaattcttgcagataaaaaaaacgattctagtatatatttgttgacaaattttcttctaaaaattttgtcaaatgtaaatgtagtataattgtagcttacatttaa

SEQ ID NO: 82782 - DNA, 1559 bp, Oryza sativa
gatgttcaaaggtggcttgccttgctcgagatctggagcttgatcctcgaaattctcgcactgcgggtcttcgggttccggaactacacgcgaaacgggacaactcaacaaacggcgaaaataaagccctattaaagacctctaagcgtgccactagatagatctcgagatttgggaaattttagaagttgaacggagtcaaacggaattacggttgggaagatattgaatttctaagattattggatttttggtctaaaggaaaaggatttaattaaatcctttttgaaaaagaaaagaaaagaaagaacagagggatggaaattagacttttcctcgggcggctagggcgcggtccaaggtaaatggagcggctcggccgagcttaacgggccggccggcccaagacggcccaagcgcgcgcgcgggagggaggagagagagtccggtggaccgggctcaccacgcgcggtcccgggtgggacccgcttgtcagcggctcggctcaccgtgcggagggagtacgtggctcatgcgcgcgggcggggaaaggacgcggtgcacgcgagcggtccgtggtggacgcaggtgcggcgggcccacgcgcagcctcacggctcgcggtggaacgcgcgcacggggagggactgaccggggtcggctcgatccggtctaggctgagctggcgccgacgtggcgcctacgtggcggccacgtgggctggcgggaggtagacgacgacccggcctcgaatggacggcgggcggcggcggcgagcggcggagcgaaccacggcgatacgggcaacagcgagcacaccgggcggttgcacgtgacaagggaaggcgagccatcggctcggattcgccggaggttgctcgacggcggcggattgcggcggtggcaaccggcggcgggagaagagggaaacggcgacgaggtcacgagaggtcgattcccggcggtgagagcatctacgcggcttcgggaactcgacgctagcgtcggattgggtggaactacgccgagcgaggccggcgacgagcgggtgctacggagctcgagcggcgacggcggcgaacacacggcgaacgacggcaacggtcggggcggcgccggctaactacggggaggctactcaagctactaccgaaagctagggggaggagatggagcgaggaggaagaacggagagagacatcaccgagaagaggaggggcgatgtgacgagaggccagcggcgcgggagtaatctctccggcctcgggccggggaagaggaaggagagggcacggccgaagtccccttccgcgtcctcgaacgcaccggctctcccggcgcttggcgaaggacggcggaggcgagacagagcacgggggcggcggcaacggtgaggaggcgaatgggagaggaagggaaagggggaggcttgggtttataggatggcaatgtcggtttgggaaccgacttagggcggtcaagggcgcgagctggcgctcggcggtcgcggccaaagcggcgacagggaggatgacgccggcgaggaggaaaaaggggaa

SEQ ID NO: 82783 - DNA, 1067 bp, Oryza sativa
atggcttcaactgaatataacttcaaatcaattgtaagcagaactattggggctaacatagtattcttctatgatggaaagtacatcaaaatcatcaaagcttatgacagtttatgttgacaaatacatagcaaacatattcagaatcaatagctgaagatcgaacgtacccgcagccaccgccgcatccgcaggaaccgcagttgcaacttccaccgcacgacatcttgatcgtctgggtctcttgtaaactcttgaacttgtatagttggatgaaatgagagattgaaagcttgatatgaactcagctcagatatgcccccctatttatagtagtagtacgcttgagaataagctgcacaattatttgcaagcattatcatgccagaaagatgtagctggttgaaatggccttgaaaaatcattatcattcattgacgtcagttttctataggcatttcccggagttttaaaaaagcatatttgtttggggtgcaattgcgtcattcttagttgaagatagtattgataagtgccctaaaatataaaaatattgacgatttttatatacgccctccgtcccataaaaaacgaatctaatactagatgtgacataatctagtacgatgaatctggacatatgtatgtccagattcataatactaggatgtgtcacatctggtactagattggttttttatggaacggagggagtagttgcttacgtgcaaaggttgcattattttaattactgttaatctgaaccaagtttctggacaaatgtgatccaagttttggccaggttcaaatttgctttcacaccatgatgtcaacctttgcttaaggtcgacgccttgttgctcatatttaaatcaaacaatctgaataagtttcttgtatgaactggatttaaactttcatcacgaaaaaccgttgaatttgatcaagttcttagctgtttcaatcatgcatcagtactatgatgcagaccctttgcttaagatagatgcattattgcacagcttgaaattgaatacgtttcttgtatgagttgaattcaaatttct

SEQ ID NO: 82784 - DNA, 1088 bp, Oryza sativa
gcttatccgaataagttattatcaaataaaagactatttatgtgcaaatcttttatatacatattcttagcgactcaaaagcaaatgctttaaaataaagtacaataagaaaaccaaaaattcaaattcaaaattaagttctaaaatttaaactttggcttataggaataagcataagccaaataacgagacttcaaacacgagctcgaattgtcgtccagctttacttcaaatcgggcaagaaatgatgatggacggaatcagcagcttcgatcatcctttatttcagttggcatattctttttgaaagtaaaattgattcttatggattatttgtaacggtatcctgataatatgtacgagcatgtgtggagactaacttgaaatcatgctaacatgtctaaggaatcgtgccatgtaatacgaatagaatcggatgatctatgcaaaacgacgtacgtgatatccgcacgaactctgcaagtttcattcgcttgtgacggagcgtggggctcctcaccgggagaccgcgcaggcccccctttgccggttcggccgggggcgctgagtgagattcttcaccctcgatctatggaacgttcgcgagagagcaaatgcacaagacacgggcgatgtatacaggttcgggccgctgagaagcgtaataccctactcctgtgttctggtggatctgtgtgtgaaggagttacagagcaaatggagagcaagagagttcaagctctagaatccctctttttccttctcctctggttctttttctccctcgatctccccctcttccttctcctctagttctttttctctctcccccctctttttttctcttcttaggtgggcaaagtcctccttttatatctcaaggggataccacatgcactacttctatctactcttcttttgggtggggacccaccctatcttgaccaaatattcactcgcgcctccgcctggaagctaaatcaccgcttgtccttgagtgatgcccagcgccgtcactcgtcggacacaggggatcaccctgtcatttcttcattaatgggaggagatctgcaatggccgctgtctga

SEQ ID NO: 82785 - DNA, 1056 bp, Oryza sativa
tatacatatgtttttttatacatatctatacatatatacatatatacatatatacatatatatacatatatacatatatatatatgaatgtgggcaatgctagaaagtcttatgatatgaaacggaggaagtatttatctggttagatacaaatcatgcttgcctgatgacttgcatttccaacatgtggttcattgaaccttaagcatccagtcatcatgtaaccacgggaagttggaaaaataaaaggattggcaacaacaggagagcatggctaaaaggcagtatctacttccagtcaaggctgactgcttaacctttctcccctttttctcatcctatgttcacacttcccacttcccagtagttagtagtatttaatcacctggctgaagattgtagtgtacctgcaaacaatttgtttgggtgtccttgtccctgatttattgggggaatggatccatcataacttagtttattgattaggtggttatggctgcatcgctttatgtctcatctattgtagtttaagcgcatagtgggcatgaattatgttgccttttgtttattgtccattattatcacgatcgattaatgttgagtgggaacctaaataatccatgattaagtgccactcagagcagcctctagtgctgtcgggcatgactttatggtagtgtgattgatctaagcctgtcttgcccaatcaaactactattacagcctgacacgattgctgttactggttgtctgcctacctgtgtagcctggactatcttggagcgtatggtgacaaagttcttatttttggggatattttaagattgaaacaatatatggttggtgccctagtcgtggatatcagcatcacggtcatggttactgtggatagtggtaagatgatgcagacattttccacggttgatatttagcttgagcaagtgtttaactatgttattgtcttatgcgttgtcgtgtctactaataggtgcttaggtagtgatggattagtgttgtttgctgcctattgtgtgattaagctgggaatctcacttt

SEQ ID NO: 82786 - DNA, 1525 bp, Oryza sativa
  unsure (1)..(1525): unsure at all n locations
gcgatctaaagtatctaactgctcgatacatccatgtcttcacgcgataatgtcgacggcgtctgagataagatactgctatattacgctggctcgccgcaatcatcgcgggcattgcgggcgatctctgccgctatatatntgcaagaaatatttgcattcctccgncgatatatatttccattccgcgatctccggtgatatacattgcaagaaatatttgcactcccccaacgatctcacggtgacacaagaaatatttgcaatcgctaataataaacgaataaatcaaacacacactacacactaccatcatcgtcgcgtcgtcggtcgtcacagcctccgtcgccgccattgtggccactacgaagaagcgtggtgaatttaatcaaccaccaatcatcaattaataacttgcaaaattcgtcgacccattcattcgttcatgtgcatttgtaaggcgtaatacttttaaattacgatgaccgcaaaaaaaggggcaaaacttgaggaaaacaagggaaaatttgtaaattacatgccaattaatacgagcttaattacgtatgtgcttgcaattgctgattttttttcaagtataagcctgctaatatattaaaacgattgttgcgtccgtaatattcgagccgattaaccaaagttgtcccaaagttattaggccgtgatggcaaaaggtagaaaaaaatactgaagagcatcgatgttttaatctccgaaccctcctaatttgaaaaccaagaaaaataattcgaaagggttcgattccaccttagtcatcaacatgggccaaaacttccgtgtctgtgtaaactatgggcttttaatctagcccaatttctaggcttggttggttccactatggatacggcctaatagcaccaagtggattttggacgttgcacactgggtctaaaatcaccgcactgccaatccaacatgatgagaaaaaggaaattaaaagaaaaagaaaaaggtccaaatgggggtcgaagtttttatctccgaaccccgcagatgttttttttatgcgatccagcgatctaagtatctaactgctcgatacttccatgtcttcacgcgataatgtcggcggcgtctgagataagatactgctctattacgccggctcgccgcaatcatcggcggcattgccggcgatctctgccgctatatatttgcaagaaatatttgcattcccctggcgatatatatttgcattcccggcgatctccgatgatatacatttgcaagaactatttgctttcccccagcgatctcacggtgacacaagaatatttgcaatcgctaataataaatgaataaatcaaacacacactacacactaaacactgccatcatcgtcgcgtcgtcggtcgtcacagcctccgtcgccgctattgtcgccactaggaagaagcgtggtgaatttaatcaaacaacaatcatcaattaataacttgtaaaattcgtcgacccattcattcgttcatgtgcatttgcaagg

SEQ ID NO: 82787 - DNA, 15667 bp, Oryza sativa
attcctgcagcccagtcagtgttgtttttcagacttcagatattgctccttacgcatactccgttacaatattccatttgtcacctatgactcttgggtggttaggatgcgccttcacgcatgatgccactttggtcaccacagataatatgatgtcgccaaagaactcgatctccttcagctttggtagattctccagacctgaaatcccatacttgggttctcgcaggaatgacaatgtcagcctctccagattagtcactgaacccgcatcgaactgcatcttctctatcctctccagattatcaatgatcaacagcttgagcttcacgaatttaccgtgacaaaaaactatgcagttgtcagcatatgatttgtgatagagcttgaggcagagcagatttggcaggtccccaagaactcctatggcatcagcatggagttcggtgcgacgaagagcaaacctggatacgtttcgaagcgatggtatccatggaggtagcctttccaactcaccggccaggctaaacttggttatgaatagaggaggcgactcaacaaaggctagattatccagtgataagctgtgctccttctcatccagagtgtggatggagagagagcgaagagggccaggcaacttgctcagagactcaaggaatgcgttccagttctcttccacaccgcgcaagagaacattgagctttgtcagattttgcagcaggccaatttcccgcagtactggcgatttatccttgactactatatggacaagtgattgcagagccaccatgttcttgaccaccccagtcgccacctccaaacctgaagattgtctcaagaacttcacactggctgtccttgtaagctgtaccttgtgccccgcaaacaaatgcttgagacaactcaggttgcctgcactagctggtagcttcttgataagagttgccctaatgtccagcgtctctaggtgtttcagattccctagaagatgaggtaatttggacacgttggtatttctgaggcttaggtacttcagctggaaaaacctgcacatacaatgcaaagtttcgttactcaagcagctgcagccttgcaagtcaagtactcttaataaccgtagctgcggaaagaagaatgggacttcctcaacagaagcagacatcgtgaaggagcgagcatgagatacattggcacttgttttttgagacgaattgtaactgctgtggatggagaggcgacggattttgtcatgggaagccaatgtactcccattgtcacataagaatgatgcaaagttctcctcaattgacctggagacaatgacatctaacatcaaatcatgaactctgcagctcctcaccttgccagtccaatcagtcctcacaggctgcacaatgcttctagccacaaactcatcaaagtaactttctgcaagctgttccatgctttgtccatgcctttggctgacgaaaccttcagctatccaccttctcaccaagggtcccctcttgatcacataattttcagggaaaatacttagatacaagaagcaggccttcagatgatagggtagatcattgtagctcaaggttaagacttgcttcactccttccagggtagggttgttttcaagttcagatcctaagttgttacaaaccttctgccactcctccttggtcctatttgtcttgcttgcgagaaggctgccgatgttcactattgctaatggcaagcctccacatttcttcaaaacggaatttgacacttcctcaaactcatcagttggtgatttatcatctgcaaaaccaaatatcttcttgaagaacagttctcgtgatgtcgtttctgatagtcgctggatattgtaaatccgatcttggggacgagaacagcacgtgttggccacatctgcattccgggtggttactattatcctgctaccctttaagttgtcaggcaatgcacatctgatgctctcccatgccgatacagtccatatgtcatcaaggatcacaatgtacctagaagaaacagttcagtaaacaaaaggaaacgtggtaacagataggattagctaggaacaacccccccccccccccaaaaaaaaaaaaagaataattagcagtaaatacgcctccttttcctttgcatcggtaaaaaagggaaaacagaaaacgaattgcaaacaaataggtgaaaagtccttcattgcatacgatgttttttctcttttacactggatagtgtaacactgtaacctatttggatctttgttatatttttcaggtacacatgccttagatagtggaactttcaagattcatcaatactaaatagtggttgggccctctctctctctctctctctcctatatatatagatagatagatactagaatagtagaagaccttacagatgatttctccatcacaactcgtaaaactaattttctggctttgaatggttcacattgaatccaaattattaagccaactctaggaaattgagactcgatttgtatgatggccttgcattttgccaatggtggcttgagccaaatctctgtatctggttggttctatatgaataactagttgtctctggttctagatgtgaaggttttatctgcaatctgttggtttgttttctgctcccttttgaactatgtaacatggtttatttaatggaaatgagagggacctccttataaaatggatatggtcctatatttaagttaaacacacttatgttttggcaataaatacacaatttcaaattaaattgcctgacagttaattacatccagcaactacctcaaattgaataccaactggtcctataaaatggagacggtcctatatctaagactgccattttgacgttctacttcaccataaccagcaatatctcaaaagaaaatatggattatttttaaagcacaaactattatagttcactatcagggaggaataacaaaaaaactctggcataccttttgtcttggaaatacctcctgagattcttagtcagtgctgcaacctcccacctttccattccctccaggtaatcatctgtaataaggccatgcttgcatcctgctattgccatcgccttgtgtggctcctggattagctcccttaccatgtgctgaaaaagtgccctgatgttgaacgtctgtgaaatgatgaacaatggacagcactgaaaatcagcactcttcaccacagggcttccacacaccatccttgccagcgtcgtcttcccaaggccaccaaacccgacaatagcaagcacacgaagccgaaggtcctcttccatcagccagctgacgagctcattcctaggctcatcgatgccaaccagctgagcctcctccgcgaagagagcatgcaactgtggatcgatatggagagaggcatgcctggtgagtcttggatgtgcttcttcatgtgtggcctttgctagctccaccccgtaccttgaacgccggtcaccgacatcctgagcacgggccttcagttcttgtagctggagagcaattcggtgacgacaggctagcttgcgaagcatagatatgagcccaccaaaaaatcccatttctgatgactcccctaggttatggatgaactcatcaatacaatcctcagagtcgtaggctatctccctcacctgcttcatccagatcctaacttggtcgtcatgaatctgtgatatggtcagattgcgtaggaatgcattcatgcactcgagctcatccttgatgtactgtatctcaccatggacaccctgcaccagccaagtatcctcagttagaaggcagccaagcttgcacagcaggctcctgactgcaccctccgtcaaactgaagacagcaccctccatatcttactatggagcatggaaatggaaacactgctgctgttgaagttaggatgctcaggttatatttgtaagacatttggttagctaatggtggaagaataagaacattccagaattcagaccatggttttcctggtcaaggagacatgcaatgacaaggagacctgcggttcgccgctgatggcaaacagaaccctgaaacatgctgacaaggcaacttgacttcatgtcttacaagcctgataagcaaataatagtattcctgtggtgcataagaatatcataaaaagttacaactcatagaaaaagtcaatcagtacggaaaactcattgctgtatgtatatgtaagaggccaaaggcagcttaaaaattggtaaaagatccagtaatacttagagaaggtataaaagcagtggggaagagtatgaacaagtgataccctaaggtttgttacattcatagctggatgaaagggtgatccaaacaagtacccagacaaggacaagcagcactgaaaagaggacagaaaacagctaggtaactctgacattttgacaacacaactcatacgtgaaatggaaagaaggcggtataggacaacagtcgtatttttgtgatgaatagcttggtaagattggtaaagtatttcgcccgccttcttacatctgacctatgagattagagtgctacttgttttaacaatgtgaacattgtacaacaccatatataaagcagagtgagaaaactatggtagcaataagcagatgaacactaacataatcacagataggacgtggcgacagcaaagcaaggtttagttaataaagatgaaatgcaagtcaaagtattgaagcatattatatataaataatcaaaactgttagctagtgtgacacaatgaactgtaaaggcatatatgcaagtgaagcgaagttaacatataagagaatagtgcaggaaggcaacaagctactcgaggtggttccatatactttacagcttaatatgcaccgatcgcaattgcacaaataagataacaatggttaaagcattgcgtgttccccttgtaattttgtataataacctagtactagtcaccttgaaagaaatggcgatgtcgacataaatgcagaaaggcaatcaagcaaccattggaaaaacaggcacagttaccagcatcatcttgactgtagtgtttgactctcttctttttccccttaaagatttgcataaaagatgaaaccgagccacagcatatccagtcctgtgaaagagactccaggagctcaatggttccatttgagagcgcaaaagaaagttgacatggaagaagacaaatcaagcaccttgattgtgaagcacttcagcgggggccgagtcgagcaagacctaggagagcttggttgttacacctgcgacatctctgatctctcccttgcgaaacattcagggccagctgctcgccgccgctacctagtcaggcccttctcgtagactagctgggtgacgcatttcatcgaacacatgaagcacagagccgcccacccgcgcgcgctcttcgattagccaccaccacgatccgtgcttcacccggctcccttgaatcttctgcgcatgcgcatgcgcatccggccggaatctctacccggcacgtcctccgccgccgccatcgccggcgcggagggctgcggctgcggctctctctctctctctctctcttttccgaaagagacagtaaggacgcgtacattcataaggcgtcaccgaacttcataggcgtgtgcctcccccacgtgatacagaaatacgccttccaagcacggatgtgtgttttctacttttgtttaagtcatgctcatatgctatccttaggtgaaaggaaaatgacggtggtaatttttttagaacatttttttttaaaaaaatacagtacaaacgtagccctagaaacgtgcgtgtacttatctttttaaaggaatcaacacgagactatactatttcattaaaatagaaggaaaagtacaacccctagggataaaactatacaaaactgataaggcctagatacggtttagtagaaaatcccgtatcctccttgctcccgccatagcccaagttcctgcctcctcttttatttttgccataaggctaaggtcgcaatctccttttgttcgaaaacctgctgatttttttacttccagatttcccaaactattaaaagaattagggtccgcaggcttttcttggacacctcatttgtattggctagcatttcccaccaattttggacgctatggcacggagcccagtgacaagggtccacctattggtaggggcacttatccttataaacacacagcatatctctaattctttataagcacccctgaaagaccaggcatgtatatcttgataatgacaaagtctccacaaacgtctcattgttaacgggtatatcatctatccctgaaagaataaatatccataaatacaagcactcgtgtcaagcctaaaatttaaactcgaataggcaggttcaatcacaagaaacctaacaaagtagttgacaagcaaaatgttgtgcttatgaaataggagtacatttgataagtttaaactagcaggggaggcctagccacaacctgcagaacactgaagcaaacgcaagcttcagatgaaatgcttcttttactgttttacacctcaattgtacaccgtcacaatgttccatttgtcacctacaactctcggatgatttggatgatccttcacacatgacaccactttgctcaccacagatgatacgatgttgccaaagaactctacctccttcagtttcaggagattgttcagacctgagatgccatccttgggttctctcaggaatgacaatgtcagcctctcaagattaggcatcgatccctcattgaaatgcaacttttcaaggttcaccaggttatcatcgatcagaagcttgaccctggcaaatcctccctgtggaaaaacgaggcgatcatcagcatatgatttgtgatagagtttcaggcagagcagattttgcaggcctccaaggacatgtatggcatcagcacggagttggctcctgcgaagagtaagcctcgagacgcttctaagtgatgctacccaaggaggtagactaccaagcttgccagtcaggctgaagctagtgatgaaaatgggaggtgacactaaggaagaaagcatctccagtgatgagatagagatgtttccttgtgcgtcgaagatgtcaatggagagtgatcgcacagagccactcagcatattcaacaactccagaaagggcttccagtttacctctataccataaaagagaacactgagcttccgtagattttgcagcaaggcgatctcctggaacactgatggatgttcttttatctctacatggacaagtgattgcagctttgccatgtttctgatcactccatggctcatctttagacctgaggatggcctcaaaaacttcacactggatgtccttgtaagttgctctttgtgccctgctaacaaatgctttaggcaagtcaggttagctgcactactaggcagcttcttgataagtgtctctcttatatccagtgtctccaggtgattcagattcccaattaacctcggaagtatggacacactggtgtttctgaggcttaggtatttgagctggaaaaatctgcagatgcagtccaaattcttgttactcatgcaacggctgccttgcatgtccagcactcttaacaaccgcaattgtggaaagaagaatgggatattgtcaattgaaggtgacattctgaaggtgcgaacatgagctacactgttgcttgttctttgagctgatgagtagctactgctgcggatggagaggcggcggattttgtcatgcgaaaccagttcggttccattgtcacagaagaaggatgcaaagttttcctcaagtgacttggagacgatgacttcaagcattatatcatgaaccttgcagcttctcaccttgccactccaatcgattctgacaagatgaaccatgctcctgctcacaaactcatcaaagtatctttcaccgacctgttccatgctcaatccatgcctctgggtgacaaaaccttcagctatccacattctcaccaaaggtcccctcttgatcacatgattttcaggaaagatactcaaatacaagaagcatgccttcagatggtagggcagatcattgtagctcagagttaacacctgctttgtgccttcaagagtaggatttgactcaagttcagagcccaagttgtcacaaaccttctgccactcttctttgctcctgtttggcttgcttgcgaggaggctaccgatgctcactattgctagaggcagccctccacatttcttcaggatggaatctgaaacttgtttcagctcatcgtcgtctggcgctccggcatccgccatgccaaagatcctcttgaagaacagctcccgcgatgccgcatctgagaggcgttggatcttgtagatgcgatcttgggggcggcagcagcaggtgttggcgacatcctcgtttctggtggttactatgatcctgctaccctttttattatctggaaatgcgcatttgatgctctcccatgctgatgaagaccatatatcatccaatatcacaatgtacctatacaatgtaatagttccacatatatgaacaaactcggcaacaaataaaataattaactacatatatgatctgtttttttagctactacctgctactggaaggaaattttgtacaaccggcaagactgagttgaatagtagtaaaatcgagtttggttcaactaatcaatagattatgattctctaatagagaacaaataacccgagcaggagaaggttgaacttcatcaaacctacctaataaaactaataggataaattcaatggaagagtgtcattgttggaaacaattttgtgttactgtaactcattaattctccccctatattataagacattttggtttttctaagtcaaacatttttaactttaagcaattttatagaaaaatgtagcaacattttgaacacaaaacaaatatagtatcaaaatatatttaatgtttgatttaataaaactaatttggtattactacggtttttctataaagtcaaacttagctgaagtagtgttcttagttacttgaacattttctttttcttagtatagtaatactaatgttctttttcttagttgttatagtaatactggttagtatagtagtactacattgttgtaactcgagaaattaagttgaacaaggaaaggaaatactcctcgcgtttcagattataagtcttttttgactttgatcaaaatcaaactacttcaagtttgaataagtttatagacaaatatagtaatatttacaacaccaaatcagtttcattaaatcaatagttgaatatatttccataatatatttattttaggtcgaaaatattactttttttttacaaacttaatcaaatttaaagcaatttgattttaactaaagttaaaacaacttataatctgattataatctgaaatgaagggagtactaaccttttgtcttgcaggtattccctcagctttgctggcgagcgctgccgtctcccacctctccatcccctgcaatgcatcgtacgcgacaaggtcgccgccgccgccgccggcggcggcgacggcggccattgccttgcgcgggcgctggatgagctccctgagcaagtgctggaagagcgccgtgatgctgaacgtctgcgacacgacgacgagcggcggcgagcactggaagtcggcggcgcccttcacccgggggctcccgcacaccatcctcgccagcgtggtcttgccgagcccgccgaacccgacgacggcgagcacccgcagccgcggctcctcctccatcacccaccccacgagctcctccctcggcccgtcgatccccaccagctgcgcctcctccgtgaacagcgcgtgcagcctggggtcgagccgcccggacgacgacgacccgccgccgcccctgaccgccgccgccgccagcgacaccccgtacctcgtgcgccgctcgccggcgtcgcgggcgcgggccttcagttcccggagctgggccgcgacggagcggtctcctcctcctactcctagcgcgccggccagtaggcggacgaagcggcggagtgaggccacgaggcgaccttcgtctccggcggcggcggcggggtggctgcggccgcggacgaacacgtcgatgcagtcctcggcgtcgtaggcgatctccctgacctgcttcatccagaccctcacctggtcgtcgtggccggcggcgtcctccggcgacgtggagacgctgcggaggaaggcgttcatgctctccagctcgtccttgatgtactgcacctcgccgtggacgcgctgcgccggcgagctctcctgcgcgagcacgccggcgagcttccggaggagcccccgcacggcgccctcggtcaagctcacaatggcgccctccattgatttcctaacaccaaacgtctgaaaaaatttgcttcttaaaatatataaacatgttgaattttaaatactagctatctccgtcccaaaataagtttatttttcatctatcacatggtaccaataaaaaaataagaagactagaatactcatattttatcaattctcaatgcaattattcatcaattatctactcccagttatccctccgtcctataatataatgtgttcacgtattttaagattctaacatttaaaacatttgagcaacacttagtatatagtataaaagtataacataaaatgaatttatttgttaaaaattatattattagattgagatttaatttactttcatatgctacaaaacttatagaatatgagaaattagaagctaaagattagttttgaagactgtgccaactttgaccacgttttatattaccggatagagagagtacaattattccttactttcacaaattccgatgcaatgattactctaaaaatgaacttatcttgggacaaataaaatgagctaaaagataaacttaatatgggacagaggtagtataacatttgggctatcctctcatattaatattttttatacaaatatgtaaaaatatgatgcttaaattacttttaaccacaaaataagtcatgacaaatatcaaatgaatggtcggacaccgtggtgaaaagtcaacgacttcctatatttaaaaacgataatagtaccagtagtgaccatcaccctatatcattgcaatactgtgtggagagagagttgcgcaaaaatatgccatccgaagacaacctaaccatgtaaacaatttcacaaagaaacgaatggaatcgagaggattccccgctcttacaagcaaggtaaatacaatacagagttgtactttcaactactcttgacaaaccaactcagcttgtcttcttaggaacacaccctgaaaaactatcaatacatactgtccagctggttacactacactttctgcattgcttgaaataagcaatgcaaactacttcccaaaatgcaagcatttctggctttaagcctagacaagcttgactagattcaaagctagaaatacttatatttcgagatgaaggtacaagcattgcccaactagctagctgaacctgaacaccaaaaccaaacaggcctctagaagcaatgttgtttagagcttgctccttaagcgtactccgtcacattgttccatttgtcacctatcactctcgggcgatttggatgtgccttcatgcaggatgccactttagtcaccatggataatatgatgtcgccaaagaactctatctccttcagcttcagcagattctccagacctgtaatcccatccttgggttcttgcaggaatgctattgtcagccactcaaggttagggactgagcccttctcgaagtgcacattgcgaatgttctccatattatcaataaccaacattctgagcttcaaaaaattaccatgagcaaaaaatatatggtcatcagcgtaggacctttggtagagcttgagacagagcagattgggcaggtctccaagaactccaatggcctcagcgtggagtccagtgtcacgaaaagtaatcctggacacatttcgaagtgatggtatccaaggaggaagcctctgcaacttgcctttcaggctaaaatttctgatgaatagaggaggcgactctgcgataagagctagatattccagtgatgagctgtgctctttctcatccagaatgtgaatggagagcgagcgaagagatccagtcaattttaccagagactgaaggaatgcgttccagttctcttccacaccgcgaaacaagacattaagtttctgtaacttttggagctggccaatttcactcagcaccgctggccgctccttgaccactatatgggcaagtgattgcagagccatcatgttcttaaccaccccagccgtcatctccaagcctgagtccggtcggaagcacttcacgctggttgtccttgtaagttgtaccttgtgcccaactaacaaatgcttgagacaactgaggttgcttgcactggctggtaatctcttgatacgcgttgccctaatgtccagtgtctccaggtatttcagatttccaattagtcgtggtaatttgccaatattggtctttctgagtgtcagatacttcagctggtaaaatttacagatatagttcagagtactgttgttcagacagctggaaccttgcaagtctagtactcttagcagccgcatctgtggaaagaacattggaacttcctcaacggaagctgacattgtaaaggagcgaacatgagatacgctgactcttgttctttgcaccgaattgtgactgttatggatggagagacgacggattttatcatggcaaaccaatggatgtccattatcacacaagaaggatgcaaagttctcctcgagcgacttggagatgatgacttctagcatcatgtcatgaactctgcaagtcctcaccttgccactccaatcaattttcacaggttgtacaatactcctggccacaaattcatcaaagtaactttcggcaacctcttccatgcttagtccatgcctttggttgacaaaaccttcggctatccacctcctcaccaaaggccccctcctgatcacataattttcaggaaaaatacttagatacaagaagcaggccttcagatggtaaggtagatcattatagctcagggttaacacttgctttgcaacttccagggtaggattagtttcaagttcagagcccaagttgtcacaaatcttctgccactcttccttggtcctatttgtcttgctcgcaacaaggctgccgatactcactattgctaaaggcaagcctccacatttcttcaaaatggaattcgagacttcatccaactcttcatttgatgatatatctgcagaaccaaatatcctcttgaagaatagttctcgtgatgcagcatctgatagacgctgcattttgtaaacctgatcttggggacctgaacaacatgtgttagccacatcttcattccgtgtggttataattactctgctgcccttcttattgtcaggcaatgcacatctgatactctcccaagctgatatggtccatatgtcgtcaaagatgacaatatacctacaggaaaaaaagtacttatcactttatcagtcatgaacctatcatagaagataacagtgtttcttacccaaaacaaaaaggatagaaggaactacatatattttatataaaggagtgagcacattaacccacgattagcaaattaaggctttagggatgatcctgattttaaggggaaaatatatgtaccttaaatacctttatttgaaaaatacgaaaaacttagaagcctttctcttggctaacaaaacactttctagttctataccagttctgcatcacatccagtgagtttatttacagcaaaaaaaaccacctgaaagtgctatcagccagtaatcctggtacacagcataaaacttggtgatacgggcaacagtagggaacagggtggaaacaacctttccattcctatgtagagcagcacagggaaggtcgtgcaccctctatttctcatttagacagcctttctatgtgagcagagatcattggaaatcaatggtcaagatctgacataggactaaattctcctatttcattgctgaattgaagtaaaaggtgcatgattgtctttgattaaaccttttcgcaagcaatgcatcaatcatctagatatattcaccaaagcaggaaaaaggggagtctaacagataatcaattaccagtaaaataaaacaaaagcactagttaccttttgtctagcaaatactgcctaactttttcagccagcactgcaacttcccatctttccattccatccatgttgccgtccattgtatgaccgtgcttacctcctgctacagccattgccttgttcggacgctggatcagttcccttatcatgtactggaacagagtcctgatattgaatgtctgtgacacaatgaacaatggacagcagtgaaaatcagcacccttcaccattgggttctcacacaccatccttgccagtgtggtcttcccaaggccgccaaaaccaactatggcaagcacacgccggcaaggatccgcttccattacccagcggacaagtttatcccttggttcatcaaggcccaccagctgtgcctcctcagtgaagagagcatgcaactgcggatcaagatgacgagatgcatgcctggtaagccgtgggcctgctccttgaagtgtggtctttggcagcatcacctcatagcgtgaacgccgctcactgacatcctgtgcacgggcctttagctcttgtagctgcatggcgattcgatggcgacagcatagtttgccaagaatatagattagccgataaaggaaaccaattcctgatgactcaccaagatgatgagtgaactggtcaatgcagtcctcggcatcataggcaatctccctcacctgcttcatccagattctcacttgggtgtcatggtcctccaacacagtgaggtaccggaggaatgcattcatgctctcgagctcatcttttatgtattgtatgtcaccatggacaccccgcacgaaccaactctcctgggagagaagggagctaagcttggacaggaggctcctaacagtgccctcagccacactaaaaatagcaccctccatgtctaactatgagcatggaaatgcagatgctgctgctaatgcagttgtgttccctaggccacacacgcacatatatataaggtatccaatagactaaatttgaaagtgatagcaggataagagcgttgcaggcaatagtttcctagtcatttccagttctcaataggctacatttggactccagcataataaattgtacaaagggaaatatgttgattgcagtgttagctgatgacaaggcaatgaaaaggagacttcaggttcataaggtgatgacccgaatgatgaacaaacatattgacatggcatcatgacttctatttgtttattctattctccatagcaatttatgataatccagacgatccaattcacatttccactgccactatatacaagccaccttactgattgataaaggaatcataatctaagaaggtgc

SEQ ID NO: 82788 - DNA, 4256 bp, Oryza sativa
ctgtctgtccctgctaattaagcgaaacgttgcccgctaattatctccgttgtcgttaatttttaaacatgtgttccaattatgaaaattgctatacgtaggacccaactgtttaactcacgtacaactgaatttgattaacggttgcaaataattacaacgcaaatgaacatgttttcctttgattgatctatagttgcatgtctctagttgtatatgagttatacaactaggtcgtatgtatagcagtattatttgattattcgtcttttaaaaagattttattcgtcttttagaaaagattacgtaagcatcatgtacctttttgttggttgttttatcactaaaaatattttaaatatggtttatatcttacgcattcacacaaaatttttaaacaagacaaatggtcaaacatgcgccaaaaatcgataacgtcatttatcaaacaaccgaggtagtatgtgtatttaggaatgcctccttataaattttaatactcccactgtctcattatataaaaggtcctcatcagatggctaaatgctttggctgatcagccaaagctgcctccaattcagccaaactacaatgcatattggttagcttattttgcttaaatggctgatcagtcaaagcatttggccatctgatgagaccgaaatatttttctccttccgtttatctcaatatatagtgtattttgaattctcgaggactgaaggacaggagacatcaaatctactttaatatgtccatgtccgcaccgtgtcctctacggagtttttataaatgtttgtaagtgtcaagtgattcaaattatatgtttaaacgtgatatgtataaatgaccgtaaaaaaatacatggcagtggtgacaattaagtcccacactaaaatgtacgactctgacatttccgtcaattgtaacccattgttgtttttttttcttttttttatgcaagtagtttattcccgacatgtatctctatggtactatcttaaaatgggaataatacgttatattatgggataaaaagagtacgtgtttgaaagacgatgaagactaataacaaccaaactaatacctccacgtacataaccgtggccattataattcatatcaaaatgcacgttactaccgtctaccgttgagtctgacgcaattcaatcaatcaagaataaaaatataaatcaatttgtactggaccaaacgcaaacccaagttccagcaccatcgtttcgaaacggtatatttgcaaattaaagtgatctccgaataaaatttttatatacatgtttttagatatctaaaagtaaagtttgaaaaataaatttcgatgaaaaatcttaaaatcagttttaaatttaaggataaaaatttaaattttagctgataacacgagcatgggagaaaagatgaggagatgaggtccttcgactttgtacaccacacgagctcagccagtacacgcgacggatgagccgaaccgtttcatcccggccgtccgcgtctaatccgacggcggccgcggcggcgccagacttggccaacggtcgaccacgccgccgacgcgcgtaacctacttgcgccgacgccgccgcgttatcctactcggttgcggcgcggggacgggatggcgtccacgctttcctctccttgccaccaccacctctcctactattatagccaccaactccgacgactgcggctacgcctccgcccctccaccggcgtctacggtcggccgtcaggttcttcgatcgcccgcctttccatacccattccttctgtatttcattcttgattttggggggaagatgggataaacaattggttatccagtagataacttcgttgatcgattgacgtcgatttttatttttattgctaatggagaagaagctaggtgatattaacttgtttgtttctagcaacatgagggtacaagatctctttcagttttgacacaaccaaatgagcatccaaagtaacactactgtacttagtatcgcgatgttcttcaaaatgctgtgttaatgaaaatgaaatagtgtgctgacagttgattcatgcagaacttgacagtggtagagaactttattcccatccaacgttcgggggaagccgtagccgtgtgtcgcgttcatctttcatggaaaaatcccaaagaaagcgaggaccagatcatctgctgattcttgtccatggtatcattgcaaggtgagtatatcctgtcacgataacatagcacctgtctgaaaatgcatagcaagattgcagtgctagttgttcctgtcacaattctttcttgagctttgctgataaatttccttcattgttctcccttttaatgcagccccagtgactggacctatggagaagcagtgctaaagaagaggttaggtgacaattttttcatctatggtaggtatgacatatagggatcacctgcccattcctattggctttctgacaaaattgagcttaggatcagatgtacagactacagaatacctatatttttaattagtactgcaagatgaaattcacaccacttcattactgtagctacattggtttgcactttgcaaatgagaacaattcgtttctagccataaaacttacagtgaactatatcattgcagctagttcgtcaaatatctacaccaaaactttcgatgggattgatgttgctggaagaaggttagcaaatgaagtatgtactcgctagttagtcctagcaaaaggtttcaagtattcacctttgtagaaactgttgtctgcactcatggctgcgcttaagagggctctgacgaaaatccgctatcgaagcaggtattggatgtgattcagaagatggctggattgagaaagatttccttcctagcacattctttgggtggtttgtttgcgcgatatgctatttctatcctttattcaacagcaatgaaggatgcaagtcaaagtgctgcttgtatagctcctacaactggagggtctgaaaagttggagtgcacttcaggattaggtgcaattgctgggctggaaccaattaattttattaccttagcaaccccacaccttggtgttagagggaaaaatcaggtgggtctctaaatctattaaattatctgatacatttttattcccctcaaaattagttctgctggaagcaaaaactactatattggactttgagttgcctagtaagattttagtataaaactattgttgcatagctaatcggaggccaaagaccagtaaccaagtactacttctgaatatgttgtgacttgtgatcaatgtattaattacatgcattttctgcaataatattaccagcttccatttcttcaagggctatctattctagaaaagattgctgcacctttggctcccttggttgttggccgcactggtgcccaactctttctcacggatggtgaacctagcaagccacctcttctgctagagatggcatctgatcatgaggataaaaaatttatgtaagtcataagaaaggtcttaaggctaacttattatagtagaacatatcttcttcgttcaaacattgtagtagaacatattgtttcttcaatgttcctcagatctgcactagcagctttcaagaaccgcattttgtacgctaatgtttcgtacgaccgtatccttccttactcctagttagtaccacatgatttcctctgcctgatatgcaaacgaatttttttttgctccaaaccattttctattttgctgctcttgttttcttgaacatatgccagatatggtcggatggcgaacatcttcaataagaagagaaaaagaccttacaaaggtgttcagtgatctccactagaatttgattagaaaccaaattgcagcactgtgtgaatacttcagtaatttttttcctcctccatatgcagccctcacatcgttcactggatggctacaagcacattgtgaatatggaatattgttcgcctatatcatctgatggccctcatttccctctgcaagctgccagagccaaagaagctgcacagagtagaccaaacaaagaaaacactgaagaatatcacgaaatgatggaaggtgagtaggacctttttcagtagactagtactatgtgctggatcttgatgtctcccttgtttctcactctatgaacatcaattctgtgttctggtaacagaggagatgatccatggcttgcagagggtcggttggaagaaagtagatgtcaactt

SEQ ID NO: 82789 - DNA, 12313 bp, Oryza sativa
gatccccccgagccactgcacctgtacccgacgcgcgacgcggcacaatgcccgcctcacctgcacgtacgccatgcctcccacccctccgccgctccgcgcgcccatgtgtccaagattccggaaccgacgacgtacgtcgacgtacgtgagccccccccccccccgccatggattcgctgcctatatatacgcacgcgatcgagctgatcgatcagtgtagcgatctacgagatgaggccgtcgatcgtgctgttcggggactcgatcacggaggaggcgttcggggagggagggtggggcgcgcacctggccaaccactactcgcgctccgccgacgtcgtgctgcgcgggtacagcggctacaacacgcggtgggcggccatggtcgccgcgcgcgccgtcgtcgccggcgcggcgggggcggcagcgccatcagccgccggcaccgtctggttcggagccaacgacgccttccttcccgggcgcgccagggcgctccatgacgtgccgctcccggagtacatggacaacactcgcgccatgtgagccctgctcggcgacagctggcccttcgtcgtcgtcattctcaataacccggccgccgttcacgaaggcggccgtgtccggtatacacaatcgctctcatcttgcatcaatttatttggttttctcgatcgtcgaacacaatgcaagaatggatcaccaatggcgcgccgccgcgcgcgtgcaggtaccagtacgtcggcgattgcgccggcttgccggagaggacgaacaagtcggccggcgcgtacgcgcgcgcctgcgtcgaggtgacggcggagtgcggactgagggtcatcgacatctggtccaagatgcagcgattccccggctgggagagctcattcttgaggtaatcaaatcaaagcaaatcaagcaaacacctcatcaccttgttcttgtgatgagctgctgagagcaagtttagtactgtagctaactactagcctcaaatcacgttaacaactaatttatataataattatctataaacatatactacattattaatatatgatcccacctatcatatatacattatgttttggagtccgtgtttcaaatagctacaaatctgtagtttgccttttattttctcttctattttctcttctcaatatgtgtttataattggtttatagtttactgttatacccgctctgatgaaatttggcgcgaaatttgaagggacgggctgcacctgacgccgcgcgggaacagggtggtgttcgaggaggtggtgttcgcgctcaaggacgccagccttggcctcgaagcgctccctgccgacctgccgctcttctgcgacatggatccaaacaaccccgtcaagtccttcgacgaatgactcatcatcgcaaaaaattcgcattactgatttgagaaagagaatttgaattccttttcgttgcgttttttttaatttacggtgctatttgctggagaaatgtttgaggttataaatgtctcggttattattgttttgattctttagaaagattggatgaataatacatgtatcgaccgtattgtcatgtaatgttttctttggacaatgaaattcaatacacgatcgagctgagctttttttaagataagagctcctgcttacgggccattacaacaagttcagaaacaatgatagcaacacacggctaatggtgaaggtacattgtttaatttggtggacttgcttgtaaaccgttgcaacttttgtcattctgaccatttcatggatacaaggattgttaggagaaatgaacagcccataatatgtttttttttaaataagggaggccagaggacttcgccgggcaaaaacaaaccaaataaaaaaatattggtacacgctgtgaattggattaacgtccaaaatagcctaatcaaatcgtttctcaattcatacttactccctctatctcaaaatatgttaaccaagaatgtgactagtgtcagacgtaacgtagaggcggagaggtctttaagcctccactgtttgaaccatggaagcactccaaaaaatatatatatattgccacacctccattgaaaggcggggcttggaccttggagctctattttagtttcgagataattttgttcttgtctccactttgatgtctaatattgattttgcccttgttttttagggttttcgtttttacccctacttttttgaaacgaaacaactatttgccccagttccattaattcttactaatggtgttaaatgtagggttaaaaagacaattatacccttagatattttccggtacttttgacaatcaaaacacaaattgataccatactatagcagtaatttaatttgtcaaaattttgtgaaagtttgccaaaattccttatctcaaaatagggcaattgtgcaagtggtgtacagaagtatcagaatcgctctctctctctctctctctctctctctctctctcctgtcctacccaattcccaatcttgctctcaagccgtagcactcagcatcgcagcggccgggacaacggcgacgaggcagcgcaacgcaacggcggaggaggcgatgaggcgtagatcccccccaggtggaggtggtgaacgattgaccgtcgacgatagaccggcgatgcgccgaggcgcggccgagcggagccacaaggcagcagagacgacatcagggccactgtctagtgtcgaaggctccaagtccaagggggaaattaatttcaagacttcaaggtacataaaatttgaaatcaatatcaagtccagttgtgtggtaatagttaaagttcagtgctcagttaaaatttgaaatcaatttcaagtccagttgtgtggtacggagtaatagttaaagttcagtgctcagttaaaatttgaaatcaattttatgcttgatttaatgctttctgttgctactttgctgctcacatctcaccaactgagtcctataacaaacctcactcatcaaatccaatgatccagaatcatctaatccaacgctttagatcgtcccacgttacccctccccctccgcacgcacccctcctctctcagatcaatttcaatcgcgccgccctcctctctcggtcactctcctccccctcaaccgccgccgcatccgccaccgctgcctccacgtccccgatccacgctgcgccgtcttctacgccggtcgagatctccgccgtcgtcgccacgcacagccacctgagctgccccctccgaaatcgccataccctgcacctgagtcaccgaggtccgcgccgccaaaactccgtcgcgccaaccctccatccgctatccccgtcgccatcggccacctcctctacggctgtccctaccacgaagactgcctcctcctcgcttgcatcgtacatttgaaggtttccgcctcctgattctatccccgatcccccaaatctctaaccccaactctttgcagttcaacggagaaggccggtgtcttcttggtccttccgttctgatctccattcctttactccaattcccattctctgattttttttctttgttatttgcgtgtgagggtgggcccaccagtgattcaagggtattcagacgtatacccaagatttttgaaaaaaaataagtatatatactccatacctcgtatatgtattaaaaaattaaagagaaggctaaaacttctcattttgggtcctgttttaccatttcttctctattggatctaaatttcccacttccttccctcccctttcctctcagcccacactcagcttgggccgcaactagttcatttcccctccccgcttaggcacagcaaacccaaatcgggcaaaccactgaggacgtgcgcggtgcggcggcggcgtctgggcggcggcgactgcaccggctgcggcggcggctgccggctgcgtcggcggcaggcggcaccgaggcgagtaggtagcgcgtcgggtaggggtgggcagaaaaagaccgaaccgaaaagaccgagaccgagaaattcggtcattaattcggtcctaggtagtgaaagaccgaattttgttcggtcaattcggttagtctcctcggttaaccgaatggaccgaaaagaccgaattatcaaaaaaaacgtctaaatgcaacatacaatccactatgtttaataggattaaactctaattttcacatccctacttcttctaggcatgcaacctaacaagagtctttactcataagtgcttacaaattttttttttgatttttgtgttgaaaattttcattatttctttgcatatatgaaaatgttcttgaatttcggtcaagactgagaccgagacggaatttgtcggtcctaacattttttttcgctgaaattcggtttttacttttcaaagaccgaagacggagactggaattttcggttagaccgaatgaccacccctagcgtcgggcgtgcggcggtgactgcagtccagtctgcagcgtgctcgtcggcggctgcggcgtgcgtggcggcgtcggcggcaggaggcgccgaggcgtgcaggcggcgcgtcggcgcgtcgccggcgtgcaggccgccagtccgctaggccaccacacaggtacgcgatgcggcggccgaacgaccacggctcgccggcctggcatggattgcgtgaggggcttgattcattgcattgatttgttctaggtagttcaatagtagttatgttttctggcggtgacggcttgattcattgatttgttctttagtagttcaatagttcactagcactgaaggattcaacttccttagttcctgtcttctttatttttcagtgtcaactgttaagtgtatatttattgacagattgatagtataaagctgtaaatattaggaatttagataacttagaaccataatatttaattttcggagtgtaaaatttatatatatgatgatagtatgaggctatatatgagctgctgttaggaatttagagaatttagagggggtgttttcttcgatggactatataaaaacaagaagcaagatgagcaacaatctacattcattggaagagaattctttttacaaggtaaaggatgaggacatcatcactcatttttaaaataccaagcatcgaaaagttctcctctaaactgtaagagttttttttatcattttaccattctccatcctttacatgttttatatgttgccactttcatatgtcgaataattagtacttatatatgttaaagaatttggacttatgatcaattctaccaatttataaagttatggccaattttgtgttctatatgctataatattatacaattagtaatgtgtgatattataccaattaattattggacttctggaggtaaaaagaattttgttttacccctacctattttgaatacccaacctctaaatcttaggcccaccccttagatatatgataagttcatttttgatgttcttattaaattctcaaaagtcttagcattgatctgaactctgatgaacatgttttctatatttggctttgttcaaaagattgctacctttcagaaggcatcttgttatcaggtagtgattcacctaagcatgttgctcatggtagctaagcatgttaccatcataattgtaattcagtacgctcaactgattctatgataaataatgaatccatttcagaaatatataataataatatatatctttgcttggatatttggttttcaagatatttcaacatttgtattgccaacatatatatccttttcttttaattgtttgatttacacgcattacgatattgtgtcgttgcattagcacgtgcatgttactagtattattctagtttaagaaacacaaataatgagattgcaagtcagccaaagaggctagagcagaagttagtcatttggatataattagtgacccagggattcgaaaaccaattgaagattatccacgtgagcatcgcattatctattggagaattgttttgtagggacaaaattgcttgcctatttttaattttatgtatgtgtaaatgtgtagccaatttatacatgaaacatgttaatttttttctagattcacccttgttttcagccgccatggacgcggcggaaggtggaggtggcggccgaggctggggtgacgccgtggttgcgctgccgtcgacatccgcagcagcaatggagggctgagagagggcgctcaccccgatgatagcgtacaaaggggaggaagaccttcgacttccagagcggccagggtttggttcaactggaagggaagtggttgtcaccaccaaccacttccatgttggcgtcgagaacgccacaatctatcagtataatgtaagtttcttcctcacagtcgcataatattctactcatctttagttcattttagaagcattcgcttatttcatactactactaaataaatcttgattttatattgaacattcaaagattcgttttttaataatactagttgggtgcccatgcgttgcaacgggcaaaaaaaaaaactatacattaattttaaattacaccaattgaaatgatgggaaataatcattgagaaattttaatatagcacaaacaagaaatatgccataattttatagtcttcatatattagtaacacaaagagcaaaaatggttgaataaaacgctcgtaaggaagcacaaccatgtatgtaaatatttcaaatcatagttgtggttcaaattttattgtattggccgtaatcgtgaaactaaatagacaaaaccatccatagatatcacaaataatttttttttccaaagtcttcttaatagattgtgattttagtaccgacgaagttgactacaaatcttagtacattccacaatgtgataaattaatttttgagcatttttttccactgacttcatgattaggtttctatgaaccccgagccaaaatcaagagctaaaaaaggagaggtactttcagagatggtagagttgcatgaggagatgacttatgactgcaaagtgcttgcctaattgatccaggctgcttatgggcctctgccttctgtcccaatgcccatgacactacaccctccttttgagcagctcatcctcaagctgcaacacgatctttgttggctgagacaactccctaaacaaggcctaacatgactcaagccatgcagccgctgcacattgcttcaatccatccgcctctgaaaatcgtgccgatgcatgacgaaacaaagccatctcacctggaaatcgcgcccaaggttgtgtcagccgttgcgccgcaatcaccgcagtcgttggtgctagaggttgtgagccctaagaaacggccctgctcgtggcatcaccctgcatcgcggtcgccgacgacgacgtcgttgccaagtccaacgtcgaggttgagggcttcctggacctggccgttggtgacacgaatccacctgcctggacaacttgaagtgacgtggacacggtagtggttgctgatgccgtgtgacgatgaccttcgtcagatttgttgtgtctcctgcttcttccagaggtcagccgccatcttcgcccgaggcgatggtgccacagccggccttgtcatcattatactcagcaccatcttctgctgcactgccacctcttgctccatcgcgaaggctgccagcgggaacggctgagttgaaggtgcagtggtcagagatgttaacatcgtgtccacaacctgagtagaacttgttgccggtgccatgaagtcactagtcaagccatcgccaaacgacgtcattgctgtcctccttgccgaagaagaatgttgtccatctttgcctccaagacatccagcatctctaacttcttaaggatggccgtcagcttgtcatcgatcgacataaccacaggcgtaggagattctaggggtggggaggggggaggggtggggggaggttcttgtcaggttttgaaaattcgaggggagagatgtctggttttgagtttagaggtgttatttgtactcacctaatagttcgggtaattcgtacttttctcataatttaataatgtacatcttttgtgataaaaatgctactatatactctctccgtttctaaatatttgacgccgttaatttttttaaatatgtctgaccattcatcttattcaaagaaaacaaagaaaacaccacattaatatacatattgcggagagatacactattatcgtctgttacaaacttggtcattcttgtccttttaggccttcattactaaatacagagatgatcaaaccatttgtgtataatacgaagcatagctaatcttcttcctttttgaaaggggaagcatagctaatctgattgttcaaataatggcgaccacttggcagtggccgaaatctcaagaccgtccatacaactagaacagcctccacttgcagtagaactcccctcgttctgtggtacaaacgacatactcccaaacaacacatcctcagtgacatgctcaaggagatcattaacaccaccaccatgactaaagctcttatcatttgaagggctgttatacgtgaagaagcgaagcaacagaattccatcaccgtccacgcataatgtgaccgggggcaacttgccaacgctcaacttgccgtcaaatatcatgaattgtccccactgtacgcagtaacctgcaacaactgtaagtgaatcaaaacagttctctccgagatcgagtacctcaagctccaatgtgcccagtactgccttatcaagggcaaccatctccagagcaacagtgccacaatgaccagtgtcgatgtgccaacggtatctatgaagttctgaatagaacgatggggcatacatagaatgcccgtctatcaacactttatcgtctttcctttcttgacccttaatgacaaggtagtattcgatcaacataggcccaactgcatatatgcctctaggtggccaaattagaggccgtatcttattagagccctgtgcagtaatttgtgaaagaaacatcaaagttattagacatacgtgcatcaaatgttacaagaataaaatgaagtattaattctagtgcctaatcatctggtacataaaacacttgtcccagagataatatattggtgttttaaccactaatccctccatttatgaatataactgttggtgtctattactattttgactctgaccgcaaattactcttaaatgattagagtttgatgaatgagagcttcacgtttgtatatatttaagatgccatacactacgaaaatatggtgtacttttttttttctttttgcgacaagtggacaaagttaaaaaatgaataattcccaatgtcagttatttcaaaaaggagatagatttatgtcaaagtttaaagagcacaactacagaaaaggaggggacccttttaagacaaaaggtataaacaaaacaaacttagtcatgaaatctctcaccggccgaagcttatatggtttgtccctcgagtattgaaagacatgattacgttgttggttgtttcgtacatctctaaatgcaaatataccgtagatctccattggttcatcatggggggacgatacattcaaatcatacacctggattgcacgccgacaaggttcattcctgtggttgtatccatttacccaacgatttttccactttggcagctggggcactgcaacaggatttcaataaactagtattacagacacaaacaccgtgagtcattaacttgtatcctgcattctaaacattatacaaaatctgtaatcaatatttgtaaactatacttccacatgttatatgtaaagatatagttcaaacgtaaaaattaagttgttcactagaaataataataactaaatggacaaaggccatgtttggtgagattgagagatcctgggtagctaggtaagaatatggataaacaggggctgcctagcttttggtagctactactaagtcttagaatctccagcaagcatctggattatttgagagaactggatatgaagctctcctaaataggatctaaaaattgaaggaaaaaaaactatatatgatcatttgtgatttatacaataccttgcttatataagattaataaatactccaattatttactagaagatgtagcatgttaagacttacatagatgctccgtcgacaggatatctggatccaaatgacatggcccttcaacatgtagagacccctcaaaaataggacaaaagaaatcattttgtcgttgctttgcaattgatactgtgaacttcatttgctccataacctgattctcccatctctcctccctctcagcagcgtagtaaggatttccatcctcgtagcggaattcataccagtatccgtcgaaagaatcgcattcatctggatcaaccgagaattcactttcggactggtaattatcttctcgagggcaggcccagcctggaagtgtcccttgccattcagattcttcattcagaatagagtccatgtccttgccccagagccaagtgttgagcacctcacgctccaattcctccctcatcatccccaaatcccggtccaaatcgtcagcctctttctcctcctcctcctgctgcgaattcccgtcaattttactaaaacctactcccgacattgattcttggggggatttcagccacaaatcaacaagaatcgcgaagcgggacgggaccaaaaataatttgaatgcctaacctttcctccgtagcttgttggccccggctgctctacggattgggattgcgattggaaagaagcatagcagcatcgagtgtgtgtatgtacagtacaggagcaaatcgcttccaacacggactctgactctgagatgcattgcgaggcggctagggttttccttcctttcacggacgggaaagcagaggcttttagtgggcccagcccagcccagcccagcccaagcccgtacaagctgagctctttctcattgggctacatctcagaaaggcctgtttctgagactcggctcggctcggagccgacgtgcctccaccaccactcgtcgcacgagcttggcgaaggtggagggagtggctcgtgggcttcctccgcggccgacacggcttggcgggtgggcgggcagagccgcgtcgggtagcctcctggtggggcggagccacccccagctgcaacggccccagcctcacaaaggtgacatagggtgaatctcagccctagaaagtaaatccaatggctaagattcgtccacataatcacgagttaaaattttactcccaatacctgaaaatttactcctagtaaaatttttactcctaaataaatctgcgagtaaaattttaactcatgatgacgtggatggatctcagcagttggatttgttttggagggccgagattcacgctatgtcacattgtgacatgcctaccttatgtcacccaatcccaatccgagggagagagagcagtggaactgaggaagagataaggtggagactaaggataacatgtggggcccactttcattttttgctacatcagtgtctagtcagcacgagtggatcgggtcaaattgttacgtcaacaaaatcagatgtatatactgctataggatccaaattggatggttttgtatagtttaggggtgaagatttctggtattgaggataatggatgtcaaacaaactcagtgtaaagttgagtgacggcaggtgaacttatacctttacttgggcatcgggttgcaggaacggaagaggaggaggaccaacaacgcttcctcctcaagctcatgccttccacaaggaccatcatcagcgtcatcggtcggtgttcgcgtccgagctacatagcggcaggcaggaggcggaggctgacacccatgacgacgggttcgctggaccaccacaaatttctaaggctctctgatcaagagcccgaggagtaggttctatgtgagttttatttttttatgtcacgccatccaaaactatactcaacactgagacctaatgtgatatgattttataaggttatggatgtgttatatccgatattttgatttatgggtgattttgaaattcgacgacatggaacataaaagtgaacattttctttatcccatgtaaatagttaatatgggcagattgtcgtgaaggccgcctacattaactgggtgccaatgcaaacatcgtaaaaatggcacaacacgtgtggtcaaataatttactcgggcagtacttctctatgtctgctcaggtaataa

SEQ ID NO: 82790 - DNA, 11407 bp, Oryza sativa
ccagaactgatggccacagcaaaaatctaagggcatttacattgatggctctcagtctaggccaaagttttccacacatgaagatccatcagaagatagcttcccacttccttttacactatgctccactatctcgctgcatccttcaatcgcaatcttttgataaaggacaaaaactacgaaaataaattccgtagtagttcttcaccaaaaggaagagatttcataaggaatcaccgagaaggaagagcaaagagtaatgaaagaaatgagattttacacttcctccggtcttcaaattcggtgtggttaaagcaagagtagtcatcatcgagccaaataactgttttttgctactctgatgctcacaaaatagctgaaagtaggggataaaatgttatataagtgttggacctacgagaaaatgcgagaatctactggaagaagccgcatgtccagaggtccccataatttatcttgcatctcttcagaaaagaaagcttcaggtccacttaatggtgaccgaagtgacttatctttaaagctagaagagtgcaccacaaataagtaacgaaacaataaaaatattatcttttttattccaaggctgaataaaaatgtgtctctaggttttggctccattcctgacgaacgcaattccatatactcaaaagataaacggcacaagtacaggagaaacgcgctggctagctagcctgcttataaacatgctaccactatccatagcatcaagaaaggaacgaatatgttgtatggctggataaaagtaaagtaagatgatttggtgagaagtttgtagcttacttgcggcagatcatcttgtcctggttgtacttgcgggcaagcgcctgaagcgacggctcgatgataccgccacggagcctgaggacgaggtggagggtggactccttctggatgttgtagtcagccagggtgcgtccgtcctccagctgcttcccggcgaagatcagccgctgctggtccggcgggattcctgccgacacaaacccccatgagctaccgccgcaaagccacagatgaaggaggaggaacaacaagaagaagagggtgtagtgggtgcgtaccctccttgtcctggatcttagccttgacattgtcgatggtgtcgctgctctccacctcgagggtgatggtcttcccagtcagggtcttcacgaagatttgcatcttggcgccctagctgctgcttcttcttcttccccggggctctctcccctttgtctctctagctccttgctgctgcggcggcggggggagaggaggctggatgttcgccgatttatacggtgcgagctagggtttggtctgaagaggaggggagcgtggagtgtaagacgggcagccgaaatggtccgcacaatccgagggaatagttggcccagctgcgcctctagttagtgggccgggcaagttcttgccgaggtagatgatgatggaataagttcccctaccatccctcaactttacgtcgagtctgtggtgtccctaatctccaatatcagaaatcttcaccccttaaatgttcaaaaccgtgtaaaataggtctcatatcagtatatatgggtgttttcactgacatggcatcccagttagcaatctagacccacatgtaagggagacgaataaaaatgtggggtatgcatcccttctttcttctcttttctcttttctcttctcttttctttctcttcgccgtagagaaggatgtggaagcgggtggcggcaagaccacaagagtctagagcgagtaggcagagcaacgcgcccgcgtggagcggagcaggggcgccagcggcagagaagagagcgactgcgggcgagcgcggcagcgggcggcggcgagcggcttgctccgctcaccgctccgccagctggcttcgcctgcttcatcctcgcaactacctcaccgccggccatgccattctcctacgttgctatggcctctagctctgcgtcctcttctcgcaagccggttcccatcgccacagccagcgcccatcgattagttccattgccggcagcggcggcggtcgtggcggcacctacgccctcgccgtcaaacctagcacggtctccgagaccccttctcgtacttctccggggaagatacctatctcaccgcctccgatctggtggccgcttccgtcatctcctcccacctctccgttgtgggggatggcgccgacctctccaaggtcgggatcttcctcaactccacggcgcggcaccgctctgtaaatggcatatgggctctgtaatttttttattccttctttgctgactaggcggatgccatgtcagcaaaaccacccatatataatgctatgggacctatgctatgggacctattttgtacggctttgaacatttgagaggtgaagatttctggtatttgagattagggacctcggactgactcaacgtgaagttgagggacaataatgaacttatcctatcttactataaagttataacccactaattctaaagctcaacatgcaaagatgtcacatcataatacattaacaatatatcacatcatcatccattaacaattattacatttaaacatcatacaagcatgttatcttatctataattttataatttattaaattttagagtttaaaaatgtaaacatgttaaatcatcactccaaataattcacataatatttcaatatatatcttcatcatttatgataatatcatatatacctatatggtacatcctcacttagttagtgttatttctctcttctcccattaaatcatatcacatcaattatttttagccttaaatgattaatctatggtccaaactatctcactccctttattctcttataatacttcaatatcttacttttacatttgaatcgtctatatactatttaaatttaaattatcataaaccatatcaacttatgtaagtatatgttgttagccatcttacatattatttttacttattgttatcatactgaaatcccgcagcaacgcgccgggtttcacctagttccgtagatgattggtcactaaaaaaaattaggaaatgccttttttttttcttcaagaagtaaacgttcttgtactagttagatgcttagtttgagttgattttttcagttatacagactcataagaaagtacgtgaagatcccttctaatcatcagactaattctatgtcacgaaaattacttatagcagtaagaatccaagaccagttcatcaactggtaaatactggagcagttggaggcctgaagaaggtgcaaggcaaaacacctgacaagccaaatgttgcacgcttttgaaattatctaatgcgtgtgtgcagagtataatactaaaaggtttactgtttgtactaataataatacaataaactaacaattcagcgatttctggccgacgagttgctctctcgagtaatcacctctatctggtcacgatcaagaaattagaccccttctgtcacatcagcagatcagctcaagtgctcaaccactacacaagtacacgatcaagtaggcaagtagtacgcgttggcgttggagggagtccacacatcattgcacgaaaaagcggcgtctgcaactaccgtagccggaacatgtcaaacctcgttcgagccctggtatataaatacacccggcgacgccatgtccgctccacgaacaacgcaacaccaagcttagctaatctcacagtcaccgagctgaggtagctggcgagatagatatagctagcacagagagcaaaaatttcctagcgagatcactttaattcgccggcgtgcatggcggcggcggcttcggtggtggtgttgtgcgcgctggtcgtcctcgcggcggcggggggcgcgagcgcttggccggtgatgagcccgtcgtactacgaggcgtcgtgcccaagcgtgtacgacatcgtgcggcgcgtcgtccaggaggcgcgctgcaccgacccgcgcgcccccgccagcctcctccgcctccacttccacgactgcttcgtcaatgtgcgtacagtgtgtcctaggttgcgtgccatgcatggcgtttgcgtgacatatttgagctgggattaacgtgtttgtgtgtgcaggggtgtgacgggtcgctgctgctcgacgacttcggcgcgatgcagagcgagaagaacgcgcccccgaacaaagggtcggcgcgtgggttcgacgtggtggacggcatcaaggctgccctggagaacgcctgccccggcgtcgtctcctgcgccgacatcctcgccctcgccgccgagatctccgtcgagctggtcagtccatgcacgcacccatgccatcaaacattcaatcacgccgaaccatatagtatctgtggatcgctgacacgtacgctttcttgtcgagcagtcaggagggccgagctggaacgtgatgctggggaggagggacggcacggcggcgaacttcgagggcgccagagacctccccggaccgacggacgatctggacctcctgagacggaaattctccgaattcaacctcgacgacaccgacttcgtcgctctccagggcgcgcacaccatcgggagggcgcagtgcaggttcttccacgaccggctctacaacatcagcggcacggagcagccggaccagacgctggacatggcctacctcaacgagctccggcagagctgcccggcgagcgaccccgaaagcgcggcgctgcgcaacctcgacccgcccacgccggacgcgttcgacaatagctactacggcaacctcctgcgcaaccgcggcctgctccagtccgaccaggggatgctctccgcgccgggcggcgccgcctcgaccaccgcgcccatcgtcgtgtggttcgccggtagccaggacgacttcttcaggagcttcgcgacggcgatggtcaagatgggcaacatcagcccgctcaccgggagcatgggggagatcaggaggaactgcagggtggtcaaccgcggctgatcatcaggttgatcagcgtctccgtgaaattgtttgttgaaaggaaaccagttgggtggcccgcgcaattgcgcggttagcacctatacaaaattatatatctttaatatgattttatttaaaatttattaaatagttatattgttgttaagactttgaaatttcaaatcttatcatttccatgtttctaattttatattttttattaaaagtcacaccagttgctatctgttacttctgttatatccttctttatttgcttgtccgatctggcactgtttctattcattctatttggagcctttcaaaattagatcttatggtttttagagtttattgtcccgttgggtttcgattttataatttttagaagtcccgtcaaacgctaccattatactcctatacggctcatccactacctcttcttttttattgtcgttgttattttcaaaatagaacataattatcgcttgggttcattttttactttctaagaagttccgccaaaacgtcagcagctttgtcaatgtgctcctctatggctcgcccgttgccttccttctttattgtcattgagattttaaaatcaaacatgaatatcattgaagtttttttttactttttagaagaccgaacttttaaagttggaccttatagtttttataatttattgtctcgttagaattcattttttataattttttgaaatcacgtcaaacgatgccactatattcctgtacgacccgtccgccgcttactctttatattcattgggattctaaaaaccggacataactatcattggaattcattttttaatttctagaagtcacaccaaccatccgcggctttgccattgtactcctgtacaacccgtccactgcctcttcattttattatcattgagatttaaaaaatcaaatatgattatcattggttttttttttactttatagaagtcccgccaaccaccttaaccggttgcttcacggcctgcccgtcatccttccttttgttaatagtttttagatgtcccatcaaccaccatcactctactcctttataggcctattacttaaataatctcgtcatatgttttagatgatctttgtctttcaatagtctttattttttatcaccaattttagttatttataaattgtattcctagttaaatcttatttttctttttctaatttcataatttatttttattttttatttcgaattttaactaatattgtattgtgttcttttaatatttatttcagtcttcttaaaatggaaaattggaaccatgccattataattttgtaaaatttgagatatgccatcatgacccacatgtcattgactcatatgggtcctatatgtcattgagataccgatgacatatctcaaactttgcaaaattataatggcatgattccaatttacttttaaaattgtattcatacttgaattatatttttaatttgtctagtttcagattttattttatttttcattccgaattttaattaatctcgtattgggttcttatatgtactcttatttcaatatttcatatatctaattctaaattttagttaattttaaattgtattcctagttgaactcttctttttttttctagttttgatttttttattttttttctgaattttaattaatctcgtattgggtttttatatggactcttcttccaatattgcttaattttaattctaaattttagttatttttaaattatatttctactcaaactcttctttctttttttttctaattttggatttcatttttttattatgaatattaattaatctcgtattggattattatatggactctttttttcaatagtacttatttttaattccgaatttcagttatttttaaattgtatttctagttggactctccttttcttttttttcgattaatgttagaatttctagcctccatagcaaacgcgatacctccttttaaagctgtttttaataatatagttatttttaaattgtatttctactcgaactcttctttcgttttttcaaatttcggatttattttattttttattctgaatattaattaatcttgtattgggttcttatacgaactctcttttcaaccgtacttatttttaattccgaatttcagttatttcgaatttctagttggactctccttttctttttctccgattaatgtggaaatttctagcccccacagcgaacatggtgcctcctttcaatttgtttagtaatataatagattgcacatgtgttttatgttttaatttcgtttagttatttcttttctatgaagattgaaatgtacacgtgaattaataattagctacgcaaaaaggtaaaaatgaatagcttctatcaaaagagaaatggtttgacagatactttctaagacgaagtaacgacggaattaagcacaaaaggataattaatcatgcattcaaggcgcaatggcacaacatgcaaaaacactcgtgcatacagccatcaaatttcttgtctagtacaaacatccagcagcataaatagcacaagtcattgcataaaactatgttaaactcaaacgctgaacacagccggagaagacgtttacatggaggtcaaagtttgttgttgggtaagtatatgtcgctcgaacgactatgctaacgaagttacaggccagcagatgaaatgctgtttcagcttcttcagatttttcttttcttaactaaaacggcaacaccaaggctacataagagctactacaacacttgaatacaaattgggtcggttttacacttctacgaatgaccatcatgcttcccaagctcgctaggcgggggtaagagaagtgcaaggcgctgcttgtatctttcaatccgtcggagccgctccttttgcaaactgccaaagaaatttatgtcaaagtggaacacaacactcagtaactctgtctaatgaagataacattctcaaacagccattcctcaactaatgttttcaatctgccgtctatcaaaatgacaacctaaaacctctccactacaccacataaaagggcgttaagttagctaacttaatatctccacccagcaatataagtttgattgagcttgcgattaaggtgttaatatatgttatataaactgactacaccaaaacaatcaacatgacaacatcacactacatattttcatttgtcttgtgaaacactttcataatatatcttcttaccatttttgctagtgcatcattattgtttcgttggatacctgaagaatcaagctggacttacatattggaagcaaaagccaatcatcactattgcatcaccatattttgaacttacttgctcacttcacaaatcatacgtaaaagggctggaagatgaaaacaaatacatacccagcacggatcttttttgcacgcttcacatgctgcttcagcaagtcacttgcagtatattcaccggtttcattctgcacagaagatcaaagccaatggtttttgagctaatatagtaacactgcgattatagatgtaaaaaactatgcttgtggtgatagaaaagataatagaaggaaatagtaacaatagctacaaagtggtcagtaacagaagtcacaagcaagtagctctccccaagaatatcaatttacagacgaaaaagggactcctttatcccttcagtctcaagaactttttgggatactacatttctatggcaaggttgaaatgaacccggatttctcaaacatgttggatgaaaccgtcacctaatacctaatattattgaaggttgtaactgggaagcaaatctaactattttgggagcaaatggaacacatgggcaaataatggaccaagacaactgcaaataagcaagagtgggatatgcaggacataagatagacaatatacttcattttaaataacagggtaaagcgtaaaattcagagttggtatgtgcaactcctaagaaatacagcaatttttgcatgtattagtcataatattagttataaaaggcatacacgcttacatgccaaaaatcagaaaatgccagtatgatccagaattgcctggaaagaatataactaagtgttatgctgtacgatgaattagcataactaaaatgctagattcattgaatcaaagatcaaaacttcaaagttagttttttacaagataccttctcttcctctgagttctctttctcagcatcattgtccttttctgatatcctagagtccacgactgaagcaggcagtggtcttggaagaattggtgcaccagttccaaagcttggctgcaagaactagtaagacaagtgcatggatagcatgatgcacatacaaaatatggactatgaactgcagatattcacatattaagagccaaaaggggaattccttgtggtggtggtggaggggagtaaagtgacaggagccttgcctgtctattagtacaaaggaaagaagaaagcatgcagtgcaaaacaactcacattgtctctacaggagacatcgctccactaggcaattacattttataggacaattcaatccatacaaagtgcacctggcaaaattctcacaagtttgaagcttgttgatgttaaaccaaactttaaataacagagagcaaatgtgtgtccgttcaaagtagtaagaggaaaattcaggcatacaacataatcaatcaagttgtagtcctagaattgcatttataaattataactgagaagaaatacactttagagtaactctagaaattataagaccaccagaatgacaattgaggcgtgtaagaacctgttaggatctagtttaacataactatagagaaattttcacatggcaagtgcccaaatcattcatttgtaacgagtgagcatgctaacctgactttcatgtggaactccattacgcacccatgatcgacaaagtgcatacaaggatcctgactcactatccatcaagttaacctttggaacaataaaaagaaatgtcagtttgtgctgtccacttgatctgtcgggataaaacaaggtatagattatattgtgaggttcctcatatgtgggccaattatatttagaaattagaatttcagcctcgtagcccaagtatctacaaaaccatttggataattaagaaaatgaattgtgaaatagaagcaatttgcatttgcatgaacagaaaaaataaggtgtgaagagccgtacgttttaaatttctttggtaaatgttaaaccaaacaaaatcatgtttatcataggagctgaaatagtgtcactaatcagagcaaagaaaaagaatttgtatcatataaaacgtctaaggtgagccataactggtatcccaaagattcatgataatgggcaaaagtgattgggcatgttccaactatccaaaggtacaggtattctcctcatctagccaatgtatttgcattaacacagcgcaaatgttctagaaaaaagtttaagaaacataaacttactttacggtcattaataaccactgttgtagagtcctccttgctcctttcactacaaataaacaatcaaaattgacagttgggaagtctaagtccaaaagataaaacactatagtttgtaactatatcccctcaaaagaaaaagataacacactacagtttgtagttttcttacctatcttttgagttgttgatctcttgaggagatggagttacagctggtagtggaatgacctaagaaagatgccagaaaagcataatttaagggaacttcaaaattcacaatatttaagtccagaatttatcaataaggaatagcctaattaacacagcacccaaaatagaccagcaccatttataatcaaaataacaataaaaaaacccatgaattcgtgtcttcgcttttacaagatctaaatccagtacggaaccattcacatgggcctaatttacctcagaagtagcattgtgctattaccaaatataagttcactaagcaattcaacatgcacatgaaacgtagcatgcccaacaggtaataagttccaaaatctaccataaatcgccaccgaaatctacaagtagcgtttaattaaaaagctctagagagtagaacgttcaagacttcaagttctcgtctagttccccttccttgcaaagctcgcagactaaaattagtcactaaccttgggctgtgcttgctgagctatagggactcctcggggaggctgctcggggcgcgacgacacacctgccaccaccgccctcggggcggcggggaacgaccggccatgcgtgggcgccaggggatgctgcggctgcactatgggcaccgcgacggcgtgggcgcgagg

SEQ ID NO: 82791 - DNA, 546 bp, Oryza sativa
gggtaaccataaagatggactgaattgcatgactactgtaaaataatagtaagccccactatcaatcatcaagctcacctggttgctgtgaccacacttcttcttgcggcagttgacagccctagggtgcaggcgcgcatagcatctgtagataaataacaaggtcggtcaaagttaaaatttgtttttttacagtccaagatacatacagaaatataaaacatgaccccttgggagttatgtacagcatgaaaagttgcaaatagcatgtcaaataaaagcatgcacatacataggcaattgaaaataagagaacatggaccacagacatgtaacgaaacactgaaatacaacagtagattggcaagtcagacaattgtatgcctcaaaattttagctcataaggtaacctcgtacatctaattgattcatcattcctgccaattaaaaaaggaccaactgtccatacaaacaaataaagaaaaccaaattcacacaccgataatcaataaccaaaaataacaagaatgaacaaagcaaataggc

SEQ ID NO: 82792 - DNA, 713 bp, Oryza sativa
cattttgcaaaggcatacttgtgttaaaatttatgtgctccatggttgtgccttggactgccaagttgccatctgtgacataacttacagcacttattaaaaaccttttacatagtatcggggcaagacaatgtcaagtatggtagaaatactaagctgctgcttggtttggtcagttttggcaacaataattacacattgtaaaatcttgaaaccacattgtgggcatacaattttttttaatcttctgactgtttttgtattgatctcacccaatttattgtattgtgatcctttaatgactttatattgtgcttgttgcaatggaatttgtgtatttcctgctttcctaataacagctcatgcacaattggcattaggatgtgcatgctttatatatatttagccttatttaatttgactttggagaaaaatattttttccctcattccttgctctaaattatgttttctcaggtggaacaaagacggaaggaggctttatctaggacatccgaagacgccttatctgccttggaaaacacactttatgacgttgtttctcgatacagctatatggatctttggccatgctcaaccaaagaattggattatctatcaagacatgaggtttgcactatctcaaatatacaactactcttgcatatttcatccgaagcaaatgtaacaagctcatatttggaactcacagtc

SEQ ID NO: 82793 - DNA, 1659 bp, Oryza sativa
gtgagcatgccctccaattgcccgtttcatgcttcaaaataggttgaccactgaagcctacagatccatcgcctgtgtagtcatcaacatcctacggagagaagcaaagtactagttgattctaaattattcatgtttttgtcaaacatgtttaacgcatttcactccatcagtttcaatcaatcttcaaacccatccaaaaagaaatcaaaacttaaaagttacaggtcaaagtaaccatcagatttttcaaggaaatgacatcagagtgcagacaatcaatcaaatttcacagagaaaataacttccacaagtaatttgtacgtgtcaatccaataaatcctcaaaattgttgcgtgttccagcataatacccaaggtgcatcaaggctctaagcagtacatcaaaaaatgattgtctttatgagcgggaccctgtggcctgtgggcctcacctgtcagtcatcactgcgcctctagagtctagaccttcaccttccccgttcccctttctctactcacggccatcgttttgcaaccgactaatcgaagtgtcacacgccaatctgaccaagctctacgcgatcccaagaatccaagaactgagcaatcgagctgtccatcattttccccctcccttttctcacgatttctttgctaggccttttctcacgatccgggccaatttaagcattttcaatcgatcggaacataaccaaaacaagaaactaaagaggattgggaaaccctacgaatcctcgaatcttggtggaacaaagaggggaaaaaagaagtttattctttttcgtgtggatattgtgggagtacctccggctctgtcgtccgcactatcaagctctgctgctccgcctccagcgacgaccccatgaatgcaccttttgcagctcggaagggttgctgcaccctccacgaagaaaggtgttcagctttgaactgcttctttggcaactcctgctgcaaaaggactccctccatattttaatgcataacgtcgttgactttttaaccaacatttaatcattcgttttattcaaaatttttatacaaatataaaaatatttatatcatacttaaagaatatttgatgatgaatcaagtcacaataaaaataaatgataattacataaagtttttgaataagatggatggtcaaacgttggataaaaagtcaacagcatcatacattaaaatatgaagttagtaggaataatcccagaggccagaacgcgagagcttgagacgttaaagaaacaggcttatcatttgagttttatgaaggggcctttcctccaacatgataggacccaattaaaattggtcgccatctctcatatgtatctctttgtgaaaccatgtgtggttatagttcttttgtgatgggaaattgacaagtaccggatgtgcaagaagtgtgtgtgtggactaacgttggtcaggttgcgacatctgtgccaagacaacggttgtttggttcatgtgtgtgcaggtgatcggggtcgatcttggtcaacggcggatcgggactagactcagggaggagttgaggtccaaagcgatcaaggatgccgggtgacaagattggacacaaggttgcacacggtggacgaacaccgtgtgaaaaggtctttgcaacaggctt

SEQ ID NO: 82794 - DNA, 1316 bp, Oryza sativa
atgagcagtcgatatcatttaacatcgtaccatttgtgatgatgggtaccaccttaccatgttcaagttgttctattatactcctatatactagattatgatgttttgtcccattctttatttccctgcctagcaggtaactcgttttattatgacctatattaaaactagaaaatggattttgtaacttatgttgttattttctcttgcttattactccctgatatgcttgtgcatgtaaaaaaataaacataagaccgtcgttggaatgaagaaagtttgctggaatttcacgagaattcaactatgccaaaaaattcctgtattccaaaggcgctttaaaaacaatcgtctggttcaattccactgaatcttattcgaattcgttgcagatagtgttgttgcgagaaattttgtttcaaagatcctacagaaccatttcatcgtgatgcgactcatttggcccatgcactatcccaacacaaaaccacagagtaaaaaaacttatttccattgcaatctactgctgctcaagatattcttttgtaaccattttggtttgcaatttggtggtccatttattattcaatagagctactagtaggaaacttggaatgatcaaaagagactcaaaagattacatatttctagagagaagtgaattccaacagttgtaaaaaggacacgagaagaagaagcaagaaagcgaggtgtccaactacgcatgcatgcagcgccaccgtccggcggctcaccggccgccgccggggccgccgccgccgccgccgttgatctctacgggcggccagcggcggcaggcggcgacctggtcgaggaacttggcgaggcgggcgtgcttggccgcccactgctccgccatcttctgctccttggcctccgcgtcgcggcggaggccggccatcttctcccggtactccgcctccacccgctccaccgcagctgcctgctcctccctcagcgccctcatcttcgcctcgaactcctccgtcgcctcccgccgccggcacgccctctccgtctccagctgcatctccaccctcttcatcctccacgccgcctccttcctgtgcgccgcccacgccctctgcccttcctccatctccctgcaacaatagatgcgagtcaagcgacgacacataaaagaggagatccaatcgatgatagtgggtcaaagaagacgaatgagatgaagaaatcccccatttaacgccgttaactttttaattatatgtttaaatatttgttttattaaaaatttttgtgaaatatgtaaaactatatgtagtatacatata

SEQ ID NO: 82795 - DNA, 1669 bp, Oryza sativa
gagaaatcagatcatgtacaaaaaatttacgtatttttagttcaatgtagagcacttatcttacagatttcaagtgtagtaagtgtgtaagcatgaactttgcaaacagaaaagatcaaatcttcagttcagaagaaagaaacgacacactgcagatcaggaatggcttggcatggtttctagttgtgctaatctagtcaaacaaccagtcaaccacaaccagtttaaatgcaaatgttgatacagagtaaagtgattaccgtctggagggagcaagaaactggccagaacagaagctagggctgtgatagtgtaaagttagttgctttattcattgcagcatttatatgtttcagtttggggtgtcaaaagcaggggagttaatttatttgttcagtgatccataactgtgacctgcacactctacacatcctacttactaccacagtaccacagataaagcttatacatgctcctctacaacaacattggtactaaatttgtgcaagattattcctttgacattatacagttaactactcgttcagataacagttaaagcacagaaaatgacagagagagaaaaaaaaaagagaaggctgaattgctccaattggttctttggaggttgcaagggccaaccgaccataaacactattggtaagtaagagcattgttaagcacccatgattcatccagctattactatcaacatacagacaaattcacagatgtcaggacaagttgtgggcacaattcttgtgagaggaaataataaggctaccactgttttctcgcaagcttgtcttccatctttagcagtgtcaccatctggcattaattgggagctgatcaatggggagataatctgccaaaacacctacctaataccctcaagaaggctacaaaataagggaatgtgcaagaggcagaagcaaatccaaagtaaaagtgatgattctaggaccatttggagcccccactggttgcctactaatgacgaattaaagctatggccagggctaattgcgcacgagatggaattttgatttggacaataagggttagttggttaggtgtctcgagcaaatttgacaaatcgaaaaccaatttaatttgcaataaattcactctatttaatatggcacctctttagttttcacctaattgtaatgaaggactcatgagagagaaatgcaataaaatctgcaagaatttcacctagaacatcttctgaattcttgcaagcaatatgcttttgattttattttttttaagttgagacaaaacagttgtttctaaaaaaaagtatttataaaagggatttataggaaacttaggattcctcaagagtggtcttgtgccatccatttcatctagaaattcaagcattaaccaagaagaaacaaaatgaaagaatgttgaaagcatggtagtaggccaaagaaatcaatgtgttgttgtttgttgatctgattggattggaccgttgtatcctccttggctagatgttactaccacagtagtagtactgacaaattgaaagcagtgtgggggtatactatactatactactcctataccacaagtatactgaaacatggatctgtgttgctgggtgttactatctttcaggtaactaacatagcaagttctcaattactgacca

SEQ ID NO: 82796 - DNA, 602 bp, Oryza sativa
aattagttataagctcaaaaaatgccatcgtgtgagtagaagttacaaaaggctacctgaagagctttataatttcccttagctgcagcgctgtgtactggtgtaagaccaagtttgttcccctggaaaactctggcaccattcttcagcaggagccacacaatcctgcacaaatacagaagacaactaagtaaagagaatgcaaatagcagtaagaactagtatgttgtattttaacagttgatagaacaaaattctaatagcataccttggctcctgtgtgcttgagctaccactaaggcaccagtgaagtgccgtgttcccttcaggatcggcttcattgacatcaacatcccccatcaggagcatctttgtgacatttacatctccaacctacagtagaaaggtcagtcagaagaaagtcttctggtgtatatacagttgtagcactaaaaactttaccttaagcatagcacattttaagcattcttgcatggaccataattggagaaaaatcagtttctgaaattgggcagggcatgaaaatgactcaaaagctcagcttacatggtattaatggtaactcatcagtatgcatacca

SEQ ID NO: 82797 - DNA, 14801 bp, Oryza sativa
aagaaaatgtagttttctcaatatttgctacttcagttctgattcagcagttcaaatcacctaattaaaatgttagagagatttctttgaatagttctgttaacatcacactttgctgtgacttttggttcttttctttttattctgcagcaagtctttcttgaagaaatagagaaaactgtagcacttttggtttttgaagatataaagaactgtccatatggggaactattggatgtttcccaacgattgaagaccgcaagtgaagttaatgctgccattcttacaagccaaagtcatgagaaaggttagcacatgtgctttgatatagtattcatattgagacctaatatcacttggttatgttatcatgtatctacattgcaataccagttttgtgcctataataagttttcattacttaaataaataaagatccacaagtgtaaatcttaatcaggaaatgagaatgcacagaatgtggggtgcctgttctcattttatacattgaaacaaatgaatcacccatttatgtgggattttctgccacgttaaaaacaacaaaggcttaactgaaaatctttcagagactaaccacaaagttactaataatactgacaagaatgggttgaagaaagggcactttgcagtgtggtactaacagatctatctattttgatgattttaagatatagtgatcagatttgcactagatttcagttttgttgctcattgattatattttttttcttttttacaatagagttgaagttgatatactgtttggaacttggaatcaataaaatgctggtccggaatgtgacttttactgaagttattttgtatatgtttcccacataatgcagatccaaagctccctagccttctaaagatgttaatttggactcaaaaccaactggacgaaaaggcagcatatccacgaatcaacaatttctccactgccgcacttgaagatccagcgatttgaggccgctcgggaggggatggctaaagaatgtaggcaccataccatgactgttttcacacattgtacttcctggatctgttgtgctcttcacctgcaaggctgcaacagtgaatccagtgctttcttcggtctttgatctcaaatgcaaaaaacgtggaatcagaaaaaaaaatcgctcgtgttgtacatgatgtagaagatgttcatcacattttaatctgtgaaaaatgttcgatttgatttgagttcattcaacatcttttgtcgaacctttcacttctattacacgaaatgttcttcccagataatactttggctgtttggcaagatgacgctcatcatgttgtccttgcgatttcagaattgcttacgaatttgaaagaaaccaaagtttcactcaaatcgcccagcgaaaaattgtttcactcattggggtattctcccatgagggtcctctgcggtactgctcactgacatgtgagcccctagaccctcgggtccacatgtcagtgacatcagtactgcagaggatcagaattgcttataaaggtacatacctccttatgattgaaatatacttttttttaatggagttatcaaaactaatttttaaggttggaataaggttaaaaactcatctttgttaatattgttgaatttttattttactttaagtacatgtattagtcagctgatatatacctcataattagcaatatgtagtatatatacctccgtatactttctcagaatcagaaaagcttcgtcattatcgatctaaatttattttctaatcaatctagtttctttagcactaaaacaattggaaggatgggagaatacctcttcactcaaatgacttgcttttcgcgcttctggatcaatccctttataggagtttcctgctgtgaccatgcgtagcaatggcgtcgcgctcgcgcgccgtctcctccggcttcacgaaggcgccgaccttctccgtcaccaccgcgtcgcagctccacgacgccatcgaccgcctcctcccgcggctacgcggcgacccgtccctcgcccccgccgcgcgcgcgctcgccgcggcagccaccgcctcgctgccgccctccaccgtcctctccaaccgcctcctccacctgctctcctcccacccagccaccctccccgacgcgctcgcgctcttctcctccatcgcggccccggacatctgctcccacaacaccctcatctccgcgctctctcgctccccgcgccacctcccctccgcgcgggagctgttcgaccgaatgccccagagggatcacttcgcctggtccgccctcgtctcaggttacacccgacacggccagcccgaggccgcgctcgcgctctaccggcggatgcaggaggagccggggaacgatggcgcggacaacgagttcaccgcgtccagcgcgctcgcggcggccgcggccgcacggtgcggccgcgcgggcagggagctgcactgccacgtcgtgaggagagggatcgacgccgccggcggcgacgccgtcctgtggagcgcgctcgcggacatgtacgccaagtgcggccgcgtggacgacgcgaggagggtcttcgaccggatgccggtccgggacgccgtctcctggacggcgatggtggagaggtacttcgacggcggccgcggcggggaagggttcaggctgttcctccacatgctgaggacccgaggtgttcgaccaaacgagttcacctacgcgggggttctgcgcgcctgcgcacagttcgccgtcgagagcttcgggaggcaggtgcacggccggatggcgaagagcggcactggagactctgcttcgcggagagcgcgctcctccgcatgtactccaagtgcggcgacatggggagcgcggtgcgcgtgtttgaggccatggcgaagccggacttggtgtcgtggacggcggtgatctccggctatgcgcagaacgggcagccggaggaggcgctgcgctacttcgacatgttcttgaggtctggaattaagcctgatcatgtcacttttgttggtgttctgtcagcgtgtgctcatgccggcctggtcgacaagggcctcgagatcttccattcgattaaggaacagtattgcattgagcacactgctgatcattacgcttgcgtgatcgatctcctaagccggtcaggccaatttgagcgagcagaaaagatgataggtaatatggcagtgaaacctaacaagttcctatgggcgtccttgcttggtggctgccggattcacaagaatgttggcttggcaaggcgggcagcagaagcattgttcgaaatagaacccgagaatccagcaacttatgtaactctggcaaatatttatgcctcggttggtctttttgatgaggttgaggatgtcagaagaatcatggaatcaaagggtataaccaaaatgccggcctcaagttggattgaagttgggagaagagttcatgtgttcctagttggtgataaatcgcatcctaaagctgatgaaatctatgcacttctgaagaagctgtatgtgaaaatggtggaagaagggtatgtggcggacattgaatttgttctccatgatgtcgaagatgagcagaaggagcaggacattggctaccacagcgagcggcttgctgttgcatttgggatcattgccactccggagggttccccgatcaaggttttcaagaacctgcgcatttgcggggactgccatgctgctattaagctcatatcgcagattgtgcagagagatatcattgttagggactcgaataggttccatcacttcaaggacgggatatgttcttgcagagattactggtgacccgcacactgcatatatgaagtagttttgtctcccgattggagctactattactctttgtacggctaatgttaatatgcggcagcaactgatctgaccaaaggttttcactggttcgagtgattaagttctggaaaagaaattccttgtcaggctgaccctaggtaaacggtctcaccttttatcattcgtgcctatcctgatgaaagtttatgttatgtacgttcgctttattttattaacatatcctgtaaatatgttcattttttgtttgattgttgattgggggttagtaataaagcaatagaattgaaggggtgaaattttgtgatattttaactgatcgtccagcttcacaatttcccattgcctgcacatgatatcttactgaacaaagttgacatatgagtgggtgcaggaacagcatggtgctctcaaatagaaaagggaaaatacatataactctgctacccatggtgactcagtcacctcgattctaaaattttcatctaaaataaatcaccaaatgaactacaaagcaaattcatgagagcgtttagctaaggcatcttaacttacatggtctagtctgtacaatgcattggattcgatgaatgtaaaatctgttattactaacacaaactgaccttaccatgagtacagtcatcatgctttcttgtatctgtatctcattgcacaaccagtgaaaaccagtaaattcacaaagttgatcccagcaatcaatgaaaagaaccgatctaggtggccttcattcaggttatctgggatccatccaggatcccctccttgagttgtaaaatatgacaccaaggttaatatgattgagcttaaatagctccccagtgagactgttacaagcgcaaatgcactacacaaactcctcatggcatcaggggcttcattgtagaagaactcaacctgacctatggcagcaaagacctcagcagcgccaaccaagaaatactgcggtatttgccaaagaatgctcatcggaacagcaacatcctcatgaataagaccttcagatctggcgatccctaaacgcctcaactcaacaagagctgcagatagcattgcaaggatggagagggctaatccgattccaatccgctgtaactcagagaaacccttctcccttccagtgaactttctagctattggcacaagcacacggccataaaacggaatccagatgatgacactgatgacatcaaaagttgagagggatgcaggagggacaatgaaagatccaactcgcttgtcaagaaccattccctgctctatgaacatagaagagttgtgagcatacaccgcgttgaatataatagtagtggcccaaatgggaaacattctgattagaattttcagttcttccacctgggtgacagtgcatagcctccacggatttgtaaaggagtcactcttggcatcatcagatgagatgatggcagccttgtcaaagaatctgtataacaaaaagtaatttcagtcagacaagaaaacacaatatattatattgtctaaaaaagtaaaagaaatgtgtctgtaaagcaagccacctactgacatatattgcttgtgctaccctgatattttcagtcattatacaaatatacctctaatggtcccatattaattataggcaccagtaatagtaattataagtagacttataagaattgcatgccatggacaaactactaatatactactagcgttctgctgtatggccttatccatattctttttgttgcatttagtatttaatttccaccaatcccaaaatggaacagtacaagaaggtagtgtatcagttttatgtatacatccaactgcaaatggctggtgttgtccccatccagactttcctccttttttctttgtaacagaatgaataaaagtgagacaatgatgcattgcaaaaatccaggaattactcaagttcacttgtgtgctccagcttccggcttccctcaatcgctgaagtctggccatcaacctcatataaaagagatgtatcatgtggcacttcagtgtgccacttacggaatgctgcaacaacaacctgacacactcttgtaagagggcttccaccaggtttctgaaatctgtacatatttgaggcaacaaagaaacttgcaatcgctaatgccataaatatagtaggaatggcaaatcctatcccccaacctgagttatcttgtatccaaactataacggtgcctgatacaaatgcaccgatatttatacagaagtaaaaccaattgaagaaggagcccttctttactctgtctgctggatcactgtcatcaaattgatcagctccaaaggatgatacacaaggtttgatgcctccagtcccgagggctatcatatagaggccagagaaaaatacaccatactggagtaagcttgcttctggacaaatagatcctgaacatttaggcggctgcagagctggaactgatgctgacagcgtcaaagcaaccagacccttcagtaaaaaagttcagaaattatccatgtttcagatatgaaattattttgaaaagatcagttcagcacatggtgcaagtgcaccgaagtaggtaatatctaatatcttctatagcaataggcttgtacttacaataaaataaattgctgagaaagcagcaatagtccagtactttccccagtaagaatctgctaggagggcaccaatgaggggtgttaggtagcatgtcccctgccaagttgtaacatttcttgcagcttcaaggttgccttgatgaagatttgttttcagataagtaactaggttctttgcaataccataataggccagtctctcacagcattcatcccctgtcaccaaactagcatttctgaaacttcaaagctactcattgcagaacagataaaaatgtgcacagcatttttcaattgatctgtaaagtatgctatctggtacttcgaccagcatttcttttgtgttgtatatcaccaaaatattttggcaaaaggtaaatacaggattgtacgattcaaaaccatatagaagcattactcactagtgcgaagaaacaaggaattccttcaagtactgtgccaaagttttatgggatatgctatgcatctttaacaaattacctaggatgaaaaaacatgcacgccaatttccagtggcatgctttaatgcagggcgccctttgatatcaacagatccatctccggtgtaaagattagcatcctgctaagaaaaaaaaccatttcagtctgaaccacctaacgagatctgaaaggcaacaagttgcatccctcaaaatgaacaaataaatggaaacaaacaaagagaagtcaaatcaatcttcgaaaggaaaacttcaaaaatttggaattgccacttcagtattttggatgggttgattctctttcttttttttgctggcaaggaagtgaatcaaattaacaacaccatatttgatcagaaaaaaaaaatccaacatcatataatccggagttcaagagatagcaccaaatacataggaggcgcctacaaatcgggcgcccgattttttttttgtctaaaatcgggcattgtttcaccaagtagatcgaaaatgtttcagtaaatagatcgaaaatgtttcaatcttttaaaatactgaaacacaaccaaatcacctcatgaaacattttgctacaacatacttcctccgtttcacaatgtaagtcattctagcattttccacattcatattgatgttaatgaatctagacatatatatctatatagattcattaacatcaatatgaatatgggaactgctacaatgacttacattgtgaaacggagggagtatgaaacaacggtttctaaaaaatcggacgttgtttcaccctatacaaaaacaatgttctagcaaatagcgaaagaatgtttcaattcttaaaaaaaagtgaaacacggtcagatcgctagatgaaacaatttggttcaacgtatgcaacaaacgatttaaagccattgcaacacttaaatcccatgtacatcaacaaaccacgtgtccatcaaaatgaaattattaaacagtattaaaaatccactgcaacatttgatccatacatagtgaaacatcatgagtaaactagctgaaacattgttggtggaacaaaaaatgaaacggatcccccttaatagggcgtttccgttatatccgggcggccgttgcaaccggtgcacgtggtgggggtgcggaggcgcgagcgcggggcgccgatttttttctccccaatcgtgcgcacgacgcggatgattcacgaaatacatgtgttaactgtttagcagaagaaatttgttgctaccctagctttgatcaataatcagcttaatctttcacagaccttcagaagggtgaagtacacctacatacttcagaaccagacaagcaaaacggaacacacacacacacacacacacacagaagacttaatgtcattaacagctttaaggccttatcttacagtctctggtttcagttgtgactcaagagaatcggttcctaaatccccatgcttctattttcctcaagtaaaagaaaacagagccagctaccataaagaggcgaatcaagcgtgacgtactaaccgggataaacagcttatcctgaggggaaaaaacagagaaaatataacatttttacctgaggaagaagaaggagcggttcttgatcaccaccctcttctcgcacctgcaatcgcctatcttctgctgcctcttccatggaggggggggggggggggctcgtcccggggacggaagcagctggagcagatcaagaagctatacaggagcaatggattgcccccatctgagtagagttttgcgaccgcaggggagcaggtggacttcggcacttcggatggatcagagattgaactgatgattggtgaatgcagtaaactactgtcacgttttgcataaaacccctgcattttggttggattttgatttgagagtttttttttttttttttttggaactgggagtgctggttggattaggaaatgcaatatactccctcggttccacattaataaaacgttctgggtttgtgcagtttgatcgtttggtttacagctaataagctgtaaaataacttaatcagcaataaaagataatttaagggtatttatatatatatatatatatgtccttagcaattaaaaaacggaaatgctaaataccggtatcccgttggactcggtcgagacgggacatgttctttcagggatcaccagatatcatagcaccaggtatctgagtacatccccaggccgggcccacttacatctgatagctttcataggtcatagactgccctcgtagaccaacacatgtcttttctgtacactttgtcctcactcgtagtctccaccaacaacagattcttcacgtccccatttctctcattcctttttttcatccatgccatattgtaacacatgtcttttctgcacactttgtgctcactcgtatgcacccgggaagaatttcccggtcggtcacccatcccaaattgctccaggccaagcacgcttcccatcccaaattgctccaggccaagcacgcttaaccctggagttttttggagattggcttccggaaaaaaagttgcaacttattgatatgagtattctattaatcctattaagccctaggccgggatgttacaccctcacccccttaagagagatcgacgcccccgtcgatcaaccctaggccaggaacgtcctctcttggccacgtccatgtgtccagtgccagcgcccgtgaaaccgcgagagtcggctctgatacctttgataccattttgtaacgtcccgcctcccccaggccgggcccacttacatctggtagctttcatagatcatagactgccctcacagaccaacacatgtcttttctgcacactttgtcctcactcgtatgcacccgggacccgggaagaatttcccggtcggtcacccatcccaaattgctccagaccaagcacgtttaaccctggagttctttggagattggcttccggaaaagaagttgcaacttgttgatatgagtattctattaatcctattaagccctaggccgggatgttacacatatacatcgatttcctaattttgattttcctttctccatttttgcgatttctaggtttcgttgaatccctaacctgtggatgcgactcctcatatctcatccaaaattgaaatcgaagtaatctaaaactccccatttttgtgtgtatttgttcattcacatggggtgtttgcaacagaggcgaggatgtgtgtgtatatatgctaaatcatatgatacttgcagcaaaatgttaaaatcatttggatttttgctttgaaatgatgtgattctttggttcaactgatctaatattcatcattaaaatgatattttctttattctttcaccttttcaataatctcttgttacatctccaattaacaaaatcagttgatttagccaatgaaacctgcaggaaaccactgtacatctcctaaagtatcacctatgaaacctgatgataccggacatgatactaaagaggatcatgatacctccccgatttcataagatcctactcaagtatcatctgtgaaatccacaggaaactactgtaccagacatgatactagacatgatcatgtgatacttcacaagtatcacatataatgatactttgaggatcatatatcatgatacctgggtaggatcatgtgatacttcacaggtatcacacgaacctactaaagtatcatctgtgaaacccacaaggatcatgttaccagacatgttacctaagtaagatcatgcgatactacacagatatcacacataatgatacttatcacatgatcctcctagggtatcaactgtggaaacctaatgataccggacatgatacagaggaagatcatgatcctcctagggtatcaactataagttttatactgtctatagaagcatttcatggataacttatcaataatttacctgtagtctattgcatctctgtaccactagcttcaacacttgtttctgacttctttttaccgcctgaattattgaggaaataattcagcgcttctctatacatctactatttgttgtcacaactgactcactagccacaaacacactagcagaacgtgtacacaaaggggattcactcgggggggcatcacttttttttattctccctgggcatcaaaagaaatcgcacaaaacagggagcaatgttccatcagacatttcctcgaatacattgcatgcacaaaatagctataacagagaagtggcttcagaattcttacacagggtagtcggcgttgaaacgcaggctgatgttgagctcacatcacacttgtagcagaatcaattgaggaggtaggagcaaaggagctgacgaaatcaactgaaattgctggattgtagaggaaatcgcagacggcatgtgtgccggcagaatcaaccgaggaatcgctgagttgtagaggaaatcgacagacggcgtgtgcaacggtgaaatgaaccgaggaatcgcgcacggaggcgcgcgattccgaggaggattcgctaggatgcggaggaaaaactgggggcaacgctcgcaccggcggaaggaagcgcggaggtgcgtgattccgaggaggattcgccgagatgcagaggagccggcggacgatgctcgcctcggtggaaggaagcgagaaatcgcgtgcgattctgaggaggtttcgctgggatgcgtacaagccggcggatggcaatcactggtcgttctccttttttttgcaacgctcgcatgtggtgatactgtagtttcagaatcatcccgtttttgaacgggatttcggtatgtagcagccccttaaaaaaatactaaaaaaacccttaaaatcactccaaaattaagtttgattaaacgtatttgcgttgaaatattttgattaaaccgagttcaagaagctcaaactcaagaagctcaccggcgacgcatggtggcctgatgggcaatctgtcacaggatgcaagttggcacttctgattagtcatattcagtcaaatccaaataaaatacctatactagccaagcacgtgtaacgtgccaaatatcctttcagtttcagcaaacagtacacatggtttatttattctgatttctgacaggaaaacaaacagatcaattatgtctgcaatagaaaatgtttggaggggaacaacatgctttcatatgaaaataaactgactagcaaaagcaagaagaagattgttttttttcccattctccaagtaatattatgtaccagtaccactgaggagaatcaatgtacatatacaagagattattcagtattttttgagataaaatatatacatacaatttgctgtacaataaattcctttgtccaagtaatattgctctatgaaggctgacattaaattgcagctgctttcttgcacttgtattgctgtgcatagtagacgaaaagaagaagattcagaaaactaaggccagctatgagccagaaaaagcggtcaagatggccttcattcaagttatcagggatccaacccggattatcatctcgagttgtaaaatatgaaaccagggtcagtatgaatgaactaagatagcttccaagcgacaccgtaacaagagcgaaagcggagcacaagcttctcatggaatctggagactggttgtagaagaactcggcttggccaatggctgtgaacacctcaccaataccaaccaacaagtattgaggcgcttgccaaagaatgctcatgggaacaggtaccttactatggatcagatcttctgaccttgcaatctccagacgcttaatctcaaccaatgctgcagttgccactgcagtagtagccacaaacagaccaattcccattcgttgaagctccgagaagcctctctctttaccagtcagtctacttgctatcggcacaacgaaagtttcgtagattgggacccaaacaacaatgctgataacatccaaggatgacagagtggctggcggaattttaaaggattcaatttgattgttgagggccatcccttgttctataaacattgatgaattttgagcacatacagtgaagaacacaatgccagttgcccagattggaaacatcctcattaatattttaagctcttcaacctgtgtgatagtgcaaagtctccaaggatcatgagaaccaccacgttcattcgacaaaatgacggcagctttgtcaaggaaactgtgaagaaaagataacatattaagtaagagtgcatctcagtctgtgcatctgcactaccgatacacaaatcttgtgttacattacctgtcatgactctgaaaaaaggtcattgtgtccaggaagttccaagacacaaacttgcaagatgtgaatgtccgactcagaccaaaataacatatttgtgtccatgccgactttgttacataataacactttttagactaaattaattttatgtactttttcaaaaagtatttttttaatctagtaatctaaactacatgtcaccatttggttgttttctccccatttctttgaaaattgggtaggaactctggcattcagttaagaatgagatgcacaatcaagtcaattttagcatttgaacccatttgaacccgggtggatggggaggttaaacaacctcctcatagcatttgtttctttaaggaatagtaccatgttaatgaagcaaatataccaaggtggccaagaaaaatacctgaattcactactatgttccagcttacgactcccctcaattgcagaagtcttaccatgaagctcataaagaacagaactatcaaccggcaaatcaacatttctcttgtggatggctgcaataaccacctggcatactcttataagggggcttcctccaggtatctgatatctatatctctgagaacctataaaaaaacttccaatagctaaggcaatgaagatagtaggaattccaaatccaattccatatccacagttttgttgtacccaaataagaactgtgccagatatcaaagaaccgatgtttatagcaaaataaaaccaattgaagaaagcacccttctttgttctctcaactggatcagtgtcatcaaattgatcagcaccaaaggatgaaacacatggcttaatacctccagaccctaaagcaatcatgtatagtccaacaaagtatatcagatactgaggcacggttggttgtggacaaaaggacccaaaacattgaggaggttgaagagaaggaaccaatgctgaaaatgtcaatgctgccatccccttcaattaaattgacattgaggagccgttagcacatgttatcaacagaaatgagtgtgtaaataatataacagattcacaacctggacaagtaggttttcaattgatgtatcatgccagtatgtatcaagctggtgattgctaaggtcaccattatgcatgtgatcataatattattatgagataagctttatgtctgccctcattttccctgtttatagttaaccttccattcatgaataaactacaatgcagaaaacatctactataattatttggcgcttaattcactagcacatgcatagccaatacaagtgaaccaatgaaaaagacaaaattatatgatatctctcccagtatgaaaatttctcaatatatgcatgtatttgcatcttaccagaaagtaaattgttgagaaaacagcaatagtcttgtactttccccagtatgagtctgctaaggttgctccaataagtggcgtgagataacaagttccttgccaagttgtgagttccttgctgcagagacatttccttcatgcaatcttgtcgataggt

SEQ ID NO: 82798 - DNA, 1532 bp, Oryza sativa
tcaaatcagactttcctgtaggtatggactcaatggaatcaggctttggggtactgacagtaacttcacccagtaagctaccattgtcagtggaagcactatcctgctggctttcagtgttgctcccgcagcactcatcgccctgatggctctgcacattgctctcactgcaagtattattctgctgactgtctgtgttatgaggggagtcctcggtgatattagtggtaagtggagacctcggggactgatgatctgacactgattctgggagctcatcatgatcaaaagagaatggttccagcaagggtacatactttggtcgcgagaccggtggaaggaggaccatgtgtgtggcaggaccacttcctacagggactacacacattctgcagataccaggaagggaacgcatgaaatcactgagcttaggataaccaagcgtgccatgatcaagctgcattctgcaaatggctctgaaatcacccttcagggagctcaatgggtgcctatctccaagtcgttcggtagcatctgcaagaaatcctggcaaccacttcctgaatataaagaaccaagatggaagacacttctctggcaagggccggcgcttcctaatgtaatgttcctcctttagctcaccatccaacagatggtgagttacctttggaacctcctggctgtggtgcctgaatggagcaattttctggatttctgcaggcaaggatcctctagcaacagcatcctttacctccactctcttcccaagcatgtacacatgatgagtttcctttgcacttatcacatcctcttctcttttgaactttacaaaaccaaatcctcgagattgcacccgatcacccatccttatcccaatgactactgcttcctccacaggtccaaattcagcagtgaagaactcagtgaggtactctgccaggaagaacaaaacaaggtaagtgttagaacttagaaacacattagttctaactttattaagtacaagtagttcaggattctgaagtttaccagcgcccacagaaggtgggaggcccccaacaaaaattttccgagtgtagtcgtgcttcggccaatgattaggctaaaagaaaatcttataagaggcagaccatgtgaagaaaaagggaattggttaatataggcagagtatgtttgtttacccgaggcacaaacttggaaccttgcttgggagcacaatggttcttactcttgcccccttgggcagaaccattactagaccggaaatcccgatggcttgctgatgttttaagcccagtaaagctgccacattatcaaaataaatatattagtttgaaacgtaggatgagaagcaaaggttctagtatgcaaaagaatggaagatctaatataaatcatgcagtatgcaccggacatacctttcatttaaatcatcactgtcataatcaccaaaatcttccaggaactctttgcagctttccttattcgtcacacttttttttggatgtgagctacggttccctacaaacaga

SEQ ID NO: 82799 - DNA, 1654 bp, Oryza sativa
caatagagtagtagattgatttctttgtcctgacgccgtctagtgaggaacgctgactggtgccgatatcttctcttcagccaccagaagcagcattgccaacacagtaacacgaccttccatggcatatctgtaggccacctccccaacctctctggttttctctgccaggagcctcactgcattcagatcctacacatggaacaaggtgacatttttgtgtgagaagatctatggaccaattatgagacagtgaatgaacattagtagtactagtaaccatacaaaccttttcttgcagagatgacagaagatcttcaatggagttgtccagtgaccatttaacttgagctctggataagaacatcagtcagaaaaacagccattgcatggagagaacttgagaagtgagctcagtggtcaccatcaccttctgcttaagagagcgatctcgagcgcgacaagagggcggccatcgaccagcttgaggtcggtgcgcgcgttcttggagagcagcagctcgatgcaccgggccgagtgcgcctcggcggcgacctggagcggcgtccgcgtgagctggtccctggcgtccacgggcgacgccgtgatgccgtgccctccctcgaggaggagcctggcgcactgcacggcgtcgtgcttgcaggcgaggtggagcagcctcgtggacatctcctggtccagcatccgcgacgcgtcggagcccttccggagacggcccatcgcctccttcctgaagcttcccaccgccgcgagcagcagcgcggtgtcgtcctccgcgacggcgcgggacacggcggtctccttccccgtcgccgccgccgccgccttgtcctcgcgcgccgctgccttggcgcgatccatgctcccggtctcttcactcgcgccctgacaaaatcaaaccacaaaacgaactcttcaaacacagatgaacacaacgaacacataaataaatttcgctcaagtttgcatcaaccgaaaattcataggcacaaataaacgaatgcgacgagctgagtatcatctctgtgccgaaagaatcccagaagcgcgagccatcgccgcactgtacgctcaacattttcaaacaaaagcagcaagcggaagaagcaggagatgggactgaaactgcagacagatacacaagaatggaattccacgaatccatcagtcgcctcggcttttaagcaggcacgacaaggtgcaagaaaacaagcaggaaagggaccaaaatttgatgagcgccattgcaatttcctttcgcttccaaagacaaaagccctcgtaaaatcacggggaatcgaatcgaaagctcagagaatcacatgatgtcgcagacagaaacgaatgacacgtcgtgacgtgtgacaagacgcccgagattgaaacgaagctacggaagatggggaaacaccagcaaggaaggtttgctcgatacgaggaggaacttggaatctcgctcggattgcaaaaaaaaaaaacgtgggaaaaaacaaaacacacgtcgaatcgcaggctcgcagcaaaaaaaacaacgaaacagtatgaaaccacaaaaacttttcaaaaacgcgctgaaatttcgcacgcccgctgaaattggtcgaatcgtggcaccacaaataggtggaataca

SEQ ID NO: 82800 - DNA, 1684 bp, Oryza sativa
gccttagtattgtactactactacgtgaacttcttcaaaaatgatcaaaatggagacaaacccaaacccttaaccatattagagtttgtttggttaattcggctgcgtttagctagactagctaccgtagcctgcagcagttgtgaatggttgcaactgacagccgatttgaattgccgcagccgtagcaagtgcctccgaacaaagccttcataggagtaatagattggaggggatagtgagaagtgtataatcaatatccttcaaatccccttgagatagggtttaatcgaacaaaaccttagataatgataggtcaattcatccacctgtggatgcaccttcaacgagaataaaaacaacacttaagtggtgagaaatgtgcgttggtatcagtggtatggtttcgcaatagtcacacccatatcctaaatggatagcatacagtaccttctccctttaaattatgacgttggtttgttcaaaattgaattcgtcaatgtcatacaaaagatatagaagggaatatatattatgacatgttgtaaattgttatgtgacaaactggcaaatggcaatggccttttgttctccacagtcctattggttgtatgaagcatgaacatgcattagtataaagtagaatctagaatagtttatacaccttttaaattaagtggtgaacttgtggaattggatacactataatggaattggatacaccattttcaaagaaatgagttagggtcctcatacaataggagcttattaaggatgatgaaccaataaggttaaagaaatgagatatagagaagtctttctcatgttgctacaacaattgaatggtcacatatacatactattggttgtatgaagcatgaacatgcattagtataaagtagaatctagaatagtttatacaccttttaaattaagtggtgaacttgtggaattggatacactataatggttaaatttgcacttcaatttatatatatgtgtgtgctgctttatttgtgttaacttaaactattgattgttcatatgtgctatactttatccagttgtttctatttgcatggtctaggtcacccatcgagtgtattttacccacctactcctttcataaaaaaaaacaacatagacaaggatatgatataatataggactggacatgttcgttgtcctatgttatatcaagtcattggttaggttttttttttacggagggagtaggtgtgggcaaggttggaaatttcggactttgatttctgaaatttcagtcattttggacccctccgttacgatattattttggccaaaatatttaaaaagttttaacttttcgtgaattttagtaatatttattcaaaaattcctaattttcggtctaccggtgacctccgatacaatcggtcaagccgaaaagttaaaccctaggtgtgggttgagggaaaaaaaacctataaccgtgtgatttgcgtcctcgagggaaaggctacttgattatgatcggtgtagaccaaggtttaatgtagtattggttaggctatttctatcggagaaaaccgataggactgaattttgtaaaattttagaatatttgaatataaaatttgattgaatctagtacatttcgtgagatccataaaaaataaaagaaaaggtctgcaaattttagatg

SEQ ID NO: 82801 - DNA, 40318 bp, Oryza sativa
tgcagacatatactccctccattccaaattgatctacatatagtttttttgaggttattcctaaatgatcatcatatttgtgttcattcattaagtctattcgttatttgtgcatttgagtaaatgggcattgatgcatgcatccatgcacacaagtatttataacccacatgtaatatcttgatttgctattggctaagaaatagtggggatggtgcatgcatcgagtttgttgttagagtaaatatagtatgagagttattagcttttcttggtcttggtgtacctatgaaatatgtagataaatttggaatggagggagtaagtgataagtagggatttaatcaaagtgccttttaggaagcgaagtgccaacaattatactggccatgattcctcttagacaatgaataatacaacccagaaggaacaacaaaagcatagcatgaacttgctacttgacagctgtatgattcttgatttcataataatcaagataaccaaaggaaacttactgtgccttcggtctttgggacctctccaagtactgaagctaaaagtgttgattttcctgatcctacctcgccacagattgcaactttctccccagatttgaccactaaatttatattcctcagagtatgtttcgacgggttctcatcccacgagaagctgcaggagtttagcgcaatgggatactcagtacccgctatatatttcttcctgcattgcccattcagctcaggagcatcaagaaattttacaacccgggtgaaagcaactttagcttgaatcacaactccaataacatctggtatctgtctgattggatcttgcacgagacgtagagttgccacaaaggtgaatacattgctagcattcagaggaactcttaaaagatagcaagtcagaaatgttgctgctgaaaccagaactggtgatgaccaaaacaggaaactgttgtatgccttcctaaggttgaatgctgacagccacttgtactcaacctccctcaacccctcaatgaccttcttgaaatgattttcccaagcatataatttcaagaccttcatatgaactaaagactcagacatggccttcaatctcacatcttgtgcttccataagtttactctggtacttgtgttgcagttttgccagtggagcattgcagagtacagtaataatgatgacaaccaacgacgataccgtcgcaagtccaactgcattgtaaaggattgccagagcaatgcagagctggacacttgttgtccaaatttggtggaaccaatacgggaattccccaatgcggtaggcatcgacagtcacatagttcattatttctccagaagagtgcttcatttttgctgagtttgatagcttctgttgcttcttgtaaatagctgctgacaggaatgacctcacctggaggcctaacctccgatgcggaaataccactgtctctgagccaaagattcacagaatttgcaaacgaacattgtcacagctagcacaattccttcatatttgaaggtcccttcccccagcgatacattgatgagtgccttgagaagcaatgggcctgaggataaggtaacaaccttgagcaatgcaaagaagcctgagatcagaatcccactcttatggcaagaaacaatggtccaaaatactgatggtgtggcatgtgactgcaactgcttctttctattcatcatctccaagaacatcaagtactgattctgcgctcgatcagtggagcctaaaagtggcatgtctttctcttcgagaggcttcgcgtaacccatcttcatcaaagggttcaaccaccaaaatgacatcacactgaaaaatccagctttagcaaaaggagttacatgactctctgaatcagccgtcccatgatccctctctgtattcagcggcatgtataaagcattttcagttgtttcataaccctcttcatcacggctgtgccgaatggcataaagaagaaggataagggctccaggtagcaaaagaacatctaaacaagctttaatggtgatctccttctctccaaccatgtagacaactgaacagcaacagatgaatgctgcacatatggtaagcaaaagcgaccagaatcgaacaaatgtagctccaagaaatcgaggtctgatgctaaaactgaaactagtaaggatcaaactgaatccttgagccaagatcacaagccaccaatgcggccggtaaatggaggtttcctgattgaagctaatccccaccatccacagtcctaggccaagattaagcaaacccaagcagccagtgaacactacagcagccaactgcagcagtgaattgaatgcgacaagctgccgcgcagatgctctactctttggaattttcatgagcaactgatgtacaagcgcaacagtgagcactgcaacaatggaaatcaccaccagatgattcacgcaagtcgaagaatccaatgtttccttcatagcacatgagaccacatcttgctcggagcaaattgggctcccacacaagctcatcgcccaagaacctgaaaaatcattaccccccaaaaaaatcaatgttaggcggtgtttagttctttggccaaattatttttgaagcatacggacacacatttgaagtattaaacaaaacaaattacagattccgcatgtaaactgtgagacgaatttattaagcctaattaattcgtcattagcaaatatttactgtagaatcacattgtcaaaccatggcacaattaagcttaaaatattcgtctcgcaatttacatgcaaattgtgcaattagtttttttttcgtccacctttaatgctctatacatgtgtccaaacgacacatttgatgtgatatttttggccaaaatttttgggatctaaacacacccttaataggaaagctcaaaaaaaaatgtgacagtccaaaagtgaaaagggctcaatgatgaatcaatgatgcaactgtcaagcacgagagaattgtgagaaaacaactaacttatgagggaacccatctgtccaatctctgttgcaccgtccgttgaatcagacagcttaaacctgcagcaaagcaaactagtcagagcaaataagtgaagaacatggactagatagggacttgtactgcacaagattagtactagtgtttcgggtggctatagaagctcaagataaccacagaaatttcactatacccagcacaaacatcactatatcaccgaaagaaaaaatcaagaaacttaaataagtcagcagaagaagagagaaaatggtaataaagtctaagattgcaatgtttcttcttaataagtcagcagaagaagagagagaccaaaaaaaaaaaaaaaaactgtatgcatgagtgttcatcaaccagctacctcaacagtcaacaccattcattcaccgaggaaaggaaagaaaatattcagggaccagtgatccaaacgagaagaacaaatcgcaaccaaaatcgcatcgcctaggggtaaaaaatctcgtcccctcgacaaatccccaagaactcccataggaattaatcaagacaatgcgattgacgttgtagattcacgatgccctcgagcccagagcagccgcactggagaagaaggaggaggagatcacgggagaagcagtaaccaaccaaagatcaaaaaacctttttactcaccttctttttcagctctccaaagcacgactccccaaaaacagcttcttttcttttcttttctttttctttttttcccctccttcctgcgccaaccaaacaccttcccaatcgtggcccccttcttcctcgccgccgtcgcactcgtgtgttgaggcgagcgaacagcggagacgacgagacgacgcgctgggcgcgcgcgcgcgcgggtggtgtttattataggtggcgcgcgtcgcgtcgcgtcgcggcgcggcgcggcgaggcgggtggcgcgcgctgggcagcgcgcgaacgaacgtgcgatgtctcgactctcgacttcgtcccaggtggcgacgacgccgacgtgccggtgccgtggcgtggccgctggtggcgtctcgcgcgccatccgtttcactggcgcgcccggcacgtgttcgactcgttgctccgtccgcgcgagccaaggttggcatactcacgttgccgaaacaagccataggccctgtttgggcttttcccaaaagccgcttctgctagaaactgccccaaacaattcataacttctgagaatatgtagttacagattttaaaaaatgaactaagaagccaaaagctggagaagctgggtttcggagcttttctagattctcagaagctggctaccaaacagctgtttctcagaatctaaagctcccccgaacaggcccataatcttattagctagcctgcctgactaataaaatcaaagccgcacttttactataagaaagcaagtttgcaatgctttaatgtgttaataatatatgggacacacatcctgatgaagaaattttatcattaatatggcacgaactaaatgaacgtctaatttagtcaaacatgtctcattttagatgtggtacagtaaggtaaattgtggtagtgcaccaaacaggctctagtcacctagtgtgaataggtgactctggtcaaacgctgctcttctttaagacaaaagaaaatgcgcactggtttttcttattagcagtttagcacatctctgcgagattcgtggtgtcttgaaattgatcgacaaatacactctatcattcttactaggagttatcgtgatattaacaaagtcaatatatatatatgtatatatatattactgataaatatatctgttttactaaacaataatttattataaatacgaacatccgtgtcaaattgaccataccataaataaagttaagtatgttcgatcaagttacttatcgtttgatcacgtgttatagatttcttcattattacatgagctttgtatctcgttgtaaacttactctcttctagctaatatatggcttttaattttattagtcacatgttagtaaaaaaaagtatggtgaattttgacgatttgagtatgccaatcaaactaatactcaccaacgagcttgattcccaattccacgtaaagttctttaggtgattatatatgtatatagatcgaccgagttcatgattagtactagtgtttagtaaataaatttactaagggcatgttcaaattgttttcaaaataaaccttattaaattttagcaagttgacatattactaaaataggatttttttcatgcatttaccaaaattggcaacaagctaaacgtagacatttttttaacaacttttttaaaaaatggtataattaaaaatggtatcattctgaacaacccctaacgttacttcataaatagaactctcttgatcaaccaccactactccataagtagaactctcttgatcaaccaccacatgtcataccatatactccctccgtcccataaaaaacgaatatatagaactgaatatgatatatcatagtacaataaatctggacatatatatgtctaaattcgtagtattggttttttataggacctaaaaagagtagccactggtgcgactgcagagcagagaggcagagtggtcaccggcgcaacgccgtgcattcatcagcgccactagtgcgagtgtgcgactgcagagagccagagcgatgatgatggtgattggccctcaatagtcccaagatgagaccgttttaaagtttccggatccatctcaagatcctagtatttagtttatgaattaaatgaaacgtaatagcacatgacctcactgctgccttcacccaaattatttgtttgcaattactcctacttgcaaggagtggtggaacgtatacatctatgtttctattcggaacaaatacgaattactccctccgtttcaaaatggttggtatcgttgacgttttagcacatgtttgactgttcgtcttaataaaaaaaatttgcgaaatatgtaaaactatatgtgtacataaaagtatatttaacaatgaatcaaatgatataaaaagaataaatagttacttaatttttttaataagacgaatggttaaacacgtactaaaaagtcaacggtgtcaaatattttgaaacggatggagtacctctctaaactatcacggttgctcgatttacccccctcccctaactataaaaccagacattttacaccctcaattgtttatattggacaaataacccccctaaacactgttttgagcggttttaactggagcgtgcacatgtgacgccaacgtggagatacagtcaacaaaaaaaattaaaaaaaaacacttccctggacccacctgtcatacccctcccttaacccaatccttccccaccattctctctggcgcgcacacatactcgggtggctggctatggaggagaaggcggaccgggcggccggcggtggacggctaaggaggagctcgcccgcgcggctgaggaggtggactagtgtaacgacccacctctcctaggccgggcccgcttacatttgatagctttcataggtcggtccgatggcagaggcggagatcgcccgcgcggctgaggaggtggactagtgtaacgacccgcctctcctaggctgggcccgcttacatcgcggaccgggcggccggcggtggacggctaaggaggagctcgcccgcgcggctgaggaggtggactagtgtaacgacccacctctcctaggccgggcccgcttacatctgatagctttcataggtcaatccgatggcagaggcggagatcgcccgcgcggctgaggaggtggactagtgtaacgacccgcctctcctaggctgggcccgcttacatctgatagctttcataggtcatagactgtcctcacataccaacacaagaggtagactagtgtaacgacccacctctcctaggctgggcccgcttacatctgatagctttcataggtcatagactgtcctcacataccaacacaagtcttttctgcacactttgtcctcactcgtgtgcacccgggaagaatttcccggtcctcacataccaacacaagaggtggactagtgtaacgacccacctctcctaggctgggcccgcttacatctgatagctttcataggtcatagacacactttgtcctcactcgtgtgcacctgggaagaatttcccggtcctcacataccaacacaagaggtggactagtgtaacgacccacctctcctaggctgggcccgcttacatctgatagctttcataggtcatagactgtcctcacataccaacataagtcttttctgcacactttgtcctcactcgtgtgcacccgggaagaatttcccggtcggtcacccatcccgatattgctccaggccaagcacgcttaaccttagagttatttcgagatcggcttctggaaaagaagttgcaacttattgatatgagtattctattaatcctattaagccctaggccgggatgtcacaactagatggctggcggcagaggcagagaacacccaggcagcgggcgactgagggggagctcgcccgggaggcccgcggcgaaggcagagatcgctcgggcggtgagcggctgaggtgaagctcacccgggcgcccggtgaaggaggcagaggcggaccgagcagccctccccaacgcgcctgccacttgccctcccccgctgcgaccttctccgttcggaccaccgccgcggccttctccgcccggaccaccatcgccgccgcactacaggaaaggagagggggtgtgctgggagacggcggcgggcttgtcgcctccttcatgagagctacgactccgccaccacagatcccgaccgacggcgccgcgatggtaggtcaggcggtgccatccacgcagaggctcgaggcggagccgttgaccctcgaggaccgctgttgcctagccttctcgctcatcgagatcgatgtgcgagacacggccgagggagaggatgtggcgaggacgctgccttccgccggggatgttgccgccgccgccgccacctaatgcacgtcatcttcctccgctgtctcatggtggccatcgtcgccttcctctgcctcctcactgctcctgttgttgggggacagagaaacagagatagagagagtgcgatggaaaggagaagaggtggaagaagatgctgacatgtggagcccaccgattttttttctgactagattgccacgtgtgtgccacgtagaatcaaaactgcttcgggctgattcagggggtgattcatccaatttgttaagttcgaggtgtaaaatgtctggttttgtagttaaggggggtaaattgtacgaccgtgatagttcagagggtaattcgtactttttcttttctatttttaaccttttttaatttacttcaaacagtgtcaagtcattttgggcgtgtttacttggctgcttcggttgcgacttttagggactcttgtttagaagctgtttggtttatatgatttataagtcaataaattttaagtcctaaatttaatgatggagtcatatctctacctcacataatgagaaaagcttttccaacctagcttttggcttaatagtgctatagtagtttgcgaaaaaaactgcttgtttatttagtcctagattttttgactcataagctaacttataagcctaaacaaagagttttgacgaattttggttagtatgttttggggttgatcatatggaatgtgttgggctttggggtgaagccttatcaatttttttagagcttttaagagtggaagctacgggaattaccaaaatttgtagggtatcaatgataaaatatatttagtttgttgttctagggttgaaaataattacaaggtaaataggctcttcgtgcgtagcttgtggacaatgatttcacttgcagttgcacttggttgtcaagtcattttttccctgccttgttagttgttagaagtattaagtacttcccctcttataattatttgacgtgtagctcaatatttggcatttatgaaactcttaaccatcattagttctctcaaatgctcagttcttttttttaaaaaaaaatatagtatatgagttggtttgccttggaaagtactattatattatcataaaccattattttgatgggaactacggtgagcatttgacagcatgaactttattgatgtttaaaagatggttttacaagatggctgtattacagttgcactggtggggggaaaggattataaattgcctcatcttctcgcttatgcttatacttatcagtaaaatttgatttttcaaccttaaatttagagttggttttgaggttttttcattgaagtttaattttcagtgtttttagatcgctaagaatatgtatataaaagtttttttcacaatttatttttcgtttacaaatagaccgtttggctaattccccccaaaagtggaacgatagggccgtataaccctgcatggcaagagcatatttggcggctgctttgcagcttcggttgatttttacaaatatgaagtccgcttttttcttatacttttatacaaatacaaatgtgagagcaaggataatagtgggctataagcaaactatatgcttaggtggaagagagagataaacaaaagtggggtgtgttggctcttatgcaagagctaactacacacaagctccaagaaatatgcattaaattcatagtgagagaaagagagaggataaagaaaataaagatgaccttatagccaacctactatacatgttagctttaacattgactaatagtaaacagtgagctatactattattaaacttgctctgatgtagtaactcgtacagcctgtttatgttactttctgtagtctctctaagcaagcatcaaagtcttgagagcaatacacaaacgacagtagcaaaatacctgctccaaaatttgtgtcgtgattgatctgaagctaagggtaccctgtactggtgaccagacacttagtccctgtttagatgagactataaaacttttaagtccctatcacatcgaatgtttggatattaattataaatattaaacatagactattaataaaacccatccataatcttggactaattcgtgagacgaatctattgagcctaactaatccatgattagcctatgtgatgctacagtaaacattctctaattatggattaattaggcttaaaaaatttgtctcgtgaattagctttcatttatgtaattagttttgtaagtagtttatatttaatactctaaattaatgtcgaaagacagggactaaagttaagtccctggatccaaacaccacctaagatcttgttgagtagtactactaattattgtcccgtcaacctgcacaattacacatcttaaattgcactcttaaacctgtcaaattggtacagtagcagtacagttggagtatcaaaagcagtcaaccccaaggacaataaacttatgggaaaaatttcaggggatcagaagaatttcaggggggaaaaaaggacaccgaatgaaacggacttcctggcagctttgacaccacgtgttgcagtttcagactttttcaggtacagacagaaatcttaacttagggtgtgtttgtttcacggtcaaggttggatgggatatagcgatctatattttattggatatgtcaatccagtttttttgtttgggagagtgaatatgacgatccagttatttgtttggttgtagggatgaagatggatttgatgatccatttttttgtttggttaggaggagtaggatggatgagtggttgcaatcacctcatcattagaggtggtgagtatacccccttcaaattcaccaaacccaaacattatcaatctactgcaaaataaaaaatcttaagagaaataaaaaaatcacaaagaaataaagggaaaaaggagaaaacagaaaaaagaaaaaaaatcacaaatcttctcgccgcctcgctcctctcgccggctgtcgcccgcctcaaccgccgcctcgctcctcttgccggccgctgccccgctcctctcaccggccgcccatctcaccttctccagatccggtcgctcctctcgccggcccactcgtcggctcgctcctctcgctgctccgcctcgtcgctcgccaaccgccgccacgctcgtctccttccccaccggccgtcgcgccgtctccttccccaccggccgttgcgccgtctccttccccaccggccgccgccccatttctcccagatccagccgtcgtcgtcgtttccatccccaccggtcgtcgccggtctccatccccaccggtcgtcgtcgtggtgcaccggccgctgccgccgccgcgtaccaggcgctgcctcacttgcgtcgtcgtcgaggtcgcgtggtgaggggtgacgcgacccatgttggtcgcttgccccgctcgcccaggcggctgcatccggccaaatcggccggatcccccatccagcatctgggaggaatattcttcttcgggccgccctatcccacccccgcccaccaaccaaacatccaccaaagatggaccgtcatgtcctatctacccaaatccctctatccaaacacacccttattgggtcgttggatccatgcaaccgtcaagctacttaccgtcaaaaaataattatgggtcactcgtttagctagcacaaaacgaagtttgcaatgtcatctgaagacgaggaaattttgtattggcaaattcaccaagcagaaggcagaaagggacctcaagattggattgatcatgtaatgtatgcgtgaatgattcattctttttttgccccctcactttcttagacgtatatacgtccatgtccacgagtacatgtttgcgattggaatgaaaacatggctgtgtcgtttataagttaacaccggcatcattcaagactatattgattgcggggttgtgtgtggggttgagtgttcagtataccatccttcttaaaaataaatttatttatagagttctgtcttcaacattgattgatcgtctgttttatttaaaaaattttataattagtattcttctttatacgtggcttattgtttctaatttcttcataaattttgcagataagacgattaaacgttggaaagaaaaaaactcacgaatatattttgagaacggagggtgtacttcagttgtcttgtcattttggttgttgtgtcttttttttctttggagaaatacgtacggagtacaggaatcaatcgtcctgtattgtcgccgaccgatgtcgatgcgtgcagttgttgcgttcgcgttctcgtcctcgcctcgcgcctgacgcgccggctgctgtcagcgacctacctacctacatgtacgaaacataccctgtgttacggacaccgggtaaatctcaatttctaacacaagttacgtaaagtactctatctgttctggaatatagggtattttgtactcttaatatgtccatgaatataaaggagtttaaggcctcatattttcgtttatacttgtcagctaaaatttaaatttttatcttaaatttaaaattgattatgaggttttttcatcaaagtttatttttcaacatttacttttaaatcgttaagagcatatatataaaagttttatttataaattatttttcatttgtaaatatgccatgatgggtccgttaatttacccgaggctaacaacgacagaagtaatcgatgccagccattagatattaagtactccctccattccaaattaatctacatatagttttttttgaggttattcctgaatgatctacatatttgtgtcaatttattaagtgtattcgttatttgtgcactggagtaaatggacattgatgcatgcatccatgcacataagtatttataacccacatgcaatatcttgatttgctattggctaggaaatattgaggatggtgcatgcattgagtttgttgctagagtaaatataatatgagagagttattagctttcattggtcttgtgtacctatgaaatatgtagatcaatttggaatggagggagtatccaccagttcccatcaaaataaaaaaacaaagaatgtacaccgttcaacctgccaaagtttaattaagtacacccttcgtcacattttaaacgcaaccataagtttacgtgtctaattttaatcgttcatcttatttaaatttttatgattagtatttttattgttattagatgataaaatatgaataatactttatgcgtgacttgtattttttttagaaagattttcaaataagatggatgattaaagtttgatacgaaaactcatggttgcacttcaaatgagaaatgagagatagtttattccccaaagatgtactttgtgcagtttattcactgtgccagtgtgtactctagatgtctgagatgcactctttcatccttcttaatttgtgctaggtcagaaataatcccctatatatacctggatggagggagtgtattgtatctctatcattgactaatgaaatatcctactattaaaaaagtgaaataatataccatacctctataatttttagagtaaatttcacaaaactacatatactatgactaaattatcacaaaactacatatttaactcagtgtatcacaaaactacacatttaacaccaaatttataacaaaactacacatttaagatgaagtgtcacaaaactacatgtttagtaactaaattatcataaaactataggtttagaaccaatttaaccacaaagtaataatatttatagccaaaaattgtagttttgtgataagtttaatattaaatatgtatttttgtgatacttaatctaaaatctgcagttttgtgatagatttgatgctaaatgtgtagttttgtgatacaactccttaaacctgtagttttgtgataatttagtcaaaatacctgtagttttgtgaaatttactctaatttttatttcaagttcctcaattacactgcacggtgcacacgtgtggcaactgttgctccgtcaaccgggttttggttgctcgcattgtttgcagcactgtccatccagtcctgctctgtttctgcggcaggtgactggctggtcgctgctgctcttgaatgcccccattacaatagatcgaccaaggatttctaccaagaaattttaaattctttgggaatggtaggagatttcggaaagaggttttggagagaagtctgtgtatgaggtgtaatctaaaactctctgttttatattattagtcgttttatttttttttctaatcaaactatgttagatttgattaagtttataaaaaattttagcaacatccaaaatactaaattagttcattaaatataagattaatatatttcataacatgtttattttgtgttaaaaatatctttttataaatctgataaacttaaaaaagtttgactaaacaaatagttaaaaagacttataatatgaaaccaaggaggaagtattgaaaaatttcctttaagcctatgctccctctattttacaatgtaagtcattctagcattgaatgaattacaatataaatgtgagaaatgctagaatgacgctagaatgacttacattgtgaaatggatgaagtagcatatcttatcaagtgttttttcatagcctattcaaatattcattcatgtattcctttcctttttatatgtatatctattgagttctttttccgtgttctgtcaggagttccaaacgaggtttaaggcccgtgaaaataaaatattccatgcgtacgttttcaaataatcggcagtgttcactttaaccaccgataacttttaaacggttaaaatatgatgctgaaattttttatgcttatattttaagctgcaatctactccatttcgatactatacattgacaatttttaatagtgtttatagtttctctaaaaaaaaggaagatggccggtccacgtctgaagatgaatacacattgttgattagtaattaatggagggaacacatgaataactctcctactacgtatgttctagtcaaagaacgcacgtgacaatttggttatcaacgtcaaatatttaaattggtggtggagctgatgacaacggtttttagagcacctgcaatagtaaagtaaggtgctctctatataaaacatgtacatctcagcaatagactcgattaatagtaaaccaccttaatagtatgtctatattggtatctatagctctctcatgcattgtctcgtttttctctatagactatctctaagttagtagatagctttcctctctctcttcatttaataccttccaagtaggaaaatatgctgacatggatctcttgtagagagcatatagataacctgtaacgctccgcttctcgtgagtcgttaaaaactaattcgccaaaatcctatatgcgaaaatctcgttctttgtgtgagagtctaagttgtgccaagatctcaattcaaatctccatcgttgttctctctcgtcgccatcaaaatcctccacctcaagtttccaatcccgattcaagactccaaatcaaattccgaaattcaattccaaatccaaatcccttccaaatcagttctctgtgaaagtctagtttgcctccctcaagtttttgtgggtcgaatccttttccctcggcccatccctcctctcagtccgtttccctctcccctcgcacgtgcgttgcacgcagccgagccgagaaggagcgccgtttctctccctctctctcgttttctctctctccgacgccgcatccaccaccgctttgccggttcccgccgccgcctttgaattccgtcgtgccctcgcgtcgcgcgcgcgcgcccgcgtggtcgccgcctgcaccgcccgtgccgcgccttgcctgcccgccgcctaaaatggaaggggcaaagccccctttcaaccgccctatctccctttttccctctccggttcgacctctctctctcccgcccttgtccacttgcgcttggagacagagacgctgacgccggtgcgccagttcgccgcccccaccttgaccgcgccgagctgcccctcccgcgctcgcgaatccttttccaccgcccgatccaccgccttcgccgctccttgcatcctcggcatccgccgctcttgcatcgcccgtgaccgccaatgtcggttccctctcccaaaccgacttcccgtgcctataaaaccgcagccgagcccctcctctcaacccctcccgcttcactctccacgctgccacgccactgtcgcccctgccctgcagtcgccctcaccgcccgtcgccgaagcaccagggagaccggtgcgtgcgaaggacgcgagaagaggactccgggcacccttctccttccccttccccggcccgaggccggagagctcgccccgcgccgtcggccgcccatcgctgcgcccggctcggtagtgcctcctccgttctccctccccgctctctctctctctcatgcccttagcttttgagctagcaaccgtagcactaccgaacgcgcgtggacgccgccccgagccccgctgccgcccggcatggcctcgccgccattgccgtccgctcccggaggccgccgctcgtcgccggccctcctcggtgcccctccgtcccatccggcgccggaaacgggttccccaactcccatggatgatcccaccgccttgaatcgacctctcgtctaccgccgccgtttcccctctttgctcgccgccggcatgcgccgccacgattcgtcgtcgccggcctccctccagtgaatccgggccggtgattcgcttcctcttgtccctcccatcactccggtgtcctccccctcccttgaatccccgtgtgctgcctcggcgaatgtcgccgccgtccgccgtccatctcggcctcccccatcttcctcctcccgccggcccgcgtggctgccacgaaggcaccacgtcggcgccagctcggccggactgggtcaaagctgacctcggtcagccgcctccctccgttcctcactcgcgcgcggggtccacggagagccgagaggctgcgcgtgggcccgccgcacaccgcgtccacccgtgcgccgcgcgtggaccgcttcctccccgaaccctagcaccacccttgcgtatgcccatccctccgtgagccgtgtcaccgacaagcgggcctcacccgggaccccgcgaggtgaacttggtccaccggaccgctccctctctcccgcgcgcccctaatgggccgcctcctcgcgcccgcgccggcccatttggttcggccgagccgcaatagccttcgggccgcgccctagccgcccgaaggaagtctaaatgacatccctctttccttttctttttcaagggacttaataaatcctttttcctttgtcccataaatcaattccttattccaaaattccataaaccattcctttggtcccgcacgtcagtgactgtcaataatattcttgagaatattatttctataaattccataaatcatctctcctattccagaaattccgattaagcttccgaaattcatatctctcaatccgtagctccgattgactccgttccagttccaataattttgtaaaattgagatctatttaatggcactattatttagtctaaataggatctttcttttggtcttttgtttaggtttttgattgtttgcgtatagttgcggttaccggattttcgtcgatcgcgggttttctcgaagattcgtgaagcttcgtgaagaccttgagcaaggcaagtcaccctttgatcaattgctcctataattggaaaatcattattattttgtttgcaacttgcattattagaatcactcacttaacttgcttggcctcggtttgcgtgccaaaccgacggacctacccagtagtcgcactagttcctgtaggctgtactaccctgattccttgtcgctccacccttgtggtacttcggtatccatgctctctgagcgcgcataccaaatatcccacatacaccattgattgtcgaaaacttgggaaatgggtttgtgaagccttcaaaacccgacatgtggtgtcggtgtgtttggaaataaaatgaattgtgaaaactcgcgatgcgggggttgtgcctatgtggcactgtcccgtattcgcatataaggaccgattcctgtgggaaactcatcgagcataatcaaagtgcaaccacaaggtggaataggacaccctggctaagtaactagtcggttcagggaaacctcgcatgccaatagttaggaacgccggggcggggtcggacaaaccgggttcctggtaaggcaaggacaagaagcttgctgacttaccgatcaaggtggttggagtttgatttgtgaatgcctaaaatggcctatacttacgtgaggatttgatccttctatgtggcatgaggtaaccctgagtcggcttgggaaaggctttgtcgcgaacctctgacaccggccagtgtctggagtaagttcgtgtcttgtgggtaaagtgtacccctctgcagaggttaactgactgttcgaacagccgtgcccacggtcatgggcggatgtgaggtggttcccgttgcgtagatttgtttgcctgttgtcgagggaagacccccgatcgcggggagtcgcgtgacccccctttcgtgagttcggccgggggcagagactcgtctctccgaagtcgcgtgttcgtccctccgatccccggttagctagcacacaaatggattacccaggttcaggccgctctggagcgtaataccctactcctgcgtttgggattatcagtgaattttaaaaggtttccctccctcccctttggtgggcaaggtcctccttttatagcttaaggggataccacatgcgccatctctaccctccctctccatcggagggaggggagggggcccttctcgctactgcgaccgggtttcaacccgtgccttttgctggaagctaagcatcggtcggtccttgagtggggcccagcgccgtctccctcctgacacggggggcagccctgtcatttcctcataaacaagggaggacttgcggcagccctgcatcgaacgccgtccggatgtgatggggcgtacctaccgccactccactgagacagaggcgacgtgggggcacgaccgcccgtccaatcggccgtgaccggcaatagactggtcacagaccggtcgcatccgactgacaggggtcggtcgggcgcgccgcacgtctgcccccgccgcattgaatgcagcgagggacggttggggcgctgcacatttatggccgctgtcacgcccagaagtttccccctttttccttgctttaaaaatttgttaaataaatcgtccgaagaaattatcttaattaacctagagctaattccataattaataaatgcaattaataatcggaaatagcgtggtggaatttttcttgagttccccatgctccaatacattaacaagatttttagttgaattttcagagccttggaaataatttttaccaattaaaaatcaccaaagtgcaattataatcccaggaaaatccttttttctcttttttcttttcttttccctccttttcctttgttgggccgtcggcccatccctctcccgcggcccctcctccttgtgggccggcccaagccgcccctccctcctctcttgggacgccgacaggtgggccccacctgtcggtcgtctcctacctccagccgttggagccggagctccaaccgctgccgccgaaaccgccgcgccgctgcctcctccgctcctcccgcgcccacgccgcgccgctcccgcgtcctccccacgtcgccgccctctcccccgcatctcccggcccgcgcgcgcgctcgcaagtggcgggattcgaatttgaatcccccattctctgtctctccacccccacgtcgccggccaaatcggccaccttcccggccacgtctgcctcctcccgcacctttaaatcactcccccgagctccctctctcgtttcccccatttgccgtcccctcccgtgcctcctaccgagcccgcgccgctcgccgctagcgccgccgcttgccgccgcctccggccgcacgctgccgtcgctagagccgtcgcctcgccgcgcaatcaccgccgctagcttcgccgccgcgagagctacctcggccgccgctcgctttccgtccgccgccgccggtccctgccgtcggtggtcgtgcctcaccgcctcctcgcctcggtcggccttgaggccgagctgagcccggccgatgcctccctccccctcccttttctccccttcacgcgtgcgccgccgcctttggccgtgccgccgctccggccgtccgccaccgcctttcgcgccgtccgctgccgtctccccgcgccgccggcggtcgtgtgccgtcgccgctcgccatggccggccggccggttttgaagccgagccgagccgtgcctagccgccgccgtgccgtccgatcagcctcccggccgatctggaccgtcggtcccgtggaccggcggtggaccacccgcgtggtcccggtccacggtggaccgaccccctttgagccgctgacccgtgggccccgcctgtcggcgccgccccccttggatgacgtcagccctgggtattattgcgcaataattgattaaggacttttttctttattagtaaaaacacagtttatcttctaaaattcatatctaattcatccgagctccgtttaagtccattcaagtctcagtaaatcaagaaaaatgcaaataatccattaaaatggttttgtttcctgtttcagtagtcttatagcatgttttgcttgtgtgctttgtttgtcgcgtagatttcggccgtttcgtcgatccgcggtttctcgaaggcattgctgaggtctcgtcagtgcgagagcaaggcaagtcatgcattataattgataatattgtacccaatttacaaatatcccgcatttctattaaatgttgcattcttttacaatgtcatgtgggatgggtcctattacccagccatatattatttaccttatgccattgataacttgggtatcaaaatgattagatgttggtttaggaaatgcttagccatgcctagttcaactggtacacaaatggggattacactattacatagactctaactatgagcatagctttggattggtgacaccgcaagggtgttggttaattaaaatacactgaattgtgggctgtgggtgcatggttttgctggtcgcacccatggcaattaaggaccggttcacgggaaaccctgggagacttgccgtgcttaccacaagcgggagtgggtaactgcttgatctgaggtatagcttaacccttttctaggcaccggtggcgagggtgggcgtgatggagttgggtcggccggggtgtccggttgtccagctgccggatttaccgtggcgcaagaggggaccgcccactgccttttgaggggtgggggtgaaaccttaacgtggtgtggatggttaggggagggtaatgcggagggtcttgtcacgatttccccctttacagtatcatggtgatacttcggggcatggtgacatgtgtggaatcgtgttttgtgggtatagttgtacacctctggccagagtaaaattattcgaatagccgtgcccgcggttatgggcgatcaaccagattcaccgtgattagtctcacccctagtttagcttaatgaactggtgtagttcaagtggttggttgggcctgttgcaacgcggtgtagcgttggacagtgattggttaatattgattaatttactacaattgttttactgctttcaactactgcttttaaatgctagctttatgcaaaagaacccctagcctactttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccagtttagctcgcttttatcttttccgctgcatttgtaatcttttctatttttgtaagacgtggatctgtatgtcaacaattgtcgtttgtgtaccctagctggtcctggacagggatttaatgcacattcagcttagaaattctggttcgagaatttctgggcgtgacagccgcccagcctggactcccctttcacacttccccccgagggggggcctcggggtaaaacgacgggagagcccgagggggtgacgtcacccccgaggggatgtcgtcgacccccgaggctctccccttcgccttagtgactcacgaggtatgtgggtgggaccagctcgcagagccgcgtggctggaaagggaagtagctctcctttactccacatacccccggacccatatctccgacacctgtgctttgtgaaaagttgttgtggtgtgggaatcgtaaccagaatcagcctttgtggcagatggatgacctgagtggtcagaaacgaatctgtgtgattcaggatgtctacgggcatcatagactaggcttcccgagtggaagcggattgttgtgctgctgggcagctggactctgggagtcggagaaattgaaaaaggttctgggagccgcctaatcaagtgaaatggctctgggagccgagaagtaatgatctgacccgggaggtcggtacattaccaattgagttgttgaaaagcatctcttaagtcgatttgagacgcaagtctcttttcgacccaaacttaaaaagaaataaatcacttagtgatttcaaaatgttttcaaacaaaagatttgcaaaactgccttgcctctcttctaagcttgcattaaacacctaaattcccgtggcttgctgagtacgaaagtactcacccttactctatataaatatatatagtttcccccgccttgaagtgaagatgaagtgaagtgaagattagggtttcgtcctggttcccagccgtcgcctgtggtgttgggtgttagtccattggttccgctgctgctgctgttgttggtgtttcctcgtccgtgtcgtcggttgcattctcgggctgttctgagctgcaacctaagttaaggtaaataagtcctctatttattttaaggatttgcaatgattcatatttgtcaccgtgggtaccagcactacgtcctgggactggtaccgagatcgcagtttcgtaggaagcggttcgcgccgttattcctacgacacgctcctatcaggtgccgttgtacggcggtgccggattggagtgtgacataactattatgggtgcccttatgtcgccgataacttatttattacgtgagattgcagccatgcattcctaattaaattttaaaaaacacctctatgtcgacttacgatttttagccgtcgaaaaccacacctaaccatacgtgtgtcagcttacatgcctttcaagtaggaggtatgaatatgatgcatatgtccatcattgctaaaatgctgacttatgcctccagtctcatctctttcccttctccgcttgggcccaattaacggagtagggctcgggaatagctcatgctcatgtgttatctgccttttcgcatcaaaactaacgtacgatgtagcgttatttttcttctcaagccttttccaagcacaacaaacaatgtgtttccaaaataaagcttatacatcgtttgtaatttttgttcatcaataaagttattttactgtgggggcttcccctacagtgctttccttaaaaaaaaaagcttatacatgaaaattgcatccatgataattttatatgtagaaactttatacatactttgtacgtgcgcataaacattccattgaaaaacttcctgtaaaaaataaatttgaaacatattggacaaacttttttttttaaaaaggaacaaaacacccttgtgggcccgtgagacccatgtgtcttgcctgctcaatagtctaccacttggaattcaaagtccaccatatccactattctaacagtgtgctaatttcgtaaaagaaaataaaagtgtaacaaaatacgcagtagaaaaaaacatgggacaaaattaaggacataaagtttgacatcccacaagttcattcatacgaacttcgctgaatagtccctcctagagatggcaacggggacccataacccgtgacccgacaggtttttactctattagaagctaattgtgttctaactcttgtacccatgggtatactaatgggcaaaactcttacctgttgggtacgtgggtatgggtccgttctttacccacccatacccaccaacccgtgggtgaaaaaaaaccgttgattgagcctaaaactataagcaatataagtttcaacgactactaaatcatagtatgaaactcttttcacatcttaagcattgttccattctagttatatgaaattattacttgatctcttgattatgtaatgtggctgtataatttttttacttacctttgaactttgaacgctaatgttaatagattgttgctagagaaaatattgatggtttacaactctaatatggctaattatagtacaaaactataaatgctacaagtcaactatatgggtatgggtacccgttggatacccgttacccgcacaggtgtgggtatggagaagattttctacccgtgatgggtgtgggtatttaagtgggaatatttagacgtcgcgggtgtgggtatggggcaagggaatccgatggatatgcacccgttgccatcctactccctccatcccataatatagcaatctagtaccggacgagacccttcatagtacaacgaatctagacatgcttcctgtccagattcgttgtactattaagtgttccatccggtcctaagtttctatactatgagacggaaggagtagcatttcccctttagagccatagcgggaaaaacgacactccattgccctgcctcttttcttcgatggctacacgctctaaccctccctcatctattccccacccccaaagccatcgatatattccgcgaggctgtccgctgtcctcactcaggtgaatcctctgccacctctgttggtggtttcattgtggtcatccacgtcttcagcgaggttaccgctctcaggtgagtcctctgccgcttccaccaatcatgagtcatctcatcatcaggtatcgtctcccatcttgcgtgttgctatccacgacattctcgttggtgtgttgagccaccttaatcctcaattttttttgcatctccatatatattaattttttcgcgaacgcgtaaaagcattacacatcaatatattagatctatatatatacaataaacttgtcatttttttattttctagtagggagtgtgtcatcaaccgtcaacaagaacgagaactcatcgcgtttagacttttggaccgagggagtagttcactacagtctactagactactacggatcagaagaactctgggaaaaaaaagacactgaatgaaatagacttgccggcagtttgacaccatgagttcgcaggccgtgtttagttgcaaagtttgaaaaaaaatcacatcgaacttttctacacacacaaactttcaacttttccgtcatattattttaattttctttaaacttttaattttaacgtggaactaaacacacctgcagtttcagacttcttcaggtccggatagaaatatcacggaaaatgctggctcattatcattggaccgttgggtccatgcaacgtcaagcagatactcctgtaaaaaaaataacttttgggtcactcgtgtaatactagcacaaatcaaagtttgcaatgtgaaatgaattagacgaggatttggattttggcacgcttaattaagcttagctgctttttatttttagttagcacgcttttcaagcagttaaacgatatatttcttataaagacataaaaagatgcttttaaataaacaaatttattttcatttttttataatttataattaattaatcgtacgctaataatgtttgtggttgtgcttgcagctaatcatccaacacttattgaccgaaaagaacacgccagaaattgtattgtcatgcagagagcagagaggacctcaagattatctgcattcttctttttttttcactttttttttagatgtccacgacgactaaatggttggaatgattggtatcttggtcgttttcatgtttccattggccttattcaaagccattgtggggttgagtatttgtttcttgcttttcttgtcactttctttaggtttcttatatattacttttcgagaaatacgtaggaatcaatcgttcttggtcgcctttaatggatttctttttgcacgatgaaatgacgtgtaaatctccatcataaatattctcagacagggaaggattcaggcctagggcagccctaggtctaggttcttgacttcatgtaaatttcatttgaatttctaaattttgtatgaatgagtggaacatcagaacaagtaatgcaaatgagactgtgttcggaactctgttttccaaactctcccctctcgtttttcgcgcacacgctttttaaattggtaaacggtacattttttaaaaaaagtttatatacaaaaattgcttcaaaaaaatcatattgatctatttttttaaaaaaatagctcatacttaattaatcacgtactaatgaatcgctctgttttctgtgcatggaagatgggttcccaacacacacctccgaacacagtcttacttgttcttagaaagaaagaaagaaagagacttcgcacattcaagcctcctttgaaacacggcaatttttactgatccttgtaggaattgaggttatcctgaaacgttaacaattttctatatatttgtcgataaattttctcctaaaaatttgacagatgtaattacagtacaatcgtagtgtaattacactataacttgcatgtaattacactgtaactataatgtaacttgtatgtaactttcaaaaatctctctataacatgttatttcggtaaaatgaaggtcgtgggaacaaatcctctcacatatgtgtgtactgtgtttttttcttccttaccagaacatatcttataatagatctaacgattcaaaattacgtgaaacttacatacaagttacacagtagtcacatgtaagttacagtgtgattacactgcaattgtactataattacatctatcaaatttttaggagaaaatttatcgacaaatgtataggtgatcccaaagttaattgcatttgaaaattgaaagggcttcaaagttgaaacaactgtaccgcaatgcaagcagcaactccggcaaaccaaaagcatcacatgactgcgccgaaatgcaggaaaggccagcccactgacccatctcgcctcggatgatgcatcacatgaaggcccgtataaaaagcccacattccggcccattgtcgtgtatggtcccaggttccaaaatggatggaccggaaattgggctttccaaacgaggcctgaccatgatgcagcccaagtgttgccggcctggcatttttgaagccatttccaatttttggtgctcttagactagtggcaactaaaaaacatcccgaattcgcatcccccccccctgaaattcatagagaatctcacaaagaaacgtgaaattcgtattacagagcaggttgatttattcccacaataatccaagctccaaatgagacaatgtttctttggcataccaagttaggttgaaaaaaaactttgggatggatcccggtagtttgagaaacgtcagggttttctggctagctccataaagtggtggactagctagcttaggtttaaagcctcactcattctaattatttgatattaggtcttatatatagatttatagaatgaataatatgatgattatttaaaaaaatatataagatgatcaattgggaatgaagagattaagaccatttgatttgtatgaaaaatatagaaatttaggaggattttatttctatgaaaaaaaaatctacgaaaacatttgaaacaaaggatcaaatcatatcctatatttaaaattcctatctaatgggtaattctataggtactttggaggctctagattatctgtgagagcgctctaaccagtttcactctaaaatcgatttggttgggctttgactctatagaggtggaactagagttggagctttgtcaaacgaaaagtattagattagatggatagtatgaaaagtattagattagatggatagtattgtattatatccgatttgttatgttatggtaggataagattaattttcatctctatctctaaagttacttaaaatctaatccatatatatactgacattcaatacttacaacgtgtccgatgttcccagtaatcctttccctctactatcgatcttttttccacgtcggtcgcggctttttcagtgctttgactggttgactccccgcctcctcttccctccgccgtctgatcgccctcagagtcgaccgttgctgtgggccccacccctcaccgccggaccccgccgccgccgtcgccgtcgactccccgccggcgtgcaacacatctactccaccatggctcccgcccactcccaccggcgtggtgcgacggaggcgaacgagcagatgaggaggaagaaggagaaggcgcttcgagagaaggaggccggcgacgacgacttcgacgagggccgctacaagcgcgccgtcgagcactacgcccgcgccgccgccctcgaccccggcgacatctccttcccgatcaagtgcgccaaatcctacttccacatggaccaggtcagccatcctcgtctcgcccaatccaatccaatccatccccaatttgctactacttagcatttaccttgttcgctgcagtacgaggagtgcgtgaggcgatgcgacgaggcggtggagaggggaagggagctccgcgccaagaaatcgctggtggcgctggcgctgttgttgaaggggacagcgctgctcaatctcgccgactgcgcttcggattgcaaggcggcgatcagggcactgaagcagtcgctggatgagcattatcataaggggacagaggctatcctggacgaggcggagagcgccatggaggagatggaggagctggagaaggaagctgccaagcaccaccgagaaaaaggtttggactctctctctctcttttctcctcttgaggaagaagcataatcgttgatcaggagacaggagtacagtttaatgtgaggttttggattatggggaaatgaggagtgcaaatgggtaaaaaaaaattgtttgattccttgtttggaatgtttttagaggctgcttggaccttgggggaaagaagagggtttgggaatcttcagacttcagctcatgaaaaataaatagatcacaaaagaatatatacagtcttaacccaattcaatcccatgacataccaaactgaaaaatcattttcagtttaagttctcagcaccaccaccaacaacaatctgatccatctgaactgtgcacagcgattgattgctttgtactgatcgtttgttgctgttggtgttagttcagttgacatccgcaattggatcagataccttctactcatgtagccatgcatgtaggatcgcttgtcctttgttaagtgtcaagtgttctaaagttctaggaagttaattctgtgatttaacttgatatttgcaaggacaaacataattattacgagttaattacagaaaacaacatacctctagtgctttgttaagaacaccatgttttaagtgatatttgtaatagtaagcattaaaatcaccttttagcaaccaacttgccaacagaccagataatgtggatagggatgtcatgttggctgggttacagccttagaggcttagagcaagtttaatagtagaagtgattgttacctcttaactttttccacatcatctactcatcaattgtgaggcaacatatacaatacactagctctaacatactggttcccaatgctaattttattttattcatttgctctcgatttactctttatcttttctttctctggaagtttgtgtacatgttacctcttgcataagggtggctcacaggctcctcctttctctactcccttctttcctccacctcatcatatggcatctgtggcatcctggggatagaggttaaggccgtgtacttcctctagaacttgtactttgcaacaagtgttctggttgttacagtggaagtagagtaactcaaagtaagctgaatatctggatggggcttgtattgtaggactatttgtctacatcctttctttaagcatgatataaccagctcctaactagtactagtaaaatgataattgccatctcattgagatgtacaaatgccgctgctgagtatgtacacatattgcaggcaaagaacttctcagtaagaaaaagtacaaggaagcagcaatccagtttactaaagccataaaaaggaatccattgaatcccagagtaagtattgataccgctactggttgtgagtcgaaagatattttgttctttggtgaaagatatgtctcgagctactcctttttaagttttggcattcattttttatgcccttttatgattgatcacccagaattttagcgacagagctaaatgccgcatcgagctaaatgcattggctgaagggcttgaagatgcagataaatgcattgaggtagatcctactttttggaagggatatttttgtaaaggtgaagttcagttcttgatgcacaattatgaagatgctatgacaacttacctagacggtttgaaatatggcccccaaaaaacaacaatttatgatggaataaagaggtacattcccagtcctctgttatctttagtgatcttattttgattatctgaagtaacattttgtccggtttagatgtttagaacaaattaaaatggctaaggaccgtgatgtcagggataaggacttgtgggaggtattgacccatttactttctttcttttaacaagtcttccatgataacctgttgctttttcagacagaaaggaatatgtcttgcatgtgtggtcaattctagtatagtaaaactgagtcaaaagggtcacatatctgtgtaataccgatactgctcctcataacttgagagattccttagataccaaaactagttccacaagtgggagtaggattgacaattcatttgtataattgtatctgctcttgagattttctacgatcattgagagatattggtaccgactgttagtcaagatatatgtacttttgtaattgacaggaaagatcatcatccaatcatttcttgttgtcaaaagttagattgcatagaatataggatgcaagacaacattcaacatccatttactcttgctgctgctgctaagcttgctatttgcaatcttggaacagaccaatgccactgtatttagtaccaatttgcttactcccagccaccaaagcagaatcttcattgaaaccaacattcccttgtcatatgataatactttttgacattcttttccctattcgaaagtatgggatgttgcaagctattaaatacacccataaatcaaaggtatctatctgaattatttgaatgagggtgtttggtttgtgcaggcattcaaaaaatcgagttctagccaagtcgaaaaacttacgatgcagcgcgatgtcgtcactgtggagcttaagtcagccaaggagcgtaacgctaatctagaactgcaactctcagaacagataggccgtattgaacggcttctgtcgatccaaaacagtgaacctccacatttcatctgtcctatatctcaggtgagcggaaaacgatatttcaattttcttggttcatgctggtaatactttttttccccctgaaaaacactggctactgtaagagtataatctttgtaccattgtccaatgactgaccataacattacttacatacgtggtcaaaattccaggaagtcatgaatgatcctcactttgcagcggatggacacacctatgaagctgagcatatcaggaaatggctcaacgatggacatgacacatctccaatgaccaacgagcgacttcaacataaaaaactcactcccaatcacgcactgcgctctgctattcgggagtggcaccaacaccgaaacatgaggcatacttctccgcggcgccaacagctttttttgtgaatttgtgtgaagcaagttgtaactatgaaaatttagccgcagttttgatccttgctacagagagagtgcttgccgcgacatggctagatcgcaatccacattttgtaaagaaccatcattaagatttagtactaagttatgtgacatcgtatttcagatattattcttgttatatgtacttctgtatgtctcacttgtgttggatggctaaatagatgaatgatatttattggagggtatacaaatgaataaattaactgttataaagttaaacaatagacttaaaattatatattatgtatgaaattcatacatatattgttagatgcaaatagtatgctctctagttcatgtagtttcaaatattacatgaatcaggccctgtttagatgggactaaaacttttaagtccctatcacatcggatgtttgaaaattaattataaatattaaacgtagactattaataaaacccatccataatcttagactaatttgcgagacgaatctaatgagcctaattaatccatgattagcctatgtgatgctacagtaaacattctctaattatagattaattaggcttaaaaattttgtctcgtgaattagcttttatttatgtaattagttttgtaagtagtctatatttaatactctaaattagtgtttaaagacagggactaaagttaagcccctggatctagacaccacctcaatcttgcttgtagtcaacataactgattgaccatggtttctgggctgaagtacaggactgacggacacggcgacggggcttacaatttcaacccagatgaatagaatggatgcagaaaccagaatatggcaagaaagaatgtcttctggggaaaaaaaagacatgatgaaaatagcatggatgctccagtatttttttttagcactatggtacagatacaagacactacagacttgaattgcaatttattcagtactttttagtgaaaactacaaatctagggacaaatgcataatggaataatttcagaaccattctgatttctgaacatcaaacaaaacagaacaagtgtaggataagatgaatttatcgcatggagccagacctgatcatccactcaaattgcaatcagttcagacaaatatggacagaaatttggggataaaacagattacttcggttgcaatttcagaataaccagcggttacattgcaactaagaatcaaagactacgacatgacaaggcaaggatctaataattaacaagaactggtagaacatgacaagtccctacgaaccaagcaagaaccaaaggagggcggatcgcctaagcgcgctcgccgcggatccggcgcgcgagctggatgtccttgggcatgatggtgacgcgcttggcgtggatggcacacaggttggtgtcctcgaacagcccgacgaggtacgcctcggcggcctcctgcagcgcggcgacggcggagctctggaagcggaggtcggtcttgaagtcctgggcgatctcgcggacgaggcgctggaaggggagcttgcggatgagcagctccgtgctcttctggtacttgcggatctcacggagcgcgacggtgccgggcctgaagcggtggggcttcttcacgccgccggtggccggggccgacttgcgcgccgccttggtcgccagctgcttcctcggcgccttcccgccggtggacttgcgcgccgtctgcttcgtgcgggccatcgaggaggaggagaggagagcttggcgcggcggagaaggcgaggcggcggcggcgagtgatttctttggatttgagacttggcggtggtggattgagagggggggaattcgcggtgtttaaataggcgtgaaatttgggagggattcgctcattcgcattcgcgcgcagtggaaatgttcgaaatttgggcgaaattttgggtttggaattttggggaggcgcggccccgcgcgggatgcgaatgcgatccgcgcgcagctgctccaaccaatcacagtgcagagctcatgctcccacggatcgcgatccgcgttctgcccccgagatcaaatctgcaccgtcgattcgaacgcaatcgtacggcgctggttccgcgcggcaaaaaaaatccaatcctattaaaaaaattgcattttaaatttcgtttaaaatttctgcatttgaaacagcgccaaagttgaaactctgtagggctgtatgcaaaacctaagcatctgaagactggcctgcttcgcaagaaggcccaggccctcaacccataggcccatctctcctcagatcatgatgcatcatctcatcttcctcgcatgggcctatcctatgtatgggccggaaaatttaactaattatcaggcccatccatgtgaagccccgggagcttgggcttttccagacgcctggatgggaaagtattgctggcccggccatttttctcaattcataccgtacgctgccactcatcgcttaaggccgtatggaaataaaaccgccgttaaatttcctgaaaattggtcatactgtacttggttaatgataacaccgagtattattttcacaatatttttcagttattacaaacatatttgggtgtgccgaaatgcacaaataactttccttttgaaatctcgccatgaatttggaatggattttttttataaaaagaaatactaggttcctttttgaaatctcgccatgaatttgtaacattttttcatgtagtggaaatagcaactagtacatggttatggagaaagcacacatattaacttgcaggaattcttttgactacatgctgaacgcgttttgaaactccttaatattaatagacatttttttgtaagcccagctgcatgctgtagtggagggttggtcggttggagacttaagtcggtcaagaaagaaaatgaggtcattatgcccctaatggcctgattaattagaggtgaagctacgtcggtcgagcttatctgctaatcatccctgaagagccaaagagtttgtacgctgccctttggcctccatccatccatccatggctcccgtcgtctcccgcggcggcggcggcggcgggcgcgcgatgggggcgaaggagcggaaggaggcggcgcagcgcgagaaggaggccggcgacgaggcgtacggcgaggagctgtacaagagggccgccgcccactatgccgccgccgccgacctcgaccccggcgacacctcctgcctcatcaaacgcgccgcagccaacttcagcatgaacaaggtcagttcacttccaatcccacacgcaattccgcggagaaaaccgctccgattcacctcgccgctcgccgccggcgcgtttcagtgcaaggagtgcgtggcggactgcgacgaggcgttggggaggaggaggaggagggacgcgcgctgcggctgcgacgagaagctggccgccgacgcgctgttcctcaaggcgctggcgctgctcaacctcgccgtctgcgccgcggatcacgagccggcgatcacggcgctggaggggtcgctggagctgcgccccggcagcaaggagacgcgggctaagctggacatggcgaagaggaacagggacgcgtttgcggagcaggagcggctcgatcaggaagctgccaagacccaccgagacagaggtttgtgacatttttatttcttcctcttcccctcttgacgaacaaccactaaattcatccctaatcacacacaccatatatatttaaatatgtaattgtgcacatcgatcaacacacagtatgtaattgtgcacatcgatcaacacatcgtatgtaattgtgaacatcgatcaatttactctgtaccgatcactgacgttgttcagtttcaaaaaatcatctgacgttgttgatgttgattcagtcgagtccacaataggatcaggtacccatctatgtggaagaatcacgcgcacacactgctatggagtacttgccatcgcacatgcacggatttgtagtcaccggtagtgagttactactccataagcagagcagctgtcctgctcccatctgtctgttgtgctcttctgtgagtgtttggtgtagtgtgtagcgctttgcgccaatgcttctttctcctcaacgatcctgttgttgattcatgtaaaattgtaaaatgtaatgctttctccacatcttactataatcggtcggcattcttccgccatcccagcgggggaaaaaaactgtagtgcattgctaaaacacacacataggtgttctccaaaaaaaaaaaaagaatacataggtatatcttcaccaccgcaactatatcaaagtgagctggatatatgggagatatatgggacctgtgctgtttacagactgtgtagtagtctacgtccattctttaagcatgatataaccagctcctagtactagtaaaaatgctaaattgacattccattgagatgtacagatgctcatactgaatctgaatgtatacacaccttgcaggcctagaacttctccgtaagaaaaagtataaggaagcagaaatgcagttttctgaagctataaaaaggaacccaaggtatcccaaggtatgtaattgataccactacactagttgtataacaagtctaatgaaattttgttctttaattggtgaaagatatgtctccagctgctcctttttaattttggcattcatcttttcatgaccgatatgatcacccagaacttcagtgacagagctcgatgccttgtcgagctaaattcattgcctaaggcgcttgaagatgcaaatcgatgcattgagctggatgatactttagggatgggatatctccgtaaaggtctggttcagattgcgatggccaaatatgaggatgctattgcaactctcgtagacggtttgaagcatgacccacaaaatctcagtattcataacagcctaagagagtaactttccaatcctctgttacccatattgtttgcttttgttattattatttgaggtaacatcttctctggtttagatgtgcagcacgcattaaaatggctaaagacagtgatgccatagcaaaggacttgacgaaggtattgatccgtcaagtctttcttttaacaggtcttccatggtaatttgttttgtttttcacaatgaaaaggatatgtcttgcatgtgtggtagtaataaccggtcaatatagccatatgttcgtatgctcacaaggttctcttattttgggagttatatacctcttcattacttgagagatactctccacaaaaggatgtaccgaaactaatcttacaagtgagagattatctatgttcctgagtttttctacaatatatgaaaatatagttattttgtgttagttaggttctatctaacactatgaggtatatatgcctatctatagctctcaatgacaaaaagattcttactttactacaccttttgtctaatcaaatcagtttaaaatctttacattagggatcttcaaataattgggaggcacataccttctaacatattctactttatcagcaaactaatggatatcttacatactttcagcaccaaagagaaatagaatgtctgcataaacaactgaacgaaggtgagaacaaagcatccaaggagcgctcaaggcggatgaaatctgaaaagctggtaaatttattactgttttactaagtgttatatattaatcatttatgtctgcaaagtagcttgatcggaaatatatcatcatacaatcgtttgttgttgtgaaaagtttgattctatagggtgcataacaacattcacatttatttaattttgcagctttgcaatttatcagttgcttgaatttttcctaactgtttgtcacctacactaagataaggtgcaaactagacttgcgcaaataataaactaaacttgcataacataggagttagattttgtaagtttaagttagaatattgtttgtctcacaaaaagaaaaaaaacataaatatgagtaattggatattgtcctactgttggaaaaaatagtcaattgacaaatagacacaataaccccttgatcttggtgttccaagaaatgggtgatcttggagcagaccactgccacttatatactgcaaattgcctaaggaaatatcagactttttccctaaagaaatataggatgtcacaagctattgactacacccataatctaaatgacactccctatgaatgacaggtgttttgtttgtgcaggtcaagacattgtcaagccaagttgaacaacttaggtcagccaatgagcggaatgcaaatctagaacgcgaactctcagaatgcagagagcgttttgaacggcttcaattgatccaaaaccgcatacttcaacatttcacctgtcctatatctcatgtaagcccccaaaaaaaaaccctcaaaaaactatactaagtgccataaaatacatactagtttgtttataacttttgcagacagatcctctgcaatattgctcctgcagtgacaataactagttactgcaggtgtaatattgcagagaatccccacccattttgtgactgatgactcacaataatttatgtggttaaaaaatttcaggaagtcatgaatgatcctcttatggcagctgatggacacacctacgaagctaagtttatcagggattggttccgcagaggccataacacatcaccaattaccaatgttgaacttgaacacaagaaactcgttccaaatcgggcgctgcgttctgctattgaggagtgtcgcaaataacacaatatgatgctacttttaacctctgctacaagcatcaccaaaactgttttttgtgttaagtaacgaactgaacaactatgctttaataacgaaccatgatatagcttttcaatatgcagattcggatttgtaaactgagtttgtgtgaattaaactatgaccattttgtaataatttattacagactcttggtagaccagttgaaatgtttgctcaattataaaagaaaatactctatgcaaatttagaatgccttctccacgcataactcaattgatgccaatatgtaacactaacgcatcattcagtaagaaagcgaggccactttaatcctgcagactctgattctctgaactcggaaaggcattccacacattcatttcaaatctttcatgaaaaacaggcaaaacaaatggatagatttgaacatggaagaccgatttctcattcataatcagctcaacacttcacagccgtgctgccatgcattgcaggtttgcaacaagttacattactactactccctagcaattttctggtaagctcagaccaagcgactaaatcaatcaggcgcgctcaccgcggatccggcgcgcgagctggatgtccttgggcatgatggtgacgcgcttggcgtggatggcgcacaggttggtgtcctcgaacagcccgacgaggtacgcctcggcggcctcctgcagcgcggcgacggcggagctctggaagcggaggtcggtcttgaagtcctgggcgatctcgcggacgaggcgctggaaggggagcttgcggatgagcagctccgtgctcttctggtacttgcggatctcacggagcgcgacggtgcctggcctgaagcggtgcggcttcttcacgccgccggtggccggagctgacttgcacgttgccttggtcgccagctgcttcctcgagtccctgacttgcacgccgtctgcttcgtgcgggtctgtgtctaacttattatacgtcaacaaaaccaatcgtatgcttctagatctaatttaattcgattttt

SEQ ID NO: 82802 - DNA, 20580 bp, Oryza sativa
gcccaccctctcccctatactactagatgtactcctccctcttcccccttcctcatctccttctcctctttcagtagaccacacaaaattttttgaaaaacaaaagttagaaaaatttatgtatagaaatactatatataaaaaatttgaattcaaattcaaatttgaatcgggtatgtaaacttttgacttataaactttggatctataaactttagatgtatagaaatactatatatagaaaatatttgaattcaaatttaaatttgaatcagatataattaaaattcaaatttgaatcgggtatataaactttaggtctataaactttacatgtatagaaatactatatatgaaaaatatctcaattcaaattcaaatttgaatcggatatttgaattcaaattcaaatttgaaacgggtatataaacttttgacttataaactttaggtctataaactttagatctataaactttaggtgtataaactttatatgtatagaaatgctatatataaaaaatatttgaattcaaattaaattttgaatcggatatataaacttttgacttataaacttttggtctctaaactttatatgtgtaaactttaggtgcataaactttaggtgtataaatttactaaaataggaaagtaatgcgatgccaaaaaaggaaaccaggtggagggagggagtggggagcgaatctgatcgctaccccatccccacggcgatcaatcgcccattaggggtaccccctccctcctggcacgcaaaacaaaactcgttttgttgcatgattaattaaatattaattatttttttttataagatagattaatattattttttaaaatattttttatatagaaaattttttatatatcattataaaaaacgtgcgcgtgaaaaacgagaaaggcaagttggaaaaatggtgataaagaacaaagctttaatgatgaataaactcgacgtaaaatatacgggccagtaatttacaactgtattgggctgattacagacctaacaggatcttatggtgtatttggataatgggaaatgagaggtgggattgggattgaaatataaataaagagttaggattaaatggaagagggagaatgaatggttaagatttaaagatggcttttggtgggagggaaatcatttccataacccattagccaaacaaggccttaatgtgaagggtaaatttgctacaggacactcaaagattgtggtctttgctgtgagacacccgaagatcgtgtatttgctcgtgaacactgtaaaaaagtggtaattagctgctggacattcttcccattattttattatttccggtcaagatggagagagaaagagttgtgtaagtaccaaaatgcccctggacactgttcttcctctctctatctttttttccccttcttcttccttgcagcagagcagaggtgcgagtgtgcgacggcggctggcccgagcttggacggctcagccacggcgaggcggcggcggggcggtgtaggccccacatcctttctttttctcttctttctctcctctctcgagcaggcgtggtggcagacttgcgtgaggcggccggcggcggagcagggggcgcggcgctggagagagggagagagacggccgacgcgatggcgagctcggcggcggagagtagcggcgcgcggcacggcagcgggggagagggggcgcgcgcaccgcccgtcctccatagcgatggcgtgtagcacgttcttgtcctccagcgacgccggcgtgccgacgtcggaccacaaccaggccacgttcttcttgtcccggaagtccagcaggatgatgaaggaggtgtctgtccgtaggaacatggtcgctgccatgagcgtgctcgtgccgtcgagccactggagcttgtcggcgtcgccgagtgcacagcccggcggctcgtagaagaagtcggcctgctcgccggtggtgcagtcccagacgccgatgccacctatagctgactgaggtcttatgatcattgtgacaggatgcaccctgcatccttaaaccgtgacagcctctgcaaagccaacctcatacacactttgctgctcattgctgatcgatcacatgatgcatgatatggccattcatgtagagaagaatccggacaagaataactactagtggatcatggtgcagttgcagagattggggaggaagaagaacactcaatgaatgtcccttgttgcccgagacgcggccgattcgcgcctgccatctccagttgtacacgcgcgatgcggaagaggtggcgcgggtcgccgggaaggcagttatacacgcgcaggtcgccgccgctcctccatcgctcatttgtacacgcgcacagcgctgccgtgcgcgacgcagcagccgccgttgggcgcggcgcggacagccgtcccgtcgcccgcggcgttccctgccatggacgccgccagatgcagctggtccccgtcgaacggcccccaccgtgcctcgcggaagcggtcgaggaggccgtaagagagcgaggtagagcgcctcgcgccccccggcaaaaccttcgcgttgctgtcgaagaagaacagagaaagagagattgacaagtgggccatggacaaacttgtctttaacttaagtttctctctccgttttcatcgaaaataataaaataatgggaggagtgtccagtagctaattaccatttttttaccgtgtctacaaacaaatacacgatctttgggtgtctcacagcaaagaccacaatctttaagtcctgtagcaaattttgtctaatgtgaaagacacagggaatatcaaacctggtctacaggtatccgtcggctgctcctggcccagctgcaggagcagcagccgccgccaccaaccaagctcgaaaatgctactaggcgcggccacgtagcatcgcgcggagagccggacggcagagcgacgcgtgttgatacggggtgggcagaaaaataccgatccaaaaagaccgagaccgagaccgagaaattcggtgatcaattcggtcctaggtagcgaaaaaccgaaatttgttcggtcaatttggttagtctcttcgggtaaccgaatagaccgaattatcaaaaaaaattgtcaaaatacaacctacaatccactatgtctaataggattaaactttaattttcacatccctacttcttctaggcatttaacctaataagagtctttacttataagtgcttacgaattttttttttatgatttttgtgttgaaaatttccattatttctttgcatatatgaaaatgttgttgaatttcggtcaggaccgagaccgaatttgtcggtcctgatattttttcgcggaaattcggtcttcacttttcaaagatcgaaaagaccgaaagaccgaaaccgagatcgaaattttcggttagactgaatgcccacccctacgtgttgagacttgtgagaggactggcgcggttttttttcgggtttccctcgttttttttctggtttttccgatatttctgcacgtatataaagtttgtatacgtattggtttttccatttttaatacgtatgaatatataaagtttatatatgcatgtacacaaaatttgtatatacatatatagaaactttgtatatgtatatagtaaaattttgttagtatacgtataaaataattatataaatatatatcatacatatacatatgtgtatatatacgtatgtactgtatattgtattgatgggttagatgggggcggaccgacaacgcggctggccggctgccggctgcagccccgcgcgcaaccgatcagccacccccaacaagctgggctccagtttggcgagtcaacgagcgaaatcaagtagtagacgagcaacagtggacgccagcaaataaaccttcacaatgtaccgtccaaatctcaaagccccgaacgttcgacgagcttcgggaaagctctatcgggcccttcatgtacaatgtaccgtccgaatctcaaagctccgaacgttcgacgagcttcgggaaagaacgaatcgttcgcaccggttataaatagtgtgctgcgaacgttcactctcacaaccagtcaaccacaaccatccgttcgattgatcgatccttccaaaccctagcttagtcgttgactcctgcgccgtccggtgagccagccatgtctcccgtacgcttcaacccgtggcgtgcggcggaggcggaggtgcaaggtgtgaagaggaaaggtgactcctgctacaacaaggggagctacgggaaggccatcaagcactacacccgcggcgccgaactcgaccccagcgacatctccttcttgatcaagcgagccaaagccctatcgggcctgggacaggtcagactcctttttctttccggcctgattgaacaagacaagggaaagggtaggggagttgtttagacggtgggattagtcgacggacttactagtaacatcttttagttcccatcccttgtttggtttaagatggagattaccccgggatttgggggagatttggcacaaaatgggcatctctggaacgtgaatcgagtggcacattctgaaacgagtgtgaattgagtagcatataatgaaatttcttccaaattgatgttcctcgcggatttaattttttttttcgagggaaccctcgcggacttgattaacgccctgttcgtttcagtaccaggagtgcgtgagggactgcaacgacgcgctgaggaggggcgaggagctcggctccggcagctccggcaacaagctgatctcggaggcgctgttgtggaaggcgtcggcgctggagcatctcgccgactgcgccgcggattacgagcaggtgatcctgctgctgcggcggtcgctggaaacgtgccacagcgaggaggcgcagattaggctgaagggggcgttgttcatgagggagcagtacgaggaactcaaaagtatggactttcatttcctctgctttatcagtatacgaagccagttgattactgtgcacattgatcgattttccttgtattttcaagatatattcctccctgacatatggtcattgaatgatctactacctccgacccataaaaaaaagaccagtactgaatgtaatatatcatagtactacgaaaatctctgtctagatttagatttattatgctagaatatgtcatatctaattatatatttgttttttttgagacggagggagtagataccactttacccaagttttactttaaaccatctttagcacatacagtagtattatttcacatcctttgagaactccgcaacaaatgttgtggttgttatagtggaagtgcagaacgcaaagtaaattgtatagctcatggggcttgcaatgccagtgtagttgtaccaatatgccctttctttaagcatgagtatatatgggtgtgtttagttcacgttaaaattggaagtttggttgaaatttgaacgatgtgacgagaaagttggaagtttgtgtgtgtagaaaagttttaatgtgatggaaaagttggaagtttaaataaatagtttagaactaaacaaggccatagtagcaagttcctgagccctacctagtactactaaagttctaaattggaattgcattaaattgtaatttatagtcattcttcctgtaacatctctaataattagaagttgtagcttctttaaagcagagttcggaatgaatttcgttattaaaaaaaagtcccattaagatgtacaaatgttacaggccaaaaacttgaatgtggtgcttatccaacttacacgcagcatctttaccccgcaaggtacctttccagtcatctgttatccttataaattttgctattattattggaactaacattttgtccggtttagacttgaagagcgcattaacatggataaaaccaggctcaacaccttgttgaaggtattctacccatttactttctttcttttaacagggatgtattgcttgtgtggttatctctaatgttgtaaaaatcagccaaagtggccacaaattcgggtaataccaatatagctcctcacaacttggaagatacaatctgtaccttcttatggaggaggtaccgaaactaattctacaagaggaaataggattgaagatttttgactctcattggtatttaagggttagttaacagataatggaaaaaacatatatacctcccgagtcccgatatctctcccaaccaaaaaaaaaacaaaccttatattgccgactatacaccttcccaaggttggaagcagtgggccaaaacggccttaggctattacgcattcttttctctttcattttaactcatttcgcatagcacatatatttttcctttttgagcacttctaatatggtggaatattatttatttttatcagcaagctaatggatgcctatttttagcatgcaacaaaagaactacaaaaaaatgaggacaaattatccgaggagcgctcaagacggaaggaatacgaagacatggtaaaaaccattaccgatttgctaaatgtcactgcattgaacatttatttttgcaaaagtttagcttgaccagaagcgtaacatcatgtcatcaatcatcctcaattgtttcttattgtgaaaaagtttgattctatagtgtataacagcattcactgctgctattccaagatatggacgagcttggagcagatcattcccatatcagaatacttttcgattacatttttttttccaaaaattgaaaactgtaggatgcagcgcgccattgagtacacctatcaataatcccgatgtatgtctgaatgatatgaatgtgtttggtttgtgcaggtcatggcaattcaagcctcgattgaacaacttacaatgaatcacgatgcagaacttaagtcagtccgggaggataaagcgaatctagaatgtcaactcttacaatgcacagagaaacttgaacggctacaatccatcttaaaccgcgaaccgccattcacctgtcctatatttctggtgagcagaaaatgatcattattttttccttttccagttcatcttattttttatatacaattttctgaaactattgactattgtacaaattgtttttttttccttcaggggattttcacccattcttgtcatccaaacaatcataaaaaatgatgagttaatatgaggagatggcaccttcacaaatgtgctggtttaaattcaacctatatcacttgaagccaaaacactatttatagtcatatttattatttttttcaactggccttgaatttaagcttaaatgtttgtgaatcaatgttacataatattctttcttgccaaaatttttaataacttttagatgtcatgcaaaacaaaatctttcctgactacacttattaccttgcttggtcaaaatttcagcatgtcatggaggatccttacattacagcggatggacacacctacgacggtgaggcgatcagggcatggctcgacgctgggcatgacacatctccagttaccaacttgcctcttgaacacatggaactcattcccaatcgcgcactccgttctgctattgtgtggtggcacgaacagcagaacgcggcacgcgaacaccgcgacatggcgtgaactacaactcggcgtttcatattgtaaaattcttaattgttgtctgtacttttgaacaattttttgctgtctgtagttacttgttagccatgtttataacacacaggttgaaattgtaggctgttagtatgccttgtacacacaggtcgatataattcatgccagaatgcaacataaacacagcattcagtaaaacagctcttaatcatatgactgtgaaacagtaccaaatatttcacaaaagcaggtgaaacaaatagcaagatttgaacatcagaaagatttcccatttataatcagagcaacaattgacagcaacagcaacaagccattacatcactactactaagcaattctggtactagagctatcacagatgaagcgactaataaattaatcaggcgcgctcaccgcggatgcggcgggcgagctggatgtccttgggcatgatggtgacgcgcttggcgtggatggcgcacaggttagtgtcctcgaagagcccgacgaggtacgcctccgcggcctcctgcagcgcggcgacggcggagctctggaagcggaggtcggtcttgaagtcctgggcgatctcgcggacgaggcgctggaaggggagcttgcggatgagcagctccgtgctcttctggtacttgcggatctcacggagcgcgacggtgcccggcctgaagcggtgcggcttcttcacgccgccggtggccggcgccgacttgcgcgccgccttggtcgccagctgcttcctcggcgccttcccgccggtggacttgcgcgccgtctgcttcgtgcgggccatcgaggaggagaggagaggagagcttgacgcggcggagctttggatttgagaaatttcgcggcgaagtcggcggcggcggagtgggttgagacagcgagggaggcgacgcgtttatatagggggaggctggggtttggaatttgagagcgcgaaaattttttgggtttggattttggccgcggggaatcagcgccgttggattgcgtgcgaatggacggtgcagattggatccagggggcatcacacggatcgcgatccgtggggggtcgagttctgcgctgtgattggttggagcagctgcgcgcggatcgcgttcgcatcccgcgcggggccgcgccttccccaaattccaaacccccaaaatttcgcccaaatttcgaacattttcactgcgcgcgtactatgcgaatgcgaatccctcccaaatttcacgcctatttaaacaccgccgaatcccaccgcctcaatccaccaccgccaagtttcaaatccaaagaactcactcgccgccgcctccgccgcgccaagctctcctctcctccttctcgatggcccgcacgaagcagacggcgcgcaagtccaccggcgggaaggcgccgaggaaacagctggcgaccaaggcggcgcgcaagtcggcgccggccaccggcggcgtgaagaagccgcaccgcttcaggccgggcaccgtcgcgctccgtgagatccgcaagtaccagaagagcacggagctgctcatccgcaagctccccttccagcgcctcgtccgcgagatcgcccaggacttcaagaccgacctccgcttccagagctccgccgtcgccgccctgcaggaggccgcggaggcgtacctcgtcgggctgttcgaggacaccaacctgtgcgccatccacgccaagcgcgtcaccatcatgcccaaggacatccagctcgcgcgccggatccgcggcgagcgcgcttaggccatcagcccacctttggttcttgcttgattcatagggacttgtcatgttctaccagttggtgttattattagatcgtcgctttgtcatgtcgtagtcttagattcttagtttccatggttgcaatgtaactgctggttattctgaaattgcaatcgaagtaatctgttttatccccaaatttctgtgtccatcttgatcctgtgaacagattgcctttgactggatgatgtgatgttcagaatgtttctgaagttattctgatgatctgaactgaatatttcggttatcctagtacttgtcctgttctgtttgatattcagaaatcaaaatggttctgaagttttccgattgctggtatggatttgcagcatttgtccccaagattggaagtagtagtgtttttctcaaaaggaaaagcattgaaaagaattgcagttcaagtctctgttatattcatacataaaggcaagtactctatacttctgtagtctgtttcataatgctcaaaatctgcaattcaagtctcggtaccgtagtactgtgtattagtaggatatacaataaacatgattttattcttagttgaaggtttgaatatcaaacctctttatgtactactgactactgagactttcatactatttacaacatctcttttccagaagatgtgctttcctgtcatattctggtttcagcaactaagtatgactagattggtgctgtgattatgctatgggctgtaggtggcaaagtttggaaagatcaaaaggtggatatgaatatgagccgctcatcaaggaagatgctatgatcttgtttgcagcttctgtcgcatggattccatcccagctcacgtagttctgtggatcagcacaagcttttgcggttaccgtttggccattcagcaatttgctgcttccacagtacacatctgggttgaaattgtaagccccatcaccatatccgcagcaagccttagtcccatacttcagccctgaaaccatggtcaatcagatcagtatcacaacaattgctgacaataagcaagattgattcatgtaatacttgaaactgcataatgtaccactactagagagcatataccatgagctttaggatggcgaaacagctcgagcgtcacagcgtgtttgtcaagatacacaatagatgcatcctgcagcttcttcctaacctcggccaagctattgttcagcagttcattgtagtaggtcactgcactgttgtaggttttcatgcaaccatatccatccatgtcattgctggtatgcgggagtttcgtgaggaatgccgggtagcatccgataggcgccatgttaaacaccataatgttgcgagcgccaatgttgtacaattcctgcgaagaatcgaataggtgagtatggaatatgcagttaattattaatctccaatctcttatctttctcaagttcagctaaattctaatttgcactatttacctgcacagtagaggagatcttgctaacaactgaagggagactttgcttgaccgtctcaatgctctgtgatcccaggttggaggtgagatcattttgaccaatgtcaattgtgtacagagcattgtgcagaacatcaggtgcaggaagttggtctgaaaattaatcttaactagattagcaatactatctctgtcagtagcagataagattgttactacttgaaacaaaaccatcactgttcagatcaattatcctaaatattctcttcagaaattcagcagaatctctgcactgacgcagggcatgactgaactgtctgaaatctgaacaggataccatcactgttggcgttgggcgagcataccgttgttgccattggaggtgagcaccttggtcctcagctccttcatctggttgagctggacagcgaggaagaaggggctgatgccggtgacgaacagcgaggtgttgggctgcagcgccgtggacgccagcgtcgcgaagttggcgccgtggcggtagccggagccgacggactgcaggtaagggctcagcagcggaagccccatcgcttgcactgagacgaacacaccaccatttccttattcagatgagcaatccatggcgcggcgagcagaggaaggagaaggaatgaagaagacgtgcttgcctaggaagtcgacgacgaggcggccgtcggaggcgcggccggcggggcggcggaaataggtcataccgaacggcgcctgctgcgccgggaaggcggcccagaagccgccggtgtcggagttggagtcgccgaagttgaagacggccgggaacctgcactgcgccgtcgcactcgccgccgcgacgaggcagcacagcgccgcagccgccgtcgcgagccacgtgatcctcctcatggcggagagagagagaagagcagatagctcgtaagcttcgatcggcgataggcgggagacggcgcgacatgccgtcgttttatagcgggagagaggaaggagatgggagatcgtggtgttgggctggaaatgtaattttcttttttcttttcttttcttttttccctttttctgagagaaattgagacggcattgcaacgattttgttttcttttaatgagagaaattgagacagcattgcaacgatttcgttatgggggagagaaggagatggggatggattgtggtgtttgttcttgttcatgctcgttgttgctgtccagtgatgcaaagctcatcctcagcagaaaaaagatagcgtggtgaacagtgatcctcgattctagatcaaacgataagttcttcaatgacatttaggccttagtgtgtggatggaacagtcaccggccgacacatattctggacttgtctgcagcaccacagtacatatgcttgtttcatacggagtatgcccaaaccagtgctttaggcatgcaaaaaggtgcactacctccgtccaaaaataagtgtagtcatgagttttcgcactcaattttgatcattcgtcttatttgaattttttttataattagcatttttgttgttctgagatgataaaatatgaacagtattttacttatgacttatgttttaaattatttttaaaaaaaatttaaataagatgaacggttaaagttgggcgtggaaaactatggctgcatttattttgggactgaggtagtaattgttagcgtgtttacttaccatctggaagttgttcgtcacgttattgaacgagtgattttgccaccatgtcaagtgacaaccaaccgtcatccacggacatgaactatccagtagtgagctccagccagcaaattgccacaggaatctggctgctgctgtgcagcacacagcgttcggagcttactgaacaacggcgggaagaaattgctgaatcgaccaaaaaggagtagcaaacgtatagcaaccaaagtttcagcaatcagaatcatcacctactggctctatatatccgacacaaaaagcaaggttaagtttatgaaaccgcttgggaagcacaacaatagtcagttcatgaaactcgtagcggaaatacgcgtacaatagctagcactcgaaaccatcattaaaaacgcgacatgtatggcgcttgccagcgtaagatggacctatacatgggggaatatgtggagagttttgttctggactatgatgtgccgatcaggtgctggataactttgtcagggtcgttgtcgtggatggccagcagttcgggaacatttgaggatgtgaagcccatctcgtggagagcgttgtaggatttcacaaactccttcacctgcaagtacataggattcatccttgtcagtttctctctcttttttttccactgtctacaaatgctcgtggcgattagaatggcagaagacacttctatctccctgagaagtagaaaatcgaattccacaaaaactaccaactggacagaatggcaatcactgttttgctagaagaagaaaccctagtgcttctgcaaatactgattgtatatagctatcttgttgacctttgaaaacctttttgagttatcaaagcaatggtttttgttcttgatgatatgttgaaagaaggtaatgataaatcacaagataaataagggaaaaagcatgccttcgctggattatctccatagttcaacacagcaaatgagacagcttcacgtccaagccccatggatatatacttgtccacaactggatcccctggagtagcctgcagaagggcaaaaataaaaataagttttctagggagatggcattacatctctacaacttcctagggtacctaacttgttataaacagctgatattgctatcatgtgaaaggatgccaagaagcgaaaaatctcttgagtatcaggggtattagtccccatttgcccaaggaactttatatattagcccttgcaatggattatcgatttttcaacaacagcctgctccctgatgttaagtacctagcactatttgtgtaatacacaatactatatggaagacaagaattatgtagatattattaccacagaagtagtgggagttgtgagttttgggcctcttggcggctgtggtggtggtggtggctgactctctatcacaaacttgctccagttggggttctccttctcagcctcagcaagaattttcctttcatactcaaaatcaaaattgaaggtactgcgaggaatttctgtaagctgtggcggcaactgaggctgcaataataaaagcaaagcacacattagaggatggccaatgatcaaatatacgagggaagtgtagataataaacgttgatgcatttaacaaagaaggatgcataaatatgcaaaatagatggaagtttgcaagatgatgccatttgtctctagaaagaacagctaggcaagcgcagtacatggaacaagttttgagggagcccattatagtatgaatcatgtctgcaagctaccaactagaacaccatattcacagtaaaagaatggaatggccaataaatgaataaataaataaaggaaaagaacaaacagaatccatccacaaagtctactatacggaataaactgcactatctatatcttctacgatgggcttctaacaacataatagtccatcaagaaacaactagaccattaagatttgtgagcgttcagaacataatagccccatgcagattgaataactagaggtgaatcctgagctaatgctactagaagtccattatttgtgaatatttgtagtggagctatttcctcatctctaattttacgcacagaagcacaaaccaatatacagagagacagtttataaacaaccatatctcctgttacactgcaacataatatcttcgttccttttcaaaagccaaaggaggataatttcagcagttcaaaactatcatgacgctatgatttatgtctgctttcaatacacaaaagttagaaggcatcaatttgaatctgaaagaacagtgtttggctgtttgctaaataaacaccaagttactccaattgaattaccaatcttaactaaacataaagggaatttataccaaacatcctgcaggcattaaaatagaaaatttggtaccaaagcagatgaacaattctcatgtaggtgaatacagcaaagtgatgactgaataacaaacttagtgacttacaggaggggttatccgatatgctggctttatcacaacttgtatgcccactgcagcaacaacaattaatgatgaataacatgctcttgataattggcaaaaaaggaaacgctacagggcagtttctaaatctggcatgatatcaacagtaaaaacagggatgttccaatatttttgtcttcaaataacttttgggaaaaaaattatatcgatgggcccagggaattctacaattttaccaacttcggctatgttgaaaacaccattaaaacaaacacttcaatgttttcactcccacagtcaatgtttcattagcaaaggtgcagaaagaaccctatgctgttgcatttatttgtctttggctagtgaaaaaacgcacacatgcaaaagccagattttctcgcacactttaaaatatagaaagtacagcattttcaactaaacaaagctgttacttttgagaactcaattttgtacataacgagaccatgtttaggcctatactgaggtcaactagaacatataaacagtagtagagctcgttcccttatccaaagacaaggtttaatctaattctgttgttgttgctgatacaagtgcccggtacgtcccctttttcattgctagctaggaagcatagcatggtgaactaactaatcacaccgatgtgcaaatgattaaatcgaggcaatttactgcatgaacaagcttggtaggtctgacaagccacctagaaaccaaatggtagtagaagttcaatgcacaactcaaaaccaaactagctcagtttcagggataaatcgctcgggatcacgatacccctccaaccggattacaacatgagatctgccaatctagcacgcaatccaatcaggtagaataagctgttcacaattcgatcgagtaaacatgacacgcagttctctcttctgcgctacccagcgattcactatgcagagattcagtatgcacagagcggggagggagggatttactcgatgtggaggacgaggcggggacggggtgcggagccgcggagacggtgggggggccatggtggtggtacggcgcggcccgcggcggctccggcgggggcgcgttggcgacgccgtgggagggctggccgacgcgcgggtagagggacgacgaccccccgccgccgccgacgccgccgccgtaggatccggagcccggcctgccccggtagtcgtagtccatcctcgccgcgcgcgcgcgcgcccgcgccggtggggctgagctcctcgggtgagagctgacgcgcctcgccgccggtggatcgcttcgccgggaaggatggaggaggacgcggttgcgggtgggggagaattggagcggagaggtggacggagtcgccatggtcggggaaggaagaaggcaacgtgatgggccggatcacgaggcgggctgggctggggttgtgctcgcgtggacgccgcttcggcccgcatcgaccgggctttgcggtgggtgggtctcggcctgcctgtgcgtcgagggtgggccatgtagggagggtgggccgcgtgatccgaagttgacgaccacggtaggaataagttcagtttaactccctcagatatatctccaatctaattcatatatctaaaccgctactggatatcttgaatcaacaaactattagaattggtgtaatttgactccttcaaggtttaggagggtcgctaatgtggcactttgatttggtctaaccttttgagtcatcctatgggacccaaccatcagtaacccttatatttcttctcttcctttccttttcccttcgtcggatcggcgccgccccctcttcccccttctgctctgcgctggaccgccattagagatttttatgggttttagggtgctgttgtagcacgaaggggcaaattttaattcttttgccacttgtcgtcgtggagggggttgtctgtaaatatgttgcctacgtggaatgccacgtcagcggttagctccagtcaagtgaggtttggactggctacgaatcattaaaccaagatgacagatctatatgtgtaatttttaagtttacggacctaagtgacagctactttcaagtttaaagacagtcatgtattttacttaaaaaaaatagcacttattcaattgctccaatgtcatgatatgtgagcaaatgggtgcttgcatttacggttaattatttttttattgataggtgatatacatgtcggcagcaaagacgttcgtagtgatttcatcatcttcaaaatatatcggtcaagtttttataaggtacttacagtatacgcgcgttatgaacgtccgtatttgtattcgtatagtgtgtttctaaaataatagtaagagtggaaacataatcgaacagaccaagtggcgaattaatcatgtctatcctatcaatggatgcatgcatgcactcttccgttaaattagcgtgcaactggcgatggcgatggcgaccgagtctggccagtctagttaatttctctctctactatactcaacttatacagatgcttacaaataatgcaattatgtatcaggtggagtggcaacggcgctcgatcgatggccttcgattcccatttctatggctggcgtttttgtccgttgcgttggctgcagcgcaggggatcggcatgggtcgtccggccaccgtaccggccgggctaccggctcgtttcgccccgcgcgcggctcgatcggcatctctggatcgttgcatgtcaccgtgcgcgcgctggcgttttgcgttgtccggtcaggcgcgctaggcctagctatatatcgatcgcgcatgcaggcttcagattgcccgggtttcactccctttctctcccagatacgcagatagttagatcacagttgttacatactcccctacatgagggtggcggatctgtcatgggggcgatagagcctcgagtactcactaccgatgttacaaccatgagagttttcattaagtttccactaaaaatttttatcatacatatattagattattagaataatgagttatagttttttataacttgttcagccctttctatgagttcttcttggatgcaagcctttgcagttttcatcccataaaaaaaaatctaagtagggagtgtagttcgagatgtgataatcttattactaggatgcatcacatctagtttgtttttattaccatccatattagtagtattgtgattgtcatatcctgtactagatttattttttataggatgaaataagtagatggagtagatcgtttggaacgttcctgtttaattgattcagttatagctaataagacatagaaatataaataaatgaccatacaaatagtttgtaggtaaacttgcatgcatgtttcattaatttgtagttatggttaaaaaaaactcatgtcggaaaatacaccacttatacggtaaaagatatctcgcaatcaactctatatttgaatttcaaattttaatttttggctctgttacgttactaacatgtttacgatttctagttttttgtaaaaaaaaaaactgtgcgaaatttattcgttcatcttttttccatgaagtgtgtcggctctatatctcgatacaagttgaaagcaaaatgccaacagttttcttctgttttatttctttaaagagatgccaaaaagtagatatttggcgtataccttctgttcccaagcgtatctaaactaaaacatgatgcgtttaatttgtccgtgctccttcaaacatgtcgctgtacgttggcgattttggcacgttgcgtttgagaggggaaaaagaaacaaatttgggcgtccattaggcggctaatcattctgctgcttttgtgattatgtcaatagacatacatatatagggagtgattgattggtttgctcgtcctgttatgtcttgatctcgtcatagcgaagaactctgctgattccttttagacctttggccggccattattagattaatttctcacatcaattaatcgtgtgtgttaattttatgctgaatggctaaatagataaataatttatactaataactattgagagcacaagcatgtgaattaactattataaagttgtaaatgtatttaaatcaatattataggaaattcaaaattcatatataaaaacccgttcaaaaatcgtttagaagcttcttgcatgttcatccgttttcacgtttcacagttttcacatcattaccttctctttcttcaagtcttatgaagctgctatatagagttatatataaggcaagtttgcatagctctgatctaaatccaatatatttagaactagatattcatagctccagaaatacatttttatggatatgtcattaaattgataatgtttgaaaaaaaccattttattcctatttcagattaaattccttaaaaaatataaaaaacaaaatattgtaacttaacttacaaactctacatcagcgtgatctaaagctgtgacaaacaaaatatctaacttgttttcggaatcaatttgttcttcaaacctctattcagggtcaatatagcagaagaaaagggtagattcttttatgattaggagtggttgaggagcgcgccgtttttacggatttgcttataaactgatgatttaacagctgtaaaatgtactcaactgttgcatggtcaaccgcgcgagcgagactgcgcacgtgacgtccgcatgggcccacacgtcggtgagtcatttgccgagaggcggtgtcgcgtggcgggagtgcgatcagctgtgccgcttacacgtggccgaagagattaaagatgagcactttgtttttttctaaaaaaaaggttaaagaatatttactgatccaaacaaccaattaaaataagggaatttaactatttgacacttttaagatggataattaagaatctgtcacccgcaatatataacatgcggaccaatatgtgagtccttaattatcacttgtaaaattgacaaaaagttaaatatctctacaatgcaatatatgacatgcggaccaatatgtgagtccttaattatccttgataaaaagttaaatatctcaaaaatagaacccaaacaatgggtgaaagaagatctaaaggatagatggtatcaagtcaaaatgagagggagacaacagtctatatacgtacatatgtaacaaatcatgagtgattaggaggttgaagattttgcaaggatccagatactataaaaattcctccttgcaattcttgagccttaagaatctcttcgtatagcttcgttctctctccctcccttttctctcgcactgcaactactaccgtatcgattgatcagtctcctctccttcatctccattaatttgcttgcaactactaccgtatcgatcgatcagtctccacctctccttcatctccattaatttgcttgttgagagcttgagatcaagcccaatggtggaagtt

SEQ ID NO: 82803 - DNA, 10242 bp, Oryza sativa
  unsure (1)..(10242): unsure at all n locations
gtgaccatggctactatggatatccattgctcacatcatgaatcaacaagaagacatcaagatcaagtcctccatgtgctgcaatctgattcggccacgtgttacattgctgatttcaaacggccgccaaatctacatacgtgctccgttttgggcccgtgagtacttgatggaaagctctcgaagtcctccttccaacggatccagcctcatctcggaattctatctcgtttggccgcaatcacagaagcaaggtgttgcgtcacctgtattgggccaatggacttgtaactttgtttgggaccctggcctatgtggggcccatgtggggtgcgccccaatctggtggagcacgacccttggaccctcttggtcgtcctcccacctctataaatagttaggtaccccttcagggtttcttgggttttgatagattgaagtttagccattgctacttgcttgcagcgcgcgtgtcggctagaccgtccgtctgcttgttcttcggaactccaacttatcatttgtattaaattcctatttgcaatatcagattgcttttatcttgttcttgcttgtttcttcgatttccttgcaggaatagggttgatctgcaccggcaagatcaacaaccaatggagaggtgtatcgatcgctaaggcgcaacacaacgtctcgtacggttgtagtcggatcgtcaacgtttctcccaaatcgtagttatcacaactcaccaaaagatcgggccaacaacagtcttgagtgtcgagaggaactcagggtccatcataggctcaaatgattcttctcgcaatttacatgtaaactgtgtaattagttttttcctcacatttaatgctccatgcatatgtctaaacatttaatgtgacgtttttgaccaaaaattttttttatctaaacaagtcctatatcaacaatccctgttcgagtaaaaaaaaaaacaatccctgttcgtggcagtgttggccaagtagcaacattcgacgaattaatgatcttgtgccgtgcacccgtgccgcagtatatccatcagtctacaaacattgaaactagctaataccgaattagacacagcttaaaactacaaatctatctagtttcaattcgttatgtttatctaattcttaagcaactacacatacttgtaccacttggcactccttaaacactaatctatttattttgtattataagttgtttggactgttttttagcaaatttatagtcaaatatagcaatatttttatattttctgcaaacctaatcaaacttaaaaaagtaaaaacgattaataatacgatgaaacgtagggagtacatataatcggaagtactccagtatttacatccggtatttaaatcttccgcctagactctagagaatcagaattcagtggcgtgagatagttacggcgtcacgccgtttgctttgtgtgaattcaaactgatgtcctgattaattcatctggtcacaaatatataattcatctgtgtacaaatatataattcatctggtcacaaatatataattcatcacacaattaattcatctggtcacaaatatatatcaccggagcagagcatgaaagatattgcacacgtacgtacacaagannnnnnnnnnnnnnnnnnnnnnggtcagggccggccggccgtcaattcgagtcgggcatcgtcgtcgacttaccaggcccgtcagcgacgatggcgatggcgactggtttcccctcgataacttcgcctttgtcctcctctgcagctgcgttcgcctcgctcctcttccccttcttgcagttgccgtcctggcccttggtcgtcgccgcctcgatgtcgtcggtggtagtgccgccgccgccgccgcactcgaagaccgccatctcgaacgccggccgccacggcgccgacctcggcctcttctggcgctggtccccgccaccgccaccgctaacgtcgtcttcgcggcagctgggcagcgctgcctccttgaacatggctctcagggcccgaacgtggccacgagcgcgtagaacctctccatctgctgctgctcttcctcctcgctcgtcgtcgtctccgccgccgtctcctcctccggcggcagcggcgacgacggccgagaagtcgtcgccatcttcttcgtcttctcccccgtgctcaatcgggcttccatttcctccactggtagttggtctatatatgtgtagcagtacctgtagcctatatatggatggagttgaatgtagtagtaagaagcaaactagcggcgtcccgccccgttgtttcccttgttcgggaaataaaccaaacgacatattacaaatgaagaataatttatacatatacttttatatacataatcttaatgatttgaaagtaaatacttgaaaataaatctcgataaaaaccttaaaatcaattttaaatttaaggttggaaatttaaattttattttataagcataagtatagatatgagtgaaaagatagcagggttagacgggaacgtgcatccgcttgcagtcacgcgcgacgcgtgtggtggtgtgggcgcaccgccgtgccgggaattatttatcgattataccttttaattccgtgagatcgagggattactagtgtcattaacattattaattaccaaggggcagtgggcctgcagattcattgctgtctctgtatgaccgtcacttccgttcccaccaaaccacaggtctcgatccgaaaggtcggtgaggaactacaattttttttttcaaaggcagtttgtatgttcttttaatagaaaatgcttgtttccagagatttaccacatgcacaattattttgtcagccagtagttagtgcagtaattacctggtgctagttggactgtcacctaacctgacctgaaaccaggtgggcacaaagaaagctttactcccttcgtttcgttcataattgatcatcacattaccaaaacaaaaatattcatatttgattagcatataactttgggaggccacttcttccgtgtgtgggatttaatacaccgccaattttagtacccatgtccgcatatctgccttcacaaccttggaaatcaggggggattaagtcctgtccaataatcacaattacgttcctagccatgcggattcgatgcacatgtatgcatgcacagtcttgatgtctagggttatcaagtccccattaataaatcagcatgcatgcataatttacaggaatgattaaattctccttcgtcttggcacccagacgtaacatgtctcaaaattgtgaacggagggagtatctagtcatggtaattataagcaacaattgcaatccaactgaactgaagtgctcaccaaaaatgaatttcattcaagtttattaccctttacaccaaagtagacataaataacattaagcaaaaaccagaggatagtttggtcgcctctgttgatcaaccaacagtaagaacactagagacccacaagccatcttatatggtcttattcacaatatacaatcttcttattctttagttaagattcattttgacgaacaatctgcatctgcacaacgttttaaaaacccctcggatgcttaagacactgcaatataatagtattgtgaaagacccggtcgttgggaggtcaacatttattaataggcaagtggcccaggacgaaattgcccgtggtgcataattaagctgctaatcgtgacggtgcatgctgatgatgcatccccacatcgtcacgaggccacgcagaaaaggcaaatcgctcgcgctatactggtgacggcacacggatgacgcaatcgagccttacgccacagcgcatcatggagacatggactactatttatttggactgtgatagcggccaacttgaccatgtcttctctcatactccagcgagaataaattaaggtagaatatcataagctcaattaggtgagtaccaggcatggctcatgctttaagttgatacaatgcaagactaccaacggactatctaaatttgatcctccaaatatttatatagtcagctatccaattaatttggcaagccaaatttatttctcactaatctaacagcatctccatctaacctctctattatgagttcatgaaactagagtacatatgtcggcctctactacccctaattcttcctcctctttctcccccacttcctcttgtccctagggtgacacactcaaacatccccgagttcctccccgtccctctctctctctatgcgaggcagggatggtcgacgctggtgaaaagaaggccgtcgacatgcgtggtggtgctcgagctcgccaccctcccccattcacccccaaccccatcgccaccatgggcttcctccataccggcggaggccgcaacgacagaaatcagagccgggagaagacggcgattgccccgctgagtttgcaccgctggccaaatccatgcagggcagaggtgttcgaggccggcgcaaggacggaggatatggatgccacgtcaacgagaaggcgcatggaggccgcgacggcaaagtcaagggagaggcgcatgatgtggccctgatgacggcagcggtagacgacaacgatggcagcggcggcatcgttggggcgatgacgagcggaaggccacggcgatggagtagggtggaacatcgggatgcggcattgatgacaacgacagaggcggtggcttcgttggcgtgccagcgagcggaaggccaatgcgacaatggaggcgtgcggcggtgaagtccctctcgatctgcatcacaagtaggaagaaacataatagatgcaatgggccccaaccaaccccagcagtggatccaccatgaggcagtaggtggttcgccggttgaccaggcgatgattgtgcttgccccttccccatgcctcggtacctaatagttgggcaccgggtacataataccctaggtactagaccctaggtaacgggtctggtacctaatagttgggtaccgggtacataatgccaccatcgttgtcgctgtcgcctccctcctagttgattaactcttacgccatctccaacccagaaactatcaagtaatttctatacttgtcatgttatatagacactatgtatagaaactatatatccaatggatagtgtcttcacattaaattctcatccaatcatctatcttctctctccttttatccacctatcctcatgtttttattcttggttcttgtgtagagatggtttcttgcatgagaaatggtttccatcttgttacctctctcttcattaattcacttgccacatcagatttttgcttatgtggcaatcaatttaatgctatagacactagatgacatgtagggtttgggatggccttattccaatggtcccaaatgagctccctagcctccagatctagtgtaggaggggggaagagggtggggatgctgttggtgcaggggacaatgattgaggagtcggagaaagaaatgagcggattgggctatagagtatagagttttaggtttggaggaggcattgccgctttgagggaggcaacgaagtcgagccttgagaagacgaggaaatagatcgaagggaaaaaaaactattcgcttgttaagttatcgcgtcactagaatggaaactcttgctgttgtttttctgataactaatgggctttgttgagactatacccatgttgtctaaagtttaattaattgtgtgtctcctttaaaaaaaatcttatgctataccatctcaaacccactcggtaagggaaaagaagttgaaaatgttatgtagaggaccgatgttcatcatctccttgttgtcttatcaaccatagccaaaatttaaattatactccattttagagttgatattgaggtttttccattatagcgtatttttttagcaatagcatttaaatcgctaaaaaatatggatataaaacttttgcccataaattatttttcttcttccatggcttataatcagtgccataaatataccacccaatcaaaaaaggactaggatagtgtaggatcaaagacatccgggggggagggtgtgaatagaattcctgctctgataccacttgataaactctgagttcgacttgacacgctcaaagctctgattggcccgacctttcggtgagttgagataaccacgatctgggagagaaaacattgacgaccagactaaaaccgtacaaggcgttgttgtgttgtgccttaggaatcgacacacctctttgtgggctgttgatcgtgccgatgcagaccaaccttattcctgcaagcaaatcgaggaaacaagcaaaaacaagataaaagcattatgaattacaattatgaattaaagctcaagataaggtgggtttccaaaggcgaataattaagcggtcaagccgacacacgtaagtacaaggaaaagtagtgattgctaaactttttactaaacaaaacccaataaaccttgaaggggtacctagctattttatgaaggtgggaggatgatctaggggtccctaggccctgaaggggtacatagctatttatggatatgggaggacgacctagggttctgtcatgctccattaggttggggtgcaccccacttgggctggggtcccagatggagttacaaacccataggcccattataagtgatgcaacaccttgtttctattattgcggccgattgaggtggaatttagagatgaggctagaaccattagagagaggactctaggagctttttatcaaatactcatggacccaaaacagagctcgtatgcgcatttggtggccagttgaagtcagcaatgtagcaggtggccgaattggatttcagcacttaagacgacttgatcttcttgttgatcaatgatatgaacaactgttgtatccatagtaggcttggtcatatcacccagcgctggacgcctgaaccctcttagtactagtactcaatacacacttttctacacagcaaataagcagcgagtcaattgtggttgccatggaggaagatggttatggtaatatactagctagtaggctgccttttttggggcattagtcagtcagtaggctatcaaaaaatgagtactctagtgagaaagctaataataaatggtgagacatattagtcattagaatttattttacgtacaatgaatgtttgatggttcgtgaggcatctcttgtgtgttcttttccttaacagagaagaagaaagaaggatcgaaggaacaaaaacaaaacctaacatctggttcaatggcttcatctcaggtcagttagatcaatttccgcattaagcagaggtgatcatgtttaggctaagaacttaagtagttaagtggattaaactccaacattgtgtatcagagcctaatcttagccttgatgttccatcatccctaatgaagccattatgccaattaaatcctaatcaattcggcatgatgaaaataagtgagaattgtttttcaatctaagttaattagctcggtttagcccttcatatatactgtttctttgcatgttttaaattcaagatttaatcttttgttaattgcttagcagtagaattaagaaattaagggaagggaagaatgagatcaatcggtttcaattttcccaaaatccccaaattgagaagaaccctgattcggatgaagaaccctaagtaacaaaatccccaaaaaatcaagaaacccaaaaaataaaaattaagcttgagttcagattcttaccggacttggagccctaattctaccgggaaacctcactgcggtgttggtctcgtcgagaagcggtatcgccgccgtcggcgccatacgggcttgcccatgcgtctcctcggtgtgcccttgccttctcctcctcgcggttgctgtgcgcacgcaaccttggagatcccccaccgtcgccgactaaccgggatgggaagcatcagcttggcgccgcctttggccttcgctcccccgccgacaaggtccgggccacgtgacgctcggcgccgcttgcgcgtccacctcgctggaccgcagacgccacgccatggtttggcactgcccacgggcgcaccctccagctagcacagatgtgccactctactcggcgctcatcgtcacacgcgtgctacacctcaccgaaccgccatctctgtcatcgccgccatacagtctcacgctcgctgggagaaggggatcggggaatagaaggggagagaatgagggctagggttgcacatgggcggtaatttcatcggtgtgggacgaatccgagctgtccatcagatcgtccctgcatcgggtcgtcacagatttcatgggccgcgccgccacagctcttagcccgctcacgctcgcgcgtgtaatccgggacatctttcacgaagataggcaaaattaagtttttttttattttaagcccatcatttatgattagatatttccataattttctatgcctttccttagctaatttaaaatcgatagaaaattatgatcaattatttgatcactcacagaattatttctagttgaatggaaccaacgggaagtttatctagcaaaaaatttaactagaaagaattaagatatggagttattttgacccacgttattataattttactaagattaagattactatttccttggttattttctgcccaacgatgatataattgaggaaaatttaaatgtaattattatttcctatgtcattttggcattaacggtaatatgacttaggattttaattcatgccattagtgcattattatttcctttatcacctctatcttatggtgatgtgattaaggattttaatttgttagtaagcttattaattgctttaccatttttgccaaacggtgatgtgtctaaggattttaatttcatgtcattactaatggcattattttaaacacatttcctatatcatttctacattacggtgatttgatttaggattttaaactgatttcctacgtcaatttaccttatggtgattgatttaggattttaaaacactacctactatattatttcctatatcatgtctaccttatggcaaattagatttaggattttaaatttagtatttacaatattattttctttgtcacctctgcccaactgtgatgtgatttaagacaatactatttattccctaatcatttacgcccaacagtgacttgattttagattataagtaatttcatttaatgattcctgtgttttgtctctacccaactatgattcaaagagaaataaagattaagttgtcattattgtgtaagtaattgtactaatgtacgttattttcacaggcaaccacaataataatgccacttaatattccagcaataaataatgttatttatcagtcaaagtctattgaattatttttctcactgatctaactgagcataagtctttcttgagtttgacttagcattgacaaatgtcacaccccaaagtttaccctttcctagctttaaaattcaataaataaattgctcaaagaaattgtttaattaaacctagagctaaaccctaaataataaatacatttaataatgggaaattatatggtggaatttttcttgagttccctatgttttaatacattaactgaatttttagcggaattttcagagcaacggtagcaattttaataacaaaaccaattatcagaatttaattaatccctaatctctttttttcttctcctttcggaaatgcgccattttttttggcccattttcccctcccgcgtgggcgtttccattgggccggcccatggccaaggcccaacagccgccacgtctccctatggcttaggtcgccgacaggtggggcccacctgtcgggcccttcctcaacatccggccggcggagacactgccccgcaactgcagctcctgcgcatcccgtgccacctcacccacccctccacatccgtcgcccactaccgcgccccatgccccactctcccacacacccgcacccacgaggaggccgagacccaagattcggttttcgaaatcccgccgtctctctctctcccctctcccccatgtcgccactggagaaaccgcatctaccggccacgtccgaccaccccgcccctataaaaatgattcccgtgtctttttccctctttttctatccattcccatgccctcaatcgcactcgcgtcg

SEQ ID NO: 82804 - DNA, 18141 bp, Oryza sativa
gcagccctcaaacgttgcaagcaaaaacttaaaatcccttatattatgggacggagggagtactatacaagttagagatttatcttaagtaaaaaaattgaagattcatgaccaattgccaagacaatctgaagacagctctagctaattgtatatatttctgcgagtccacattattaatgtccaataagctagatgatataatttcagtaaactccaagaaacatttaccagctatatagatcaccaggacaaagcctcatgtttggcaaggaaggttaaagaacaagccaaatacagttcgatacataattactaagttttttcaagaagaaactgtatgcactcaacaagtaacatcctatacccatccgatgcaactttaatcactttaagtaggcccatgttgtgataaccactggataatgcaatcaatagctcatacaagacaaaatacctagaacacatcaatttcacaggaattgcataaaaattattatacaccacagcctgaagcaaatcacgtcaatgattctatcataatataggtgttgcagtaaagaggttggggagttcagaaataatcattaaatcgtggtcccggtagtcacagtggcggtggccagtcgctgcgttcatgctctcgcttgagagccctcaccatcgttcctctctcagactgagggagactgcgatcttcagtctgcaactgtttctttgttcctctctccctgcaactgtatcacctgggcagtggcgaaggtgaggaggacggcgggcaggctgagggagaccatggtgaggaggcggtggactgcggcaggccagcagcagtatgaagaggcggaggtggcgagcttgctacggaggcggaggcgcggagcggcggggaactggagtagattggcggcggtgacacagttgaggagaagaaacggcggcggcgactgccgaggcgagagaggagggggttttagcgatttttcaaacaaaccccaaaagcttcacatactacaacgacatccaccacaacgatccctgaccattaatcctccatccaacggctgcaagagggggacgaatgctgcaatctcgccgtgccacgtggaggggctatttgcacgggaatccgcctagatttcaatatttagagatttggatgcatacagatttgacatacattatttacttggaatcttggtagtatttaattaaatccagactggtgaggtaacatgctcatttttttcaaagttttaatggtctctgaagtttagtcatttagacacttatttgtaaaatgtgtagatatttataaagattattaagtttaagttatgtccacatataggggagcaataaccatggaaaaactccaaaataatcttactgcatagttaacgatgcaatttgatttcgtagcatattatgattaatcatatatttaagaatatttcctaaagctaagagtggtaaatagcactcataaaccactcataattatactgcgctatgaactgagcaccaataaaacgcagttttctattcttgtaacaacgtgttgtatgttttctgccgaacacattgataaggttgtgaaagatatcccaggatcgaattattaagctgagcttttactcatggatccatgttttaaatgatcataaactaagtttattttagatatgttatgaccaatacatatgtaaattagagccttaactaatatcctggataaggagaacttaaatttatcaatcaacacccgctaagttaagcttgagtttatttgagtaatatagagaaatataggtttttgttgtctcagtgacgtttgttgcaacacattgccttggaagctatttttttagttgacttgtccgttaatcttaaaatcaagagaagaatgttggttgaatttatcgactagtgtcactgtatatgagaaagaggagaagtggcagcgaggcaataagtagcatatagtgagttggtagcagattgatgtttgggtagcggattgcggatagcgggcgcgattgcagatgctaagttccaatagcaaaattaagaaaaataactataaatttagattgtatatcaatattaacatcaagtccaagttaaaatttaaatttagactacatgtttaattactccaacatttgataacataaaaattatgaaataacatataaatatataagacaaataagacaccgacacttattctatccatatatgaagcacaccatttaaacattatagcgatctaacaaagttaataaacattatagcgatctaacaaagttaataaacattatagcgatctaacaaagttaatatatagcgggctactatagcggtcgcgaagcgatataatggccactaagttccaatacgcatatccgctacttgtagtggtagagatccggtaccgctatagcggccgctataaacactattattaccttaagtggcaggggtgacgtcgaacctctctctaatcctaaaaccttaatacaatcaccccatcgatctctaatcctaaaatcttaatacaaatatacaatcaccccatcgatctaggtactggacgaggtttgtgagccatatctcttgtgtgttttttccttaacaaataagaagaaagaaaaaaaatcgaaggaacaaaagcaaaaccaaacatcgacttcaatggcttcatctttcatctctgataagttagaaccaatttccgcattaagcattggtgaatggtgatcatgtttaggttataggttaagaacaattaagtggattaaactcacctagggttattgtcgcccgtgttgtcaatgtgtttttttcctaacaattattataagcaaatcttagtattaatagcatcgccgtgcccactaattcttttaagtatatatagactcatctgtatgaacttgatttctttctcctgatagaaaatcgatacagtactctagtcccaacaaaagaaaagaaaagaaaagaaaaaaatcacattgacaagctaagatcgagattaggcgcgctgtccaccttcttctccggttggactacttggcttcccttcaactcgaacgcgaagtcctccattacaaacgtcggccgccacagctgctggcgatcctgcttcttctggccaccatccacgctcgtccgcttggtcgcgacacaatcaccgttccgccgccacagctccctcatctccctgacctcgtcgagcagcgcgtagaacctgtccacgtcttcgtcccgcgcctcctcttcgtggccatggccacccccctccggtagcggcgccggcgccgccttgatgttacccgacggcggcgttggcggcggccggtccctcttcctagacctccggtgccgcggctgcaggtgctcctgctccgtcacgatcatctccgccgcggtgctgctgttgcgtggaaaaggggaagtacccgaaatagtatgtggagtgggcatcgtgggatccatgagaccttgagttgagagcgaggcgcgcgttaaataggacaaagcttcgctagctatccctcccttcctgcgtgcggaacgagtttgcgtcaccgctttgccgctttgggcgggcgagcaagcaagtgcggcaccgaccgatggtggtgggcgcgcgtgcaccgtgcgcgatgcggtgcggttggcctatttttatcattatctttttgcgtcggatgctcggaagggggggggggggacctccttacgtacgctgttacgttggctttcctgtaagcggcttacggaagcaacgtcgtccggtctgactcccccccccccctcgcccgtcggtgttaactgtacggtgtcgatcgacatcgatgtcggggatgcttacctgcccgctgactaccatgcgccgttggataggtctcggtgctcacatggttttttttatcccttgtactgctcacatgatcttttttcgctttttaactatacaagatggcgtgatccacagctagcttggtttgggacctttaatttgtatataatagaaaatgttagtcactccgttttatattataaattatttttatttttttcctagttaaacttttgttaagtttgtctaagtttaaaaaaaattggtaatattttaaaaaacaaattagtttcattaaatctagcattcaatatattttgataatgtattttaataatatgtttgttttgtgctaaaaatactactatatttttctataaatttaagttaaacataaagaaatttttcccgcaaaaaaataaagaaatttaacaagaaaaaaaagtgaaaaacgaatatgaaaaaaagaggaacagagaataaacgttgaatcgagattacgcagtgggccaggggcagaatttgtgagcccgtaaaatgtatagtcgtcaatcgcgtacgcggtggccgggttcgatcgcgcgccggcttaaactcgcaactgacgggcaagatcctactgcggtgagccggggggcggcagcgcgccacgcgcgcgggtctcgtgggcctcgtggcgtgggggcgtgacacatgcggcctgacgtacgtccggcaccagcgtgcaagacgtgtgcatcgtactgaaggttgtcgacttgtagttgcccacgtctatgctttcggcgtgctgcagaattgagaatgtcaaatactcgtcttttcaagctgtagtagtaattattcgctgttaacgtcacatctaaaaacagaactgtcaatgagagataaaaaaaaactattcccttcgtccgacgagggcccctttgatttggagaaaaaatgtagaaattttggaggattttaacccaatagaaaaaaaatcctatgaaggccttagaaaaatcatatctaatcctttaaaattcctatgaaacgggtaatcctatacacattttgaagaaaagttagcaagaggtctaacctcttggaacatttcctctgagtctatctgtctcatctgattcctgtgtttttcctatggtccaatcaaacggccattcctgtgtttttcctgtgttttgcaatcctctgtcttacaattgtattcctgtcagaatcctgtgtttttcctattccttcgttttttcattcctacgatttaaaggggccctaaaaagtaaatctaggactacgatatatactagtactatgaatctgtatgtccagattcatattaataggatgtgtcacatccagtactagattggtttttataggatggaggtagtacgaatttacctatgcacttatctatatattaggctgtgttcttcttgctagctttcccaacttaactccctcattttctacgcgcacgttttccaaactgctaactactctcttcatcctataaaaaataaatctaggactatgacatatatatatactagttctatgaatctgtatgtctatattcatattaataggatgtgtcacattcaatactaggttggtttttataggatcgaggtatcacgaattacctatgcacttatctgtgttctttttgctagctttcccaacttaactccctcattttctgcgcgtatgttttctaaactgctaaacatggtgatttttgtaaaaattttctatacgaaagttgctttaaaaaatcacattaatctatttttttacaaaaattgctaatacttaattaatcatgcgttaatgagtcattccgttttgcttgtgagaaggattagtttccaactcactccaaagaaaacagcttagtgtaatataaattaaaatttttattcgatgaaaataatatgattgaatttgcttttaacttattttcatatgattgcccttttattgctaattttggaagactatgctaatttgactatgcgtgtgagaaagtaaagttgaaagactattgagaaagtaaagttgaaagactaattctggagactatgctaatttaactgtaccttatatggttggttagagggaagacaaatttggtctcacattgtagaacaggtagtacaaacatctttaaaagctcgatccggatagagtttcttatatgtcaattttaatataacatatttattagccctaggagaaaaccaaaagttgtataggctttattagggcagtcccaaccctccacctaggatggtgtctatggcattaactacattgctatgtaggacttttaacttacgtggcactatattaattaagagagagagtgaatagaggaagaaactgggtctcatgcaagacaaagcttcaacacgagaacctagacactatcaagttttgcattgggagagaatagtgtcttcataatagatgaagaataaatatgattagtagagaagagagatgatgtatttattaatagcctactttaaaaaactatgggttgtggagtgtagtttctattgtgatgttttattgacatgacaccttagacactacttatgcacactatgggttgagactacccttattactccactccatcaatctttaattggtatctccccatgaaccattcaaactattttcatgacatcattcaagattgttaagaaccctacttgtatttattagctactcatttggcccaccttcttatttgtgcatttttgcaaacgaaaaggtggttatatcaaggttgaaagcccagctcagtttttgctgctgacaaggtccctgaaccagtaggccgacatcttggggtacctcctgagggtcctgaaatccacgtacaccaggccgaacctcgacgtgtacccgagtttccactcgaagttatccagcagggaccaggcgaagtagcctatgcagttggcgccgtcgtcgatcgcctccttcagcttggtgatgtagctcctgtagtaggcgaccctcgtggtgtcatgcaccccctgagcaatggtcacattgccaggatcatccatgcctgaaaaccgaattatgttttgttgtgctgttcttagtgatcacaaaacaatgtgaatgaaaaaggaagttacaaggaaaaaagatgtaccattttcagatagaaacattgtggggttaccatacttctccttgacataggtgacagctttgtacaaaccccacggtacaatgtaaagccagtcagaattcgcctacaagaccaaatggttttcagcgatgcacacaactgaagtactaatcgatatatgattcgtatcagcggtagaaataaccaacagatggcgtacccttggtccaattggcacgccatcgcgttcatctgcagcaccaagagaggcaaaggatatcaggaaattaattgtcatcacaatggaactttcattatttagagaccaaacccttaattttcagtcttggggaccactgaagcataacagtttattaggtagttaagtttttttttttgagagaattaggtagttaagttaagttgaagagatgactcacaaataggtgcagcatgccagtcagacgagtaactagggagagtcgtggcgttcggctgctgatcacggacataataagcagtatactgattaatgccaacatagtcgattgatcccttcaccatgtggacctcatcggccgtgaacttcggaagccgttctttgacaatcacttgcagcgatttagggtattcaccatagatgattgggtgaagaaacctacaaaggtcaatcaacttgtttcagatatgtgcgtagggattttgtatttttgttgtgtaacgtggtgtgatctgtatatatctcatcagttataaagtctaaacagccttaatatcttgccatctaggagcaacatactccggcagtttgcggattcttggcttgaataaagaaaataagaaaaaggttaagaagaagcagaaatgaatttgaagcaaaaataccatccaacgtggaagtctcttgatctttgagccgcagcttggtctgccgttgaattggtaagaccttcataccagacaaaatccagaagaattccaatcttccccttttgtatatgctgaaaagtttgttaagcatttttaggactatttctgaatttcatgctactatttgttttatgggctaactggatccatgtcactataaatgcgctatattagaaaaatgtcattattatttgtgatatcagctgggtgctaccgaagctttataaaattaaaaccatgccatcatcatcacgtattatgtcatcacatagaccaaaatacccttacacgtgaaacccacatgtcagttctatcttcttccaccacccaggcctgactcttgggcggggcaaagagggcgatggcctaggccccgtcctggctaggggcctatgcctaaatatacatgagtactatatgagccaaagtggtatttaagattagtgaataattccgtactatctactactccttgttatctacataatactaattagtgaattaataaagattctagattcaacaatcaaaattgtatgtatagatagattcttgttgataatatatattttcataattttaggtgctgaaaagttgtaattttacttaagaagcatttttatggtgctaagtaaatgggaaaaataaacaagatcagtttaagtgttgatatttttctatttctaagaatatatatatgaaatgttatgaatgattatttctctctaagattagatttgaaaacacactttgaaaatgaagaagttgttcagattgtagccaaaataaatcttaccaaattttggcaatttagcaatattgccaagttttgacgggatttcttatgtatttactatagtttggtaaaaactaaatgaatacatctttaataactttaccaaaaaattgatatggcttgaaatgacatcaatctgaacaaccctaaaaaatgtgaatatacatataacacatctctctataggggagagattgatggttaagggtcatgttgtcaagtttgccctagggccctcaaaattgtagagccagccctgcctccaccctctcctcttctgtcctcccaccacccacattccccagtcgtcctcatggagcacgcggctggggagcacacatggtccatcctcgccgagcgtgagagtgggcggcctccctatccctaaagctcgctgaggaggacaagaaaagaagagaaggaagaagatggaggaaagaaaagaacatgacaacaaacataacggtagtagtatgattttaattttataaaattttagttgcacctaactaaaattgcaaatagtaataatatttttctaatatggcatatttgtaatggtatggatccaatttaccctagttttatatctctagtggtacacttttacatatgtaaagagctaacaaaatggtcacttgttttctcataatttttttaaaatcacccataaaaagaccacaaaccggtgactgtttttacctgatacttgtgccggtatctctgaacagcagaagcatgggaaagaatgaggtgatgggcaacaatgtaaggctcggtggcagagtttccagccgtgcattttgtgcaccttcctggagcaaaatttccatcatcgtatcctagagcggcaacaactctcggttcgttaaatgtcatccagttcttcactctgtcgccaaatgtcttgaagcaaaactcagcgtagtctgcgaatgcttccctgcgtgattcaaaaacaaaccagtagatacatatattggatcatcttgatctacagtttcaggaatgcacaatctgctgctgcatggtgattgttaaaaaaacaatgtatgagaaaaaaattattgagagttgccattggaactcctgtactttgcaggattttgagcggcagttgtatctgatcttttgctagtatgaatatataccacaaggatctgcaattccgatgatagtaacttcatttttctataaaattcaaatattgataaaaaaaattatggtgaactatcccgttggttccaatgagtgtctaaaaattgttcagaaaaacgaacgtactgctgcatagcttgagaagagaacagtcacatgtcaatgtataagtatttggatcaaccttagtcttgaatctaacaaagcaatacttacactatttttctgttcaacagtcctccatattgcacctctagtgcctctggtaagtcatagtgatacaaattggcataaggtgtaatgcctgttaagcagcagagcaacgttcagctttagaattgaaacatgtgccacgtatcagatgattttcattttcatttttatttttttgcgggtgaatatcaaatgaaacattaacagtacgtggcatacctatcttcagcatatagtttatcaatctgttatagtatgccacacctttccaatttactttcccagttccagctaggacagtgaacacccatccaagagaaatataagttagtttgcatcactttcagaaatcaagtccaaaataataaaattgtactcgtagattaagacgagcaacttaagggagcttacttgggaatattcttgaccatgagattgagaagcggtacgcatcgaaacccatacttttcatgatgtttacgtcctcctgcaagagcaaagccaagtttaattctctgctctcaggtcatctgttttattctatagttcccggaatcaggagtacaagcgaatgaataaattccatgcttgtctgatagaccaattattaggtaccacttctaaaaaacgatttttccggacacattggtttcattttttcagttggatctaaagaatttcacttctaaaaataatgagaggcctgaagatttaaccccgctagtaaaagttgacttttaaaaggcggggtttaaaaacgactgccatgaaaaatacccttattttcgctgacaatactctttataacacgcatgtgaaaattaaaaaatccatctgcaaaagagcaggaatgctattaaataacagcaacgacagtagaggggacaacagtaatgtctctcccactcacctccctctactcgatctggtcggcgggtggtggcgacggaagcagttgaggggtggctccgacagcggctccaggtgcctattttctaaaatttttatgatttttcgcctaaaataatcacagcaggcggtcttcttaacatggtcacatgtgaaaatcgatttttcataggtgttctacttaagagaccagcatgtaaaattcaattcacgtgcggtttgtgcagccagtagtgaaaatttatcgttactagtggttgctctaatctcttgcgaaaaatgaaattgaccgccagcgattgcttgttttgtcgtagtgtactaagtgcaaggggtagtgtagtgataagcaaaccttatataaggaaaagcataagattatgttcctaaatgtacaatcagcatgacaacagaccaaaatttccaaatctacaattgatgtttgatttatacaagataagtttcggttcagtttgactttgcgttgttcttctagcaaatcatgcaaaagttgaatatgttcataattaaagcaagcctttcaaaccttaatataagagaaatttcaagcatgaaacaaaagtcgcataccaaatttatgaaatgtcaaataagccagataatactataatttctcaccatgatgaaaaaggtacggtgtatatatgatgtatgcttaatactatggaatataggtgagattgaactttcttttggaaaacaatgtggttgaatgtttattgtgaaaaataatcataaaacatttagatcggttagaatcataaagagaatcatagaaacagaaaataagttgcacgtcatctcaaaggaaaacgtgtatactgtggtgttttcagctatctgtttttacttttccctgaatggtacgaatctgttatcgttgaaatcatgacgtgtgtgtagcccttctaccttgccatccaggataccgtactcttcacaagagattcttttgatcactatgaagtagtccattacaaaaaaagatagaacacccacaaaaatatcaagagcgagaaatgcattttgtcggtgatatgggcccgggggtatcaggtttagagggaggaggctgccccctgatgccacgtggccctcccccgaggggagtcaggcctgaggtagggtggcggccactccttccccaaagactagtcggaggaggctgccccccgatgccacgtggccctcccccgaggggagtcaggcccgaggtaggacggcggccactccttcccagagactggatggaggaggctaccctccaatgccacgtggcccttccccgaggggggtcgggctcgaggtagggcggcggccactccctggctgagactagagggagaaggccgccccaggcgccaagtggctcccccctgaggggggatcgggcccgaggtcgggcggcggccgccccctcccgtgactaggggtcgggctcccccgaccccctctctaggtcaccacgtatggtgggttaggtgtccgcctccaggtgcccacctacccgcatttatggcgtcccgagtggtgcggcgtgcagtgcactcaaccggtctgtgaccagtcgaatgaccgatgggactggctagtgcgcctgtgcgctgctcgtgtgtcaggcggcgtgcagcctgacatgtcccatcaaatagtgatggtgagaggttctcatcctcttatcccagccggagtcggtcctcccgctctggtcaaagcaaggctcccgtttcccggtgtaataggagcccagaagtcttcacccattaaatggtgactgacaggggcaaccccccgtgtcaggtggcaagatttgacaggccccatcatcaagacgacgtgtgcttggcttcccaagtcaagagacaagacatacatttaatgcaaagattataatacttctccaccggagctaggttaggttgttgggcccatgtggtaaccccttgaggtataaaaggaggtccaggcctagtggtgggggggggggacttccgagcgaactggcgcttgggtctcgcaaccccaagcacttgtgttctacattcaatcaatcatgcacaggagtagagtattacgcttcttagcggcccgaacctgtataaacctcttttgtctcatcgtcttagaggggcctaactccctcaggatcacacagctccgctcatcaagccctcgaatctcacccgctgcccccggccgaactcacaatggggggccttacagttccctggtggaggagttcattctccgacacatttgtagtttgaaatcctccattgccagcccccctagcttcttcagcttgttccaaaagccagaagcttaaaaagaagcccaaattattgtacaatctcaagaagctagtcttggaaatgaaccctattgttcactccgtctcattttaagtgcagccatgagtttccgaatccaactttaaccgtttgttttatttgaaattttttttgaaaagaaataaaaaacataaatcacgcaaagcactattcatgtttcatcatctgataataataaaaatattaatcataattttttttaaataagacggacgataaaagttagacacgaaaactcatgctgcatttaaaatggggcgaaaggagtataaaataggaatgatgttttggacttttcaaagtcaacaagctaggtacaactttgactatttaactcttttgcataaataagaaaaaaaaagttataaaggtgtgataactaatttgaaagtttttgttacgacgcacttggctttaaacaatacttcgttgttaaaattaacttttcttgaccgcccggataccataacattattcttttgtgactggaggtaagcattttaccttgtagcgatggtactcatcaacagtaacatctgccgtagcattatttgctatttcacctggtcagaaaaataagcaaactctagtcagtctttacaccacgactcacaaggtcgcatgtacacgtatataggattagaggcgctctttgctctgttgttcttcgatcgttctccctttttctgaacaaaaagaaatgttatacgtgttctaacactaagcatgattcatgtacttaagggtaattcaatacggttcagtctgtcctatttatagggcagaaatgtcataataccagtgttatatgccttctacaccttttattttaaaagaaccacacgttccgttccctttgtttcatattacagctttataagtcccttgtaagtcaaatctcttttcaaatatgattaattttataaaaagatagcaacgtctataacaccaaattagttttattatattcattgtggaatatgtttatagtatatttaccatgtgttgaaaatatcgatatatttttttatataaatttggttaaactagaatagatttgacttcaacaaatttaaaataacttataatacaaaaataatataaaacagagggagtttttaacttgtttgttctaagctctgtaatcagttttgataacagaactgttgccactgtacatatatccttgtgagtgaagtgaagatgatcctaaatttaacgtagggggctcctgcatatatgcagcttagagcttgtttagagcttgtttagagcttgtttattttgaatgccaaaattttggcaagatattaacgttgtcaaaattttagcagaatttctcatatattaaccaaatttaccaacaaagtaaatatagatttttttttgataaaaatagcatcaaaatgaacggttccttaatttgctcaccgggagtcttgacgaaggcgtcccaaatgctagggccgcggccatccttgagcgccatgccctccacctggtacgccgacgccgccgtcccgaacacgaaccccgccgggaagctccgccggctcagcccgcccgtgatcccggccgcctcctgatgatcggcgccggcgccgccgcgaatgccgtcttcgcccgcagcttgctccgccgcgcgcgcggctccagctactaataaggccagcagaagcacaacgacgaggcggtggcccatggttaactgctctgccgcactgtgaccgccggagaccggagtgccggtgctgcacggtgtgcgcgcggcgcccgccggctaactagctagagaagaagaagaagaggaggagcgagcgcgagtgctcgctgtgtgggcctgtggcgtagacgtagtataatggatagctcagctgttttcggccattatagggggccatacgcgcgttagacggagatggttgtcagcacccggcgccctcagtttgtaccatatgtagcgtgggccggacggggacgaagctaccgtagccagcggtgcacgcgtcagggcaaaacgggtaacgacgcgcgcaagtactgcttagctgctgcctgccttcctctcgtcgtcacgcgcgcgccactcatacatgccgcttatagtctctttcttttctttttttacttcgctgtctttttgtttcttttcttaaaaaaattacacagtacaatggagacactcattacacacacgcagtcacccctataaacgcacgcacgcaaaccctacacctatgagcatcttctaagattggaccggcaaatccttcgggattaacgaagtcaccacaggcgcattgctgtcgacgggtacgtcgcctaccactgaaagcacaacaccgttaaatcctgaaaaatttgctcccatgaggagtcaaacccaggaactcaagtgctactgaggctcttgtaaccactaggctacatgtgtttagagaacggcaagagttatgcatgcatttttctttataaaaaatatagtatcttcgaaagacttagccggtatattttgagattgacgaaatcatcataaacgtctcgtcgtatataaagaatagtgagttgtaaattaacacgagtacccgtaagtttagaacttgaatatgaatggattggtttaaaaaaaaagccaattgaggctttgttaagaaaaaaaatgtatttttcattttaaaaataaagcttcgcaacaaaaatataattttatttgttttaatacttaatagaattttttttgtcaaccttttaatctaacttttataaatattaattttttaaaaactcttatcccatgcggtggaaattgaggtggcaaagaaaaggttgcacccacggttaaattccgtggtaattcagggattcgcgatgtcaataatcatggtggtgcgtggcatattaaatcgctattgtcgcacaataggaaatctgctattgtccttgtcaaagcaacattgaactgcggtctcgtaggattatttccatgtgcctttgccttctcaacctatatagtttatcttttaaagagtaaattgtattgatattacacaaacttgtcaagtgagttcactttagtacacgaacttataaaatattcgttttggtgtatgaagttatctgatacatgcaaaacaaggctaaaaggatgtcacaaccattttttaacaagttagatgttgattaggatgtgatgtgcacacacgagatgaacatgatttcagcgtccttcgcatcatttttcggtttttaatgttcttctccgtgtaatcttttgaccttattaaatatttatatatatatatatatatatatatatatatatatatatatatatatatataggacactcatatggggcaccatggtgcccgggcaccatggtatctaatgcacaaaatcactcaaattttttaaaattttcaaattgtgagtatatacctagttataataatttgattcatacctatacttatcaacaaaacaactcaaatttaactttatttcacaatccatgattacatacctaactaattatatgtatggatgctatatacctagaatcaaaatctaacaaaaacaagttcaaattcagttcaaacttgctttaaactagttagtaaagtagttaacgttaatacctaggtaattgaaaaagtttcatacttatttgaattgggtatatactcaatttcaacaatggtgcccgggcaccatggagcaccaaacaaatttactatatatatatatatatatatatatatatatatatatatatatatatatatatatatatatatatatatatatatatatatatatatgtgtgtgtgtgtgtgtgtgtgtgtgtgtgtgtgtgtgtacgtagcattcttcttatatacgtgtttatgtagaatcttaattaacacataattagtaagtgtagtcttgttttgttcttttgatcttagttggtacgcacctaataaatttgtatatcaaaatgagtattttacaaaatttgtatatcaaaatgagtattttataaatttatgtaccaagtaccttgatgtactacttgataaatattagatggtttgtatgtaattgaaaaggccaagtatcttgctcttttttttctacactgacggattagcaatcagtgccatgcagagttttccggagacgtcgggagcactgcgcaaaactaatgaagatccggtaaatattttaaaaaatattttttcttttaactttgtcaatgtattcggtggtttttgttacgacacccaacggtaagccaggtaccaaaaacggtaacaaacccggctgccatgcgacagcttcttggttcttgtctcgggttggtttgattttgctgagcttcacgtgtggtgtggtgtcgggtgttaggtttacgatcccaataccgttcaaaaactatacaatgataaactggtaaaaccgataaaatccaaataaatcttgttaaaaatctaaaatgcagtttttttttttttgaaaatgaccggaaaaaccgagcatttgtgtttatgacccggacaggtttccaccgtaccagaactgtaaacactggtcagcgtaccggatctgtaaacaccggtctgatgtctgcgggatagcgctgaagaaagttggacccactcgtctcctgcgctagtccgaccaaaggccaatgtcctttacattttttaatgtgtgtcctatcttgaccaaatcatgcttattaacgtat

SEQ ID NO: 82805 - DNA, 46891 bp, Oryza sativa
caataaaccaagtttagggacatcgatgtgcgctatgcaagttcgttgacctaagttaaacctcccgacaagtttaaggactgctggtgcattttactcaaatatatttatacaattacttcgattagcattgacttcaatatttctatgcatgctatagagccacatgtgcacctacctgaaagccttaggtagctcctgtcctcaattactattcatatattttaactgtttagaaggcaatttatcaatgtagcttaagccataggtacatgtagttgagcaatgtaaaataagtttaggataaaactttacttttgttcttagtggtccaaaagcaaaattgaaagatgggaagtgaagaaaaaagttcatatatcaaatctaaaatctaaaattaaaagtgtgttcctgtcgaaaaggttggagtttaatatctaacttgaactatgatgaagaaatttaattgtcaggacgtgttagaccttcctatcagggtttcaaaaaccgccgggggcccggttaccgccacccggcggtacggcggttaccggcggtaaccgcggtaaccgcgcaaaaccgcgacaaatttacaaatcgaaatttgaatttaaaaattcgggcaaaccgcgcggtttggcgcggttaccgcgcggtttgacgcggtaaccacgcggtttggcgcggttaccgcgcgatgtgtaatgggttgcacagtaacgggccggcccatttttttttctttttccaattttcaaatttattctccgttttgctctcaaatttgaataaatattactcttttttaagaaatttcttcaccataaaacactataaatcaagcactaccttcactatttttttttgatttttttcttttttttaaaaatttttttgaatttggacgaattttattaaaccgtaccgcgcggtacgggtaaccgtacccccgcggtacgggcggtaaccgcgcggttaccggcggtttttcacaccctgcttcctatcttgtagaagtatgattgcagtgcatgatctcgtgagatccatccaccaaaaggtaacatttcattccaaccattcatttttcctatcccattttataccaaattcaaaattccctatatacccatgagttttcgttcgatggcttctgtaaccttgaattttgcctcatcttccttatgtccatgagtttttattttttatccccctatacctatcagcccatgccgcttattaactgtgagttgatcattagatttttttttcaaaaataactatattgtactctgatactttacgctacatactttaaaaacatacttaatatgaaagaattcttactctataataaaaccaaaatgaacataattaattggcatcggattctaaaaccaaaatttaaatttacaaatatttttgaaaaatgatgaaatccatacataggtttcactaaaaaaatttaaaaaaaaacaaaactgatttttaattgggtttaaatttcagcaaaaattctgaaaaaattatatcaatttgatttgaaacattttctaaaaaataaattttagtttcaaatttatgataagtaattatgtcctgtttattttttaaaataaatcaattttttacattaagggccgtatttttttccattgaagagcaagtaaaagatatgggtaatatatatattttaagaaaaaattaatggtcaacaaactaccaactcacggagtaggcataaagaaggtcaaaatacatagtcaatgatatataaaaagaacggaattgctaaatatcatttggcataattgtagggtcaaaatcttgcaaatttcgaccttagtgtttgattcgtggttcatgctccggtgaccaactctccttctccataagatcctgtgaccccttctcctccatcacgggcaaccttgacgaagggaatggagttacgagttagggtcccgggttaggataggggtgataaatgggttggagaggaggaagaggaggaggaggagggaggagatcgtcgagcctagggggatgctaatgggaggcggtagctcggtggtggacagtggacccaggtggctcactcggagccgcaaagatggaagagggtggtggactgggaagacgatggagcaggggcacctcgccgacaccggtttgaggaagagggaaagggggagaagccagtcggggaggtctcatcagcgccattgatgtcttccggctagccgataagatcggacagtgacatgatggtggtggcagtgggagcgacaagatcaagcactcgagcccgcatcatggcggcaccgagggtggatagaaggggtaggttagtaagtgcagacgaatcttaaagcaatctgacagttgaatttctacaggatttttggtgggcttctctatcaaacaatacacatacagttccttaaaaaaaaagtctaaattcagggacacagaaaaaaatagacgaaaattcgtaggcacatggaatatattttctcaaatggaagagtgggcgcccaccgagagcaaaggagcggctggctgttctgaccagtgggccccaccccacggggacggttggattcggcctgtttccaggcaggggaggcgaccgttccttcccagagaagcacgacgcctccagctcaccacaccacacctcgtgccctccaattatttctctcttttttttttctagaacaattattatttctctcttcctatttccctgacggcctcaacatgcatcctaatgacagctactgatccttctaatcaacccatattttttttgtgaatattgcatctgaaatgagaaataaaaaaaaacaaccacatgttgtgttcacctcaccactatcactgaacattcctcttaattttgctgggtagttttagacaatttttcatctccttttagtttctctattggaggtccctcccttacattggagattagttagatgggattagtgaacttgagcatcagggtcagtggcagccaattttgttagtaacctgttgatagcaactccagccactaaagtcaaaccccatgtgtaactgctcacactctttgctctaatcatatggttaattaaaatgtggcacacatggttggcttattgactgatacgtgccaacttgcggttagtattttacaaagatgatacaacggttcatacattcaagtcgtgtttggacccaagtaaactttcattttccgatccaccaggaattgaaccgtttcatgtgaaattttaatgtaattttctcgcaaaatgaaaattatgacatctttatttctcatctagatttactaacgttcatataaatttgaacgcatatgaattatatatatcgatttttgcataactatattcaaaaatcaaagcgttttgtaatatgaaacagtagagagtttaatgtaatgcatgaagctaccaaattaatcaagggaacaagtcattaactgttatatagcctataggtttgtttagcaaagcaccaaaatcattaggtgaggcgtcaagccatcaaaccccaattcgcgcgtagaatttggtgacgcgtctcttttctctctcttcttcttcttctccctttaattatcatcacaagacctctctctctctctcactccaagaactccacgccaccatccccaccgcctccattccaccgccgccacaagcctcgcctcgccgcgccgcgttctcggccacggcggcgccaatggccgaccgcgtctacccggccgcgaagcccaacccaccgccggcaatggcgaacgcgggcggcggcggcgcgacggcgtcgttcccggcgcccaagtcgcagatgtaccagcggccaatctaccggccgcaggcggcggcggcgaaccggcggcgcgggcgttcctgccgatgcagcttctgctgctgcttctgctgggcgctgctggtcgtcatcctcctggcgctcgtcgccgccgtcgccggcggcgcgttctacctgctctaccgcccgcaccgccccagcttcaccgtctcgtccgtcaagctcaccgcgctcaacctctcgtcgtcgcccacctcgccgtcgctcaccgactccatccagctcaccgtcaccgccaagaaccccaacaagaaggtcgtctacctctacgacgacttctccttctccgcctccaccgccgccaacgccgtcccgctcggcgccgccacgtcgccgggcttcacccacgacgccggcaacaccaccgtcttcaccgccaccatcgccgccaacgccgtcgccgtcgacccggccgccgccgcctccgacatcaagaagtccggcgccttctccgtcgccgtcgacgccgagacgcgcgccggcgtcagggtgggcagcctcaagaccaagaagatcggcatccaggtgcactgcgagggcatcaaggtgacgccgccgccgcccgccgccctgccgcgccccaaggcggtgaaggggaagaacggcaccgtgctggctccggcgccggcgccggcggactccgacacggcggcgaccaccgccgcgacggtgagcaccgcggcgcactcgtgcaaggtcagagtccgtgtcaagatctggaagtggaccttttaggtacagaatttcgcgaaagtttaggggctcggatgcaaaattttcagaaaaaaggattttcactttatcatttattatatattggagtagaaataccatgcgtcggtggggtgtaaattctctcaaacatttgtttttttgtttttttgcttttcgttttcttctatattatcttattaaatacttttttcctcctctttgtagcgaatgtactgtataattttgtgatttattatttgtaacattataatttgaattttatatttaaattttctacctacaagctgttgccagtactccagtagtagtagtactactgatacaattttggctgcgtttagatccaaagttaaagtttggatctaaacttcaatgcttttatatcacatcaatatgtcatacacacgtaactttttagtcacattattttcaatttccaccaaaatctaaactttgcgttgaactagacacattttggaatttggtagtgtatgccaattgccaagtgagtgttggtaaggtgggtaatcatgaagtcattagtagtataaaatactactaacaatctatataattagaattaattatttaactaacgagattaaataaataagtaaataataatgtaattaaaatcaagtcatggaagggcatgacatgagtgagagattgaagacatgtgaaggacagcgaggaaagggttgctacgtgacgtgcagatagcggtgcacacagctgtaacgccttgtacttgagcgcaggagattggttagtttaacgacgactactatagtagtagtattaatttattattagttttagtttaattaaccgtgctagctggtcaggtaatagtacaatcagcagcaaacagtagaaggaaggcaaaatgtcattaaaggtcaacaccatcattgagtggcgtgagcattttcaagtactacctccgtaccttgcagccatgaaaattcatatctaacgttgacagtatgttttatttaaaaattttataaaaaattttaaaaaaattagtcacatataaagtaatagtaatcataaatttttttttaaataattcgaaaacattgggtatagtaggtcggacagacggagacaggacacacaccgccgtggatggacttgataacaccacaactttgcacggcatcggctgtgtttccgatgtgactctacgaccctgaccatcttgtagcttcatccatctctccctctctccactccattggtgcagcaagtaaagcaacctcgctgccgttaagcggggtactggagaggaaatcagcgatacagtttggatgaattttgaccaaatttaaaattttggaaaaaagcaaaaaaaattaaaaaaaataatggatgttgttcttaatttgtaattgccaatggtgaaaaaaattttaaatagagtaagctaaattaaaatttaagggcaaaatcgaaaatagtttacaagttgaaaaagagaagagaatattgggccttaagtatcctacatattcttccaattattccaattattctcaatttctagttttctatacatattcaaccgtatttttgattttttcccctatttattttacatttacatgatttcagctacacagcccatgataaccgtgcgaatatcgcggtaaaccgtgcgattatcacggtcaaactgcgaaaccgtcaagttttgaatttgaacttttggatgtgatttttgtgcgactttaggcgattatcgcagtaatcgtgttgccgcggtgtggcggtaatcccggcccaaacgataaggtaaaccctgggcagtacattatactactccctttacttttagctcctcttatttaacctaaaataattctatttttaataattattatatcgaaatttagaaaaatagggataaatataataggcgtaaataaagtggagaataatatcattgatattatgcaaagatattactttttttcttatctgtatatgtgagatgggggaataagatcttccttcgttctgagtgtacgacgttattaactttttatggaacgttttaccattcattttattaaaaatatatataaatattactacatcggtattaaaataagtttattttcatcattctccacatatcaccaaaagactataatatcactactttattcaatcccaacaatttttcactttatttaccctcaatacaattattctctaccttcacaaactctaataaaataattacttaaatttattctcttaacttaataagagagggagggactatttatacttttacgtatttatactaaatttttaaataaaatgaatggtgacgtgttatttgaaaagttagtactccattcgtcccattttaagtgcagctatgagttttcatgtgtaactttaatcgtccacctatttgaaatttttttgaataaaaataaaaaacataagtcacacctaaaatacttttttatctctaataacaaaaaaaactaatcataaaaaagaatttaaaataaaacggatgatcaaagttgaacacggaaactcatgacaatgcttaaaatgggacaaaatgggacggagggaatagctttatatattttaggatggagttagtaaaataattatttcgtgagtttgtgagagagatgaggtcgcgcatcacatggagagggcggagccagaacgaaatagaggaggatacctcttgcttaatttactctgttttaaatcaagtttaagttaatgcctgtgtctaagtttgtattaagaatgcacacacataataaaaatcgataagttataacttaaaaaaaaaatttgaccaagttactagacacacccctcccatagtactctacctccgcccaagtgacgacgggtcgaacggagcacgcgcgccggaggcgatccatgtgacgacaacggcgatagaccttgtgcttgcttgatgtacacatactctctctggtctctgctctgctaatacagctgctgccattggttgctttgctgctgccgctgcgcctgcatactggagtaagtaggagtactccaggccggactatcccgtgatccattttttgaatccgccggattcgattcggcataaacgcagcagcaaccaggaatacggccgggtctagaagatcctctgctgctggtcatggtcatcgtctcatcttatcgagacatggagagatggatccatgtttcgtcacgtccgtacttccattttatatttaactccctgtctccctcgtgtactcacgctcaggcctgattcagttcccaaattttatttccccataaacagcgtatcaaatctttacacatatgcatagagaaatatagataaaaagaaaaattaattacacagtttgcatgaaaatcgcgagacaaatcttttaagcctaattagtctatgattagccataagcgccacagtaacccacatgtgctaatgacggctcaaagatttgtctcgcggtttccagacgagttatgaaattagttttttcattcgtgtctaaataccccttccgatatccaatcaaacatttgacatgttatccaaaaattttcttttcgcgaactaaacacaccctcagtcttgtgagagtgctgctgtcctttagaatcatccttcgtaaaagtgcatcaccggagcggcaaaggaatattgaaaaacatattcccatttttggtgcaaatgcatatataaaagaaaaaagaattgcaaacccgtagaaaaaagagtaaattacacccattgtacaacaagttggcaggtgggtgcgatatagtgcaagaattttagaattgaacatctaagtacaacaacttaacaagtgggtgtgttttactgttttatataagaacttgacgatttagtattttagtgtatcaacttggctaagcatatgctaggtgattttttttcacgatgtcaatatgccattacatatgccattacatagtaatcctacagatattaacttttaatattgaattgagcaaatttcataaaactatatgtattttgattaaattatcagaaactataaatttaatatgatgtatcacaaaactacagatttaacactaaatttatcacaaaacaacaaatttaaggtgaaatgtcacaaaactacaaatttagtaacaactttatcacaaaactacaggtttaatgatagtttaatcataaaacttgacaattataagtccaacatatcattaggacgaacaatttaaacccgaaaatctgtagttttgtgataattttattattaaatctatagtagtcttaaacatatagttttgtgataaatttattgttaaatctgtagttctgtgatacattacatcaaatctgtagttttatgataatttgaccaaaatatctgtagttttatgaaatttactgtactgaatttaatctttaataattatattgcacatacatacaatttacatcgaattaacttttaagaattttttgttttcttaccttcttaactatcaaccaaatataataatttctacatttaatttaattgactttcagttattagttattaggataaaatataaatatgctccaaataattaagatgtcgcataacttcttctcaatttattgtattaaaatcgtacctactttgtaagttgtatttatgtgaccatttataaagttcttatactaaattacacctacctgctaagttgatgtaccgtgagtgcaatttactctagaaaaaatacacaaataatttatagggactatctatatatcttgctagaaaaccatagctcatagttttcgaattttggaacattagatatgctttaaattttatgtgcaacagtgatcttatcattttcctccccgtccgcttctccccgcaaccgcacgcagcacaaacgtgaggcaagctcgattgcttgcttcctcgagcaccactgctgccatcgccactgccaccccacaccatcgctcggtctcgttggctggccaaaaggcacgaatggcgctggcgaggaccccctggccagcttcctaatccccttcccctctcccaccccctctcctcctaaagtcatcatcatcgaggtgtccctgctatgccatcttccccgtctccgttagctccccatcgttgaatctaccaccacctcctaaccagttgctttgttttgtcctcatcattgacgtcggtccataggccccctccattcccgcgactccagcggtgccatcgcttcccgctcgagttcaccgcctacttctggtcctccgccactcacggtgatccatttaaagtcgaactcctccctctttccactctcccacccctttgtcacctaggactctaaatggttaggatcgtccccaccatttgttggaattcaacaatgtcactggagttggaggagaagctcactggagcacgaatcgtgaagcaaatctggaggttagaaatttgcaatattgtgctctcatttttctatcgaatgtggtttagcaatttcgtaatttctacatcaatgattattatacgagaatccttaaagatcgcctatggatatagggttattgctacaagtaattctcctaccagcaatgtgaaaatcaggtgacccgtattaaaggccgagagtccgaccaaggaagcggctaactagtcctagtctcgcttgctctacctcaccccctctgccctctctcctctcagagcaagaacaatattgagctataagtaagctatatacttgtatataagagagttaaagaaaaataataagtgttaactcgcacgtaagaactaactctacatgactacatatactcaaataaatatgcataaaagtcataataagagaaacagtgagagaaaaatagagctaaccttataactaacctattactccttcccataatataagagattttgtagggatgtgacacatcttaagaccatatatctagacaacagtatgtccagatacatgattctagaatgtgtcatgtccctctaaattcccctatattatggaactgaaggagtactatactctatagtagtaataaatttagaggttgctctatctcagctccatctcccagctagctagcttctcctctgtcactgctaaagccgacgtcattgctatcgaccatcgtcgcctcatcgaacagatgccatagagtcaagtaggagtattcggcattggcatgtcttggcaagcgacaacgacgcccttggcttcctgcgggcttgtttacgtcagatatgctgacgggcctcggcaagtggcgctgcaacattcgggcattgatccgattgtgaaaacccacaatttcatatttcatccgtcccccaaaataataatttagatagagatcaatatgaacaaccccatatccaaaggtgttaatataaactagctgggtgacccgcgtaattacgcggctagttaatataaattctcacctagattgattttgtatgaacggagggagtagttgattagtcagatacaggcactactacaaaaaccctcataaggatcggtcttataggtgccggttcctaggcctttttccacctccgcacgtgggaaaaaaaaggcacctttaaggcactatagctgtcggttcattagtagaaaccggtaccaatactagatgtgtcggttttttaaatgaaccgacacctataatatattataggtgccagtttattaaaaaaccgacaccaataactataatatattataagtgccggttataaaacgagccgagccaacgagccgagcatcgtatgtcgtccttgtccactcgctctcgcaactcctctccctctcacgtctctctccctcccgcgtctctctagcgacggaggctacccggcggtggtggcggcctcccgaggcgggcagatgcttggcagaggtggcggctgccgcaccctcccctccgccagatccggcagaaggggaggcggcggtctccagcggccgcccggtggtggcggcgggctcccgaggccggcggctgccgcgtcctcccctccgccagatccgatggaaggggaggcgacggtctcccgcggctgcccggcggtggcggcgggctcgcaaggctggcgattgcctggcgaatgcagtggctacccgatggaggctgcccggcggtggcggtggctaccgcgccctcccctctaccacatccggcgggaggggaagcggcggtctcccgacgaaggcggcagcggcagcggtggcggcgctcctccaccaccgccatcccggcgacccaagggcctcgttgccgctgcatcatcctcaaggccgctgtggttcgagtgtgttctttttatcttgtttatgttctcttgtttaatttctctcaagttctcttgttcatatgtgtaccgagaacatgcggatttggatcggatgaacattatagttaaatagatgtaggaattgttcttgttgttgacgtgttccttggattttgattttcggtgtgtggatattgttctgggatgtggaggggatcacgggatggggaggggttctgattcggctcgattcgagccggagtttttttagctcgtgtagacgtaaaggtgccggttctattttacctattggtaccgatgccagcaataggtgtcaaccaattggcgccggatgggaaaccggcacctattgccagttttcaactggcacctatagggcttttttaccagtggggtggccgtacatacaaataaatttttttggctttgtatataaacaactttcgtaatatccgtgcaaaagaaaaaaaaatacttcgtagtagtgaaatatacacaactatagaaatggaaaaaaaaatactattacccttctaaatcagcgttgttatcttttctaccggtagtatagaatattggcaaagagcacaataaagccacttgtttttctttcaaattattaggtgttctttaaaaaggtttgacaaatttcagcaattttaattcctgtaggattatatgtaggggtaacattgagtttctgcgttatattttctaatctctatgtttcagtgtttttatggttgttataagcaaattattaaggcttgccatactttttaagctttaacttgtggctaataaaattgaagcaacgcttaagagagcaaccatgctacacttttatgtactatcattgacataagtgacctatgcaatgttgaagggatcttgtccgagcatctccaaacaaactatctaaattagactctccaaacaactaaatagtcagctcttcaatagacttagcaagccaaactcgttactcactccaatagtttctccatctatcctctctatttcgacttataacactgggatccacatgtcatcctctgctacccctttcttcttcctcctctttctctcccccctcctccttttcttctcccaatggcgccatccggagctcctccacggctctccctctgtggcggtaacaacgaacagttgacaacgatagtgacggtgacggtgacggtgatggtgacggtgggtctgtgcgtgtgtgaagataggtcttggcatagcggcctcgaacacgcggacgaggaagggggtgacaccgcatgaggtgatgacgacgaggattaggaggcacgggagggtgggagccgatggcgatgacagtaggaggcgatgccgacaaggattaggcggtgcaggagggtggaaggcaacacctccctttcagacttcctcagctccgtcttggtccatcgccgctacgccaagaacaacacctccgttgcgccacctctcccaccctcctcggctccgtccccgtccatcgctgctgcaccaagaccggagcctccaccgctgtgacaccctgacccaattattatgaggcccatgtgtcctatgaaagctatatgcgcatgttttgtaccaccttactaatttagcaagggtagaaccagtttataaggcctcttctctccaaccatattactcccgggttaaccctttttacacgatgcgaggatgaaagtgtaagtggagtggtatgtgtaagtgggcctacccgttggttaggctaggctacgcggttctggagggaggactattacaaatgatattagaatggaccctcacggttgcgcgtatatgtcagtgtgtgtcacgcccagaaattcccgaatagaattccaagcaaaatgtgtattaaaacccccgtccaggaccggccagggtacacaaacgacaaagttgacatacagatccacgtcttacaaacattataaaagtcttacataaatgcagtggaaaattaaaggataaccggagctaagccttgacttggactgcagcgggaacaccactccacaggcatcctcgacggcacggacgaatcctactcctcggagaagccactatctgacacgtactcaaactctgggggtttggggggaaaatagagcaagactgagtaccaccaccgtactcagcaagtcataccggaataggggtatgatgcaggatataaccaaaggatagctagagcggttcatttgcataaagcgagcatttataaatagtagttgaaagcagtaaaaccattgtagtaattaatcaatatgaatcatccactgtccaacgctacaccacgttgcaacaggcccaaccatccacctgaactaatcaattccattagactaagctagggtgagactaatcacggtgaatctggttgaccacccataaccgcgggcacggctattcaaatagttttagtctgatcagaggtgtacaactgtacccacaagacacggccccacgacacgttaccgtgcgccgacatgccaccacgacatactggaaagaggccgtgacaggacccttcgcataaccccctctagccaagcacaccacacctcaggtttcaccccagtccccagcgggcaacgggtagtcccctctcgtgtctaggtgaatccggaagcgacagaggccgtcgcagggcccgccccgctccatcacgcccacccttgcctggatgcgttaactagaggaaagctacactacaagcccagccgttgcccacgctggcttgtggtaagtacgataagttcttccagggcatcccgcgaaccggtccttaaatgccatgggcgcgaccatcaaaaccatgcacccacagcccaccatttaatatattttaactaaccaacaccggagcggtggcattaaccaacatcattactagaatctgatatctatgcattaatgtaactcccccattgtgtgctagttgaactaagcatggctaagcaatccctagtccaatctctagtcatgttatatcccaagctaacaaaggagcatggtacaaaaatagcatggctgtaacagtaggtaagcatcccatagtaacattataaaacaatgcaaacattataaaacaatgcagtattcaagggaaaacgatagagcatttgcaatataggatcaacatgttcaagtgacaagcatgacttgccttgctctgctgctggaggaacttcggcgactatttcaaggtacaccggagcgtcgggagagccagaatctaagcgatatacaaagcaaacaatacaaacaggccataagacaattgaaacagagaacaaaaccatttttaatggattctgtgcatttttcttgatttactgagacttgaatgggcttaaacgaagctcggataaattagatatgaattttagaagattcactgtgtttttactataaacagaaaaatccttaattgatttattgtgaaataattaaaatcctggggagagagagggggcggcgccgacatgcgggccccacatggcaatgactcgggtggcagtctgcggcggaccgggtccacggaccggggaaggagcggcgcaccacgtggcgctgacgtggcgccgacatggcgtacacgtggcggccacgtggagccacgcgggcagccgaactgacggccccgatcggacggcggcgggagagcgcggccggcgcgcacgagcggctcaagccggctcagcggccatggcgcacggcggcgcggctcgacgcagcggcggcgcaaggcggcgaccggccggcggcggagggcggcggcgtcttggcgatgcggacggcgctagcggcagctaagtggctaggcggcggcatggtggctaagcggcgcgggagagagagaagaaggggaggaggtgtctcacggacggcgattgacgacggcgagcgatggaggatgatgacagcagcgggacgagctccggaatcacctagcgaacatgatgaaaggggttagggagagagaggaagatggaagagggcgaggacgccgaccgaaggcggcggccatggcggtgctcaccggcgcacgatgcggagtgggttccggcggcggaatccgacggaagaggggaggacggggtggcccgctcgatggtgaaagcggcggcgtcgacggcgcggctcggcatggcggctagcggcggccggagcagtagcggcagcggcggaaaggagggcgacgacgctagggtggcggagggcacgggagcgggtggttgcaaaacaaaaaagagagaggaggagacaggagtgctttatatagacccgcgggggtcgatcgtggccgggatggccgcgatttcgccggcggagtggggagaggtggggaggagagagaggcggccggctgctgggccttggccttcggtcggctcaacggggagggaaagagaatgggtcggcggcccattcgagaaggaaaaggagggaaaagaaaaagaaaaggaaggaaataaatttccagggattaaatattgcttgtgctcatttttaattgattaaaattatttctagagctctgaaaattccactaaaaatcttgttagcatatttcgacatgtagaactcaagaaaaattccacatgccaattccgattattatttgcattaatttattagggtttcgctcttgcttttacaccggtattttcttgaggtcatttataaatttaatttaggcttgggaaaagaacttcagggtgtgacagtgtgcaggcatatggcgcatgtgcgctctatgtgagtcacatatggcgctggcactggtcgtacggacgtgctctaagagggggggtgttcctgcctgtgtggctatatttagtacactttgatggggggaggggtgtatgtgacatcctaacccaattaggatgatgcatgtgtagcctatgagagctgtatgcacatgtttagtaccatcctactaatttagcaagggtggaatcaacttataatgactcttccttccaaccatatcactcccgggttaacccttttacataaagcaaggacgaaagtacaagtagagtggtatgtataagtgggtccgcctgtcggttgggctgggctacacgattctggtgtaagggctgttacagccgtgccacctcttccgttctcaactccatccccgtcgtccgccgccgccaagactggcgtctccatcgcgccgcctctttctaccgtaccgcctctttcgccctcctcggccagcagctgtgacaacggagggcctgtagctaccttggcttgtggcggatagggggaggtagctccgtgccatcgttgttagcaagggcggcgacgacgtcctgtctccgggaggatggggacgacggcgtggggtatgcggatggaaggagggaactccagtgcctctctgctccgtgccatcgtcaacgccgagccagcgaacaatagcaagtggcgctgaccgatacgagagagaagatcagcggtgaagaaaagcatgtggtgatgggaggaggaatgtgtgcggggccaccgttggcaagtgaatttggctggccaagtttggcgaattaatggaaggagggttttggcacaaggatggtttggccacacaattggagagggtgttggaggacgtgttttttttttgttacaatagctaaaatttagcttagagagtcacttggagaggttattggagatactctcagaagagtataacaaatcaaacaaaccgtatttaaattgagatgtactctatagttcctactacctctataccaaaatatatttatttttcacaatcccacacatgccaatacaaaataaaaaatggaatacccttatatgttatcaaatcccaatgcaactattcttcactttatattctttcaatacaactattctctactttcacaaactttaatgcaataattactttaaaataaacttattctgtactccctccataaaaaaaaacccaattatgggtttaaacctaaacacatgtctaggtttaaacccaaaattaggttttctttggacaaagagagtaataaatagaaggagccagaaatgaatttattatgggacggaggaagtactaagatggcttaggcaaaattgtgatagtgaacttaataacctttaatttcatgaattacaaagaaggccaaatgctctattagcaccaaaacagaaaaaaataacccctttttatgccttggtgattggtgatcagcagcaacatctttgtgatgacggatgaacagggatggccccgccgactgacacccatctgccccgaaagccgggcagaggcagaaggcggtcaggtcaaggctgacaagctaccagtagtagctatccatagctctctgtctccctcccataaaaagcgcagtttcccgaagcacacaccgctccaaaccatcaccccccaaaaagcaaacacaaaaccctgacccctctactcctactgctgctgctaccactaggtctcatcattcatttgccctagtgatttatatagggtaagcggctattaaaatttaaacttaaaattttattaacaaatatggtttttatgacttttaacatagtttttctatattagtgtgtcccagaatataagaaattagaactagatgatactccctccgtcctataaaaaaaatttaggaccggatatgatatattctataaaaaaaatttaggacgggatatgatatattatagtacgatgaatctggagatatgtatgtcagatttgtagtactagaatatgttacatctgatactaacttggtttttttaggatggagggagtatatttttaagtactacgaatctgaacaaatctatccagaatcgtagtattgtctcacccgattctagatccttgtattttggaacaaagagagtactacctccgtcctaaagtaagtgcagctgtgagtatctgtatctaatgtttgaccgtttttcttgtttgaaaaatttatgaaaaaataaaaacaattagtcacatataaagtattattcatcttttatcatctaataacaataaaatactaatcataaataatttttaaatatgaagaatagtcaaatgatggatatgaaaagtgcagaactatatttatttctggatggagggagtaagatgctaagtcctatattttacctataaattaattaatgttcatccaatctcagtatatttattttaagatgaaaaatttacccctattttaatatatttatttggggacgaaggaagtattataaatatgatttcaccgtttataatcagatcagccgtggcaaaccgatgagaaccatgttagaggaggtacaataggatattacaagccggttataaacatattttaatgagaaaaaagaggagagctaaaagcagcgggctacaggttcgtagccagctgtagcatagacttcaagatgcatgtgtgtatgacaggtgagactagacattaattatatagtatatatttgttggtaattattgtatgaattagctattaaattgactatagctgatttttagcacatactccctccgtccaaaaaaaaagataaatcctgggttttcgtgtccaacgcttgaccatccgtcttttttaaaaaaattataaaaaatttttaaaaagacaagtcacgcaaaaagtattaatcatattttatcatctcacaataataaaaatattagttataaaaaaaatttcatataagacggacagtaaaacgttgaacacagaaatttagggtttatcttttttttcggagggactagttaggccccgtttagttcgcgaaatgaacatttttagatgtcacatcggacatttgaccggatgtcggaaggggttttcggacacgaatgaaaaaactaatttcataactcgcatggaaaccacgagacaaattttgtgagcctaattaatccgtcattagcacatgtgggttactgtagcacttatggctaatcatggactaattaggctcaaaagattcgtctcgcaatttcccccctaactatacaattagtttttgtttttatctatatttaatattttatgcatgtattcaaagattcgatatgatgttttggaaaaactttcttaaactaaacaggaccttagcactattaaacttgttcttatcgcagctactgtagggacaaacccgtcaattcgcacgggccatcgtccgtactacgtgcatatccggcctcgccgcacgaatctcgaggcaagacatcgaccgacgtcatccctccgcgtctcgtctcgtcggggcggtgctacatatacgcgcgcctctcgtgtctcgcctcgccgcgcgacgcgacgcgacgcgacgtcgaggtgagccaccaatggaggacgaagccggcgcggcgcggaagcggaagcggcgcggcgaggggaagccgaggccgaaggcgaccaagggcggcagcaaggccaagcccaaggggaaggccgccgccgccgctgctgctgctgcggcaaccgaagaagcggcggcggcggtggaaaaggtggcggcggagcctggggtggtggtggagaagaagcaggaggaggactacgcggaggggatcacggaggagtccatcgccgaggtgatgagctggctggagctggagatcaagctcgcctcctccgccgccgccgccggcgcggccgccacgcccgcaccgttcgccccgccgcctcctcctcctccggcggcgggcggcggcgggtacatgccggcggcgaagggggtcaacaccagcaacatggagggcagctgcggcgcgtcgttctcggtgtcggcgtcgacggtgatggcctcagtcgacctccgcgccggcgcgccgccgcctccgccccttccgtggccgctgcccggtcacggcggcggggccacggcgtcggcggcggcggaggaggcggtggacgacgacgagtgggtggaccagctactgacagatgggcccgccatggagtagtagtagtagagtacagtgtccagtgagtagtactagtactgttgctactggtagtagtagtaggaagtagtaggagtaggttttggagggtagcgtaggaggctgacatgtgggggccatgccctttgtgatgtgtaggacagcagggcatgaactgggaacatcttttgtcggtgtacaggggagattcggaggagtacgttgtgtggggtttggatggatggatggacggacggatgtggctctgtcactgcgcgtgtcattgatcagttttgtcgtcaggctttgcgaccgagccataacttttttgaatcgccttctcactccagcgttgttggagaaatcttagcgcagtagcagggattttttttgtttttttagaccttttatttctaattttattaatactagaaaaaagcctgtgcgttgcaacggatgaatgctattttagtcgtattattgttaatttttttatctaaatagtatatgtgatttttatttgatagtatcgatatctaatttggaatccttatttggatggtggccatatcatgtacggtgctttcttatcgcctgaaaagaattctgaagcaattaggagtatgactcttgtcttaagttagcatgcaagttttttaaaaagactttttatatgactccttatacagacgaggtaccaaaaatatcgaaaaaacatttttaatttttaaaatagtagagattttcgtttgatttaagtgttgttatatattttctaatgggtgaaaaggagtttgttggagcaatttatatgttatgcttgcatacatacaatgttctttgttgttgctggcccgctgcatacgtgggcaacgatagagtcggattcacagtgcccactacatggtgacgaaggacggatatgggaggatatataagagtcggatgacagtaaaaaccaattcaaatacggatgacatatcaaagttctcaaaaaacatattcaatttttataatagtagtgagatagagatatagagataaaggtatagaatatccagtttgggtgtaggcaatatcttgatttaatttcatatactgatgccatgattttttctcgataatctacatggaaaggaaacaattttattcaaggaggattataatcattaatccacatggaccaggaaattaatcttgtgttagtagcaccagccaatagcactgccgcatgtataagacacctatctgtgccactacctgaccaagtgacagccatctgattaattaaatgcaacagtaatcgatcaaaagctctggttacggaggaaatcgacacggactcacgtcagccaataggagacgacgtacaaaatatataggcaaaaacattttaaacttttataatagtagatagatacttttctaaaaaatattttcaaatttgaaccttttcttgtttggtatggccaaataactgtcacaccacgcagtgatggcctgccacgccaagacctcgccatgccaatcaacgcttaagcttcggtttttcaaaatattttttttaaaagtctaataataaaattttaaaaaataaaaaagtcttaaaaatgaaaaaaatagtagcagcacttctaggtctcaacaagaagcccaaatcttcacgtagaaaaatgcaaatgaagctctcgtttttagattgacccatcaccaaaactttttccaggccggtctcaccgaggaaatcactttcctctccttcattcaactccaacctgcaccgctcttttcctttttctctcacttggctttcttctacgaaaatcactcagctcccatggcggcgtcccacctgccccctcctctcattcgactcgtggtgcagatctgatgacggctcttcttccctaatcctgtgttgctctcccctttccccatcgttggcgccgctcgccctcccccgcttcgcctgcgccgcatgggagaagacgccacggcggcagtagcgggcgcctctcccttccttctcgccaacggatttgtcgacggcgacacgacaaggaagttggtgctacagatgggttggtgacgagtggcggggtagaattgggcatggcgataagcttggcgtaacaacgaggttttttttagataatggattgacaacaacaaggttaggcgacagatttgccacatcattttccttcaccgtcgccatcttcccttctcttctacgggtggtgatggcttcaccagcgaccgcggctgcctcgcacgaggcgcaggagcatcgcacggggccacaccttctctcaactcatcgccggactcatgtctcacctcacctgacaaacccagacaaaaaacacgtgtctcactttggctacgcagtctttaggttagtagccgcacatgcgtacgaggaggcgaatctccaatgtggcctgctgaggctgaacgccaaataagtgccctgtgaaagcccttatgggaatcaagtacctcactccggtctgtacttgtgtttctctttatatagaagttgtactaactttatcctaaaatactttctgccgtctctttttaggattcaaacttcgtctctccattttaaaatttatctctttatgattcaaattttattttaaaatagttatcactataaaatttttcccgtttcaccttcaatcacaattccactatcaagcataggagtacatcctattatttaataaagggtattatagttttcagtattaaacgttaatctatcgtaaacaatcttggataagtatcatgagtcgagggagtattttgaattgaatttcatagaaatgatagatgtatgcgttatattttacattttctaaggatttttttacgctatttatatatgttggaataacctactactctatctaaaaaactgatcctagctacaaattttgtattctcaaatgtctattagaattgggttttttataggatggataggggtaagaatgtgaggtttggatggacggacggatgtggctctgtcactgcatgtgtcattgatcaattttgtcgtcaggatttgcgaccgagccataactttttgaatcgccttttgagtctatccaacattgttggagaaattttatgggaattaagttccttgctccctggtacaaaattatagggcgtatcgtaaatctttaagagaaaaaaggtaatttcacaaaatatttggatcattatgtcacaaaattatagattaaaaaattatatcataatctaaagatttaaaatatcgtatcggaaaactacatatgtaacatcatttttattaaaaaaaactacatatgattttttaatctcaatagtgttatggatatcaactctaaaatctgcagttcattaataatctaatcactgaatctgtagttttatgatacaatacaataaatatgtagttttctgtaaatttagcactaaatctatagttttgtgatacacatatttaaatctatagttttacgatagttttgtttaactatatgtagttttatgaaatttacgacgttaagtgttttgataaaatagttcgagtcataagttatttttttctcatctatatcttaaattattgaaaatgattcagcttactcgctagtggtattttctctttagcgtttatgccatattttacactgaatttggtagaattgatatatgcattataacttactagctacttactactactagttatatggataaaatctcttataactaggtagtaatagtatgttgaaacttgaaagcacctaagactaatttgaacatcgatatttaaatttcaagaaaatagtcataaaaacatttttgaactttgatgatggtgttatctatggatatttgtttttctcattttaaaattgaaataatgaaaacagtttacctttgctcacttactgtatttatcctttgtgtttctttttataaaatgtttcctagcattacaatttactactatttacatttttttgtaaaaaactttcactattgacatatgttggaaacatctaggacaaatttaaatatcaatatttgaaatttcataaaatagtcatcaaaatattttggaactttgataatagcgttatctattatctaaaaattaaagcttaaaatgtgacttgtctaaagagaaaaatgttattaagtagagtaaaccatttttactagttcagggataaaataagtgtactaatagtttaggggattaaatgatcccggaagtaaaataaacttttttctatttttaaaaagcctttagcacaatacttcaaaattgattaccttaatgagctaaaacaaaatttccaaatatttagaaaccactggataaaccggccaagttaaaaaagatttgaattgatccttaaaaaattgtcaaaatttgtctgattttttttaaggttttcatcgataatcgatcaattataacaccacggttatcattgaaaccaccggggagtagtattcaccaatcggtcacattttgaaaccctgtttgtttgccacaggggagttatgtctgcatggcgcgtactctgaaccttgtgcttatgcaatggaattaattatcattagggtagctattgtgtttattgaagacacagcgaatcacagatgtgagctacggaatattagcaccccatattcctgtagatatatactgtaacagacaccattagggtaatttgtcgaatttgtgaccgacgtcaatgttatgcatatgtaatacggaggatgttcattatgaaattcccgtcttgttgaagaggataacaatggtacacccaacaccgaacttcttacgtgcggaaaaacgagaaagatgggttgggaactcaattgaacacagccgttagtgcccaattcttgcagatgagagctacaaaatggctaaggtctcccgttcttcagctctcctttggtattatgggccatcccttgtcaaaagctgcaatgctagcttcatcccggatgcatcctaaccctaacaaacaatgtaaacatgtgagatgtctgaaccaatgtagtttggtcgccatggagaggtgttgtaaatgagacacacagccttttatggtgcccttcacattgttgttattagaaaaggtttctcttctgacaatttaatacagtatatgagaacgtttctctaccttcattaatacaacgcgagcaacacttgatggttcccaaaaaaaaaagagatgctagacaccgaaaaaaattagagggatgtcatttgttctactgatcttgttactcgtgccaaatgactatagtttgtaactttgtataaaaggaatgaaagctgatttatatgttcattggatatggtcatgtttgaagcaagagatgatccacctgtctggaatgtggaaaaatctaaattgttatattttagtgttttctgatatattacatcgaccctctcatgggatatatatagaagtacataggagatagagacttggagtacaatacaagaaagaaagagtagatttatctctaggattctatctctagaactctattttatctctaggatatatcttatctctatatttgtattttactcttatctctaactaacatattcatacttctaacatgcaagatggaggctatcttttgctcagttcaaggaagcgaacataagtagcttgggctaaattcctcatgcttctcaatcctataaactgcaccatttattacgccactgtaatttgcatgagacctattgcagttggtagctaactgtacaaatctttacgagcgtttggcctgaacattcatggacatatatagggggggggggggagggggggtcataaaaaatgaggtggccctctgtatgacgattacagtggccatgtgtccatactggcttcgaattgctatttgattctaactgtcaatttttcggctttcttattgaatgctcccatatgtcatttttagatatcttcgaatggaagttaattctggatttattcattctcacccagagtaagtttaataacgtagactataaatgcacgctaaattatctgaagataactctgtagatagatagagtatatatgcaataagcaactcctaacacaagatacgtaatttgctagcatgctatccttcagagctatgcggtcgtgacatgaaacctgtatggtgcattttgacacgtatgtatatagtccagaatttatcggcaggcaagttattatgttgttgaagactcttgaggtacaaaacaatcagaactatgtggttcttggtcatgcactttagtgtactttcggccttgacagtttctgtcgttttttcttgtaaactttatttcttctggatatattcggaggtcctccttcagccttcccggcgaatatagtgttgcaaccattagtgcaattggctgaatcggtgtgatcgacatgaggtcgtcagtgatacatggtttgtaacaatagggaaatcctttacttttttgtctggtcaagatatttttggtacatactataactttaacataagaatgctgtgtaaaccacaaaacttctcactagtggagcgtttaaaaccgagcaacatcataagagaaatgcagtggccaaagactaggaaatactgacattaaacatgctggactcaagagatcattcgagcatcagtcctaaggccagccctaacccaagacactagatatttgtctttttatagtagtgagtcagcaccagtttccaaggtccaacgacgacagcagcactcactatagtgataacgggattttctctcatagtgacggctcctgatccatatttggagaccactcgataaaccagccaagttaaaaaaatcaaactaattaagatttaaactcttgacaaaatttatctaaatttcatcgattttcatcgataacctctcagtcatcattattatcgatgaatacactagggagggttattcgtctactgatcacattgtgaaacctcttgtttgtttgaccgggcaagaatttgtctagtgagctagctgtaaggtggtgacatatgtttgcatgcatggtttgtattgtgaagtatatgcaagtgcaatgaagttaaattagctgtagccggccggtaggctaggtatatattgtgcttattaaggacacattaatgaagcccagatttgaactaagaaatggtgttagcacgacaaattcctatacatactgtcagaaaataccattaggggtagtttgtagattttgtggtggatggtagcgttatgcatctaatatatgtgtgcactaagaaattccgttctcttgttgtgataacaatgttatgtcgaactccagatttcttaccactagttgagtggtgaagaaggacaagagcaaaagtagccgcagactggatcgagtaaacttgatgtgtgcatttgtgcaagagacgaaaagcagtggattccagggtatttccttgcacaccagagatccaaaatggctatccctctcatttttagctctcttttggtattaccgatcatcccttgtaaaaagctctcttcatccggatgtctcctaacccaaaacatgtaaaatgagatatatatatctgcacatatatactccagttttttattgattactgcaccaactagattgatcgccaattcaacatgcatgtagtgtttttttttcttaaagagtcttagagaggtgttggaaaggaggtacatgcgtgcacaatcttcagtcttttatatgtgtcattctagttgttgttaccactactccatctcttctcaatcttaaataaatgaaagctatttatctataacttccattaatacaatggcaacaatgttagctagctaaacctttcataagaaaaatgaaaaaaagaggtagataatagtgtctttgatttgtataaaatacataaatgggctcagtcccaaatgaggcagccaagaagaaaccaaattaaaggagagagaccaactagccaccacgcttacgcccaaatccaatacaaacggtcggatctctttttcttccttcctctagaaacttcctctgcccttgcatatgccattacactagcttgcttgtctagaccactcagtcactcagactatgtttccgttcaaaggcacccactgcagaaggcctcgactcttttgcatatatgcaggcaagacactagtagaggctgaggtggagtttcatgtaattcaatattatgcctcaactattcagctgtttgggaggattgaaggtgtttttttttctaatttcaatgagcagaaggtttagttggatctatgttcttgatacctctcaatcctataaactgagccatggataacataatgcctttttcgagggacctatcttgcagttgatagctgactatgcaaatgcttacaagagtttggcatgaaaatgatggacatatagaggttgggtgctatctgccatagcaacagtggtggcactcaaactatatatggagagttctctagggagccaatattaatataccacttaaagtggccatgtgttaatgctggctttgaattgccatttgattctcattaatttgtcaacttttttattgaatgcccgggattttgtcgacaatcttcatgcagatattaatttccacttatagtttttaggatcgtaggagaatgaacgactttgatccataggatttttttcctatagaggtcccttaccaaaggattcgaacttgttaaattctacaggaatgcatttctatgcctcaatctcatagcattttaaacatgtgctctaacctaattgtttttctttcctttaagaagtccgatacaaattctctctctaatataagtagcatataatataattttttttttattttttctatgagccaaccaaatatatattctgacttttgagtaatttatgcggttttgtttcatgtagtatttaacatgtgatatttcaatcatgcgctttttctatacctacatttttacattcttgcttcctcaacgactccttattcattctcactaagggcatgtttggaagtccagtttccacccaaaactagtttaaagttccggcccgaattattgtactggggaggggatacaaaatggctttgctctgatgggagtgtaatacactaaattttagaccgcttcaatccattacactcaggtaactaagatcgcctcagcaagtcagcaggccacatttttttattataaatgtcgagtcctctctcattggctcctccgtgctgttctccgatttgctcagccatgtgttccacggcgaccctcctctataccctcaccttactccaagccaattcaatccatgctattggcctcatcctagactctctagtgccctagattctcactagcttgcttagtaccacctgtgtcgtgtagtcctagtcctagatctgcattgccaatgtcattgtagcctcacttctcatcaccagcatcatcccatcctcgatccacatgtacaatatcatctcgacatctcttcaaagataggagtcccttcgatttgtgatattgcataattgggccttaggctcaaatgggcagacaagaagaaaccaaaaagagagacccaccacacctaaatccaatccaattatgcggatctcttctcctttttcccaagaatcctccattgcttcctgcgctgcgatgctggcttgcttgccaagccatggcatcgccacagttccattcacgtcagccagccgtgaatggaactgaatcgccacagttccattcaagtgcataaaattgatgcaaattggtcactgaatcggcatacgaagagaatgagatttaatttacaatgttgagatagaaatgcacctaaatgttcatttgaacatatacaattcaatcaggaaagcaaccccaattcattgcacatggtattctagcgtaccgagttggtcgatttactggattgctgtgaagatatgataggtgtaaaaatcaggattagcctcttgacaatatgattaataaccgagtaagttgaaaactttataaaacataaatggtatctcacctttagcagacttgaacctttaagcaaagctagtagaactgcaactcaatcctagcaagtagcaacatgactgccttcctctcatcctctggataaggctagcctacatgaaggccatatttatagcatctctaaccctgtattccaagaaatctatatatattttgaaaccgaattcatactgaaatttgtggtttgagctcgttaggtgtacaccaaatttgagaaacgtggtgtactttgcccagcatccattgggtaagacctttgttttttatttcaatcaacagagctactggttaaatattttcaaattattgaaactttgcaaattcaatcatgatggatactgaatactttctgacgtaaacatgcccttgctgaaaaaaaacaatggctcctacgttcacgtgcacgtaaaccctccacggcttaacgtacgtctcgcgtgcaacgacattatgagcagtgagcatagaatgggtgtggtttcctgacgtaggcgtaattggtggtgcgtaacccattcaccagtccatcctgcgctcacgtacgcgtaaaccgtgcacggcctacgcgtactgggtggatcgagattcaggtggtgtctacatggttcacgcctacccgtggaacgcgggcgtaaaccattccatcctacgctcgaaagctttaaaaaaagggtgcacatcgagcctacacatatctttggggagggagagtattatgtttacgtctgaaataccatatttactctccaaatgtaaggtgtacctagatcgatatatgttcaccatgcagggaagggggagtgatggattgtgctgggctcctggcgtgctgcgtctacacagtgacacaaatacgatgataccatcgtcttattgctcctccccgtcgtcttccctaccacttcttaggggacctgtgtattcatgtgaattatagttaggcctatttagggaagctttcagtagctacagcttcttctagaatgtcatgcaccaaacaatccaaattctcgcatatattctctggcatagtttctccaaagaatctcaagccccctccaatagagccttagccttagaaacttttcacaaatgtgtacactactgtactacatgaattaaactgtttttttttggttgaaatgctccgaaagattaatgcatgcaggatgcctgaaaagttttgaggctccaaatgccagtttggtactctgaactctgcagggtagccttcccgtgtagcctgtaggcaatggtagcaactagcaaggcaccagctttccaaagaggctggaatgcaaatgcaatgggacaaacaatacacgacgtacttaagtatacattactagtatggcatacagcagagagaaagctcgccatctttctacttggcacaatcttattgtactttcccgttttcactttcaccgagtaaattatcatggctaggaggaacacagccttttcatcattaaaagaggcaggaggagcagatcagctctacaactccactccagactcaactcctagaactaaatttagaagttagaactgtaccaaacagacccttagatcttagatctgtaaagtaacgcaactgtgtggatagcctgaattgctcagtagggagtattagtagtagtatttgcagtgaaaaccatacgtgtttacggtgaaaacagcagtgacgggccggcattgaagacgataggtcaggaggcagcggcggatggggcggcgtttgttttcttcttgcattgacgcccattgcctgaaaattccaactccatgttcctgaattcagagacaatttgcacctttcctgcttcatgctcttgacttttggtagtggtacagtttttgattatctggtgaaccttctatttcaattgcatcgtttgtttttatagatcacataagaacataacaggaagatgaatacacataaagttaactgattcttcagaaatatgctgtctctcaatgctccaacgctaccaaatggacaggtgattattatcactgaaaacacattaagtcataagccacaacattttctgatactgcaagtttatcattcttgaacatcatcatgattgatgagtggcacatgaagctcacatcacacacgattataaaccatagacaagcgttggtatcttttcagtggtgtacacacaggatatcttactgtggggtagaatgatctttcatgttggcttctcgtagctgttttggtctctgaactctgatatcttacctctgatcatctccgccacatgaggctgcacaaacatgtgtgtagggtcaagcatgtgcaggatgaacttgtccgaagcgggcattgaagcattcagattaacaatgaactgtgccatcggtacatcgctggaaaaaaaaaggatttatgagttgattgtgcaaactacatagaggtgaagaaaaacgagctaaattttatcgattgtaaaaggaccttaccaggagatgaacaacccctttattgcattaaccatgtttctgctctttggagaacagaatgccacctgatcatttaatcagcaaaccacacagccatgtcagtggagaatcagaagtactggaaaccttccccaacaatcagactctaaaacagtgatgcagtgatcttttaaagcacggtaaaagattgcaagtgaggagataatggagatagaaaccttactgccttctaacaaggataattatgagatgagatcatataatgaatgacaagcatccaacctaaataagttatgcttaaattgcttactgctaccacacaggtacataatacaaaggtgtgagctatgcttgaagaggcaataagtttaaatcatactccactaccgaaagttggtaactaacaaaaatatgcaaaacattgtagtggccagtgattgtgctcccgtgtccaggggcggatccaacttgggaactttttggggaacaaacaaactgatctagaagagaagctagggttaacgaacgaacgcaagcaaattctagtcccgatgggaatgggggagagagagatgaatcagaaagaaagaggatgtggatgctcaccatgatcctctcccctgctctgctcgcccgatggagatcgccggccacgactcgtcccggcggcgcaaggagcggaggagaatgctcacaagtgtcaagacttgcagtagtatgttgagcttgctgtactacaatagttagattggcagttgaacattagtgaagtagtaaggaacatgattgaactgaagagcaaaagagcgaactcttctgaatacaaatatttcacttgaatcaaattattcgtataatgtcatgtgggttttgtacaagaaaccataccggtacagtaggctgtgacggctgccgcgcgacgtggtgctagctggacgggcggggcggcgaggcgatgcggcgcgcgccgccgtcggagaagccccggtgccgggcgacgcggtgctgggccggaccggcggcggggcgatgcggcttgagcacgggcggcgcgcgacggcggcgtcggcccggcggcgcaaatcgcctgcagggcttcggtctcgcgagaaggggaacgggaaagaaacggaataattaattatttgccactcttacatatggtgataaataatttgccactggatccacatgtcatagacacatgagggcccatatatcataaacagcaagtggcaaataattaattgacacatcttaaaagtggcccaaagttaaatgtcccgaaagaaacagccaatcgtttttttccgtaatggcataggcggtaattttttcccctcaaaagccagtaaaaacaggggtatggactgtttttggatttgtactaagagcaaggttaataatacagttgacctgttggctataaggtttcttatagtattttctcagcctacccatataataactagctctttacaattaatatagggtccacttgtctctcacagaatttcttgaatttcttggttcttttgtctaagccggctataagtttatagcccgcttcttctctctcctcacttttctcctccacctcagcatttagccagcttatagcctaatattatacttgctctaagcagctttagagtaaaagcacttgtggcttttggactatttggttggtttttgatttttgtaaaagcaaaaacacgttgaaaagcccacccaagcccaccctaaaacaaatattttggtgcatgcatcgtagtaaaattataaattgtaggagtttgaaaaattatagatttctaatgacctaaaattacacaatgtacattgtttaattgttgacagccaagcttattacccccatcgatgccctcaagcagctggttgaacctgtgagaatccgatcggcttatcctcttactcttctccctcagcttatcatccaaacctaaaagcgtggatctcctattacctgcattttgaaccttattattcatacttttatatatgtccaagttgtgcaactttctatttacagatttacacaattccaaatagagacaaaaactatatttatatggactattttagatgctgacgataggattagttttcatacgctgtatggacttgttgctttgttccacaggtttcaaaataaaacgataaccgagccggtccatatataaaaactgttcgataaaccggctaagttcaacaaaatttcagactaaacttcaagttctgatcacatttccaaattctgtttgcaattgggcaagattttgccttgagaacttttgtggtgacataaatgtgcatcatgtttaattagctgtaggctagctagctatgtgcttaataagtacacaatgaagcacacagtgaactacgaaatgatttgaacgacatatatattcatgtacatacggcacaaaataccattgggccccatttgtgtgtgttttggttgtgtgcattctacttatgtagaaatcggagtgtgctcagtgcctttttattatgttgatgtaatttactgggttcaataaaacctttcattcctaatagagttaaaacacatggcaaacaaccaactatgtagtcgatgaagataaagtgtttttgacagaaactgtagtttatacggcaagcatgtttagaatttagaccgattttggcactgtaactccacttaaccatgcatgtttgatataaatttgattacacttttgagagggttgattgcgcccagtacttctctattttcatcctctgcttccaatagaggctaaaatctacctgttgtgaagaacagaggaagatttgaatttcatgaagctaacatatatccaggggaggagctacagtacaaccaccggagtcaggtgaccctctgacaatgttctacaaacttgtgtattaggtcaatgcttatgacaactaattccaaatgtcacaagcgaatgattaactattgacaccggcggcttgatttcttggctgcagccatcaagatacctgttgaggctaatatcctggctgatacctctcaatcctataaactgcaccatgaataaagtttcatggatttaaattgctatctttgcatgagaccaactggagtggataactcatcgtgcaaatgaattaaagagtttggctagaacacatcatgggggtatatatatatatatatatatatatatatatatatatatatatatatatatatatatatgggtcgggtgctatctaccacaataacaaaggtggcattcaggtacaaagagttcaataagtgaataacaagccaaaattagcataccattacagtgtggtcagtgctggatttaaattgctttgattctcctattcttttgttagcttttttttattgaatagccatgtggtacgggatttaattcccacttatgtattttcatttacagcaagttcaattagcaccaaaggttaaaagtatgtgccaagtcatctgaagataacttcgtagatagatagagtatataataaggttgcgttcgtttgtgccggtttggaacctttccttctggcatggaaaacagaacaactcattagcacataattaataaagtattagctaaaactaacttgaaaagttgattaatatgatttttcgaagaaactttcctataaaattatttttgaaaaaaaacccgtttagtaatataaaaagcatgcacgcaaaaaacaagagggggttgagaacacagacaaatgaacgcagccaatagttcataaaaaacaagatacaaagtttattaatatatttgacagctaattttatctcctcttatgccccttcttactttgcaacattcttcataaagaactcgctgcccgcactttgctagggtaccagagcaagcttgccaatcaccactgcaagaacgaatggcccgtacactactacccttgagattgtgagaatgtcatgaaatctgcgtgctgctttttgacacaatgtatattgtaacatggagtttacatatgttgtaaaattgtttgttgtgtttattgaacacacatgaactacgaaatgatcaacaccacacattcctgtaaacattctacattagtgtcgaaataccaccggtgtaatttgccaaattggtgaaattgacttcagatcatcagctatgtgtggcaacactaggaaattcccctattttcttgttccagtcaatatattctggtgcctgtaactatgtgtgaacattatcgtcccaaccacataacttcttctcactagctagagagtgatgaaataatctgagatagatcgcctgatcaaagcaacgaccaacaacttgaggaaaataatactcaaattaaacatgttcgcatcagatatctgaagtatcttgtgggcttgcttctcatacgaagcacatatgcatcagtcacatccttcaagcaatccatgccatagcagtttgaactccatagagtagctccatgaaggggcgagtcatcaagatcagagctacacaacccggtacattgccttcttcagctcttcatctgcattcccaccatcccttgtgacaatatgcaacactagcaccattctggatgtctcctaaccctagatttttcttgttaatcaacgcttaccatcattctcgcaatcggttgcacactcttataatagtatggttgtgtatacttcagggtgtggtcttgcttcaagaaaacaagaaatctccatggagagttgttgtaaataatatacacagacactcttctcggccttttgtgtgccctctagctaggttaattattatcaccagaaggcatctctatgtaccttcattagtacaatgcttgtaattttttatctttaaaaaaaaactgctagacacttgatataccaattttcccccctctttaaggagatcgattgctattgcagatgatttatcactattatgtgcacactattcacacgcccattttagaaggtagaatacacatttctgttagctggcacccatttgtctgctttggatagcgcaaggatgtaaaatggttggtatcagagttttttttttttttgcggggttgttggtatcagagttgaaggggtaaatcggattttcacaatagtggaacctaaatctgatatatgccaccttgaaaactaatcaaactatttgttttgtttattgaaggcacatgagctacaagcctacaacatgatcagcaccatacgttcttgtaaacacaatgtcataatacattaatacttctagtgtaatttaccaaattggtgtgatcgacgtcaggttgtcgattatgcatggtgtgcaacactatgaaattcccatgtttcctagcgatagaatcgatttcgactgaattataagcaactagggattaaataaggattaccattgcagcgtgtgctcatctatgttgtgataaatcgatgagcttgggaatggtaatccttatttagtggcggcaagcacagccggcgggctgtggcaacacgttgatcggcagcgatcaatctgtcgacggctacggaagataggtctacgcggccaggcctcatgaagtcgtgatctctacctcttatctcttcctttttagttttttttataatggggaatcataaagaggccttaattgaaatccaataacctaaattcatcccatcatcatggatttgtcgaaaatcctatggtagaaagtataatctatttaatttgtcaatgtgatgaactctacctatgcacgatccccgaccatatatcggagcaatggtaaagagtcgattttttagcccctcttttgattattttttcgaaaactatgaataaagcctgggatattacaggaggctagctatcaattgaagaaggtgaggaattagctgtattgtgtataggatatcgtgctttagacattactattgcagaggattcctcttgtgcatttttttgttcatatctgagccacacatccaagaaagaatggttgcgaaagttacaactcccaacagttgcttcttcttcttcccaatttcttcctagttcacaacctgaaacaagtgaaagcaaggaataaattgtgagttattttccaccaaaaaggtgcctacaaacccaagccgctagaatttagatagactggtccaagatgtaggtggtgaacctgaaaactgagccgtagcaaatccaggaagttcagatattgcaaagcagaggaaacagagtagagtttcagtggaaaggctgagagttgtggggcaaatttctcctccattattttctggaattcagaagtgcgtataaagcaaggtagaagaaagagtaaaagtttcagtgcaaagcctagctatttaaacaacaccaagtcagggtctcgtgccatcccaaaggactgtggtactgcagaaaagtgcatcacaactatgagcgtggaggttcatccctatgttatcgtctttagctcttccagtacattcctatcatccattgatagaagatgcaacgctagcatcattgctgatgactcctaatcctagatttgccttgttataacacttgttttatcattctcatggttagtcgcatatgtaagatcaaagtgtgttttgattcttattctgtgatgaacaattggcatctgtgattattggttttgatatttggagattatcgtcgaagtggttttggagataatcaattttcaggtgatgatcggattcactgttattttatgtgaccggtccgaccgggtggtgtatgccggtcagatcggtggtgatcgagcggtcagaccggccggcccacggtctgaccggccgacgctgtgtcggtttcggtttcgggttgtttctttggatatccgtgattgtttcatggttatggcttctagatggataccatacgtatataatactgttgtttgctaacaatgagtcaagttggtgatagcttggtctcagaatatggtttctttgtttgtttcatgtgtagctgactcgatgcctcgagagagtatttgcggtgatggaccgggagtcggcttggtggtaagacgatgtccgtggtggtcagatatcatgcgggatactaaggctagagttgatgcacgtggttggtgaagattccatatggcatacgatggaggtattgtgtgcgtatgggatgcggagtcgaatttggaaggagtccaaatttggtacaattggttatgtaaagtttgtgtcttgtactagagggtttcttaaggtgtttaggactcttagtatgagtttggttcgtggctttaggctgcctacctcatgtataaatagagggggagcgtgaggcttcccggtatcgtttttgtatcgcttttgagagcaactgagttgctagtttcgttagggtttcgagtttagtcgagatttttgtaaggagtgctgttggtgcactttgtaaacacagagagaagtaataaagttgttgtctactttgagagttcttcgatttgtgtttcatcgggtttcgacggtctaaccggcgacataccggcggtcagaccggcggcaggtggcggtcagaccgacggaggagaggcgatcagaccagcggcgacttcacacgcggcaggcaatcttcaggcggttggaccggcggatcaacaccggtcagatcggtggcacaagctcggtcagaccggcggatcaacctcggtcagaccgatctacatcgaatttgagggtaacttttatttccgctaaaagtttgggtttttgggtatatcaaccattcaccccccctctggttggcttagttcttgtgattcgatcctacaagtggtatcagagctttgtttgcttctttggattttaaccgatctagagtttttgccatggctgcttctaataagttttcaactaagcctcatgttttttatggaacggatttttctcattggtgtagtaggatgcaatcttacattatggctgagaattatgatatttggagaaaagtttctcttccttatgtgattcccgaagttattaatactgctgctgaaaaaattgcttttgaactgaattgcaaagctcgcaatattcttttgagtgggatttctcgttcggattatgatcgtgttgcttatcttcaaactgctcatgagatttgggttgctttgaataattttcatcaaggtacaaataacattaaagaacttcgtcgtgatcttttcaaaaaagagtacattaaatttgagatgaaacctggagaagctttggatgactatctttctaggtttaataaaattttgagtgatcttaaatctgttgattcttcttatgatgctaattatccacaatctgagatttctcgtcactttttgaatggtcttgacatgtctatttgggagatgaaaattacatctatttaggagtctgtgaacatgtctactttgactttggattcgctttacacaaaactgaaaactcatgagatgaatattctttctcgtaaaggtgattctaagtctagtgctttggtttcgtcttcaatttctttggatgttggtgcttcctcatcgaagtcttctgttcttgctttatttaatgccatgtccgatgatcaactcgaacagttcgagggggaggacttggttttgctatctaacaaattttctcgagctatgaaaaatgttaggaacaggaaaagaggagaaccgaatcgttgttttgagtgtggtgcacttgatcatcttcgctcgcattgtcctaagcttgggagaggcagccaaggatgatgatggtagagtcaaagatgatgacgtgaacaagaagaagaacatgaaagagaaggagaagaagaagcattgtatgaagtggttaatccaagaactcataaaagtttttgatgaatcggaagatgaagatgagagcaaaggtaagcaagttgttgatctagcttttattgctcgtaatgcaagttctgatgttgatgaatttgatgatgataatgaagaaaagcttagttatgatcaattaaatatgctgcttacaaatttgctaagaaacttcaaacatgttctattgtgcttgatgagaaggatcatacgattgagattcttaatgctgaaattgctaaattaaaatctttgattccgaatgatgataattgtcaatcttgtgaagttttattttctgaaattaatgctttacgagatgtcaattctgttaattgcaaaaaattggaatttgagattgaaaaatctaaaaagttagagtcttcttttgctcttggatttgctttccatactcgtgttgttgatgagttgattttgacaaagaacgttttgaaaaaaatacaaagttgctttttgtgcaagttctttggtcaatgcttcatgtgcaaataaggcaaaacaaaacaatggtgttttgatttctcaagattgttcaaagtgtgttttgaatgagttgaagttgaaagatgctttagagcgtgttaaacacatggaagaaattgttaaacaagatgaggtgttttcttgctcaacttgtagaaaacaaaaaggtcttttggatgcttgcaaaaattgtgctattcttactcaggagatttcttatttgaaaagttctttgcaaagattttctgatggtaaaaagaacctcaacatgattcttgatcaatctaaagttagcacacacaattatggtttaggttttgattcttatgctcatcatactagatatcctcctactgttttgggtgttgctaggagaggtgaaattttgattgaaattgagcctaagaacactgtgtttaaatatgctggcatcatgtcttctttgaatgcatcttcttcgaaatcaaatgttgtgaatgcaaaaccttctgttgttgcaaaaccatcaatttaaaaaccatctacctcacaaacttgtcgtgagaagtacacttgttctttttgtggaaaagatggacatttggttggttttgttttagacttgcccataaacagaaaaaggaaagagaaattgcttttgcaaaacgacgttggcaaaaattgggttttaattcgaggaccacaattagaccgacactgaccagtcggtcagaccggctagcggtcaaactgcagatgaaccagtggtcagaccggttgccaggcccggtcagaccgtaggtacaatggcggtgagaccagcctcggggcaattttgtgcgaaattcaactcggacttttgtgaagcaaaaaaggtaagttttctggtaagtctgattctgattttgtaagtgcgtatgtacctattggttctacaggtcgtgtaactcagtgttggattccaaaatttcttatttctaaccccaacacggaggcctcgacatcttctcgttcgtaggtattttggcggcatactccccatgagtgttcaattttgagatgacgattgcttcacaaggtaacatcaatttaattttggattgacatatttttggttctactttcttaattattagcttttcatatgctagtgtttgaggtagtagtttttgttaatacaagtgtatacatgtcaattcatgagaatcttggtgatatcattggcaattggatgtctttttcaaaatatttgatttcttcttgatttttgttcggggagaatggaggttattttgagggggagttagtgctttttatgactttcttttggcatgatttgagggggagtttgtacctcatggttttatcaagcaaaaatatgacaatgaaaaaaattgataaaagagagctttgtttatacatatggtattttcttgtgcatgctagtaatactttaaaggtttatttgtctgtagcatagcttgtatgtattctagtctcttcatgagatttagattttgcttttaagggagatgatgcatgacacttaaattctatacttgaattaagcaaatatgcaatgttgatgctagcatatggtttgatttataaatgctttatatatatgctttattgacttgttattcctcaaatagctttaattgatcattgtgaaaaagagaataaaaatatcaaaaaaaatgaataccgaatccttggaaacagtcttgacgacaaggacgttttcgatgtgagcaaaataatgggtgccgaatccctggaaacagtcttgacgacagggacgtacccggaataaaaagagaaaaatatgagcaaaaaggctcaagaaaaagaaaaagttaaaaattctcttggttgttttgtgctaaaggttatttgagaaagagtgataaatgcaataggtatatgtgtttagtgtttattcttcaacctatgtgcttgtaaaattgttgcattataaatcgtatgaaatcatgaattttgattgttgattcaagcttaattgtaaaatctttggtttatggttatactttaatgcatgcttgttctattatagatgggttcatcttctttttgttgcaacacaagacttgatatgctatgtgtatgctaagctcttgaacattaatgaacataattcctatgcttgatgaaatcattgtcaaaagggggagaagtaatgtgaaaatttttggatttttggagaagcaaggtgaagcaaggtgaattttgagagttgttgagaagagcatgtttttggttcaattgggggaatttctttcttttggatttttgagcacgatgtgtacaattgagaatttctttcttttaaaaagggggagaagttttcttttggatttttgagcacgatgtgtacatttgtacgaagtgtgttttttaccacttttgtttttatttttccaaacatcaaaacattccttttgatgaggtttgccaatgtgttcatcaagagggaaattgtcagatcaaaagtgtgtttcgattcttattctgtgatgaacaattggcatctgtgattattggttttgatatttggagattatcatcgaagtggttttggagataatcaattttcaggtgatgatcggattcactgttattttatgtgaccggtccgaccgggtggtgtatgccggtcagaccggtggtgatcgagcggtcagaccggccgacgctgtgtcggtttcggtttcgggttgtttctttggatatccgtgattgtttcatggttatggcttctagatggatgccatacgtatgtaatactgttgtttgctaacaatgagtcaagttggtgatagcttgatctcgaaatatggtttctttgtttgtttcatgtgtaggtgactcgatgcctcgggagagtatttgcgatgatggaccgggagtcggcttggtggtaagacgatgtccgtggtggtcagatatcatgcgggatactaaggctagagttgatgcacgtggttggtgaagattccatatggcatacgatggaggtattgtgtgcgtatgggatacggagtcgaatttggaaggagtccaaatttggtacaattggttatgtaaagtttgtgtcttgtactagagggtttcctaaggtgtttaggactcttagtatgagtttggttcgtggctttaggctgcctacctcatgtataaatagagggggagcgtgaggctttccggtatcgtttttgtatcgcttttgagagcaattgagttgctagtttagttagggttttgagtttagtcgagatttttgtaaggagtgttgttagtgcactttgtaaatacagagagaaataataaagttgttatctactgtcacgcccagaaattctcgaatagaatttcaagcagaatgtgcattaaatccccgtccaggaccggccggggtacacaaacgacaatgttgacattcagatccacgtcttacaaacatcataaaagtcttacataaatgcagcggaaaacaaaagataactggagctaatccttgacttgaactgcagcgggaacaccactccacaggcatcctcgacggcacggacgaagcctactcctcggagaacccgccatcggacacaaactcgagctctgggattggggggaaaatagagcaaggctgagtactacccactgtactcagcaagtcataccagaatgggggtatgatgcacggattcaacaagggatagctaagcaggttcatttgcataaatactgg

SEQ ID NO: 82806 - DNA, 4567 bp, Oryza sativa
ctatgttgacttgattgcatgtcaaacaacttactgttagtgataagaaagattatatatgtatatttagtgatttaaaataaatattaaaaataaaattacgttaaaaatactctaaacttatatccaaaactagtaagttttaaaaattaaattatgataatagttgaattatatttgattcattggacaaactataaggctgacataaacgtatccttgatttgtactttattcttttaaaaaaacatgataaacttgaacttaatatgacatagataaatagagatgattttaccggatcccataaatatattgaagccgtggcaagtggcaaatcagcgatacttttacaagctatgtagcgacgtggtttgaaatacaatacaaatgcatccgtttaaataaaaacatgtgctcttacctctataaatacatacctctacgatccctccgagtacaggactgacatgctttattaaaaaatgacacttacacgcactcatgtaagcatgcacacactcatcatatcttaaaattgacgaaatcatctatacatgctcgtataaacacacactcacacccttacgaacgtacgcttgcactttacctctatgagcattagactagtatatcatgagactcatgaaaaacacctatagatgctcttataaacacacactttatttctatgagcatagaccggtatatattgagactcacgaagttaccacgtgctcctcggtgttgacgggtcgccgtctatcattagaagaataatataaatgtgcacacatatattaagtcaatgacttaaatttgggtgggcaagttctaccaccaggaattaaaaataaccaacaaaaatcatatttatattgtttgttgtgttccagaaaaaaataaaaaaaaatgaagaaagcacttatctagtactccctcgttttaatattataagccgtttgaatttttttattaatcaaaattctataaactcggtcaaacaaactcagaaaaaattatatctacactataattcaccaactatctcttattacatactccctccttttctaaatgtttgacaccattgacttttttaaacatgtttgaccgttcgtcttattaaaaacttttgtgatatgtgtaaaactatatgtatacataaaagtatatttaacaataaatcaaatgatagaaaaagaaataataattacttaaatttttaaataagacgaacggtcaaacatttttaaaaaagtcaacggcgttaaatattttgggacggaggaggtagtactttatacttgattcgtagaaaatcgtccaatccgacgctcaagatcgtcgcggaccctctcctcttcccccgcacgcgctccgcacccacacctcgatgggccgcgcgtctcgccccgatcgcctcccctctctctctctctctctctctctcgcacaatcatcgccgccaccaccctctgcgccccgcacgctcccctctcccctcctctctctcgcacacccgccgccgccgctctcccctcctctctctcgcacacccgccgccggcgccgccggcggcgtcgatccgacgtcgattcccatcttcagatcgacgccaccggcgccccctcacgccggttctactcacgccgcaagaacgctatcgcctcgcctcatcgatctccgacaacaccgccgcgcgccgccgccgatctccgccgcaagaacaacgtcgctccgcctcaccgatctcctccgacgatattccgcgtcaattaatcttcagatcaataaggtacccatgccatgagtaatttgcatgttcgactgtagcgtttaatttgtcaaatttccattccctggaggtggcatgaacaatcttccattcagttcgtcaaacactgcactaggtcccatgcagtagtaaatatatcaagtttgctactctactcgatgggacttgaaaatgttgtgaaatctctttcagttgctggtagaagcctggcattatgcaattttattgatatggtgcatagattgaaggagctatttcttttgtccctgcagatgcaagcactgacacaatattcttgtattttgaacacataatttttttattgctgggtcgggagaaaaatttgacagaccataaaaatccccaaaatgaactttagtttttaagtcaattatttctagaaaactaacttcagacaactttgcaactgataggtcattgagacattgtgttctggtcaagatcaagagactttctaaactaccatgctttttttttttacaaaacaatgtaagattttcagttcttgtaattttgacggccattttgttcaacttttcagaatttcagattttaggacttttaagttttgtttatttcacagcgttttgatgctttgctacttcatggacctttgcatgaccttattcaacatgtaataagtactaccgcaatgcattttattttgacgatgactgagctagacttcttttgagttactcacatttggatctacagttctgctgatctaaataatatttgctaatgcaacagcagttccaggagaatctgacttagcagatgtaaatatgtttctaacattatatgagattttttatgcgtatctatacaagccataactgagttcctatacaccatttgtcagtgaactacccaagagttgtaagaactaggatgcacttcaagttttaaagttaatttgagcagaatttgtctcctggatatatatatatatatatatttgagtaataatctaatcctttttgaaaggtgtatttctgtgcttcttcaaatcccctgctgctatgtgttaggtgctctgataatttccattcaactcgcgtattcttttatgccactttgtcctgtgcatctaatactgtacatttcagcaggattagaaaagtataataatggtattggacaaactacagattggatatcataaattggaaattccggggaatatgctaaatgtttcctgtaaatgcatatactgattttttatatgctgctttatttcccataggggtatatactgaaatttatataacaaataacagatttatattatcaaatcaccaaatgtgtacattgtactgcatgtaacagaatctctctccctctcaagaaaagggaaattatcagcacatgcataggttgtgattaatgccacatgcactatttgctagctggaaaccgtatatttgcaaaatatccaattttgggcaatatattggtggtatggcctcctgacatcaactcttacccatattgtttgtcataagatctgctatcctgaatctatgactctaaaagctcccaatctttaatatttgagaatcccgtgcataggcagtggaggccgaggaggccgccatccacaaccgacaacgacaacgcgatgctgctgccgcctcaagatccaccgctgcctatccgtactcacgccaccgttcctcctccgccgaaaggttcagggcacccttcgccacccctaccccatccctaatatgtctcctctctcccgataagtatccctgatgtcgatcttatgtaaaagcatgatttatgctcaatatatattcaatgtaatttgtgctggaaattgggaatcatggatgacattttctgtatatctacatccaaagccaactgtgaacagttgtattttcctctgataagcactttcaaactcttgaatatgtaccatactgctgatttcagtatggtggggaattgatgtggctggaataagaaaaaacattctcacaccctgtgtttcttccaaaaggactatatgttcactattctaagggtgatttgtctacatgtgtatcggacaatcgctgattagtccctgccatatctaactatgtatattcataaattagtactatgtattgctatattcaagtctatatgcctatgcttctatgatcacatagtactgtgtgcaatataattgctctatagtcaaattgaagggaaaagcctttatatttctgtgctgaactggaaatagataaatggcacatttgtttttaataaaaattgggttgtctgaagtttagagcactgaaatgcacattgttattgtcccttgaaagggtaaatatatttggatcattcgtgcatatatgtattcgggaccaatatatattcttaagatcattgatttagactctatacatgggaaatggtagcgaccattgaataaaaatgtgttttggttccagtaactggatgggatagatttgttgtctacgtttggacgatatcttactgatttccagtaagatctaagcgtcggtcaatttttcatttcattccagcctccgacgataggtactgtgccgttaaagatacatgtttctattcaagttaaatcacacttatgcaattattcatggctatcatttgagattgtactaatggtttgtattatattaagggatccatatgcttacaaaattgttctggattattttttttctatatggttcatccatacaacttaaatggata

SEQ ID NO: 82807 - DNA, 28006 bp, Oryza sativa
  unsure (1)..(28006): unsure at all n locations
atatgacatggttaatacaataatgtacccatctactatggataataatggcaattagttattatgcagtgatgctttggatatccaatagttcaatagtggttcatgagctttgactaattaaatgcacacatctacattttttctcaacatccatctcttcagtatataccttagcaacttgaagcacaaaatgaccaagatcagggtgctttctgacacagtgccgaacctcatgtgctccactgaggtaagaattgtttgttagcccagtaatcttgcaacatgagaaaacaaaaacaaattagcaaccagattgttgaaattgacagggaagtcatctagacagcattttgtataaataaaagttgtagcgtacaaattgattgggcacataacatggtggttctactgattatttgcaattaaatttctaaacacacaagttgttgattcttgctaggaagttggatgatggcatatatagggcatatgaattgcaatgagagaaaacaatgcacatttttggtcattctatccaaataggctattatcctaaggactcttgtcaaatagttggtgtatgttattcacaaacaaggggtaaaggaaaaacaaaagaaaaaaggaatgtgaagttgccactggtaaagcagccagagtgaaaaatgttgagatttaacaagcgaggacatggtctactgtcaactggtaaataacatgaagtggtttatgtcttgtatgataaaaaacagaaagaatgtagattaaaaagaatggcatggatataagtttcatttagacaatacctacagcactaccatcactgttctaaattttactatcaagtcccaacaagcaaaagaacaaaaaggagtacagctgcacaatggttatgcaaaagaactttttgcatttaatcaaaatttctaagtttgtcacatttttctactatttcatggtgtctaacttaaattttcaagttgcataggcatgaaacattcatcagacatatcaggaagacatgcaattaacgataggcactaccaattcaccaccacagtaagtattactgcgtgatttgttagcaggcagaccaatatttcagggtcaaagcaattgcacaaagaaagtttatagtttccaacacattgagagatgcattagagacagtgaccaactaacagcatagacaagtcatcatacctgaaaggtagctccattatgaatgatttcatgcgcaacaggatcattaatgtactggtgtagtggcataaccatatcctccacatcatatgcattaaccctgtggctacttctcactttatcaatccccctagcatctctctgccaaattaacagtatgcttttatattattgcaaaaatggtttagtataggcatcaggcaatgaaaacatcatcatcataataatggtaattatatgtgtgttgattccaaatatttctgaactctattttcctgatcactcacatcaacttaagtgtaaactaatagcgggacaatgacactaaaaccgatgttcaggtgttacaaaagcttaagagatcccacctgaaagtcaaaaccttcctgctgacaaaaccttaaattattattattcaaacactggagcataagcattatcttagatacttggagttaaataaaattgattcttgggaaactggcatgtcctagatggcttccaaggttcaagtatatagtctccgctccatgtagcaaaggttcaattgactagattattgcaatgtgtttttgtttgattgcttctaatcaagactagatttaagatgcacctgtggatcatgatgttggataaatacattggcatataaaggttcaattaaatagaggcttgattatagtctgctccatgcagcagatgttcaatttactgttagaatggatcaactactttatctttgctgcaatgtgtgtttgtttgattgcttttggtgaagactagatttaaggtgcgccttctagaacctgatattggatgaatacattggcatagaaaggttcaatatctagaaatgcaggcttgatagtttgtcctagttgttttcctactagtggaaaaggatgatactaagcaaaaggtttggctgaaataagtaaacataccctggcaaacagatcttctctcatccacgggaccaagtatttccaaggccatatatccaatgtacttacagcacgagattttgttaacacacggctagtcattaactttgcagatgttaagtttggatgcacaagaaatctggctgcaacttcgaccgagaactcatatgtgctgaatactcggtcaactgggttccttagtattgtgacaacagaagtcctctcacttggcagcttggacatgaagctatagtcatcatgactaacaaccagcttacaatcaggatggctgacacaaagatatataaaacatcattattaattgtaactgcagaatcatgtgaaataaacaggagtatgaagccgctcaacttgtacagcaaatactagtggataattacatatcagatgctttaattgaacaatcaatcttgagtccatcacaattttctcgcatgactgacacgtgttcacgatagccatataagttgttgattacgttgttcaagatgtattgaatgcctggtaatccgtataaaggtaaaccatatctactgttttcagtcagataagcactaagaatgttattccaatacatgggaatactctaaatcagtgttaaaccacagaaaacatgttaatccatgggaatgttattgtctgaatctgaataggatagtacatagtgtaaagtaataatattagtaatacacaaaagacaatctagtttattttaattctcatttggttggccaacataaagcttgacaaatatacaatagaacaaaaacagagaacaaacttttctacctggggtcgaaccgcagcttatcgtaggatcgcggacactcctcagcattggtatacagctttttcaggaagctgccaaaaacaactagcatgagtgaaatgcacacatcctttgatgacgatgaaacaagctactatgcatgtccccatcgtaccagtggaagtaggtacggccaccggttctaggaatgtgaaggaagaagagcagatccctgaggctcagcttgtccccatccttgccctcgctccccgcaaccgaggccgcccagcccttgacgaccccctcgcagcgcgcgtggtcgccatcggagctcgcaacctggagcaagttcactgcaaacaaacgaaacaccaaaaacgacacgcgcaaatcagcgcagacacatacatagctacccaacgcagcgatgattccacggaatgatcctaccaaaaaccgaagcgcgttccgcccaccacaaattcgcacgcggcgggggagggcgagaggagaggggattgattgattgatcgattacctgatacgacgaggagcgcgagcgcgagggcgagtccgccgaacgccatcgggggttcgggcccagatccagccggggtgccgcggccccggttcgaggcggaggaggaggagggcggcgcggcgtggggaaggggggggcagagcggggcggtaaaaaggcaaaaacccggaagggagaagagggggagggcggcggcggcggtggcggtggcggtggggaattgagcgcggcgcggcgtggcgtggcacacggcgcggcgcggcggtgtctcggcgggcgcgggcgcggggtggtgggcgtggcgtggcgtggcggcgcgttccctagtttattgtgctttggcgctcgctttctcgcgcagtgtctgctgctgctgctactggcggtgtctctctctcgttcgccttctccacctctccgcgtgccgaggcagaggaggcggaggacgaggccgaggccgaggcggggcgacgtaaatagtctagtggtggaagtggggggaaaatcgcggcggaagcacgagttttccttctcgccacttgcgccgttgcgctgcgcccacccgccgtcctcctccgcctcggcgcctcccttttttacccgcacggtgtccaacgaacggagccagatcgccggcctgatggtggagaaagatttacagcgcacgcgaaacgagaaaattcattacctccctccatctacttttaatagtcatatttcatcttgacacacagaccaaggataagtaattctacttatcatttatttaagcatgctactagtcattcatcgtaaacaagcgattcattaatatttacatttctcaaagcccatatagccaatcatgtgtggaagaatggagagtcacgcattaaattcgagaaaatcattaagatgatatgttgttggattgaaatatacctatcaaaaataaaattttcagatttggaaatatgactatcaaaaatagatggagggagtattattgttataaacttgaaaaaaaaatctatttgattctttaacaacttttatatagaacttattttttaaatacacaccatttaacagtttttaaaatatgctaacggaaaatgaagacgttgaagtttggagaccctgttctaatcttaactccaaacattaacctcctcattttcacatttgatatgttttgtgaaacaaaaaaattatatatagaaatttatttagaaaacaacatgttgtcgttttcgacaactgcgtcacgtcgaaaaacgtggttctctcaacagtggttggaaaaaaagataattgtattgcttagtaaaaattttttagatccccttgttacatggccctaggggcctatttatagctctattatagactcctccatcattagggtttaggttttacatagaatttacatgtatgggcccctaatgggctaagtggctaggcccaattgttggcgaaacctctggaagacacgatggcccgctaggccttctcccgatgaggtttggtacttggcgaaacccatgccttcgtgcaaaggctttcgtcccgcagtcttcgcgccgtatggccctccaacaaggtccgcatttagtgaagcccgcgtacttcatgccacggctttcgccatgtggctttcgcccatgtgggtgccttctcggccttcgccgcgtgcccccggcttgagtccttcgcctaggtccttggtttcagtaggcccagccgaaggtccacgtggtatacctctaacacaacaataaacatatatttcacatttgtaataattaatacttaattaatcatatactaatatattttcttatttaatatatgtgttgaaaatctctcttcaaccctaatgaagctttttaagtcactaatatagacgacttattttactgtagtccatacgtcaatggtataactatagattgcacaaagctatagtggtcttgtccccaaccaacacatttaaaatagtaaaatttcattgttcggctaatcctcaagggattataataggattaaggtggattaatttcacacctcaatagtcatggaattaattctctccaaatccctctcaatcctcctatctctaaatctctctcaatctttttgtagtgataagtgtggaataatacttttgactttttaggggcattaatcgaataagatccgatgggttttgcagcctccagcgcacggtaaaattagaagcgtgttttatactgatctaaatttagcaggttgttaataggtatttaagggcctatttagcacagctccagctctagctccacccctcttggagctggagctcagccaaacagtttcagctctaccaaaactgagaatgaagctgggtaaagctctctcacaaaatgaactgacttgtgtagctggatctagggagcttcacaactccactctagacccaactcctgaagctaaatttaggagttggggctgtaccgaacatgtcctaactgtgtgattacaacatctttgccgtttctgcttagaaataatcggggctacctctaattaagcctaaagaaggttacacagcaagggagcaacttgtggtggcagtcacgcaggcttgccgaatcttgctgctactgaagaacaatctttttgtggaagcaggctgccggattcaggcttatcttgtccactaccataacactacaacttagtgccgtttggtagagggaagatgattactcactaattgatcaggttatcagggtccctgctcctgccaaaccttttcttcattcatcttcttgtgtattccatccatctttttttaaaaaaaaaaacttgtggaggccatcgtttcgtttattaacggaataagcgaaacgttatatttacaaacaaaaataatttgtaaataaaacttttatatacgttttcttagcaatctaaaagtaaaatcgaaaaaataaagtacgatgaaaaaaacctcaaaatcaactccaaatttaaggtttaaaattcaaattttagcttataagtataatcataagtcaaaagatgaggctgtgtcacaacttatagttatgaatgtgactatattcaaaatcaaactaaaatattgattttttttctaaaagaggggggatacattcttgtaggtactgatgactctctgtcagagtgcaatgttcagtaggacagtgtcacctgaaaggacttaatcttatccaatgaatgattgagcagttgttttcaatcaacctgggaagcctgcaactgaacacttgcatggatgatgcattactgacagtgaaagtgaccagctttgctcactgaatgcagttaaccaatagggaatatactgttctcatacaatcaggtcactgtgatctatcaagtctggataagtactcctaaagatcactgaactacaaggtatttgtccaaaactacaaggaaactgtgtgcactgtactgctaattaattccatgacatctcaccatttcaccaatatagtgacgtatatccaatacttcttcacaaaactcaaattcaaattataaggtttccaaaaggaagaactgattatggactagaacttaactagaatcctctttgagtgactctaaaatcctcaatagttaacaagtgtcatgtaacgactcatcaacactaaacaaataaaacaagaacaaactaactgattactactccatgcatactgctgcctatcatgtcatcaagatacaaaaaaaaaaggaagttcaaattaacaaaacgaaaatcatagccacgtcaggtgacacgtggcacggttcatcacgcgtctctgtattggccgtacatggaagcgtggccaaacaatggcgggaacggcaggtgcgggtcgacctcgccgtggtacagcgggtagtcgaacccgccggcggcggcggcagggtcgaccacggcggaggaggaggcggcggcggagacgacctcgtggagctccgacgagtcccctcggctcatgacgaagtggccgccgcctccccgtggctcgtaggagtgctccatggagaagtagctctcgccggcggccgaaccggccggcgagacgaacggcggcgaggagaaattattacaccctcctcctagcgcgtcgtccggcggcggcggtggccccaccccggcgtggaacggcggcatggaggggaagcagaagtgctggtcgtcgtggaagttcgtcgtcgtcgtcggaggcggcggcggcggaggagccagcccgttggtctccaccttcaggccgtgcctgaagttgacgagcagctccacgctcgggtcggcctgcggcggcggcggaggcggttggtcgccggcggcggcggcgcggcgctgcttctggtggcaggtgtgggcgccctggtaggtgacgtcgaagacggcgaggtcggcgtcggagcgctgcacctgcttggtcgccgggcagccttgcgcgttgcgatacgtgcaccggtagtaacccctgcgaatccatccgacacgtgtcagtgacaggaggcatcagatcatgcatctggcccgttcatttttttactttctttttgtcggcccacaagctttaaaaaactgagaatgttaattttgacccaattttaagaaatgaatttgccacgataaatcgattgggctcggactaggcctcccaatcaaaagcttttatcgtttgttaaccacaaccaaaatataaaaattgaaacttaactttattttttaaaaaaatatcatgttttatcagtaattcatcattaacttttaaatcattaaatatacttatataaaagttgtacccataaattatttttgactgcttcgattttttttaagcttatcaaccgtagagtcagccatgaggctgtaaaatgattcgatttttgtgtttggaactatgggggcttcaaataatggtgaattttgtagggtttttttttgtggggaatgaattttgtaggtttaactccctcccgtcaagaaacaagctgttttgggtatttacagtcttcaaaattgatctttcaccactagttttattcaaaataataataatcctgacaaaattattataatatttttttaacctacaatatgttttcatgcatccaatctaaatatttagaaatatacttatgtttaaaattaccaaggtttaaattaaaacatgtataaaatgatatgttgagctaaccttgggaatttggcaccgaggatgtccttctgaccatacttcctccaactgaatccatcatctggtgtagcctccaaacttgcatctggcactctgaatttttctgtccatcttggcaggcccttcctgtatgatgatttagagccaagaaaattataccaaatggtcagtcaatgatatttgactcctttttttcctttggttgactcaggcaaattctaataattcagtacagctgtatgcttatgattatgactgtttccacttatgattatgactgtttccatgcttttgaccaaagaactatgacatggatttctacattgcccgtccttggggttaggtccttttcaaatatatttttgacggttgcatatgattggtttgaaaacggaatttgttctttttatatttaagcaaataaccacaaattaaatagccttttttttaggaaattaaatatcctctgtttagagtcacaatgatatttcgaatgggttttccccctgacattgattaaccggagacatcgatattttggaactaccaaaaacatgtggaactggaagctaaaaaattcacattgcaccatgatacaacacagagacgacatacatactcatctacatccataacgcattaggtagatcatttgccctttttgctaaaaagaaaaaaaacagtgacttgattttaaacctagtttttttagcaaattaaattttagagttggttttgagtttttttaccacggtttatttttttagccttgacttgtaaaattttacctagatactacctccgttttttaatagatgacgccgttgactttttctcacatgtttgaccattcgtcttattcaaaaattttatacaaatgtataagatataaatcacacttaaagtactatgagtgataaaacaactcataacaaaataaattataattacgtaaattttttgaataagacgaatggtcaaacatgtgagaaaaagtcaacggcgttatctattaaaaaacggagggaatattatttttttattacttcgttaatttgtctacgacttatagttatagactgtagctggactgataagagccattcttaacattaaggcaagagatttataacaaaaaaaaagtttaaggctctaaacaagtccaaccatgtacacaaataggggcttagaaagggtgacacgaattttatccttattcagtttcagataagacaagccgatgataatatactctatccattatctcaatttgcttaagtggcgacttacgcgtggcgggcatgtccttagtttcgcgccatttttttaaaaaaaattaaagtgatgtgacgacggccaaaatgccaaacgtgtgtgtgagacagtgatagagattttaaagcaaattgaaagagaaattttaaaacgaactgaaagagagagatttttttttgtttagacgaatttgaacacacacacgcaccttctcttgatcgtgtcatggtggcgttcttgctgcgcgacggcggcgtccctcgccgtccggcccgagctctcgtccgccgaccgtggcgagtcggagcggtcgccggtggtgccgcgcgaccccgacgcgccgccgccgccgccgccgccggcgaaggccgccgcctcgatggccctcgcgatgcccatcgccctcgcgagcgtgccctgcagctgccgcgccacgcccctgtagtactcctccccgcggccgccgccgtggtactcgtcgtcggccgccgcggcgggctcgccgagctgccgggcctgctcctcgccgtcggcgaggatgctcagcagcaggtggatgtctcctccgtccatggggcacaattcttggacacgacacgacacgcgaaagctaagctgattgttcttgtagctttggatcaatcagcttgcagattcagacttcagatgttgcaagcaatgcaagatcgatgttgcaatggcagatttgaagagccaagcttgcaggcaggagcaatggaaggatcatgcatggcaagttcagagaaacacaagagaagttgcagaggcgaccaacaagacggcagcagcaaactcccaaagtctgaaactctgaaaaattagtgatctaggacgacaaacaaagctctgacagatatcaggtctttttattcacttcctaccatgtagcaaacactgcaagattgcgtgaactgggagagaagcgaaatggaatggtgatcggttctttctctgcttgcttgcttgctttggtaagcttgctggaaagaatggagaaattcagaagcagaattggaggagatagcttagcaaggacattattgatctaagctagggttggattcatggagagagatcagagatgtggttatgggcacagatgaatttaaggccggtggccatggctgtctgaggtctgaactctgaacttagttgggtttggggagatatgatatgctggtaagaggaagagaagtttgaccaaacagaaaccatgcaaagtttaattcttattttttccctttgtatttctctccttttattttcctgggtgcttgctccccgttgaccagtctttggtcatactcatcatcgtactagtgctattactgggagatcaggaggaatttgctaagtacacccggtatcggtaccggccgaaaaacttgacatcgtatactatggtagttcgtagtttgcgaaagaagaaagcattacttggagtagtatggatctactttatgtttttaatgtcaattaatctcatctggttccatttatcttgggaatattacagtgcataattgcataagctttactactttgtagactatttgattccattttgtaagtcaacttgttgtttttccccctgattcagttggttgtgtagaaattaaacacaagagtttccaagaaaggagctccaatctccattgcaaaggagaaaataaaggaggaagaaaagggaacacgcataggcttttctttttcttttgtttaattaatgtcatattcaccataagcattaagctaccatgccaaaagctcagaacttttgacttgtgaaaataaaagataacaagtgtgatgatctaattagctccagccttttccaaagctcacggatattacatcgaaattgcaggtattaatgcgatgccttccagaacaatcacatatttggagcctgatgtggtatgcttattctcactgggataatgacatgctctgttgcattttaagcttgataccaactagtagcatcttttgtgttggcattcactcaccatagaactgctttttggcaaagtttggtggacttaggaaagttcaaaagctcatatagacagtgttgaccgctgaccagtcaaccctccactccaaattgctactggtcaaacggatcaaagaagaggagaatagcacaatactattggcaaaagagaggtcaacttagaaggttggaagaactgaccaggaatcttcaaacctgtttccgtgtgtagagcaggagatggatgacagtgacgcagaggcttcagagcttgtgcttacgactgcgtgctgacccaagaaaagggagtttgtgggtcacagccgcacaaggaatagttccccccccccctttttttttcttatcattatttgctaagcaatcagaaatagtagtagtacatgcacagaatgagattctagcctaagggaatagtagtaataattaagttgtgcaaaacataggatgacttaacagaatgatctaacaaaagacagtccctgtcacaccgtttctgacagtaatcatttcagcacaagaaagacaaggctatgatctgtttccagtcttttatgagtggttaggtacatgacatgtgaattggatttatatatataccaacatggtgagattacatgaatgggtgaagcctttcttcaattgtctgtagcattgctcgtttactttgccatcttgtagagtgcgtcaatggttccctgaacaaacaatgcacgaataaatatattagagattatattaacttgcattagctagaagacttcaagaaatgatggtgatgacaaagaatggaattgcagaacagagaaactgtttttggtatggcatccaacctgatagtgcttaagcaactgtggtcgtttcttcttgtatgttggggttataagatcacgctccatatcaaatggtaatgggtcaagatgtacagctcttatgaactcatagcctttcagctggcaaggtaaaaaatatataaacatttaaaaatactaaccccgttgaaatgcgtagaaaattgtagggtttacatgccacaaaactttaccttcttttcctttgcaatcttcgtgagttctgaaagaatatattctttagctcttgaattttcacataattcagataaacttccagagataccattttgttcagcccaatgctcaagaacttgttggttgggatttatgacagcaacaaggaaagattcaaaactatttccgtaaatccatatctgaaatagattagaagatacaatgaaaaacaagacatctacaaacaaaacgttgcccaaaaaaaagattcaattattcatgcattgggtagtcaggtgcatcacatttccaaacaaacatgcactatatagcctctaaaatggttagaaccaaatgagcatgagacactaccaaacagtaaacaattttgaggcgaagccattatttccatttttgtgtagttttagtgctattgagcatgtaagccaggtgccatgacatggttcagttagatgctcataagaatttactgtttgatatgcattttaatcaaaacgctaaagggctaaaaaaaattaaactggtgcttttaaaaccatattgtgatatcagcagattatgctataaagaccttttttcccactcagggacactttaacttcatctaatttttcagatcaggtgctgtatacattcatcaattgtttcaacaaacataaaaaacatatgggaaatataatagggaaaaaaaggctcatatcagatagaaacataaaatttgagacgatcccctgaaaaagtgagtagttagtatagtagttaccgaatctatctcttggagaaccccgtacacattctcgagattttctactgcaacatattctccctgtgaaagcttgaatatatttttcttcctgtcaatgattttcaaggacccatttggttgccactcgccaacatcccctgtattatacatggtatttggcatatagtcatcatctgaaaaaaataatgccattatagtcaactagcatgtcccagagattatagaaacagctaacctgtgtggaaccatccatcaatcatgacttcctgtgtaagatcctcccttttgtagtatcctgagaatagaacacttccttttacacatacctctccacgaggaatgctcgacaaagcgtcatagcccatctctggaactgactcaagacgtgcatccaaatgctcaactggtggaccaacagtcccaaccatggaaaaatcatttggtattgcaacaaatgacgccgcaccagtttccgtgagccctgaagttggtttttcataattttatttaaaagtgttactatatcaaccaacatatgaagcgcttgattaaatacttcctaaaggaattgaatggtgaagcaagcatataccatagccttgaacaacacttgcacatgtcacaaccctcaaaaattcttccactgctacagataaaggggcaccaccagacacgataaaacgtagttttccacccagtctttctttcacctaaaggataaacactaagttagggcaatgatatacatatgaagatgcattgacagtctaaattttatctgatgaagtgataaaaaaatgctcctgaactagctaattgtaccttgctgaaaactaatttgtcaaaaaatggagctgctttctcgtgtttaattcctttcctcatgctgtccagtttcctgttcatttgataattatgactaattcagaatttgtatcacaccatgacataatcaactgaacaaataagttgaaaaaaatgatgaaagttcagaaaaggtcaaaggacataagaatatcagaagaaacttatattgtccaatccatcaactcaagagttctgtaaaagaaattctttttggaaagccttgtaaaaggagttctcagtatagtcatatccagacttacagcttgtaagcaatattgaataaagctttcttcagtatgccaccagacgagatctttcctgtaagacctacataaacaaaatgcatcgaatattagttaaggacaaaatattgcaagtacagctagacattatgtgcaactttccactgaatttctacattaaaggactttcatttacgcagagttcagtagctagtagatcaatccttgcaaaacatttccaccatatttgacaattaacagtttctggtttgttcccttatgcatccttgtcaaaaattttcaatctaaagagctagttttgaaataatttcaagtaaggcctccagtaaactgttatggaccttattgttatagtatatttttatatttcacatgttcacttcaatacttcatatgaaaattttattaatgcatttagaaataatgagaccatgaaaataatagtagtctaggcatgttaacatcatgaacagaaatatggcagggtatcagataaattgattagacaaataaattctgagacatgtatagtcattgagttccactttccatacaaggaaatcaactagtgggcattaacatgatattagctataaatgtgtacgtttggaatttacctgagtatattctatcaagtactcgtggaactgcacagaatactgttggttttagagctgcaatgtcatcgaccaacagcttgacgtcctacatacatatatgacactatttgagtatgcatccattgaaagcttaaatagaaacaaggagtatccataaatcataccccacgccaaaatccaatttttgatccgtgtgaaatgaataattcttcaaagattctatcaaagatatgagccagtggaagatacgatatataaacatcatcatgatcaaactgcaaaagagcaatggagggcaaataaaatgagttgcatgattcattcaagatagtacatagcaatggttattacagaatacaaatatattctacactcacaggttcgccaatagacctggtcacgcaatcagcaccagtgatgttaacaagaaggctttcatttgatatcataacacctttagggtctccagttgtcccgcttgtgtacattattgtgcagatgtcagatttcttcttttcaggaagatcaaaatgatgatcacctccctataagcataaaagtcagacaagttcatttgtaaatttgtaatggttcggtagcatgtcatataactggtaaataacacattattagtcagacaagtttaattcttcaatataatcttgaattataccaatataaaggactaagtaagttgaaacaatttataaattaccatgatcaggaattcctcccatgagaatatggacatcccatgatttttagcctcctctttttggtcatttgtcacacctccaaagctgatgattgctaaataaagataagaaaataaaagttaattcatatactccagtgattgggaatcgactaattgatataattatgggtataaaatgaacttactcttcaaatactttgatgtggcatgacaagttttcaagagctgccatcattaaaaccattaacaagaattaggatactttcaagtttaaagcaaccatagtaagcactgccacatacagatttctccctaatcaaattacccaaaacacccatctgcatctcacgctatttggtcaattggactcaactatttcctcattcgagacacaatcgagagctcgagagctctcagtagttcagcactacataaatttctaacgaatactgcatcagcttagcatgtggtctcttaatgattacaaacactctctgcatatgcgtctactcagtaatctcaaataacagatacatgagaataatattctgtatcacagtttttttttcaataatggaataaaatcctgtatttgcttcaacgaattacatgattcgctcaacagggagcacgtacaatccaggaactaaacgatgcaaagactaatactccaacactaaaggagtaacgagaataatattctgtatcacagatacaaactaatattctgtatcacagatacacactaagcgaatcggaattcgcccaaaaaaggtagagcagagcagattaaccagaggaactagccatcccaaattcccaatcatttgctataaattcgatgagtacggatcatctcgactcgcgcaaaaaaaaaaagagcaaaaccaaaacctgcagaattcatcgcgctgcgcggatttgccgatcgggaggacgcgcgctgccgaacgcggggcaacgcggcggccaggaccaccaccatagcccatccccatccccccccacccctctcgcggggcaaaccgctacgagcgccgccacctgcggagagcgcgccggcctatcgccggagcacggcgaggcatagctccggcgtgcgcggatgcgcggggcaactgcggcgtggccgtgctaggccggagtcgccggaaatgccaccggcgcttcgccgtccgtcggcccggcgaaacggcctatgctcgagatcttattgggccgggccgagacaagactaaataaagcgggccaaatgtagatcgactatatgggccaaattgggattatatgggccgtagatgaagaaaggccagcccaaattacattttctcccccttccaaatcagcctatctcttctctatctctactattataaaaattgaagatgtttttgccgatattttggtacgtcatccgtgtataagtcgttttttaagtttgtttgcttttggaaatacatttccacatttgagttagtttttaagatcgttcacttttggtaatacataaggaattacataagaaatctatttaaaaaaacttgagacgatcagactcctaactgcagctcatgattttctaataatatactctctccggttccatattaattgacgttttggacaaaattgaggtcaaacttttataactttgaccatcaataactttaaaaatattcagtctaaagaaactagaacaacatatacatattttgtcttttaaagtactataataaaagtaaacatgcatttattttattatatatattataatagaaaagtaagatcaaagatgtatcttgtagaccgtgtcattgtccaaaacgtcaattaaaatagaaccggaggagtatatatccaagcgaactcacacagtgaatttcatcttaactaaactatatagcaataataatattaaaatagactttacccgttgcaactcacatgcattttttctagttaaaaaaaactggaaaagctgtcgaattacctctgcgatttttctctcttccacaaaagcaatctggatttcagcatggcacacgataaactccactgcaccagcacctagaacagaaacacaaaaaaaatatattaaaaaatagaagaaaaggaagagctaatcttaattcttgagctctttttactacccttgaggtagatgtactttgaagtgttaatttatggttatcggtatcttgaactcttcaagaatggttaaaagaattctcatcaattatagaattgcacatgcgtttatgtgcttaccaagactatcatagagaggcacgcatgaaaccccaagtgcattgcaagcctgaaaatggtcagatcagagtaacagattaaggttaatggttaaaactgttcatgcaacttaatggttaaaactggtcatgtgcatgagtgatgagtaatttatggttgaagtaaacctccatgctgatgatccattcagggcagtttgcgccgtagatgccacagctttcaccctgaaatttggtaatttattcagtttgataacatttgaattgtaaaatctaaaatgattgaactagtcaactgttcccatccaataacatagtactactcatcagcaaatgagaggattcttcagtcaattacttttcaaacaaactgaatgttttctgaattgtggaatatgatatccaaagagattgaactgaaagatgccaggttatactagtacatgacaatggagctatccaaattctagaacatgatcaattcaactctcctggaggtaatgaattgttcagacttcagactttttaaccttggaagattcaaacagtggacttttgctcacaacctgccaaagttatggttgtgagtgcctctgtcatcatcctgatgacaacaagagtggaactcttcatctctggtggtaaatcttgtttcagcaatgtcaagttactgtgttttaagattaaattaattaagttatgcttataacgaatcaaaataaataagcctttcctgatgcttaatggttaatttactaccaagtcaactcacatatctgaaataatccaatcttgtttgattgatgcacaacctgcgcagtttattttaaaaactatcaagattttgtaagatccaaaattcatggtaagcatgcatatgcatccacaatctcatgaattgctcacattatattaaatttggcagctggctcaggtttgcagctaaccaactgctggtgatcaagacgtgcacaaatggccattgatgatgatctaaatatatatatccaatgaacctgagccataaactattgccaattattcatttactactatgtatctttggaatcaagatctgcttaacaaatatttccattcagttaaatgttactgaatgcattacgttttttttttataaaaaaaacaaagttactgccggcaaaagttttaaggaggtaatcttcatctgggaagttgattaccttgctgattcctgacttgctaatggaggcagcaagtttcatcacaacgtcataaacctccttgtaagtcatccaaacatattcacctgcctgcaaatgaactatacagattagagaactaattaaaccgaaaaaaaaaataagttttactccacatgtgtatccgaaataataaagtggtgcttggaatgatcaaagtagcaatacattttgtagaagtagaaggcagaagagagaattatagctacaagctagagcagaaaccaatgtgaaataatgaaagattattcttgttcaaacgaagggaaaagaaatattgaattaatcaccttgccgtcgtcgacgactctccggcgaccgagcatcgggctgtccgggtacttctccaccgaattgctgcaaaattatccgaagacgattcaagaaaccgatcgaatcaggctatgaatgacaaaaacaaatggagctgcatgtctccggccatccgccggcgatcgccggagctgagaaatgaagaccgcgcgatcacctaccggaagacgtcccagcagctctcgacccccggcggcggccgcagaagcccggcgtccttggccagcacgttccggtacgtcggcccggcattctccgccgccttctccgactccaccaagtgcttcatcatctccggcgacggcggcgacgacacgacgacgagagaggaagaaagagagaggagctttcaagattgatgccttgcaagctgggagagattggtaaagatatatagggaaaatgtctttggttgactgagaccatgcaagcacatgaccaaaagatttttcttttcaacttctcattccacccatggatttcttttttttcaggagggtggattttgaagtccaaattaactttgcaaattcttttcaaaaccaagcaaaattagctttgtaactttggaataacaacagtcaggtttatgcatatgttgggtagagaatcatattccaattctctatatgtctgaacatggttttatactagtaattattaccagtatgctgtaagaatggaagagagatcgattactccctcccttttctttatgtttgatgacatttaaacatgttttaccattcgtcttaatcaaaatacgtatgcaaatgtgtaaaaatataagtcatatagataatatttttataagatgaatagtcaaacttatatctaaaattcaacggtatcaaatatttttaaaaaataagtacttgtcaaaattttcttgggcagtgccaaattaaggtacaccttacaaaagtaaacattgagtattggacatatatccaacaaacaaagttaatccgtagagttctctatcggagcaagtaccaatcttaatcagagcaatcacctgctcaattaattattatcaacaggtgagcacaaagtactactactgctgcttatcactatagttccccagtaatctgggaaaaataacgttcattaaataataattttgactaactgttcctaacgacaaattttatccatggaacaggtcagacagaagcagaaaattgacctgtacaacattggctgctgtatatcttgatgaatttgggccgaaggaagttcagaattacgcaaccataatgctggaagaccatttctgtacgtaaactgtacggactacggaaccatatatttaggacctgttcactttgataaaaaaaaaccttactaaatttttggcattaccaaaattttggcatagttgcctgatatgatttcttatatagttaccaaaatttggcagcaaactaaatgtagccacttttttttttaactttaccaaaatttagtaaggttgaaaatggcatcaaagtgaacagacccttatttcataatgaagtttgatttctgcggtttcttgcaactttgcaagaaaaaaatagtttgaagaaaaatgattagaaaaggacgcaacttgatgaggtctaagtaatcatttgggccaggtttaatcggcacgtgaggcccagatagcatctgggcttaatgggccgaacttgttaggcccagtgaaggtttgtgcaagtgtaatgtcaatttccaggtgacgcgtgtattgggttaggacaaaccaagctcaaaactgcatcattaatgcttgagaattcacgaaagcaaagctgcactagccaaagccgaaagagactgatgaactgaagattgagaatgtattgcttataatattcttaagatgaaacacaaacaatggtgaaacttaagaacaatgtaaagcttgaaggttgcaatggttttcaaattgtaactcctccatgtgttgatgctttgttcattcttcaacgaaccctgcaaaagaatttgaaaacaaaatcagctcatatgaagaaaaaagaattctaaaatgtttttattttttgaagcgtaatggggagttcttgtaatttacctgaagcagttgaagtttgggctggtcgggatgaagccgactcggacgttgcaggcggcggggaggccggcggcgcggccggagtcgaccctgccgtcgccagcggcgagcatctccgacaggatgcacgcgcacacggcccggcgctccgcggcggtggcggcgaggtccctgatgtcgccgagggcacggcagcagcggcgcgacaccgcgggctcccctccggcgacgtacgccgtgcactcgccgaacgccgtctccgcgaggccgcacaggtccgacgtccccgccgccgcgagcccggcgccgccggcgacgacgaggagcgccacggcgaccgccgccgccgtcgacgtcatggaaatggacattgttgggtgagagcagtgcacgctggtcgagacgaatttggatcaaatgcgacttatttatagggagaaatgggaaattgaagatggaatcatctgcgttgatacgcaacgcgtgcatggatgttatcatgttagcatcaatcatctgacaggtcagggttatttacccgaaagttttttgatattttgtccagggatttcaattgtttgcattgcatggtgcatgcatgctactgcatttttggaaaaaaaaatgcaagtaaagatcttgtggtcaatggaaagcaatgattttgaggcaatcctgtagggatttgcagcagacagggatatgctactgcactgctcctctggtgacagatgacactagatagtagacaggcttcttcatgggctgtagctgtgaaatcagaatcatgacatcgacgcgaagttattcgaatagtttcctttttgaattattcaaatttgagcgatcaaaattcgttggagcccccttggtaaacgtaccggcgaacgaatgatttgcatctcagttactctccgacgttatcttccgcttcggttcgatgtcagcgaccaccgacggccatgtgaacgaaactcaattggcataaatatttgatgccttgagaaatacaaggattacgtacaactcgcaagccgttgcagaaacaatggttacacacttcctcaccaacaatagatggaagtttcaaatagtgttttctctgtttttaggtggtgttctaagtagttttcatgtgttttgtcaaagttgtgattttgtaagttgaagaccagcaattggatttaatttcttgaagcaaagtccggaatggattctattatctaaaagtatcagcacaaagacaaagggggaaccggggtgctcagatcagttctcaagaggaaaacgtgatgaactgatgatcatggtgaacaatatcaagtgcatattctgatggttcaaggttactgatctactgcagtttcagattggaaccatcctgggagcatggctgcatcaggctaaaatgcagagggtactgcagctgcactttcagggaatgttgaaaaccgaaatgcaagctgaacaatcaagaacagcaagcgaaactttttcggcgtccccttgatggattagaatctgacttcagaacagcaaatgatttttccacataccttgttgaatcgacaagcttgcaacttgcaatttttctgtgtcgacctagcaacagcaacaaggtatgtggtgctactggaattctggaaaacatagaagatgaaacagtagctgaccaagatacagattacagacaacttcagcatggaggaactcttgggataaattataatttataagtgctcacaggtttgcactgaatttacagaacaagcaattcctcatcacagagctcaagcaattcatcaattcatcaaacgacataagaaaatttgagattaccatggtaagattcatgagcattagtgctctgaaactctgaaacattcagaaattcagaatcatggcctgcataacaacttcaatttattcataattcaagaagaaaggggagcacagattgcgatagataaaactacaccatatcttctacatgtcttgacagatcacgccatgccggtgtgaagggagcttccatcgtcgcggcgtgagctggtcagaagtcggagcagcggccgccgcgctcccagtcgccgtaccgcgtcggctcgggcccgcgcgggccgccgatctcgccggtgtccttgttcacgtactcaccgccgccgccgccgccgtcttccccttccttcctcgcgtcaccagcgtcgcctcccttcttcttctcctcctcctcctctcccgccgccgctcccttcccggccccgcccgcagcagcctcccccttcttcgccgccgccgccgcctgatccggggatgcggaggtggacaagaacgcgaggcgggagaggaagggggcagggtgggcccggcggtgggaaagcgcgggcgcgaaggcgcggcggaggtggctcgtcgccgccatggcctggctcctcgccgaggtcgccggtgctttcgctgctcgcttctcttctccggccctcgcgccgccgcgtgtgcgagctcaagccgccgcctccgcctcagcgtggaggactggaggtcacctacccgtaactgggccgggccgatcggatggcccaccgccacagcccaaatcggcccaataatccaccactccatagcccaactcgggcctattaatccaccactatccggcccatgacgtgacgggccggcccaatatttgtgtataattatgcgggccgaggcaaaaccgtggcggcgagagggatattcttgtcagtacaacgcaggggtgggggcggacctacatttgtagatggggctgctcaagaacctggttcagagatactatatttttttaagctatattttatctatttttatcatatatatatatatatgtattttgttagtataaatttagacacccgtatcaaattaaactcgatttaaagaagagtaaaacaagtgagggaaaccacattctactttgttttagctccgtcccccgtacaatgtatacatagttagctattccctccatcccaaaatgcccacttttgctaggtctacatttaaacttagagcctaatcttgtggtttatgcttatgtttataagccaaaatttgaattttcaactttaaatttggagttgattttggggtttttccatcgtcatttatttttcagccttttgcttttagattgttaagaacacgtatataaaagttttatttataaattattttctgcttacaaatattccgtttctcttgttctatcgataagcgaaacgatggagtccttagaattgaccttttttggaatgtacggtgtagggtctagcatggatcgtagtagatacaatatttctttctcggtgttgtttttctcgtgcttcggcaacagcactcgatcacatcgatcgatcgatctcaaaaggataacaaaagcaatgagatcgatcgatgatctgattctgccataatggcctagcagctagggctaatggcgccggttcttcgttttgtctctagctagactaaatcatcataatcagtagtgttttggtgttcatattgtgttagatatgtatggcgatgacctcatgacgatcgacctgcgtacaatcgaacgattgatggaccttcaattcagccgtttgtctgattctgatgcccctagctacctagctagttactaattaaagtgatgattacatattgatctaaaaattactactccctctattctatatctattctatattataagtttgtttcgacttttttctagttaaatattaataagtttgactaatttgatcgaaaaaattagcaacatccatcacatcaaattaattttattagatataacattgaatatatttttataatatttttgttttgtgtgaaaaatgctactacatttttctataaatttgatcaaaattttaaaaaatttaactagaaaaaaaaatcaaaacgtagtttcgtatttatgacataattaatagatcaacctcagccatgcttaattaactaaataaggttgaggccatctattaattagttgcagtggtcacacattgcgatcagttaccactacacatttgcattgattatcaggtacaaagtactacctccgtttcatattacaaatccgtttcatattataaagaaaaatttagcaacacctaaactgtcaaactagttttattaagtatatcattgaatatattttaataatatatttattttgtgttaaaattattattatatttttctataaacttggtcaaacttaaaaatatttaactaagaaaaaagtcaaacgacttataatatgaaaagaagaatgacttttttaagtcaaactttgtcaagtttgacaacatctaaaatataaaattatttttattaatctaatattgaatatagtttgataatatgtttgttttatgttgaaaatattactatatttttttataaatttagttaaacttaaagaagtttgagcagtaattgctcaaagatgccaattgtagctatactacctccattgtcaaaaagatgaggcgtagaacacgtgtagtcaaataaaaaaaatctgaaaatattaagtaattaatatataaatgcaaaagtatcaggatttatttaaaatgtgaaaattatgagtagacactttcttatgaaaaactctttcttgcatatagactatagatctatagtattttaaatatttttgtaaaatatattgttttgaaatataatgataaaacatgtgtgtattgacgactactatcgatgtatacaatgtcagaataaaaaataacagagacaattatatccctgcaacagcattggctgaatgcctgaatcttcgacgattgggagagaaaaggagctagtatagctgcatcgatcacccactaccaatcgtgacgatctcgatcgatgcttttgaacatataactcaccaatggatgctcgatcgatcataggagagtggattttaaagttacagatctagatatatatgcttctttcacatacgaccaatcgtacgcgttttctgacgatgaattcttctacgcatgcatatgatcaatatcgatccgtatcagcttttccaaaacatgggttctgattgatactccctagctgtagtccctttcaccatcatatcatatcatcagcacgtagtacctgtccttaaactgggcatattcagtggggggcgagatagacagtgagatggaagcctgaaagagacactatatatgcccagctgatagattcacatgtgatacacatttgatattaagcacatctctacttatatttcatagcaatttcttgctacatccaacatgtgcagatcgatgtgctagtataagtactgctacacatatatgtttacattctgctgtatagcttgatctaggagtagctagcagccgctgcatataaatacaaaaatgcatgcatatacagtgtgtgtccttgngtgcgagagcgcgcgtgcgtctcacatatacataaagcatggtttagtgagtgagctcgttagatccagtgttatatacatacagattaatgcacacttctctatatatatatatatatatatatatatatatatatatatatatatatatatatatatatatatatatatatatatatatatatatatatagagcaaagctagcttcatgagagaccttagccttgctcagctattaattgcataattaattacaccatcatatatatgttgtgtgtcgagaatcatttcaattgtctgaacctgcaatgta

SEQ ID NO: 82808 - DNA, 18849 bp, Oryza sativa
gaataagacgagtggtcaagcagtataagcaaaaagtcaaaatcccttatattatgggatggagggagtatctcacattatgttttggatgttatgtagaaaccatgtctcatgcaagacatgttttcttctctttcctcatttattcatttgccacatcatttttcatactaggtagcagcttatttaatgctatggacaccatcctaatcattgggttggaaatgacctaataccactggtgtttcctgacaaatgaatttttttcttcgttaaatatttgggattttgcacatcctgcatgatttccaagaccatcaagttcacatggatccaaatcatgaatatgttaataataagtagcattaaatttaagtatggaatagcggggcttgatttgaaagattagtgtttagtactagtttcttgatgatgtagagtttatggaaatttctagtgtcttgggttgggaatggccttacgtgaagtcatggatgcacacaaaggaataaatcctagtgcccaccaagaactacactcaggtttttaatattgatgcccacgaatattactcgttctaaaaagagacggagactaacgtcaatttcctgccaaacaatttattatacgaaaagaagcaatctgcagttgctacgtttgaaattgcttccaacacaaagtaaccacggtgaaagctgaaacaaccaccatatcgatttgtttatagagtgcatatacataacataagagaacaatctaggcagtgttgtaatataacttgctgggttttctctctttctttttaagtatggcaattggcaagaacaataataattcagccaacataatggcagaatgaaagcaatgtacactggaaatcgccatgagttattgcattggaagaacgtgttcttgcagtccataaaattaaggagcgctacagctacttgacattctttttctactactgccagactacattaagcttcacaatgtgtaataacctgatgaagggaacccaaagttgtgcattgtaagctaacatatcatgccaagctatgttcgaccgtagaacaatggtaactgtgtgacctggcagacgtacctcaagctgttgagatctccttgaacttcccatcgtctccacttgcactgccattaccattttgaataagcttctcctctgaaggtagatttttcatgatttttctagttggtcctgaagcattccataagtaccacacacgcgattttggaggtggcacagctcctgccaaaggagcaaccaaccccggcttcccttcatctataacgctgtcaactatgccataatccttggcttcccaaggactcatgaaatagtcaaactttgtatcctcatcaatctaaaataaacagcatgcagtagatcagagaacagcaaacttttgtgctaaagcaatacatcagtaacaagttgtcaaggagtacctgctcttcaggcttcccggtgattcttgacagtattttgttgatctttatcttctcatacatcatctctcgtatctgtaatcccatctctgtgacctgccagatggcacaaattaacatattctattgaaaaaaaaaggatgacccatttctgaaagtagcattgcatttcatggtagcacatatattgccatagggcacaatggtcagaaattaagccaaccgagaattattcttttcaaaaagcaatattgatagttatgattttagtcttaatatgatattatcatataaaatggaggttatgattttatttcaggagtgtttggttgaagccaaagcttccaattgtttcccacgattccttaggcaatttccgagcaagttcgtctagtaaaagagttaaacaacataaaaaagcttaccttcccaccagcaccccctgatggttgatggatcataattctcgcattaggcatgcaaaatctcttcccctttgtcccagcagctagcaaaaatgcacccatggaagccgccagtccaaagcagacagttgatatatcagccttgcaaaatttcatggcatcataaactcccattcctgtatattgatgtgggcatgtttattgcatcatacgataccagtatggcagcattaacacaaaactaaatatttctctggtgatcggcataaaagttatcaagaataattgtacattcaggaacatgagtccagttcagtttaggcagttggactttaaaaactcaagtacaaagagcctaaaacggtaaggggcttaaaagggtcaaatataaaagaaacagagctgattgaactgactaggttttggtgaacttgagtgaagcagattgggaagacagtaaaagatttaagccactatattggaattatgttacaagatggattcactttcatatttcagtaaatattctagatgttttgagatattctgcaatttattcccaagtttgcatggattggtgataacgaactgataagattgggttcatatcagaattaaacatgtacagcaatgtggcacaaacagtgaacagcccccagtgtctcctaaaggcataaggtttatcaaacacaggttatataatatataaaatcatgattttcatggagatattgcacaacatgcataagatccaatctaaggtgctgaacctgaaaccatttatcactgttactgttgagctcggcactgtacactgttcactcatgaacaatctcaggaaagttaaagttgttctattgctgacattaaagcgctttagaatgattatgaatgcagatcctaggtataaaaaagagactccacaaaaagcatgtgtaaatcttgaaacgaaaaaagagaacagattattaaacttcaggtttaattttcttgtatttgatgaacttgtacagcaccttttcagtatgtatgaatttggtaaatgcatcagcaaaaagtatgcagcataagacttcactagagagaaaataggagcttttttcaaattcctaatgttggagcacgcatttccttatatgcaaaacatcgtattgcatataattggcttggatagttatcaagttgatgccattatcatgtagcataaaacttatcattttgttattgccagattatcatcagcatatttgacacaccaaagattaaaaggacaggtaaagaataagaaatcaaaattatgcagaaaatataaattaactaaacaaaaatcaaaatacagtccatcagttctacatttcatgtgcatgtttagtgtttctattacacaagacctgtccaacgaaaaaagtgagtatagttatttttcgatttctgaaccatggctgtggtttaaaagttctatcagagaagttgaacttgaattgatttcgttaactaattcttgattcattcccataatctatgtgcactgagtggtatgtcacatgcaccatttagagctcacaagatttcactcatgtgttttcacaaggtttcgctggaatttcagaacaccccgtgatgcaaagtgaaatttatttcaacatatcctggtgcaaaacatggcataaaacgaaacaaagcgatcttcaacatgagtaaagtgcaattttctccaagtaatataaagaactcataggcagatatgtagaccagagacatttgtaactgaatgcatcaccaatgccgcataacccaatcagataagaggccagtttattatatacaaggacccttaaattgacacagcaaaatgccaaaaccaacactactttatatgccactgccttttgaaaaatcaaaatcttacccttctatctacttgctactattgtaaattccatttgattaccaatgtaaggggaatggtatctgcgtattcttcctcaaaattagcaagaaaatcttctttttaaagtcaactcggccaaacagccaaccttggtcctgttaatcagcgagcttggtatcataaatcagttcattcacatgtaaacttgttattctttctgttttgcagccaccttagaatccactagattaagggcacaaagacacattatacctgagccaatcaatgataaaactgaactcttcccaccccaaaaggaaaagaaaagaaaagaaaaagaaactcggaactcatcatctaccacaataacaggatgaactgatgccctccattggagaggaagaagaaagatgtaggacagaatgtcatgtgcggctggccaaataaaaaagagggtatatagtatagtcaggacaaaatgatctttgcacagctccatcactgcttgactaacagaaattgggaaataatagcgaataaggtaaaggctcttgataaaaaagaaggcaaaatttggatagtcagggcaaaatgatctttgcacagtttcattactgtttgactaacagaaatcaggaaatagtagcaaaaaaggtaaaggttcttaaaaatcattggcatttaaggttagataaatcttgtagtgttacagcaaaggatccaaaacttttcatcaaatataatctgcaaggcatttacgttacaagatacttaaaatgaagttagtcaatttctctctatcaacacaaagagcacaaggcacaagttattacaataagaggttgagaacacatacctgctgttatggagcctccaggtgagttaataaacaatttgatgtccttagttttatcctcagcatccagcagcaagagttggctgatgataagatcagcactcatatcatccacctagtcagcacaaggcattgaaaacaatagatacattattttgcacagtcagttatggcataataaaagtgctatttattacacagaacaaatattttcatttgtgtacacaatacagtgacatgaaatttgttcagagaacagtaccatgaaggtgaagcatagtgcttgatcagtgggcaaatcattaataaaccgtcagattgtaatgtcaagaaaacatgatataacaagaatgtgttagttcaaacagaaaaaagtgttccctgaagtcacttctgctaattattcctaccaaaataatatggcccatacaacaaggaaaagaaagtaaaacgacatacgactcaggaaagagtttgattctgaccctaaccatctcaagcatttaggctgtgttcggagctccaagttcccaaccactctccctcgttttccgcgcacacgcttttcaaaatgctaaacggtgcgttttttgcaaaaaaatttctatacgaaagttgcttaaaaaaattcaaattaatccatttaaaaaaaaatagctaatacttaattaatcacgcgctaatgaaccgctccgttttccgtgcggggagatgggtttccaaccccagtatccaaacacagccttagtttgttcaagaagatgcaacattaccaaggtgacatctaatcattcaacaaacagcactcatgtaaatgtaattctcagcatgaaagattcttgattcacaaggttggcaaaaaggaaacaaaatatatcccatttacatatcttatgcacattctgagctagaaaaagtattaagaaaaaaaaaatcaagatgggaacaactagaacaatttggacaacagcaacaacagaatatcacataatgtatactagagggtgatcatagcatgccatataaaatcttggatgcccattaagtgttactaaaatgcttctagttctttgcaaactacataagtttgagacaacataagtttatataagtcaatacacttttaccacacgcatataagaagccataatcctcaaggaaacaaatatgtgacaatgggcataccaaagaacatattgggctacattttggttgacataattgaattgcaaatctttcttattcctaaactagtgcatttcgttttttttaaaaaaaaatggcgaggaaattacacttaacttttttcacaccataaaattcgcaaacatttcgatattaataattgaacaagaactgcttaatgggtaataacaacacacacagtgcgatttgggggggggaagaagaaaaggctaaccggggagccgaggaagacgatgcgctggcgaaggagcatgttggtggtgtccagctcctcgaggcgcggcttccttgccgcaggccgagccgccgacggcccgggaagttcccacgcggaggagagcgtccgccgtgccgccgacgccgatgcgcggaccgtagctcttggcgccgccttccagcagcacgggttgggagcgaggaaaagggacgacggggacgaggaggatgagcagggagaagcggggagggccgccatggctgccgctgcctccatttcttggctcgcggctgcttctgctgctgctgcctgctagtgtgtgttatcctgcgcaggggtttggagaaggaacagattggggacgagaagatggggcccagatgccagcggctcgcaagacttgtactactccatactcataaaagtgacaatgtttaagtcaaacgttaataactatcaagttgttgttgagtttaaaaatataaaaattatatgtatagatttgtattgaaaaatactttcataaaagtatacatatatcacttttcaataaatatttttatagaaataagaagtcaaagttgtgttttggagatcgtgtcgctgtcctaaacgacttcctttatgagtatggagggagtacagtgcagtgagaaatgagacaactctatcccctaaggtccctcaacttgtcatcgggatacgaaccgtaaaactagatatgcgggatccctcaactatataaaaccggtcacccgaggtcccttggtggttttcaacccggttttgtccgacgtgatagctgagtcagcatgggacccacatgggccccacatgtcagctggccacgtcataccctctcccctcctctccttttctcctctctctctcactcttctcgtctgggtaggcactagtcaactagggaggacggcggcggctactgccttcggcggcggctactgccttcggcggggagaggtgggagaggacgagggcgtcggtggccggcgacaggcgacacgacggtggtgactagcgactggcgacgctctgccgccactgctctcgcctgccgttgctgaggccgcaagcgcgaaggcgcatgctcctagacttagcccatatccgtgaatgacacgatcacgacgtattatgcatatccacggttttgatttatcagctaaataagcttgcttatcgatcaaattaaagagataagctggggttttgatttatctgaacgacttctgctggtcatgcgtgcggaggaaaaggcagttccaaacccggcaacataggaacaagttaaattattgtcaccggactatggcacagcaacaaaacgaactaacaaatcaagtttatctctatctattgcttcttatctgcaggaaaatcggaggaggtcgctccagcgtatcgcaacggcggacacgcggtgtgcggcgcggcaccgacctcgtagacgttattttccaccttaaacaaggacgtagtcggtgagcgagaagacgcgcgtgcgcttcggcgccgctgcccaggttcgccatggcttgcagaccgatcgtgttttttcattcaaaacgaaagcaggagggaggaagagagggatggctgggggttaccttttggtgagacgagggagcgtcggcacctctggtgtcgtcatcgtcgccgccgcgccggagaagagggagacggggggttggatttggaggcaaaggaaaaggggctattggagggagtcggaacgaatcgaggctgccgccgtgctccccttctccctcgtcgccgtgtttcccagctgcagctaccgcctccgggcgccggccaccgtcgcgtcaccggccaccgagcgccaccctcctctctcccgcctcgcttgctggcctcccgccgctttgcctcgcccagaaagagagaagaggagaaagaggagggtgatgacgtggattacgctgacatgtggggaccacgtgggtcccacactgactcagccgtcacgtagactgaaaccggagtcaaaaccgttgacggatcttttgtgatcggtttttattagttaagagacgcgggatatctggttttgcggtttgaggatgattttgtatctcgataacaagttgagggaccttgggtgtactttttccattgctaaaacactgtcgcaggctcaaaatccggtccacaccaatggattgggccattggggttgaggcccatccaaacgataatcatacttgggatttttaaaatttttcttttttattaaaatattaaaaatataatttttgtttgacaaattaaatatctagaggaaaaaatcacccttccatatagcgttaaggggtctaaatgtaaattttttaatttatatacagactcgttttaattgctcaaacatttttagaatagtgtcaagtcaaacatttttaactttgactattaatagaaaaaaataaaaatgatctatcatgtaaaattgatgttattatatatttatcattaaacaaattattataattgtgggttgtcatttgaagcttgttactcatggagagtgatctcatagacggttggtgtcacccacaagtttccgtcaaggttgtgaattgacccgggcaagtttgtgaaagtattcctcacctccacaagggaacgaggtaagtgagtaaaaaaagttgtgctgaggtctcagaggtagccctagtagagcaatcctcacttttagttatctctagaaggttctgttggatcttggtggtcactcgacttatagagaaggacctaggagtgttagattgaaggttgtggtcctcttctttgatctttgcacaagtgaggcaaggtgttaatctcaacggcgagtaggatccgtgtgattcgaacttggggaaaaaaaattctgtctcttttgtgaatgctctgtgcttgcccttatgttctatatactcctctagtctactgtgaatcatattggttgaatagggcctaaagttctttttgatttggagttgtttctatgttttcatagttaccctttgaactttaaaagttccgggctaccttgagctaccagaaagtttcggtgttcatcaccagaaagttttgggccctgtttaaatttaaccgttgcgattatttttagtgtttttaaggaaaacctattcactccctcattagactacatcttcagctttcacttccttatctctctctctccttcctttctcttttctctcttctccggcgaggcgtgcgagccgtgagcggtggcgtgaccagcaggcagagtgcacggtgatgatagaggtggcgcactgtgatgacaaggtcttaggacggcatcgtgtgtctctccactagatggccctccccaagtcaccatcaccccgatccactcggctcgccatcgacatcaccgactcggatggtcccatgcgacgccgtaatcagatatgttcacaacatgcccgacccaacgtcgacgaatgtgcacccgatctaacgccagcgaatcgcaatggctgtgcccaacgcccaatccgaagaaatctgctcgcatgggccgtccccgactccagatcagttgctctcatccgttgccaccatcgtcacatttgctcgcgccattgtcgtggacggcacattgctcattgctacccttatgctgtttttttccttttaatgcattttttactccaaattcatcaattgtatgtaattttaccaattcatcaattatgtgtaatatttttactcaagattgaacaatggtgtttgtttgttgtcgggggaagagagaaaagagaggaggagaaaggaagaggatgaggaggaagagaacatgagccacatgcagctagcctaagcaaaacatacatgggtaattttgatcatgccatgtaaaaaagtggacccctcttgcctcgttagcatgaaaatattaatttaatgggcatggtgtctcatgacaaataactacatttctagtgtgctcctctaaaagtgacatttgtgtgttgtactatagctaaaaccacaaagtcgcgatgtcctatagcaaaatttgtcaaaataaaaaaatcaatcctttcttgctgatatgggcaaattggtcttatctgtctacagcttacgagttaaagatttgctccggtccaacaaaaaatgcaacaaaattgtttccgatcgttggatctcacagtgtccatcctgcccagttagatcaaacgatccgaaatgatttagtaccgtgaagtactggtacattgaaatattttttactagaccggagcaaatctgtacgggttaatatgtacatggagttagctggtcgtgttgatgcaacaataattttagaacaggggccattttcccgtgctcaaaaagataagatgagatgttcccgttccaaactagacaaaagatgtgattaggtagaaggccacacagtacatgacactgacagggattttttattcatatcatcatagagagcttacctagcggttcaaccaaacaattgattgattaaccccgccccttcacccggcctagctaccgctccaaaaaagaccaattcaatcgacaacagacgtgtcgtttctagttcgtacacgtaatcacaattcagaacacgtagccacagctctagctttcactctctttatgcaactattttagtaataatccaaaacaaagcacgtagtactacataacatatggccataatatacacagtagctagacacctcatctctatgcaggcttaacgcagtagtacacatcaaccaagcaagctagctaattaagcaagcatgttgccggccggccggagaagtcgccggagttgtagtatatatatggattattggttttacatgatggagcaggagtcgacgttctcgtcgctgaacatggtcatgtagcggacctcgggggcggaggggtcggccatggcggcggggttgccgcggacgaagccggcgggggccttcttgtcgtaggcgccgccgacgtacgggtaggtggtcatggtgtacgggacgtagggccacatctccgccgccttcccggtgctcttcacgcgctccagcaccttgctcgcctccacgtacccggtcaccgtgcaccggctctgcttcgggttcaccgccacgctcgtcacccctcgcatcgacttcaccgcgttcttcaccctcctctcgcacccctcgcagtccatcttcaccttgatgttcaccgtctacacacacatattgtataagcaaaaacacatcaccaaattaattaatgaagaagcacaagaacttcacaaattaatttatctctgtgcttaattagccaacgaaatttgagcaaacatgcatgcatgtagtatatataaatcgatcaagatcgagaaaattaaaacacctgcagtggccgcttcttccttagcttgagggcttccttggtctctgtcaggctgcacatatcagagaggctgtccaatacacccatggttgctctctgttactgcaccggcaacctgatcttgctcgcaacaagctagctagctatggaaagagtaagctaggctaattatttgctgcttgaatcaatcgagtgagaaagagagtacttggtatagctcgtgggtgcagaattgtgggggaagccgggaaggaccatttatatagagagagaaagtttcaccctttgtaagcaaaaaaaaatttaaaaaaaaggaaaaaggaataagaagaagaggagaggatggatcatttatacgtacagtgtggctggcactcactggctggctgattttgtatggttaggatggatgccaggtttttcttcttattttgttggtatggtcgcctcgtattgatgcttgaaggttacactaaacgattgggagaaccactgagccttcaaattaaatggctgagttgggaaaaacatgatatccttcctgctggtgcctggatggcgggttcacatcctctgccattaaggccaaaggcaaagtttgccgttgctgtcatccatctcttattctaagagaaaattagaaccatgccattataaatttgtaaaatttgagatatgtcatcttaacccacatgtcattaactcatgtgggtcctacatgtcattgagataccgatgacatatctcaaactttacaaaattataatggcatggttccaatttactccttattctacggctctgcatgtttttcccaacttcaaaattgattaacagccaattaattaatgaaatcagttgtgctggaccaatttaaaagacaattgattgattgttggtattgctacacgtacttaaaaaatcctcacaaaacttccggctaccttttaatttaactatttctagaaatctatatttgctcacaccatgtcaaatatgtgtttataaaagttttataagagcgctttttcctatagccttttctaaggaatagctgtgcctattacttttcttttgtcaaaacaacaaaaatatagtcttgtacaatgaaattttcattgttcccctgaatgaatcgataccaatggttcaaaaagtgaagagtgtgtcgctagtttttttttcctgctttgcctctggcgattgttttctttacatttctgtagagtaaattctaccaaattagctggtagtaagtcacggaaggacctgacggttgatcgagggatggagggtgtggatggcagcaacggcatacattgcctttggcttcaaaagcagaggatgtgaatccctggatggcccatgcgccatcattcataggccggtcggtccatgcactagctagctgaattattgttgctcattgtttaatttcataattttttttggtgtcgttttaggggagtttagatatttgttttggccgtggaaaagcacacagtcgattggcatttttttttctttctttcaaattcttgccgtccctatttgagtgtcggaattaaatgcttggtcttttcttcttcttcttcttacttttttgtttgcgaggagtattcaaacgtttcatataaattcacaatttggatgcttcagtttgttatgtgcgacgacacacccatataaaattatagaattcttcctcttttttttttggcgttgatcagaagcttgtctcttgttaattaggttgctgcgggggtcatcaagttgttacacattcaagtgttaatttgtcaggagatagaacaaattacgtagtatatattcgaagtgtgatatattacaaagcctcctcaacggccaaaaacaaaaacatataatctgttttttatttcagcttagcagcatgcgtcatcattcatatgattcgattttatttcaattacttcaaggaaaacatgaatatactaccattaaaaaacatatttaatatcttacaaataattagatgtgagacaataaccatgtactaacttttcttattgattataacagtgtaaacattatgatccatttaacaagtttgtgaggtccactagtttggggacaactgaacctctgcaataacgctaggtgtcccgactgtgacattccaacgcagcaataaaaaataaaataaaataaccttctgaatgaattgctttccatcggatcttgttccttggatcattctgaaagatgtccctggtttctctctcctagtttcagcaatctaatcctgaactagatcttgatgcatgtttctaattaagactaggaaagttaagtagctaatgtactacaaatatataaagtgatggtaccttaatccttgatattataactttagtgatagtttagttacaaagggagatggatctgccgtagccaacaattgttcgtcttgtgaatataaactttaccagtacagtgattgcttttcattttctttgggttcatttcacggcggagttgttttcaatcagcacgcacgcaaggttcttctttgcaatgtctttgtacacctgtcccactatatactcgtatctactttcgctgcttttgcaattttaaacctttattcacaattgaatactttctgaacctaaagaaaatgggcttaaagttctcgagaagctacttatttgctaagttttctctcatagcaattctacggtttttgaggaggtaccatgaggtaccaaaagtttagtgtaaaatttggtagcttatggtacctcatagtacctaggtattaagaggtaccaaatttataatagaaaaaatggtacctcatggtacctactcaaggatcgtaaaattgctctttctctgatgttgaaatccaactagggaacatttggaagtgaggggtgccaatcctatcgaaattttcgaagaaaaaggaaaacatacatgcaaaacggattaagattgttaattgttgatgtctcaaacggattaacatttgtggagagaaattctagagtgagcagcaagtaccatttcttcaaggcactcgcgttgggcatataaatttgaggataggattctggattcgcatatcgttctattttaatttttagctgggaattaggccttgattaatttagtgtacatgcgtagcagattgtaaatcattgtaagagagggttagcttctgctatttgttggtaatatggctgagtagaaacgatggtttttgatgaatcaccattattttcctatatgcaggtcattttcagagtaactcattggctccggtcttaagcacaactacaaaggtgtgatgaagatgaagagttttctaaaagttgcatgtcgaaagttggagactacgattatataactttttgtcaattatggttggagatttacaaatagactttaataattgtgatctcctatgttaggctggattctttgtttttctttacggtgtgtcctatttatttagatttacattatgttcttgaacgcttatatatattaattgactataactcttttgagtaaaggccgagatattatatttcattattaaaaaacagagagttagcacgacttagggggtgtttgggagagagggaaaaataagtctcctctctcctaaacaaccccttaaattaagtgactgagagagtacatactttccgttatgcatgcacgcatatttgttgtgtcggtataaattaaaaataataaatatccatgataccacatgattggtttaatttgcacctgattttgttcttttaggcgtccagaaagttgtgccaggtttttctttctccgaagcaaagcaaagctcattccgatatattccaatagcgattcaaagttattcttgaaaagtgaagcactgtgcttagacagatgacatctaaattcttgacgattgtccactccagcaagggacaagaatctgccatatagccacctctctttcttctggagtgggaaaaacttttgtagaccgatcattgcattgcgtctttgggtgtgagcacggggtggcctagttttttcttgctctgggccttgtccttcagcaatcactttacacagccatccctcttgatgatctatcatattctcctttattttgcaccgtatatgtgcatgactgttgggaattaatgtatattctccttccatcattaagtgtctatgtgaggatttttttttctttcaagataaataataggatattaggttccaacatgatagcacaaaatagtaataataagtaggtcggttggaaaacagcctcaactatttccgtaaccatatttctttttagaaacgaaataaaagacgatagaattggaaacaaaaagtgttgaaaatatttgaaaataaaaaacaaaagtacatgaacaaaaacatactagtatcgatagaaaatcaataattagtactgaatatattgaacttaaaatcatgtattaaacttacaatacaatatgatatgaccgattaaattcatatgtaccttcccagaatataagtcatccataattatggagagtcaattgtaacttttaactaataattcaactaagtaataatatgtatatttaatttaatgcatgtggtgccattatattcgtatataacattatgttaatattatagttgttcatccccatcgtttggcttattttttgaataagccaaacggcatattttcaaatgaaaaatattttatgaataaaacttttatatacgtgtttttagcgatctaaaagcaaaggctggaaaataaacttcgatgaaaaaaaacccaaaatcaactctaaatttaaggttaaaaatttaaattttggctgataatcataagcataatagcgaaaaaatgaggcccattgataatatactataaaaaacctaatggccagtataattttgaagaccgtgtaaaaacatgcactcattacatcttcttttggaatggatagagcaaattataaactctcatttaggcatgtactcgaattagggatttggttgagattgataggcatgtaaaatatgggccaaatagagacatggaccatacataatggggtatttgaaaaaacataattgtcgtattataaacatggtaatttccaaagcgttttttttaagaaagacatttggcgcgctttattggtatgaaaacataattagatcatttgctcgaacgtttagcaagaagctaggggattcaacccaattacaagaattctttgagatgaaagcatgtctagctaactcatgtgctacaccatttgcctctctattacaatgctctatagtaatattatctaaacccaatctaagtatatgatattcatgaaaaattacaaccaacgttgtaggagagaatccaccatcttgcatggcctccactacttgcaagtaatctgtttggataataaacttatcacacccaacttgctcagctagaaagagtccttctctaagagcgtatgcttctgcaacatgaggcaaatacatacacacgcttactatgaaacatcctcgtgcatctcgaacaattgcccctgttcctctagaacctgatgttggaattaatagatgggctaaggcctattggaagattaattctttgaaaaatcacaaaagcccacctcatgggatggcatgtatgtggagtttagtaccaccttgcttattccaggagatggggacctccttaaaagggaggatgccctactagccacttgaagcatgtgtggtggagagaagaggggaaacacacgcgggcgggcggcacacgtgcacgatgttacgcgtcgaatggtccgcaaaattggcttccttttgcacttacgcgcgacttatccggttcgggacctatctctatataaaccgagccgctgccttcacgcaacatacgtgaaatcaatctgtctactctgtactgtgccgtcgctcgtagactactccatcccgctcgccggcgtgcatcggcgatcgggagagcaggtttccggccggcgtgcatcggcgatcgggagagcaggtttccggccgcaaccgcgagtagttcctgccgagcaaccggtctttccgccacctcggtacgtattcgacatgttgcgcatatttgatttgttcatattttactgcttagtttacatatgtagatctaatgatgcgttcaatctagtttacatctacaatgtcatgatttatttatggaataaattaaatcattatgtgcttataattttaacaatccaaaaaccttattataggcgctgtgattttactatggctggttttgctgatacactgagaccggataaattcaccggtgtgcactttaagagatggcagctcagggtcactctgtggctgacagctatgaaatgcttctgggtgagtactggcaaacctgaagaaattcttactgctgatcagcagaagcaattcgaggaagccactactctctttgtgggatgcattcttagcgttcttggcgatcgtctggtcgaggtatatatgcatatgaccgacgctaaggagttgtgggatgcactgaataataaattcggtgctattgatgctagcaatgatctgtatatcatggagcagtttcatgactacaagatggctgacaaccattctgtagtcgaacaggcccatgagatacaaaccatgactaagaaactcgaactccttaagtgtgtattactcgacaaatttgtggccaggtgcattattgcgaaactacctccatcttggagaagtttcggtactgcactcaaacacaagagacaggaatactccgttgaggggttgatagcatatcttgatgttgaggagaaagctcgggaaaaagatggtgcgtctaagggcgatggtgggtagtccagtgccaatgttgtgcacaaggcccaaaataagagtaaggggaaatacaaagctcaacagaccaccaacttcaagaagcagaagaagaacaacaacaatcctaatcaggatgagaggacttgctttgtgtctggccaacctggtcatctggctaggaagtgtccacagcgcaaggggatgaaggcacctgcagggcagacttctaagtctgctaatgtgaccattggcaacactggagatggaagcgggttggtaatttacctactgttttttcagttatctactaactggtgggttgatactggggccaatgtacatgtttgtgctgacatctcattgttttcttcttatcaggtcgcacggggtttcaccgtcctaatggggaatgggtcacatgcttatgtcatggtgttggcacggtagatctgaa

SEQ ID NO: 82809 - DNA, 19416 bp, Oryza sativa
tacatgttaagttttaagagttagtgggcatcaaatttatagtaagataggataggatttagtgtctgttttgaaagatgatgtggttcgatgcatgttgagaaattagttccaattatataagaatagtagatatggaaatcttggtaaattctcatggtttcttctatcactagcatccagctccaactaccatttgctatagaaaaacattattgcagacgattttttaaactccttaccatatgcatcctacaattttaaatatatgacatgtttttagacatacatcgaccatttattttattaaatatataagtagcattttttattcggacttattttattttaatactttataggcatgacttatatttttatatatgtacacaatttttttacaaaagaaggatggtcaaacatcagtcaaaaaaccaatatcatattatatttaaaaaatggacttggtattttccatgtaagagatgaatgtgttggtcttcactccctcagctctagcaacatgcttggcccagtctgggtcattgtcaacatgtgtgttactttttatcaccgtaaaattatcagagaatctactccatatcactaagtttgtcccagtttaacaatttgtcattgacattatctcttctgtaatataccgttgaatttataaattattctacaatatgccatgccattagactgatgcttttcttaaaaaatacccttaaatacatactcccctggtcaaaaaaaaatccaatctagacagggatgcgacacaacatagtacaatgaatttggatttgtgtcacatccctaagtaggttgagtttttcggactgagggagtacaatgttaagaattgaactacctcatttgaagtttaaaaaaaatatgaaaattcctatatggcctccttacacgacatggaagtttgtacataagtttttaagtttttctggtatatttattttttatataaaaatattcttatgtgttttatgagagagaatttacttacacaaaagataatatcacaaaaatatcttatgtagcgtatgaaaaatgatttacattaaaaaataacaacacaaaacgtattttatgcagcatataatatattaattatatttaaaaaatttagaaatgcaaaaaacttgaaacttatatacaaacttccatattgtgtaaggaggccacatgaaaattttaatatttattttgggtacttttgaaaagaatatttagcccaataacgtatcgtagaataattgataaagtcacaagtatattatagcaaaagacaatgtcaatgataaattattgaactcagacaaactcagtagtatataaaccatatgcagtttggaagagaaggaaaaggaaaaaaaaagagtcataaacagtctaattgaaatataatccatctgttctaaaatatagctaagcttaagctaaacattagacacacactcatcgagatgcatagctaaaagatatttagggatggaagagtagtatcatatcatctgtaacattgtatggattttttaaaacaaataattaattatataaattcagtaattaaataagcaggttactatccctccgtttctaaatatttgacgccgttgacttttttaaacatgtttaactattcatcttattaaaaaaagtaattattaattcttttcctatcatttgatttattattaaatatactttcatgtatacatatagttttacatatttcacagtttttttaataagacgaacgctcaaacatgtgctaaaaagttaacggtgtcaaatatttagaaacgaagggagtatgtaataacttgttcacactgataaaagctatctaaatcaatatttattctccaagtaactctcatcattaattcattaattgcgtgttgtattatgacttatccaacaggttattggcgtgtggttgtgagctattgaatggtcgatacactgcaatttgctctaccacatctagtctgcgcgtgggtcactcattttattgctgctattttacatgtaacacgttttcttcttgtctgctaattcaagggtgaaaagtttcactgtgtcacatcagatatatatcgatacacatttaaagtattaaacgtagactaataacaaaataaattatagattccgcctgtaaactgcgagacgaatttattaagcctaattaatccatcactaataaatatttactgtagcaccacattatcaaatcatagagcaattaggcttaaaagattcgtctcataatttacacgtaatctgtaattagttttttttcatacttaatattctatacatatcaaatatcaaacattcgatctaaacaggccctaagttagggggatcgagggccatgacttcaactaaacatgactgatatctcaaagcgccatatcagcattcgtttttcttttccttagacctgatctgatcgattttgttgatttgctgtcactctctgattctttgttctataatttgttgattgaatatgtcgtcttgttgtgcatgtgtacttttgaccactacatgtttctatctgggagagatcctttgcttacaaccgcaatcttgacaaatgttgaattagaatgactagctagaagtgcacaaataacaggctaatctatctataattttaaagctggcacgtctcactgcaacctaattggttgagttgttacgcacttgttcgtacaccatccatctaactgttagtgatataccctagaggcaatcatagagatgattgtatcacatactatgtttacatatttatccgactttgttacttgaaatagataactcattattggttaatgaatatgtgattctttcatgagactctttatgttgtgtgttgctatttctaaaggatccctgatcaaatatcatatgtggaacaaatatgtttagatgatcagcacatgtactaattgatgatcatgtctcatggatcatggaatagagataccaaattaataatgtggacacatgttggtgaacatgttgatgaatagacccaacatgagacactgcaagagccatatgtgttgtgtcatcagtaatctcatttagtgttggtgttgaatccttagacctgatattatcatggttcccaacatgtgtagtagcttacttagggactgctaaacgctactctgtaattgggtagttataaaagttgttttcgggtatgctatgaaatatgtagtgagatatgaataatcaagatgggatttgcccctcctatggagagatatctctggacccctcgatgttgtaaattatggaagtgcatggcatgccaaaggtgattgaggagtatatcacaagttatataatctatcaacaggttcgagtgaatgattgagctattagagtatggcacatatctagccttgagcttaatcgatattgtgaggcaaaggggttcatacaagtatacactagagattcagccgatatgatctttatgtatgcccggtgagtcaatatgttctgctagaggccgctgttgatgcgtggaccgaaaaggacttttcgggttacagcggagtgtacatgaacctacagtatcgcacgcttaataggctagaataaggggattggatggagatccaatatgagcttaattcggatagagatccgaataggagtcctacgggccttggaggcccgagtaatggatcctatatatttgtaaggggtgtgaccggcggaggtattgcatcacgtgagaaaccctagccgtcactcccctccccgagcaaaaccctagccgcgcgcgggtgctagcatatttgcgcgtggcgttccgtccctgtacgtgtggataccagtagaggcaccgctggtttgtagtgctgatcggtgtgggaatacagcgaggagaacgcatgaggagaaggtcgagccggtgcgatcgactacttcctctacatcgacgcgcgctacttcgcgagaattccttcgacttcttagcgccttcttccgttgcgtagcgcgtcgagtggtaacgatctatgatctaatacttgcatgattcctggtttacgcgatagaaaattttaatttatactatcgtagcctatgcgtatcccaacactaaccatgcatgcatcttttgcacctagggcagcgaaggaggaccggtaaatatcagggccacatgacggtactaaattggcaaaaaaactcattcggtttggggggacggtgggaagagatgcaagaaacaaagaaaccccgagagaacattcagaaatttcaacgatgaaaaaaggttgaaacccagaaaattcgaagaaagaaaggcaagaaaaatgaagtaaattatattaagtgatagtcattcacaatgaacggaacaagagaaattttcttagagttgtagcttttccaaaaaaacatataatgtattttttctagcatgactggagatcttcgaatacttaaaagatagtgtaaatttcccaaaacttcaaatattttgactaaactatcatagaactatagatttaaaatgtttatcataaactacatgtttaacatcaaatttatcacaaaactacaaatctaagacaatgtatcacaatactatatatttaatattaaactaatcgcagaactacatattttagagtttaaatcctaacaccattgttatgttagagctataaaatgtagttttataattaaattggttctaaacctatagttgttactaaaatgttttgttacatttcatcattaatgtatagttatatgataattttgactttaaatatattttttgatacaccgagtttaatctatagttctataattatgtaattttgtgaaatttactctaaaatatattgcatgctaaataggaaagtacccattaaaatatcatatgatacggaagataaaaacaggtgtcacagcagtactgaaagatgaggagagatcgtgatcactactctccctgtaagatgtgcagtgtacaattataatctaatcactgatgaaatgcgtccagcaaattagtaggagtaatagactgttggagagtgttgaccctaaatcctaattatatcgtgcgtacgtgtagtgaggctcggcaagttaatctggccatactaagcacgcagtcctgtaatggtcggcagcgaccagcagcgacacacgtacttaacctgtacagagtcccgaaaccaccgggcgggtccattaccagcgcgacgcgacacgtccgtcggtcggtcggtcgcccaaaccgcgcgtccgcgaccgccgaccacgactactaaattcgggcccagaaacttcggaagcaccgatttgcgacgcgtcgcgcgtactagagtccaattggttaccctataataattagccaaaatcaaagtaaaactaaaatttaaattcccaaacttaattttgatgtttattttcagatatttttgacatatttttgttagcgttgatttttaatatcgaagcgaacacatatataaaattttaccaataaaaattttaatttttattttctaataaatcgttttggtttattagagaatatggataaatgataaatacatagttttctgacaatgaaaacggtcaaaaatatcttcacccattgcataactcgaaaacaccactaaaacagtagacgtagaaccaaaagtactatactatatatatattagaaaactgaaaatgaaactacaaggtaactaacgtcagaatatgaacataaacactagtacagattctatcatctgtgacgggttcaattatgcgtgtactatatggaccgtcagaacaaagtcatctcaatcggacttaaatttgcaccgttatagatatacttactctaggcccaaatacatatagcccgtcaccgataacactcatatgtgacgggcaaatatttaggcccgattgagatgacctcgcatacctcaatcgggcctagataccgagcccgtcagagatgagggactttaaagcccgtcaccgatgactcatatcggtgttgggtttttgttgatgcccgttagagataacttttacttaggttatttttttatataactttttttaatagtttgagtttgaatttgaaaatatgacaacttcaaacaattttttaaatactaaattatttcaaatgaaaaaaattatcaacaacaaagttgtataacataccaatatttacaacttttatttttattttggttatttttctatataacattttttttgagcagtttgaatttgaatttgaaaatataacacttcaaaacaatattttcaaatactaaatgatttaaactaaaaaagtcatcaacaataaagttgtataactcatcaagatctataacttataacttttattttggccatttttctatataacgttttttttgaacagtttgaatttgaatttgaaaatatgacaacttcaaacaatattttcatatactaaatgatttcaactaaaaaagtcatcaacaataaagttgcataactcatcaagatctataagtttaatttttgtcatttttctatataacgttttcttgaacagtttgaatttgaatttgaaaatatgacaactttaaacaatattttcatatactaaatgatttcaactaaaaaaagtcatcaacaacaaagttgtataactcaccaagatctataacttttatatttatcatttcttcatccgataaagtgctagtaacattgttcacaaaatttacatatatgttttattgtttacaaaactagatgagagatatgtgaattttatagccaatgttactatcactttgtcggatgaagcaatgaccaaaataaaagttatagatcttgatgagttatacaactttgttgttgatgactttttcagttgaaatcatttagtatttgaaaatgttgtttgaagttgtcatattttcaaattcaaattcaaactgttcaaaaaaaaatgttgtatagataaatgaacaaaataatagttatagatattgatgagttatacaactttgttgttgatgactttttcagttgaaatcatttagtatttgaaaatattgcttgaagttgtcatatttttaaattcaaatttaaactgttcaaaaaatgttatatagaaaaaagaccaaagtaaaagttatagatcttgatgagttatacaactttgttgttgatgatttctctatttaaaatcatttactacctgaaaaaatatttgaatttcttatattttaaaatacaaattttatatagttcaatcaaacccggatggagaaatgaccaaaataaaaatggtagatctcaatgagttatacaactttgttttttatagcttttttatatgagttcatttagtatcataaaattcaattcgaaatttattttttcctagaagtctaatttgcctcctacttatgataatacttgctaaatatatatttgatccaattaactcggatttactggtgaaatatgtgatcaaaatagatgttatgtgaatgtggttgtgttatgtgaatgaatgtatatgaatagaggatgctagggtgtgacatcctagcccagggcttaataggattaatagaatactcataccaacaaattacaatttctctctcgaaagccaatttccaaagaactatgaggttaacctagagcaattctcggataggtgacctaccaagaaggcacacaagtgaggttcggatgggtgaccgactgggaaggcacacaagtgagggcaaaggcccgaggctaacaaaaaaacaaaatttatttttttttggattatattcatctgtgatgggctataatctaggcccgttagagatgagagtcatccgtgacaggcttttgtgttggcccgattgagatgtctcatccgtgacggccggatgcccgattgagatattttgtcacatcactgacctttgcttagtgacaggggcctgcccgaaagagatgatgctttaagcccgttagagatgactaatcccgttatagtgaaaaatccattcaagttacgatataaaaattataaactatctctcctttaaaatattgtcaaattagggttttgtatgagataccataactaccgtattataaaaagtagttctttgtatgaaatatgagataaagtaattacacttacacatattagtagatatggggtatatagaaatacggtaattgcaatctataaagcaaacggtataggatatataattttatggtatatttgttgtcttatttcctccatctttatcttgagggacaattagtatttagtagcatccttttattatttctaatgacattcttcaccaactaaagatagcatattgtatcatatatattcatgatagtttatattatatcatatgttcctcacagtttggactctaggaaattcgtcgtcacgttagaatagattcgaggatgtaatatcatcagttagtggtattgtttcaatgtagattgggtaacaaagttaacttttcttcaatcaacgggtgaattataagaatttttaactaacacgtcaaaattgcctagttaattttaattctatcaaaattagatatttttaaattttaatttaatcttaatttcattttcccaaatttatttcttaatgtatataattttttatatgtatacacttttaatgtaaaaaatacatacatctttgtaaacgtccgtataaaaaaaagagaagaaaacctagaaaaataaggggggaaaggaaaaaaaagtaaaaacgaaaaaaaaaacttccacatgcctctctcctgcgccctcccgccgtgccccctctccatgtgcgccatatgcatggttgcaccgcgcgccggggggggggcggaggggggtgtacgcgactagtcagcaaatagggttttcgacgcactcacctctacgaatgcacacattcataccctacccctataaacacatccggaatactaagctggcgtatagtgtgattgatgaagtcgtcgcggatgccttaatattgatgggtatgttgcctacgattgaaagaataattagtcgtaaatgcgagcgctagcgtcaaatctaggatttgaatcctggtgggctggttaaaaaaaaaacctaaccagctgagttacgctcacttcgcttaatcgtgaatttttatttttcttattttctttggattaattgagaatgcttagattgtaagactatgcttcttttcctattacttttaattatatactgacatgcttggatgctaaggtcatgcatgaaaatctaattatgattggtctgttacatatttacattgcttaggtgcctcacacggtttcgttgctgagaactgttgtccgtttcctacactaaccatgcatgcatgaatatttattgctacatcacatttccgaaaagaatccttggctgtttgagattgttatcggtttcatacacgatgacaattcataagcatattttttattggtacgtcccgtttcaaaaagaatagttgttcatttgttgtttccttcttattttcatccaattaacgtattcttttttgtttgtttgttttgtttattttacttttctctaataacgtggtaatttctaaatcgtgggaatgaacatggtggtttctttttctattctctctccaaaagtctaaacctactttattttttggtttttttccaaaatcctaagacatatttataatctttgtgggataaattccgaaacctagaagtcatagttgcatgcacgtatatagttcattggtttggtcacgtggtgggtaagttaattactcttggtattggtgacagaagaaatactctctccatcccaaaatataaagcacaactgttttttttttcatatatcataaggcgtgcatggatgcataagttaactatcacctcttagtcctttaaatttggttcattttaaatcttctaccatcaagttccccaatcacatttcttgcgtggatagatgtgattcaagcgaggagataatcaaatttttttcttcgtctttatgttagaagtggttaagccttctattttggatttgagggagtaggtctcaagacttttggatgaagggagtattactttattattaataagttaatagattcaggtatggtataatatggtaagttttggtaacggttcgtagaatagtaaaattcttcctgtatctatttttattttattattattatttttatcagttagaattttcaaattaatagttcggtcaaaaccaagtcggagataagtaacaagcaagaattttaattactttctcatccctactagactactagttctaatccggttgggggcaggactctcccgaaaatgcttctcttcgaacgtccgatcagatgaaaaacattggacgcctacggtcagctcagtccttacttgctaatttcttatttctctctgttgacgtcaagaaaatgctgttgatcagcagcctggtactgtcgtactgtaacatgcatgcatatatctagttgtttcttttcattcttttctcctctctttaaatattttctcttctaaattacttatctgatctacgaaccgatcgcaccgttgtattcgttgcaattaaatctttacaacaagatatcacatgattatattatgtcaaaagaaaaacgtatgtttcaaaccgttaaaacaaaatatttcatatgtgatagtgatatgtttcaatatgtgtcttaagtgtgtttcacaaaattcctgaaactacctactactactctctctccacctcatgcatgcatacatgcatgtattttagcaagcttcaaaatgatttttctcttaaattacctattcaatctaagatccgatcacaccattgtattcgttttaattaaatctttacaacaagatatcgcttgattatattttgataaaagaaaaacatgtgtttcaatcagttaatacttgttgtttcatgtgtgacagcaacatgtttcaacgtgtatcttcaccatgtttcataaaatatttaaatgttccagttgctgatttttttcaccatatatataacatgatgttttacttgttggtcaactgcaacatttgaccatccatttttttttaatttaaaaatgtttcacctaatgtactcatgatgtttcactatgtatgaatcaaatgttgcagtgagttaaaacatcctttcgctattcgctgaaacattattttcatataaggcgaaacggcgtccaataaaacattttcgatctacttagtgaaacaattccaatacttggtgcaacagcgtgcaacatttaaaaataatttaataataagctaaaaaaaatttcatcggattatattcatgtgtggtcttgttttaaagatttaattgcaacgaatttaatggtgcaatcggatcatgatttggataaatattttgagagaaaaaatagtttaaaattcatttgatacatgcataatggatggctggtgtacctgtgcatggatcggacggttgcggaggcatccgatttttcgtctcgcgtcgtacgtccgacgcgtagcgctctccggactctccgcgtgcgcaccgcgcctgacgacgacgatcatggactcatggtcatggagccgcagccaggccccgtttggaccatttctcgtcgcgagcaagtaggcaaatcacgttgctttcagtagttatggctagatagggagagagggcgagaaagctagttggcggggatatgatgttactcgttttactgacttgtaatttcgctctcaattgagtacaagatcgcgcaggagcagcaacataagccaataacaaacggagcctacggatatggagaccgcgaagtcatccatcccctgttgacagttcttcttgcttgagtacaagatcgggcaggagcagcaacataagccaataacaaacggagcctacggatatggagaccgcgaagtcatccatcccctgttgacagttcttcttgcttgagtacaagatcgggcaggagcagcaacataagccaataacaaacggagcctacggatatggagactgcgaagtcatccatcccctgttgatagttcttcagttttaccgaaacaacctaattttattttacaaaagatgcaaaaaaaaataccgatgtcaaccggtggaaaggtaacaccgttttgtcgctacatggaaaggcgaggagccccatgtcgacaacccacctggtgaggattagagcagatacaatagaaggctataagccagttgcaaacatattttaagaagataaatgatgagagagaagagcagcgggctatagatctgtagccagctgtagcacggactccaagacgcagtgtgtgtatgacaggtaggaccagatattaatagtgtagtatataactattgtataaataagctatttattagattagctatagatgaattgaagctagtagttggctatactattaaacttgctcttacgcactctatgactctaacgccggcattactgagctcacgctagtcttctcgtgcctatacgtggccaccctagctgttggtcatgctcgcctcgagctcacgcacacgcaaccgtacgtccacgctcgccctaagcccatctatgcgcgctctgttaacgatagttaagtatcaatgtcgacggcaactatcataataaataaatggagaactaatattttttacgtatggcaataataaaaaatataatttcacttgtcttagagaaataacatgtatgcaaagattatacaccaaaataaaggagaaatgagccaacatgcaaagaaacacatttctagcgaatcacgtaagagcacatggattgatgggcccaagtcaggccaaaccgacttaaaatgtgtccaatcaaccgtgcaccaatcgaagggcccacatgtcagcctcaggacaaggtcggtagtgaatggtggagtccctggttcggccaaaccaggggtgtacccctcgccaccgtcttccacgtggtgcctcctcccgcactcttgatagcggttatgcctaattcccaaaccaaaaccgatctaagcaactgtcattagaagctataaatagaggagagttccttacttcacagcacatactcaaggagaaattttctctatctgcattgtattctctacaatattagtggaaataggcttagagtaatcttcggttctatggttttctcggagattccagtatgactttagtactttactgttcttgtaaaactatagttgaattaatagaattaccttctttatattcttgtgttcatagttcatatactgctttggtagttttgtgttttatgattaggatatacttcatttatatgattcacttgattaggctagtcgatcaatactacggttacagtccaataaccttagcggattacactaattcttacttgttcatctgaaaggtgggagtcacattttagattggtgtgtgtcacactatccaattatccttattattctaacccctgtttacactatggtgaattaattatagcttgattaatgatgtataaactttatctttacaccatcatcttccctgcaaaaatataaatacgataccctttgaataaccctaggtgaaatactacagcggtatccgtacacctgcagatttatctgtgatcgtaaaaaataccagcatgccacagcaatcagactcacacgctcgtgtcaatcatgctcaccccgtgcatgctcgctttagatgcacctctcgctttaatagtacgtgtgctcgtcttaagctcaccaacgccaatcgtaggtccgtcccgctcccactcccgctcccgtctctgtctcatcgctccgatcagcatcattggcgcttctcacgttgatggctcaagcaccattgccgctcaaatatggtgtcacgtgctcacttgcatgcccgcacatggacacctagagtagtcaaccaggtcaattactcaaggcttgtcacccttccatgcaacgacatatacagcgtggcataagtgcccacatgtcaactactttttcccttcccttactgacatctcccctggcaaccttccctcccaactccacagtgccaccgacttctcttcctcttcttctcacattctcggttggggttttagactatttgccattgtcctgaagggcgtattctcaaatgccattctctagaataactttgactttttgctatcggagaaagaagatttcttgttcgtgagccatttttcagcccatgagaagccatgtcaccaaattcgaggacaaaatggccgccttgccctcctcctttctttcttctttgccttcactcaccttcatcatctccctctcctccggcgtgctccctgtcaatgaaggtgtacaagcagacgaagccacgtgagctccacgtcgagggtgcggccgagggtcatggccttgcagtaagcatccgcgagtgccatacctccaccatcggctcgctgtcgaggggtacgatcgtcgtggccacgatatcctcttccactagagccaccaacgacccatcgtcgagggctccacttacccgctggtgttgatcactcctgcctcacccatcaccgacctcgtcctcacggggcaaagccaccgctagctatcctctcctcttgcgcatacagaggagcggggtgaaggagacggctggagctcgcgggccagggggtttatcagcgtggcaatcctcactggagcccaagcacaaggcaaggagcgagaatgaaagacattgagaggggcaaaacggaccctttcgtcctcggatttggtgatgtggcttctgatgggctggaaaatggcaaatgagcaagaaatcttctctcttcgatggtaaaattaaaagttatttggaagaatggtatttgagaatacggcattcggaagagtggcaaatagaccaaaacccctcgctgccaggtccggacggacgtgatgatccttttagaacaaaggataaatcctaccaaagaaaacatttcacgtaatttggcaacattgaaaatctttaacccttttagaaaacttaaatatctttttcatcactacctccatatttagatattttaggtattaatcatgcttctaaatcgaagatttaagtatgcttcgatctgcaagctactttttccatcgtggaaatatacaaattgtagtaatggtgtaatggtagtatggtacagagggggaaatcactacaggttcatgccacaggttcacaagttttcaatttactactataataacttgcgggtttaaaacatgcgcacaaacatgactgagaataatatttcctccgtttcacaatgtaagactttctagcattgcccacattcattatgtgtttagatttattaacatctatatgtatgtggttaatgctagaaagtcttacattgtgaaatggagggagtaggtgttaccaaatcatgataaattacttgtcaaaaaataacagctccatgagttaatttgcaaagcaaagcaagtacgatacaaaaagtgggcagatacttccatcaaacaactaacccacaacatggtgcacactatgtatgtctacatatcagaatatatgccgttctgtacttcaaaacaagagaaaatatatcccatatttgggaagaaaatccatcatgcaaaggtttcatacaaatgctatgctccaggctagatctaagaaacatagcagactaaccaagaggagaacaaacaaattacagcagaataagatcacaacagaagaaacttaattttgttacctgtgaactatgagttaaacattcaaggcttacacctcctgatactggtgtaaaattgtgaaccatggcatacacagcaagaaaactctgtacaccaaacttatatatcaacgtcacccccagagctggctgaatcaccatcactgccgtcactatcactgctgctgcttccactaccactcccacttccactgctactactgctgctgctgctcccgctagagctagaggtttcctgctcatcctgctgcccttctgcattgacttgagctcgcagggcctcggctgcattgagtccctcatcagcctcatcactgacatctacatcagcaatttcatcatctatgtcaagctggtttggtatgttgatgtcaaaaccacgaacagaagctccttgtccagaggacatgttattcggtgagccattgtcatcatcaccaagtatgtctaggttctcctcttgatcatttggatcaggcgaaaatgaaaatggatttgtggtaacaggttggtatgtagtgctcctgttattgtttcttagacctgcaactggcaaactagaaaatgagaacaaacgataaatcctatccaagaaaacatttcacgtaatttggcaacattgacaatctttaacaacccttttagaaaacgcaaacatctttttcatcactacctctatttttagatattttaggtattaatcatgcttctataatcgaggagaacaatgttcaagtatgcttcgatctgtatgctactttttcatcgtggaaatatactacaaattgtagtaatggtggcagtatggtacagagggggaaatcactacatgcgcctctgagttgtagaatggcatgtatttggtgaactaatatattttttttgcagaacaggtcaaaacggcaattagaaaggttaaactgtttttgcattgtgccatatctttcctccagcaccatgaaatttgacaagatgatatcatggtacaaggaccattccaagaactgcaaactacaacatcaacatcaagacccgaacatagaatttggtgtataacctacatggcaaatgccttgcctttgttttaacaacaattacgcgaatgtattcatcatctctagtatcagagcaagttaagaaactaaaagatcctcatgattaagaacaacattgcaataaaaaaagggtcacattacctggattttcaggttcaccaatgtcaatgcgttcaacctcaacctataaaatgatgatcaaaggtcagaagtcagacgatgattaaatagaagagtttcttaaacttcaagaattccactaaaattgtacaacgtgatatcacagaggttggccaatatcccccagggcccagggtcagcatatcaataacattgtcagcttataaatctatttatgaacttataacactttaggatgctttcttcaggaatctagtctcaatatatataatctggagtaaactgggaatgatatgagaaatataacaaacttatgagcctatatccaagtcttagaaagtatgtaaagtacattttagattgggacaaggatgcatctctcatgcaaatcaaatgttcagagattgtatctctactttgagctcactaaaagctgaaatcactttgatacccaaaatatagcagtatattcagtagcaatggcacagttgcatgataatgatactatgttacaaaagctcccatccgaacacttgcattgaacaggcaagggccctgacaaaatccccatcagggataatgatactatgtcacaaaagcttggggttaatggatccaggaactgaaacgaggaacttagcaaggactgtataaagttttctttgataaaaagaaaagcattaacatgataggaaaacaatccctggcccagtccaattgtcatgtgatacgaagttaattaggataattgaatatggtccattgtatcaagccatcaaatttccatattcaaagaaaaggaacagaacttgctaccatattttggcaaaaaaaaaaaactttcatcggtagtcagagctaaccatactgtattctggcataaaagttgtgtaaaggaaatttctactcactatccaatgtttggccttctgaaatataaattatgaagaataaaaattaacaatattcacttttcaatcagatgctcaaagactaatgttttcataaaccattaaatactaataacctaaaacatactatgaaattcaaatattaatcactttaccatatcacaaatataacataatcctgtggatgcttacgggtctgagagatgttagattcaaaagagcttatgaactggctaggcttgaatttagacaaacatgaaattttattgtggcacatatataatgttttatactttctacatgaagacaatcaggtaatatggtctacaacattccaaaaagcccgaattgtttaatatgctaccgataaatattactgaagggcctatatatgagtggttccagtctcccagataacaaaaatctcttggcaaatgttttgtgtttgtcagtctaaatagtgtgcatcatatattgtctcataccggttattcaacgttatcactttttttcctccaatacctaaggtcgtaacaaattatataacaatgtatcaaaatttatctagggcatctaaaatgctgaaagaacttacaggaactgagtgtacagcaggtttactcatggccggtgactttccaactttcggtaatggaggggaatgtgattcgcccattccagtagtagccgaagtggctgccgaagactctcctggaactcggacatgccttaatctcttgacagcccgatgcaaccgctccagacgaaaggtttcaccatcaaaaaacaagacaccatcattatccttgtactcttcttggcttccttcaaatgtcacctttggcttgccaggctgattgttgtggaattccacagtaaccctgttatctttggtcttctgcagagacccagcttgagtcttatcaattgatgctggcttaaattcatctgtcaacacaaatataagaaaagggttcaacacgacatagcctgatatgtatttataatataaaagaataaggatcaacacattagagatatttgtagaaatagttttcaggcaaaagaaaaatggttatttcaaacttcataatccaataatggacttaaaatggaagggaaagctagacagcaaccaacgaagtggtgactcattggatttcagcaaattgttatgctaattcattcatgaagagtacccaggacaggcatgccctacatgatcgtggtaacctttttcaaaccacgagagggagagaaaattaactatttaatcagttttgggagcatcaattttgattcctttattaccaatgacttgttttggcccaatgaaaaaaaaattgaaacatgtcacataaccatcaagagggaa

SEQ ID NO: 82810 - DNA, 26304 bp, Oryza sativa
cgtggcaatggtcttacagatggtacagtagctcatcacaaacccgtcggtgactttccccacgaccctctctcttcttagctctcgtctcggaatgacgtagtaacatgttgttcatcatgtagtaacacaatgttttacttacagtaacaaaattaaaatttactcataatatacttatgatggatctacttttggtaagtactttttttttgaacatcatggtgcaaacggtttttaaaaatagtacatggtgtgagagatattacccttcaaagatttgtttttaagatttaactctccacaagtagtaatactaaattaaaagttttactactgcctgttttgcgttactgcaatcacatcatgtcattactacaagatgtagtaacgattataattttcacgtaatatagtgtcttactgcaattacttgataacgttactgcaagactataagttttgcagtaataaagcgtctaactacatattttgagtagtgttactgcataaacacgtggtaacgtgtaattgtcgtgcagtaacactgttacttttgtgcaaactttttgtgcagtaacaagtgtatgattagcatctgagacttttaacccatatatttttgtttcaattgctgaattactgcaattcaccacaatattacggtcaaaagtgcaataacgtcatatacatgcagtaacgctatattggagggaggaaaccaattttcttgagaagagggaggaatgtaacatacccgaattctaggattaaggaatttccatcaagactagctgaaagggaagttcttcaattttgtaaaccaaaaatttccattttaaacaaaggtgaagttgatccaactcttgcataaataaaatttgagaacaaattaaaactttttcatctttaacataggacttggatgcaacccaagtgaaagcatgcatactctcatagacatgtttgacttgagtccttcatatgcatttggatttggattgcatttggattttcgatttgcatttcataataggtttcatgaatattaactaagatctagataaacaactaaaccattagggcctagtgctagctagaggaagttaaaatagaaaccatacaccttaaaatatatcaacaaggccaatgtcaagccccacaaaactattttggtcatccatctgaagactagtcatgaacatggaagtgaccaaatagattatatcatatagggtatattctatcttaatcatctctataagcattctcttaatttaatactaaagtaaacttatgcataataggtaaggagcttatgacctgtgtaatgtaaattgtaattctaacatatcaacatcacctaggttaatgagagtccaaatataacttttataaacatttacatgcatttaggaaagggaagcatatataagacataagtcttgcgaattatctaaaataattcgtgcaagataaaatcatgggaaaattcatgtaggctctaatcaacacatgcaactcactgtaattttggtatgatttaataactaaatttggtacctcaaataaatcagtcaaactaataaaaactagattaactgtagttcttaatcggctaaaaccatactttgtctaaaagtgcattttactgcataaaagtgtataagtaaaataatttattcaaatactaggtcatttataatgaataaaaataatttttccagaatttatcttctctgtttaggtctcctaaaaattcgaactagtttccaaagaacccatattcctctaatttctgtgagtaatctatccataatttttgagtgcaaccaaagaaaatggaaactaggtacatacacctacctccagtaaaatcaacactagttaatcttatcaacacattaagtattgaagctacaaatttagaggacaaaataattccggaaattcgtccaaaaaccaagctcacccatgtttctgcctacacatctctcttccacctagtttacttcgacctgggcccccttgtcagtccctccggcttgctcttcctctgtgcaacttctctagccgaccgataaacactgagagggagagatcgagggccgaccggctctggacgccgcgcgacgcgtggccacgacgtgtcgacgccctaaaaacgccgagctccatctctgcctctcccagacgcgtcgccactcttcacccaccatcccagtgccgatccaaccgagggaggaagctccagctctccctctccacctctctttcgtcgccggccgccaagaagagggacatcgccaaccgtcgtcgagccctcttcatctctaactcatactcgttccattctcatatcaccatgccgaacaactttggttttgatcccattccatttcatcttctacagcagcgggaacgccgccatgtcatggtcgctctagggcgcgctctgtgcaccgccgcagcgacatcatcgcagttcccgcttatctggaccatgccgggccaagctgtcgcgccagcgtcttcgccttgacctcctctccatttccccttaagaatcttgaaggatggtgctatgagtgtggagatcgtccaccgtcttcttcacctccggtcgccgtcgccattgtcgattccgcatcgtccggtgagccattgtccgattcttcgcgtatacaccatccctggggcctcactaacctcatggacacacatgcatgatagttcttggagctgattgagccatcgccgttcacccggaggttcttgccgccgtcatcagcctagctaccccagccatgtctagcatctcggtgagcacccttcagcctatagaacatacatgcacgcacccaattaaccaatacatgattgtagaagcacatgcatcaccacccgaaaacatcctcctttcgaactcgccgccggcgttactccgatgtccactgaccaagaaaagtacaggaatggaatcgcaatagcatgatcttcattttgtcttttggtcgcaccctcaaacgagccatcgtttgtcgccggtgagctcgagatcgagctcagccatggctgttctgcctctctgcgtgagaaaagaagtcagggaccttgtttcgagaatttaaacaactatggaggttatcgaaaatgtttgcaaatcctgcatgtcgattgtacattaacaaattaaaattgtgttaaacttgttagacaaactcctattatttgcattatcaccttaaccccacatatatccatatccctcattcctaaccttaggaacaatatgactacaccactttatatatgaattttggagtcactaggttactataatgcttagccatgcttagaatggtcttccttgtcattatgggctcattacaaatataaaaaattgatttagaaataatctggacagaactttaatacttgtgattttgataaataaaatgatggaaaacatggattttaggtttgggcctcaagtggtgcacatatggtgattagttgtgtaccgatagggggagagtgtgcccaaaccgacctaaggacttcactcaatgtcagttcatttcgtatacagtgcaaccaaatgtgctagtatgggatagcccaagcttagtaaattatttatggtttagccttacattctggtaggccggtgtgtatgagttcggataactcagaggaacttcctatttaccccgacatggtagtttaggtgactaagtctgtccaatacaacggtattgtgccacgtgggtgggttcccgttgtgtccgccaccacggcgttaagtttaaggcgtgggcccgccacttaacggttctaggtcatataacgtgtatggcttaggatggagtaacacgtatcgtgctggtgtaaggctaaatcatgaattttggaaaagctttgttgcgggtaataaatcgggtacttatgtatcgcgtgccatgctcttgcatgattattatttcgcatcatgtgggtaaagtgtacaaactctgcagagttaaaactaatcgattagctgtgctcgcggtcatgagcggcgtgtggatatatattgagtatagacttgtgttaattcttctaaatgctgaaatttaccttcaaattgtgatgagatttgagaatgatctccttgctgccatggaaggcaatgaggtgcatatttatacatgattaatgcctactttgatgcccaatatgtcaagtactagcttgctgaaatttatttgaaagtaaacctgatttagaaatgttttatgcaaataaaacttgctttatgctaaaaagaaccatattatgccttccttgattatatgccttgcaagtagggtgttaggcttgtcttggtgcttgccagtacattatttctaataatgtactgactcttgctattgaattaaccttttgcttgcaggttttagatttagtctttgagtgatgcgggtaatcgactgcttcttctaggacttgaacttaatggggtaaacccctagtcggtgtgcttgtggattgggtagacaagcttccgctgttctatatatttatttggccggtcggccaatgtaactaaagtagatgtagtttataatcgctttcatcttatttgtgtttgctatgtataatcatgcttgagatgaaagtgtgaatctagtgcacatcctgggaactagattcacatgagtatgagttgagaatatttgagatgttgtagatctttagctatttttgtcaagtctcctgaatgtgtaacacatctggtcgccgcctacgagtggtttgacgggcacatctcaggttgaagttgactggcaagctaaaggcctagcaatgtctccaatattcttctctcgaggcgtcggatgtttcattatgtttgtttgatgacttgaattattcacttcatccctcaaatataatgaaagttccggaaagcctacgacaaggaaaaacggttcttgaggaggggagtacgtagatgcattttgaagtttaatcctccacatgcagtaacacgataacatcatggtggaaacggttttaaaaaataatacatatcttatgactattgcttttcaaagattgacattttgaactttagccctccacatgcagtaatagaatgtgtaatttacagtaacaggggtttatacatgcagtaacatggttttaccaaatgtataaaattattcaaaacactcctacatcaatcagaccttgctcaaagccacctacaaacttacctatggcccacctattcgaacttcttctcgtaaaaatgacatagtaacactgcatttatcatacagtaacatatctacttggaagtggtaacatgcacctattatgtagtaacgcttctacttttgtgtagtaacaagtatacgggtagcatgtgaggctttaaccccatatattttagtttcaattcctagtttaagtagtaatactattcaagaaatgcaagacactttgttactgcaaagcttattgtgtttactagactcttatggtaaccttgtgatagaactgtagtaacgtacagtaataacaagtcatgctattgtattactacttgtgaagagtcaaatcccaaaaagaaaagcttttaagaacaatatctctgatgtcatgtatggttttttaaaattgtttgcaccatgatgctagaaaaaaaaatgcttatcaaaagtagatccatcatgactatattttaactatatttgagcgttgttactgcatgtaaaacacagtgttactacacggtgaccgtcgcgttactgcacagtttcgcgaaacgagagcttctttttccacatcgccgcgtgaccatcttcgctatcaataggctggctgccaggcccctttccaaacactactttaagatctttcaccatagcaaacactgttttcccactgcgatgtttaggcttcgtacggtggtccgccttatgttcaaagtgattgcctttcttccgtacagggtggtttgcagcaaggaatcgacgatgacccatgtacgcaaccttcctacagtgcttaagatacgtactttctgtttcatccatacagtgagtgcaagtcttgtaccccttattagactgcccggatacgttgctaagtataggccaatcgttgatggttacgaacagcagcgctcgtaggttaaactcctcatgtttgtcctcgtcccacacggggacactttctttcttccacaacagtttcagatcttcgaccagtggtgttaggtacacatcgatgtcgttaccaggttgcttggggccttgaataataatcggcatcattatgtacttcctcttcatgcatagccaggggggaggttgtagatacacatcataacgggccaagtgctatggccgctgctcatctctccaaaaggattaatgccatccgtacttaaaccaaaccgtatgtttcgtgcgtccttaccaaagtctttgaatgttctgtcgatgtttcgccactgcgaaccatcggcggggtgtgacacagtatcccgtcctgttgatgttcttcagcgtgccaatgcatcattctagcatttccccttgctcctgaactaacgccttagccgtggtattatagggaaataccacatcaccttagcaggaattctcttcttcgttggctgcccataaacttcacatggatcatctcgtctaatcttgtatcgtagtgctttacaaacagggcatgcttttagattttcgtactcctcaccgtgatataggatacaatcattcggacatgcgtgaatcttctgaacttctagtcctagagggcagactatcttcttagcctcatacgttgtctcgggtaatttgtttccctccggaagaatgttcttgacgagtttcaataaatcgccaaatgtcttgtcactaacatcattttttgccttccattgcatgaactccagagtggtatccaactttttgtgcccctgctcggaacctgggtacaacgacgttctgtggtcctctaacatacgcttcaatttatgggcctccttttcactttcacagtcctccttggcgtcctacaacatctgaccaagatcatcgcagcgtcgttattgtcagcatccctgtccacctcgcccgtttgatttccttcaaatccagcgtactgagcccagtccggaatgttctcgtcttccacttcatcttcttccatctcaaccccttgctcaccgtgggatgtccaacaattatagcttggcatgaaccccgactaaaacaagtggaaatgagtagtcctgcatacagaatactccttctagttcttacacttattgcatggacaaccaataaaacccttatgcttgttagcttcggccactctcaaaaaataatgcaccccgtcgataaactatttggaccaccggtcagcgtacatccattgccgatccacctacatgtaatgaaaaaaagtcatacataaataaatattcataaaataatgacagtcatacaataatgatcaaataattaaaaactctttcaatagtcatacaataatgacatatcattattcatacaataattataaaataatccaccaaacaattcttatttattatttttgaatttttaaactaatattaatgttgtacttcttttaattttcaatttagtttgttttctattttccatgattaattttcattatattttaaactatgagaataaaacttttttaaataaacaaacaaaattcctatatattattcttccccacacaatttgtttctctcatcaacttacaacaaagttttggagacaaaaaatgtgtgaaacatagctccaaaagtaatataacaccaaaaaacattggaggatgaagttactaaccttttagacacctccgatttgtatataatcaccaaaaaaaaattcacaagaaattttggcatgacctcccctcttttttggagaaaatttgaagcttgctcgggctggaggaggaagaagacatatataaagagggagataattagtcccggttgatgttatcaaccaggctaaagatcgccgagatctttagtccctgggggtctgacaaggcctaacatctttagaaccgagactaaagatgatcttaccaaccgggactaaagatcatatatgcccgctgtagccaccaaccgggtttttagtggaaccgggactattgtggatttcggaactatgataagatctcttgtagtgacggcttgtttggctattagagaggcagtttgagacatacggcacacagtttcataccgtgtgcgtgccaagttggcaattggatcctagtagcagcaaattttgaaacactcaacccaacccaatccttcttctcttaatcttctcttcctactcttgtgtttgtgtgtgtgtaagaggctagtagagttagctagcctaattttttttgcacgttgcagctactagctgtgctgctggcttgtcgtcctctgcttcaactttaaagagagagctaatagatcggtgatccgcttgggtttctggtgatcatatgcaacatggactagctacttggatttgttcaaaggatctgcttcttggatgctgtccggccacgtcgccatgcatgcgaattttgtggatggagtcaaaagctgcatgcacggagctgatttaattaagggcatgttcacattgtagtcaaaataaaccttaccaagtttttagcaatgccaaaattttggcaggatttcttatgtattaaccagatttgccaacaactaaacgtagatattttttggtaactttggcaaaaaatgatatggttgaaaatggcatcaaagtgaacatgccctaattaacttgttgacagctactccctccattccaaaatataaagtataactacccttaactcaaagaccaagaaaaaaatattatcatcttgtagtttgaatcatcctaataaatataatgcatgcatccaataggattagataacatgagagtaaaggatttaaaaaagtaataacttaatgaagaagatgtcatagttaattgcatgcttgcatgcatgccttatattatggaacatctaagaaaagtggttgtgccttatattatggaatagagggagtagtacctaattaagcacgtgtgttaatttattattaactagtaatctgcccgtgctaatgctacggcgacattcagaaatacaaattaagatcgatggatatagttattatgttgttaattaaattgccacatgcataaaataacatagttattatcctggttcaaatggagtcattagtgacaacataccatggtaaaagcaaaagtaattaaactttggaacttggcaccttgaaccatcaaatccttgtctaccatgctgtctccctgtcaccccccccccccttaattctaaattaaatggatgagagaaagagattaatatagtttagtgtgatagtgccaacacatggaaaatttagagcttctagttctctccttctacatctctcttaaatgtcggaccaagttcttatggggcccactcatcatacaaccatagccaacacatcatctgctcttctctcatttaaatcttcttttatttctcaaaaggtgagagaaaggtttaaattgaatttccacccaaaatgccactctaccactccaagccttctaggaaacatctatatatgggcctatttgtcgtccaaatacctgcaaacaaccttggtgaatcatctctttatcctaaattatattttcaaagagagaaagaaagagagagagggagttaaagtccaatttacacccaaatttcaccatacctctcatcttctcataggaaacatctacataaggccactagacagccactcatacttggttgagtgaagtacaagtaggatcacagcctcaaaccactgccaactcctttaaatcgtttctacccctcatgttgacaactagctctcactttgcaccttcacttttaccattcactactacaaccaagatttttgtgtgagggctaaaatgatttttgcgcgcgggtaggcggtccgcacgcacctaggggtctgggaaaatgatgatttttgtgtgcgggtggcgcatccccacgggaaaacaaaaatccgaaagaacataattttttaaaaaaaacgaaacccaagaatccggcggtgggcttccgcccgacggccatagtgccgcctgcctcccgccggcctccgcgccacccgccggcagatccgcgcttccctcccgccacaatgccgccgacgcccctcccctccgccggatctagggagggaaggaaggggagaggaggggagctggatcccgcgtggggagaaggcggccggctgccggatccgtgcagggacggccgccaccgctggattcttgcattgacggccaccgccgtttgatccgtgtagggactgccgccgcccgccggatccaacgcccttcaccaccgccacgtggaggaggccggcgcgctcctactcccaccaccgccgcgccgctgctgtcgccgcacgccgccgctgctgccgccatcgggaggagaggagaggagagtggagagaggagaggagaggcgtgagagagagagtactgagaagagaagctctgcgtggaaattttaaagtggaaaaagggatagaggggaggggagaggagagaaagaggggaaattttaaagtgggtgagagaggaaagagggagctagtatttttgcatgcggctctcttaataggtccgcacgggaaaatcggctcattttcacgtgctgtccatttaagaggaccgcacggaaaaatcgatttttcccggaagcaacgagttaccgcacggaaaatttgatttttccgtgccgtcctctttaatgaaccggacgcgaaaatgagccgattttcctagaagcaacgagataccgcccacacggaatctaaaaggtccctatctaggaaaatcatttctgtagtagtgattcatgaagttccttctctacttgatcgatccattttctttgtttcttttttggcatagatcgaacacttggtggtgcgctcgtcggtgttcccggtgtctagagcgccaccatcgccccactttgtcattcccgtcgactcgaatcatctccggctgtaccattgcgccactgacgtacgccgccacgaatgccgtcgttcgccgttgctctcctgctgcctctgcttctcttgccgccgagtcaccgacatgtgggcctggctgtttagccacttcattaggtgctaaggactttaattagtagaaattgaaatgttgtaaggttctttttgtaaaattgctttgtttgccatgtgggcttatggacctaaatgcaattcacctaatgcccagggaccttgttgtatagggtttagggcttaccctaaaacatgaaattactatttcatgcattcattccttgatataatagcttgatgagtatattgttatcacccttgctttaaccccctcttttagaatcaatttggagtttttgcagaagtcaggagtttaatcatataaattagtttcattccaacttagttcccaagtatagattagatagatggtttaattctatagcaaaacattagagttggctcatcctgtagcttctacagtaatagttagccacaatcttgtaaataccctattattttatgtaaagaaatctccattggagccttaatcaaatgtatgcgatgaagattcagattgttgaacctttattaatctactgatccagggttgatacagtttaaatatgtcggttaccgaatctttaattttgagacccgacaaggtgtgtgggtgggggcccctacgatttgggagcctagagcggccgtaccgctcgcaccccctcccgcctgagccggccctgactacatgggcgttaaaaggccaaatggcatcttatgacgttttctgggcttgatggcgacgaaaatggacgccatagactctatgacgacagaaagattgtcactagattaatgacaaaaagataaactttctttataaaacgccattagagacgcatgataggtgacgaatatgattcgtcacacgaatgtcacagatttcatagcatgacttaaaattcaatttttatgacgtaaatgagcatcacctataatcagattcttgtagtgatggcttgtttggctattagagaggcagtttgagacatacagcacacagtttcatagcgtgtgcgtgcctagttggcaactggatcctagtagatgcaaattttgaaacattcaacccaacccaatccttcttctcttaatcttctcttcctacacttgtgtttgtgtgtgtgtgtgtctaagaggctagtagagttagctagcctaaaattttttgcacgttgcagctactaactgtgctgctggcttgtcgtcctctgcttcaacattaaagagggagctaatagatcggtgattcactttggtttcttggatgctatccagccacgtcaccatgcatgcgaattttgtggatggagtcagagggtctgcatgcacggagctgatttaattaattaacttgttgccagctagtacctaattaagcatgtgtgttaatttattattaattactttgctagtgttaatttatccttagtttttttattcgaaactactagcatgcatgcctttgtctttgtcagagagagaaaccgatggaatatcctcgtttcaaaagtccatgcataatgtgcatgctgtgtggattcgtgctgtattttcctgggtagataagaccaaaaaatcccacttaccaactaggttttttaaaagtctggtacatcgtgaaccatgctgcttcacgtggtcggaactatatacgttaagatcaaatgtgctcaacgtggtctggcacatcatggatcatgctgcttcatgtggtcggatctagatgcattaggaataatccttttcgtagtagtgaaactaaagaacttcacttgccaactacttcctccgtttcacaatgtaagtcattctagcatttctcacatttataatgttcctaatgaatctagatagatatatatgtttaaattcattagcattaatatgaatatgggaaatgctagaatgacttacattgtgaaacggagggagtagtttttttagagtctgaacaaagatgaaactttttggaaaggtgctcctgatgaccaagttcaattcaccaactgaaatcgcacactggatttacatgaaaaatgcgagatagacaaaaatgatttctttcggttctaaattaatactcccggccatttgggaggagcaatatgtacatatgcattcatcacacttcagcttttttgtcttttttttccttggagttttaagaatgctcataattagggcatgcaagttgatccattgatatattcgcaatatttgacgatttttttttcattttaaaaattgttgacgatattagcttaattttggtatggaaaatatcggttaatttatccccaatttttatcaagagagaaaatgaaccatgagagttgaggtgctaattaaccacaagcagaaattcattttaatttgtggtatatatatatacacgagcatgcatgtaaagatggaaatatgtgaaaaatataatggtgctagtagatttgtctaaaacacttccataatactatgatcaggacactcgataaggacaaagttaaattttagggattgtgtcattatcaaaattatcaatgaataattggccagagggccgggattagcaagggtctactactgtcctgccatttcattaattaattagattaagtccccgattccttgcatctctaattggcctacgagaaccgacaaaaatcgcaagatgggaggattgtggtaggttatcttctccaactgtgcctctcaagtggccataacatattagccagaaggataaataatcatcaatctgccttcacagttttgatcatctcatgagacatatatataaaccacccattagcaagagtctcctaggtgaattaattaactatgctgatacacatatacttaattggtataagaaaattagtagtgatagttaattagtataaaagcatcaatcaaatggagactattagctagctaggagaccgggcaagcaaagcaaagcattgatcttgatgaatcctccagagagattaattgcatattgccagttcctcctgacctattatatgcatgcaagtgctctctgtacttgtgcggtgcaacgacgagtagaactgagggtgcgccttatatacgccggacgagtaaagagtgagtacgtttgtagtgacgtctccaattttagtttctatggtagtgaaatatgcgacgtttgacacctcaaactggagaaaaattggagctgtgaaatgttttctttttttatatacgtggagctctgaaatattgacagttttgtttttttctataaaaaaagccaagaagagttgacggcttatcggtaggcgctcctcgatggagggagatgagcttaaaaagtttcagtaaatggacccatggagtggaaatgcggagtggagtggagcagtaataaaatttaaaatgccacgcgcagggcatctcgaccacgacaggactctccttgagatcttagaacagtgtgtgcttgctagctgaactgcagcagtggaacagtaataaaatttaaaacagatgtgcagtgttcacagaggacgagtgtgctctgtgttctctgcttgtgaatagatatggcgatatctgcttgtgaatagatatggcgagtactattactgggtatacatggttaggacagatgttagtttgttctgcttgtttggagatggatttgggagcaaatgtacatggttagggcgcaaatgttagtttattttgctgtggaggggagtgggtttttgtcacctccggaatttccatctaaaattccaaacgcttacatgtgtgttaaaccctcgtccaggaatcagccgaggcacacaataacaaattgataatagagtatgaataaacagcgaattaatattcacaaataataaatcattacagaggtagatagttcctctcaaagaataaaattctacgcagcggaaaataaaacaaactacggaacagctatggtgtctccactccacaagcaacttaacccagatcaagcctagtcctccagatcatcaccttcactgaagtactcctcctctgatgaatgaatattgcaagaatgagcatatgccatacttaacaagccacacagcaaatatgcaagtgcacaggataacaaaggacggcataataaagttcatttgcataaacaacatttaataaatatttaggagaatagtaaaacagttgaataattaatcagtattaaataaacactacacaacacacccgtgttgcataggccccacctcatctgaacaaccaccccggttgtacaaatcaaacctcgataccaggaatatgccactccaaaccaggagtcaaattaattaacacaattaccaataatgagtagtgtgagactaatcatgaaaaacattgttcaactcacccataaccgcgggcacggctattcgaatagttttactctgattagaggtgtaccactgtacccacaagacacaatcccacaacatgtcaccatgcgactcagtaccaccacggtaccttggaaaggaactgtgacaatactccaaaggaatgtttaggcttaaactaaaatgatgaacaatgttgatcttttatgtttaggcaatgatgaacacttattatgcaactgtgatgatgtaactgtgatgtttatatttatgtatatgtttcatatgtttatactaagacttgctaaataaatatttgttccaattaactcggttttgtaggtgaaacatgataaatattcaatgtgaaatatgtgaatggatgtgaaatatgagatggctgtgaatgtgtggttgtgtgaaatatgttcatgtctgtgtatgtgaatgcatatgtatatgaatggttgaggctggggagctggggatattggatatctgtgtttgtttctgtcatttttgcagcgggcatggctagcaaaggcctgaggctagccaaaaaacaaaatttattttttttgtgtattatagtcatctgtgacgggccataactaaatgcccgattgagatgagatcatatgtgacgggctctagtttaggcccgattgaggtcagtaggcatctgtgacgggctatagtttaggcccgattgagatgagtatcatctgtgacgggctctagtttaggcccgataaaggttagtagtcatctgtgacgggctctagttgtggtccgatagagataggtcatctgtgacgggctatagtttgactggtcgtctgggtcaaagctatctgtgacgggctttacttagggcccgattgagatatattcattcgtgacggccgtttgcccgattgagataactcttcacatcagtgacttctagcctgtgacggacgctgtgcccgattgagatggggcttaccgcccgattgagatgagggtatccgttctagtggcatcatttcaacgtgtttttcaatacgaatacaacaattctatttatgtattactagtcatcaacctgtgcacttgcatgcgctagaaaaattatgacatcaattaactgacgtggaagctttattggtgcatccaattactaaatataagatttattctttgtttctcaattctttcggtcaaaaacgtgcatgtgtgttattcatagaaacgtatgtagtatttgtaagaagtacagtatcgaatttccaaaaagttctgaccttgtgcgataatatacacacacattaacctacataggcaagctagctagacctagaaatataccatttctaaacctattcggtcacttactcacattgggcagcctaactaaactaacatggactcacatggcatgcaagccagccatggtactaactcgtctaccacgccatagtacgctacaaacacaactaagttatcttatgaaggactactcaatagtacacttaaaacattattactcgtttccttttaccttcatctgacgggtacgagctaagtgtatctgaaaatcatctccttctgtccatcggcgaaaacgtgcaaatttaaaattccctggtacgcaggactagatatgaagagtttgttcagagattgtgaaacaaacatatacatccatcaactatatacatgcataggatacatacatacaatgcaggtagccatttgcaccatattcataatatacaagtaggcagccatccgcaccttatccataccaagacgatccatttgcgcattatccacatcatcacataaagcttctgcctataaatagcagcagcaccttacattcaagaatcacctctcaacacacaactaagaaacatagctaggtaaccagggaaggtagcatcagcagcaggaggcaatggagggaaagaggactaccacttcgatggtgatcatgtgcctggtcatcttgagcctcactgtcgactccgccaccgcggcacagtgcggctgctgcatatcctctcgggcaaaagcatgttgttttggttgtattgctgctggtggctccgactcaatctgcaagaacacttgttgtttcccatgtattctggccgattctggtaaattcactgaagtcactcttttaaatgcacttcttatatgtagatacagactttgtagcatatcgtggactaatacatatgtgtggccttccatgcattttcatcaatatagtttgttgacttcacttcccatctgacaacttcaggcatatatcttgcaacatgaagacaatttatgctctacttccactacaaaattaattaactaatgcgctaatgtgatttccatattttaatttcacagttgttgctaagatggacgaaatgggagttcttgctaagatggaaggacaagcctaaaacaacctactcgcattgctaccagtcttaatgcctttcataagaatatgttgttttgcttcaagttatggccaagttatgttaatgtttatctccaataaattgttgaccatatggagcgatctatagtcgatccatctgttggtcccaactatttgtatgtcgtgcatatgtgcgctcacaagcatatttaatttctcttgctacttttaataaggccatagcactatccaatgtgtcatctgttggtctctgaccttagcaatttaatgcaacatgattattattatttgtgtgtgcatgttctttacttaatttattcttagcgtatttctgatgtttttgtgagttttagactatgggagataattaagattgtcatgccaaagagtattccgaatcctactaggaaagcaaagggaggggggaggaaacatggtcaatttctcggctgctatcacattccttgtattcttagtgtaacatacccgaaattttaggacttaaaatttcttgtcaaaatagttagaggttaacttctccaattttgagagagccaaaaatttccgttttaatttaggtgaagatcaacttaaaccattgcatgattataatttgagaacaaaataaaatcttttcattcccaacattagactagaaatgtcaccaagcatacatgtacataatgcatgcctaggctcgagttctttgtgcatttggagttttggtcttgcattccataataggtcccatgagcataatctaaaagaattatttcaccaaacaaacctatagttaatcttgggtgataacatgtggacttaatattaaactcaaatatcatcttctcagtctaaaagaaaatttaatgtaatccctataataatattaaatgcaattatgaagtgggaatacatatacaaacaaaggtcatcctaattctctaaaatattttgtgcaagataaaatcatggaaaaatttatgtggatagtgattagcacaaacttatcctccgtaatttggtaacgtgttaacactcaagttgatacctcaaattaaacggtcaaagcagacaactaaaagaaatcaaattaaattttaatcggctaaaaccatgtttcatccaaaagtacatttaactgcacataagtgaacatgggaaataatgtattcaaatactagactagttatcatgcctaaatataatttttctagaattttcctcctctctttaagcctcctaaaaattcaatctagctttctaatagcccatctttgtttaatttctgtgagcagtccacccattatttttttagtgcaaccaaagaaaatggaatctaggtgtaatcatctaccaccagtaaaatctacactaattcttctggtctacacattgaattatgtagttacaaagttagaggagaaaataattccgaaaaaaatgatctaaaaatcaagtttacccagaatcttacccaaccctctcaccctagcctagtttgccatgacctggacccacctggcagcctctccagctcgcccttcctctgtccctcatcctcagccgaccaagaaacacatagagggagagattgagagccgaccgagtcctggacgcgtcgacgcgtggtgacgacgtgtcgacgccttcaagtcactgagtcatgcctccatctcctccagaccgagtcgcccaactccacacatcactctggagctgaagaagccgagggagaggtcctcagcctctccgtcatcctcaacctcgccactggtcgtagtgacgacgaccttcgccatctccgtttgagtcaaggtcacctccatctctttcgcgttcccatctctccacacaatgccgagcatttcctcttttgacctaaacccctctcgtgcagtgcatcgccaggaacgcaagccacgccgacaacgccctggagcacgcaccggagcgccgccgcttcaaccatcgtcgccgtccggccattctcatccacctcagagaaagccgctgcgccattgtcatcgcctcgacctcctcttcaaaacgcctcaagaaccccagccggaaacatcaagaacacggagaacacatccttttcttcaccggcgccaatctaggatcgcctccgccgtcatcgtcgtttaccgctgcctcggtgagccattgttcgattccttgcgcatacaccatctccttgacctcacaaccctcgtgcatgcttgcttgaagcagctcattgtcccgttcgagccgtcgtcgttcacccgaggaggagcgccgtcgccgagccgttccacaagtcaccgctgccgccaagacctcgacaaccctagctcgacccacggtgagcatcctgaagtctagaagactacatgcatgcatccttttcgttcgtaatcgacttccatgcacacatgcactttcaccccaaaaccaccgccgctcacactcgccatcggcgctactccgatgtcctctaaccaagaaaactagaggaatggaatcgcgagagctttctcttcattttatcttttgacctcaacctcaaacgagccaccgtttgccgccggcgagctccagatcgagctcagccatggctagctctgctctgcctagagcagagggatgacttccgtgaattagattaagtgcagggatctgtttacaattgtagaaacacactgacatatgggcctaggactgcgggttgattcctagaaacctcaagggcctttgtgcatattggtccctcacagccatgtggacccatcctttaaaatctgaagaataattaggaaaatgcccaaacaaatatgtttagcagaaaaatgcacaaagttgtaaaatctatataaaatcaaatatagctcattttgaagtgattctagttgctgtagattcttgaagttatgaactttattccaggaatataaaacttgacactcactgtacaaataatgtctctaaaatttatctaagataggtcatacataaaacatgtacaaacttataaaatacatagaaaattcatcacaactcattttgaaacaaaatcaaattctacagattcatcatcatacagtctctgattaggtgaaataaaagtaattacttactttgcatcaaatgcctctaaaactattatctctataatgattagttttagataagctaaactttagaaattcatgtagaacccaatttagcttcaatttgagtaaacttaagttctgtaggatcactaaacatgtatttctaagttatgaaataagattatatacttactgtgtagtaaaagtctctaaatattcatataaggatttactaacatagagcagcctttaatttgtaaaacttgtagaaaatttatttttagtccaaatgaaatgaacaaagtttctatagaaccagcaaatagttatcttcaacatggtaaaataaaatttggaaccttttgtagagaacatagatcgaaaccttaacttagtgaaataagaatttaaacacatagttgtttaagtaatacataaacatgtataagtatatatatacactttaggtctaattaaacctaaataaaaacttgattgaccagtgaagccatagttccatcctcatccactaaaacttagaagaacttggctcatataacaatttctaggttaatataatatattgctagtttagattagagcatctctagtttataaaatatgaaccatactagtaaagaccataaacatgtgaactaaaaatgttttagataaccaaattattccttttattcaacttaaacaggaagtagcatgttctgaacctataactcaaaagtcatgaacatataaaacactatacaccaataacacgttataacttgtaaaatgcataaagaattcattataaatccaaaaattgtgaaaccaaatgtgttagtattagaaaacacatctccacacccctgtgaagtctaatctagtaaaaatcactttacaaaagtatttcataacactacctaagactatactactataaaccgataaaacttctaaaaagttcataactccctaatggaataagttaaaataaaaattctttcacctaaattcattttagatcagtaccaacccactgtgcataaatcatgcattttagagcattttggattttcagctctttcggtgtttaattgcatatcgtgtccttttatctagataattgcataatcggtgaaggagtggattaggtgctaacaattctctgatcaaggcaagttttctcctcccatcctttgaacacattgaatcccatgatttgaggaatgaaaatatttgtttgcaaagttgcatgtgaacttagattatatcggtatttgaaattgggttaaggtagttatgacctatttgctgcataccccaccttgaataattgatcctcttgctgtttgaacccctagaaatggttagagtacactctttgtgctcaaatgggtttatatatgctctatgtgcaactactttgcttagccatgcttagaaatatgcaaatgctcattccatttataattaaaatgtggttttgatacttgaaccttcgctagaataaaatgaatatgatgggtatttgcgaactaaaatgtgtaaaatgtgattttacacttgggcagcaagtggtgtgcatacagtgttagttgcataccgatagggggagtgtttgcccaagtccataaggaccgaacttgtgtcacccatttaaagttattcgtacatccatatgtgctagtatgggatggcctaagctgattaatctatttaggactagccttgcattctggtaggccggtgtgtatgagttcgtataattcagaggagcttcctatttaccccgacgtggtagtttaggtgactaagcgtgtccaatacaacggtattgtgccacgtggtgggttcccgtcgtgtccgccaccacggtgttaagtttaaggcgtgggcccgccacttaacggttctaggtatattccaagtatgcctaggatggaggaacacgtatcgtgctggtgcaaggctaggctctaagtagtgtaaaggcttcgttatgacctctagatcacattcaacatgaagagtgtggtggagtcttgcaaactcaaaacaaactagagagttcatatcatgtgggtaaagctgtacaaactctgcagagttctttaaactaatcgattagccgtgctcacggtcatgagcgctttggtgatgtgtcatgagtatagactatgttttaaaaatgtgatcatgtgacactggtttgaaattgataaatgtgttgagttgtgtatgtggtgatacattatgacttattgttaagtatggcaataagagattgtttatgatggaattatgaagaagttaataatgaaactcaaaacttgtctttgttaattgaagcatcaactcttttacaaaagaattgcgaaacaaaacttgctttatgctgaaaatgaactacatattgtcttcctttgaatatatgccttacatgtagtatagtaggattgacttgtgcttgccagtacattaacttgtttaatgtactgactcttgctgttgatataaccttttgtttgcaggtttagtcttagtctttgagtgatgcgggttccgattgcttcttctaggatgagaacttaatggggtaaacccctagtcggtgtgcttgtgattgggtagtcaagcttccgctgttctctaataagtctatttggccggttggcctatgtaattattaagttgttgtaagtcttaagtttctttcatcttagttgtgtttgctatgtgtaatcatgcttaagatgaaagtgtgaatctagtgcacatcctgggaactagattcacatgagtatgagttaggaatatttgagaggttgtagatctttagctatttttatcaagtctcctgaatgtgtaacacatctggtcgccgccttcgagtggtttgacgggcacatctcaggctgaagttgactggcaggctaagggctcagcaatgtctccaatattcctctctcgaggcgtcggatgtttcattatgcttgtttgatgacttgaattattcacttcatctcaaatataatggaaggtccggagagcctacgacacttagtcttgggagacaaatagccacactaaaggcaatacagccgaggaatggcaaccttactcacaaggacaaatagtcattaaaaaattatgacagcactaaccatatctaatttcagttcaccaaacttacatttaaatttaggcagtattacggagatctaaatcaacaaacaacaaaccatacttcattgtcaaaacaaatggccttctatgtactttacaaattctcacaagatcatatttgcaatttttcctaaactaattaaccaagagaaaatatgtagtggaggattccacatataatttcacagcataagtacataatacaatatggtataatacacatatgcacagtactttgaaatatgcataccagaacatatgctttagttcactccattcattcttgcattcttgcacattcaacatcaatcagatctaccaagcattcttgtacattcaaccacaagcagatctaccaatgaatcactaacttatgtagcaatgggggaaatcggaggagaattaaaaccattcctcgtcagacgacggaaggacaggaggcggcggaagattcaccggctgcacaccacggcacgcgaatccctgaggtgtgggcatcgcatctatcagcaccaacgacatcggcagaggcaggggtggactggggctctttcgtagaccgatgtaaactagacttgttggcttcgttttagggaggggacggaaaagagataaactttacccggctggcctttgggcctgcgtggagagggataggagtttgcttggtttcagccaaaagataggaagaggattttaaataggttgcatatgcatgctttgtctaaagaaaattcctaaaaataaatgaagcaacaataaatcccaccaaaattctcataaatactaaacaacaccctaagcttccagcaattttagtttgaatttatcacatcaattgataacccaaataaatctttcaacacagctaaaaatctggaaacagcataccaattagcctagtttgcaccttcaccaaaattaaaccataactcctctagcaaaatctcaaggtcagaatgttaaacatactttatcatctggtgcaatggcttagtctaattcgaaatgtaaccacatgaaatgagagccataaattacgtaaactttggaacttggcaccttgaaccatcaaatccttgtctaccttgccgtctcccccctaattctaaattaaatgtatgagagaaagagagtaatatagtttagtgtgatagtgccaacacatggaaaatttagagcttctagttctctccttctacatctctcttaaatgtgggaccaagtccttgtggggcccactcatcatacaaccatagccaacacatcatctgctcttctctcatttaaatcttcttttatttctcaaaaggtgagagaagggtttaaattgaatttccacccaaaatgccactctaccactccaagccttctaggaaacatctatatatgggcctatttgtcgtccaaatacctacaaacaaccttggtgaatcatctctttgatcctaaattatattttcaaagagagaaagaaagagagagagggaattaaagtccaatttacacccaaacttcaccatacctctcatcttctcataggaaacatctacatggggccactagacagccactcatgctaggttgagtgaagtacaagtgggatcacagcctcaatccactgccaactcctttaaatcgtttctacccccgtcattgttttgaaaccaaaacccttaaagggcccttttccttttccaaaacccttttttttttttgccccccaaaaaacccccccttttttttttccacaaaccccctttattttttttttttaaacccccccccaaaatttttttttttttccaaaaaaacccctttttttcctacaaccaagatttttgtgtgagggctaacacgatttttgcgagcgggtaggcggtctgcaccacctaggggtctaggaaaatgagattttgc

SEQ ID NO: 82811 - DNA, 30212 bp, Oryza sativa
gatcaaactatagttttgttctgttcgtcctcaacgtggagtagtggcgcttgtgcttccacgtcgccaccaaccatggcgatggccacctacctcgcaccatgacgtcatccaacctcctcctcctccgcttaaacgcgtagcctccattgctctcctcctcctccccaccatggagtcgtcgccgccgccgccgccgcagatgcgtgtgcgcgtcatggagaccgtgcacctgcgtccgcctccggcggatgacgcggcgtcgttcgcgctgtccgggctggacacggaccgcaacgtgctcgacgtgacgttccgcacgctgcgcttcttcccgccgccgtcgctcgagctcgacccgctcgccgtcctcccgcgcgcgttcgccgccgccctgggcatgttcgtcccgctcgccgggaggattggggacggagggcgcgtcgtctggtcggccgccgacgccgtgccccttgttctcgccgcggcggacgacgtgtcggtggccgacgtcgacaccgacagcccgggctccgatttgctggagcggctcgtgccgggggacggcgacggcgacggcgtggcggggtcaccggcgctcgcgctccaggttacgcggttcgcctgcggcggcgtcgcgctggggatgcgggtggcgcacgcgctctgcgacggcgccggcgccaccaagttcctctccgccgcggcgcggttcgcgcgcggggcgcaggagccggcggcggtggcgccggtgtgggagcgggaggaccgtctcggcccgaggcgtccgccgcgcgtggtgaagccgttcgaacgcgtcctctcgctcgacgacgccgccgccgcggtgcacggaccgtacggcgcggccggcgacgcacaaggacagatcgcgagggagtgcttccacgtgagcgacgcgcgcgtggaggagctcagggcgcagctcgccggcgaggccggcatcaagctcacaacgttcgagttcctcgccgcgttcatctggcgcgccaggttacactgatcccgtcgaacacctgggacaacaaggtgattttatctcctctcgtttaactccgccatggaatcggtgatcgagcaggacgaaagccagaaggacgagccccgacgaggtcgtgaagatggtgtactccatgaacatcagcaagctcctcacgccgcctctcccggacggctactggggcaacgtgtgcgtcccagtgtacgtcgccctcaccgccggcgagctcgtcgcccagccgctcgcggacacagccgccatggtcaagaagagcaagcaggaggtggacgacgagtacgtccgatcctacatcgacttccacgagctccaccgcggcggcggcgtcacggcggggcgcggcgtgagcgcgttcaccgactggcgccgcctcggccactcggaggtggacttcgggtggggctcgccggcggccgtgctgccgctctcgtggaggctgctcgggagcacggagccgtgcttcttcgtgccgtacggcgcagccgacgagaggcggcggcgcgggttcaaggtgttcgtcgcggtgccggcgatggcgacgcactgcttcagagaggagatgcaggagctatcgttgcaacgccattgcctgcgttcgaaagagaagctgtaaatttcacacgaaaacagtccgttcaaattcaaaatggatagtactcattcaaataaagatcttcatacacatttccgaaccgcaatgggagtgaatcctgtttggatgggccaaaaaataaaatggtcgatcaagaaatttgaaatttccaactccgaatccgataagaaatcaaacacccctgtgtactgttggcgcatatataccggcacggctcttctcgatcacctcaacccagttgagagatcacctcgagatcatcgagcgagcctgatcgattcgagatcaagatcatgacgcgcggtggcagaggaggttagttattgccttcaatttcagtttcgctacatgttcctcaccttcccttgatctcttgacagtatcatgatcttggggactaatttggtttttttctcttttttttctgttcgatagaggatgacaatgaggtggattcatgggtgaagaaagaatctgaatgggaggaagcaggagatggagaggaagacgattattcagacgaaaccgaatatgatgatgatgatgatgaatcttcagatgaagacaacgattacttctcaatggaaaatcgggatgtccgcttcgcttcggaggagaagtgggagagccaaatcatggaacagatgaaattctctgtctccactgctgatccatttgatatcaggacgatttggaaggggtctctgcacgtcgacgggccgtgccaatctctcgatccaaacctcttatctatgaacaatttcagtaagttcatcgtttcacataccaatctttttcaagaaaagaaaaaaatatttaactttatatgttcttgaactttaccatatttactggttatttctgctgcagtgcctcagttaccactgagaatgaagaagaagaataatgaggagccttgccgtcgagccatccaggtgtttggtctgactgtatcttctcctgacaatgttgttcaggagatctatggtatgtttgcattcagagatatacgaaacagccaagaacgcaatttcatctttgaatacccaagagacagaccatttacacttaagccggtgagcactttatcaactcttctttttttatgcaatcgttttaattagtttattccttaagcattcaagtttttatctcacaggtgtaactctatatcatacatatatatgcagggttctgataaggtgcaacccctgattcagcctcctcgcggcatttacgcaatagggccagtggtaatggagtatcacctaatgatcaaaggtcaagaagaacaagaagatagagtattggtagatggttactccatctactgtccatctttctacaaagaacgttcaaggttccactggcacattgacactggccactgtggtgccattgatctgaagatggctgctgtaccaaacgccgtgctggccacagtggagatcgaggtgattcgtctcggaggaactcactacgattcgcttgccattgttgtcgcattatcgataatcaagggtatgtatttggttttcgatggcaaggttagcgtaggcaagctactgcctttcacggtgtgcatcaacagagagatgcatctgaagctgttcgtgtacggctactccagtagtcagattggacatggcgattgctctccagatggtgttgttagtgattacgacaatgatgggttcttctccgcaagcgaggatgtttattacgacgttttgaatttcataccacagtttggaacctataagaaaatgtcacacaatcttgaagatatggacgtgtctgtgacggtaacctggtctagcttgtattagtacagataaagtgaggattatattttatgttcttgtcataaacaattactgtaaatatgtggaagaacaatgtcagggaagaatggcggagtcgttaacactcatctttttatttgatatatggacctgcagccgcggctgcaaagacatgaagggatggcagcatacttatgtttataactgaatagattaatagatccaaagaaaagtttaatcaaaataataataataataataagccaacatggccaatatgaggctaactacccaggtaaagctcacctaattttaccattcgttgtgaagtcattaacaaaagaaggaacttttaactgttgttccaacaaaacccttcccttcaattcaaacatataggcaggcacatcacaagtcatattacaacagcacaacaatgaatcctagtcctaatcaaagccactctcatcagatgtgtgcaacctctcaaccaaatacattctacattggtcacttgtttgttccatgtcactgtaaaaaacaaaaagaagagagaaacaaagagtggggagaaaaaacaaaagtgaacttcacaagatgtatcatacaatgagcggtaaccatttcgcggcgaattttacacactgagcgaaggaacctctagttgttgttgcttcttctgttggccccctttcatgtccttgggctttgcctttggaggaccagctgcctttgccttctgcacccttgctaccggtttcttttgatcaggaggagatggtgttacggttttcttatgatcaggaggagacagtgctaccggtttcttctgatcaggaggagatgctgctaccggtttcttctgatcagggggagatggtgatgacttcttcttaggggcttttcgatcattgatgttgttgcttagactgattgagccttgcagcttcagagctgatgggtttgtgctggcattttccttctttgcctgtcctttcttcaggttttcggggtggaccagtgatcggggctcccatggccgtgccgctatccatcggtccatccagctccaaccccagccacccttgccaacttcatagttgaagtttccaagacttgtggcagaccttgctctccactgaaaatgtgcagaatgaatatgccgattactatgttgagtttatacatagagaaatgagcatagtgctagtctgaattaactagtaagtagcatggaaagaaactattcctaaggggaaaagacatgatgaaaattagcttaggagtctctgtcatatataagatcaaaatcatagatataatgtgctgcaatacgtaggattcttttaaaggaatgaacaatgaatgaagttgtaacacctgaatcaattgttagtacctgatgattgaatgcatatgccatagctcgttcacgctttactgcggcttcttccctttgttggatcctcccaagtatttcctccatagtatccgagcctccattccactcgacctgttaaaacatgccgatgccaaaaggaaatgcaatgtcaaagaacattagtattcttttactagtaaatttaatattattaatacaaaatatagttgatttgtttaatcagttaaaggattaagggtaggttatgaccaaaaaaatcccaacaataattaggtaggcagaaaaatttacaaggaatggtggtcctttaggagaaattcacctgcaaattttggagttttgcttcaagtttcatttgattttcttgcttcttcttcctattgcgcccttcagtgaccatgaaggcacgccggtttcttatctctgcctgcaacttgttccaagactgtatgtagttcaatgtggcagctgtctgcttgttaactggattggtctgcccaataatgtgcaatcttttaacccccttgagacatctgagagttttctttgcctgcatttgagtgacgaaacggcaagaaatgatgtgccaatttcttagcaaccgaaaactcatgtggtagccaaaatgaaggaaacaattcaaatcaatgttaccttgtagcatctaaaggcattttgaattcgagtagctgcccattcctctagtgctgcattgtcttcagggtcactactagaggaaggaccattattagacttttgatttgttgagtttggcccattgggtacctgaccggcaaccttcaatgccaaagcaaaatagaggaaaatagttggtcaatttgacgtttagttcatctaagtaaatgtacagatgtcctaagccataatgtaatcatttaaatacaaagggcagaagctatgccatttcaataagaggcagtttaaaggtacaagaagtacaatcagattatgtttatgcactgtagccggtaagacaatcccacggaaagaaaaactacactagtactacaagaaagaagctgagagataattaggccagattctgtctgtaaatcgatgtacaaaaaaaaaagctaccaaggagatcaattcaacagtcaaattactttgactgaccagtccatgttcaaaagtgactggttgactgctgaacatataacatggacagagcataacaaagatctctgaatttatgtgactaaattaacaaaatgcttactcaatgagaactttgttttcttttttctgggtgggggtggggatgggggtaacttaacacatcttctgcagtaacatagaagagaacaggcaacagtggcaatgccaaaacatttccaattttcaaaccataaaacataaaaaaaattatcgacacagaattcagcttctcaaagaaccttttatatgtgtaccatgcaaatttacaatgacaaattcagatgtcctgttgtcagtaggtggggacagttaattagcagtagctcaccaatacaccaaagatgcagaaggttgtactactactctaaaaggtatacctaactcacacatactactgttctgcaagtcagcatccaaggtaccccataattgattgctagtatgtacaaatcaagcttttcccatcagccaactttctcttatgatgaccgcaaccaacaaagacaatcaagtagcagcacagagaggctgtcctggcccttcttaatgatgggatggaattgcattgtatggcatccttttcaggttgcttagaaggcatgcaaggctatgtgtacatgaccattcaactttcaggagggacttggaagttgtgaaaaaaaaaatcagctttttttggagtacatagaaggcacatactccacatcacggatacaaatcatctgcggtactgcatgtgtcactgacatgtgggtcccacctgctccgggcccacatgtcagaggcaccaactgcatgtgcattacagccgaggatccccactcaccaacggtacatctctaaccctactaaattcttactaaattctcgcgtgtgcgtaatatttatggacatgaggatttgatttttggaaacagtgacagaaataagggggttaatggatggatggagtggatacctttgcgtgttttgacttgccacgtttagacttcttcttgctgatgatcgtcttgaaccagtccccagaccccatggcttcaatcagagtgagcctcacagattaatccttgtccaacccccttgcttagatcacagaaaaaaatcattaaaaaaacagggttaattttgtttttaagtataagatggtgcaacatgccgaaataaaaaattacacctgatgaaccaagtttattggctcattctgaatctctctgagtgttcattaaccaaatcaaaatttacatggagaaaagaagcaaatcctaatatttctgtcaattgacagaaacatgagaagcaagcatgagaaatgaacccttgtttttgtttctatcctgaagtcttctcgaatcaaatatgaatgattccccaaaacaattcgactaaaatcaaacaacaaaaggcaataaaccggaagccaagaatcagctcaaatcttacagaactgacagggctcaagcttcagacttccttcctataaccttagccaagaaaccaagaacacccagagagtcaaccccatggctcatccatccctctgctcatcatccatggcagatgaacaagtattatcttctccctccaaaacccagagcacaagaacaccagaggagccaagccaagaactctgaagaaacacacagataaacatgatgcagctgagcagtgactaagtacctgagcttcagaaggttgcagtgttggcaatctgaatctgatcagaagttgctctcagaaagagaacgggagacagcagctcaggaaaggaagacatccattggaagcaatggatctctctctctctctctcctcaacctttgagagaagaagaagagagagaaagagagagaggtgggagagaaggtggaaaggtgaagaggctggagttagatataagtccagatcaagtcctttgtctaattgctcccaagttgttttctttaatccttctttgcctccctcctcggccagccactgatgactttaattactggactttttaattacagtgcggttgctaatgatcttgcttagcagtgggagttactgtcccttaatctcgctggcgatcttgttgccattaaaaatggagacaaggagttacttctttgttgacttgtatggagatccacttgctcagagaatccacaatttgcagtgtgcaacattttttatagctcatcttcagcagtcagcacagtgaaatcgtggtagtactgaaatcacacacaaactgtcgagttaataacagaaacaaaattaatcttgccgtctcatttcgttgttttcgagtaacagtaccttttcacatagacttggggtggtcccgggaccacccaaaaaattcctaacccaatgtatatatatatacatatgcaaaagaacttttgaaaaaaaaaagaaaacaaagttcttttattaatatattatgatgtacatttgatcaatttatatttctaactttgttatatttagagtatttaaaatagttatataagttgaaccacctatataaaaatcctagacatgctactgctttttccgagcgattaagagtgtaccatacttaaataagtatcatgagttatactatactttctaacttaaaaattcgtatgctagaaattaggatgaaaaaatttacaaaaaaaaaactttgacaactcttaaagacagtaaaaaaaattattgtttctatactacataaaaaaatccgaaaatcttcttgtctgccccagtaagaaaacggttgcgcgttattgcactaacacgcgacggagcatgaaaacgtatgcgtgtctacggaagcgcaatattaaaattcacgaattacctctcgaacttctcgatattaaaaattaatttaatcttaataaataggcacatataaaatcaaattaaggttaatattccgtataaagaagataaataacacatttcatacaaaatatattcgtatttgttttagataatattacaatatttttttatctctataaaagaacaagtattcagcgagtttcacataaacacaaactgattgtatttctggtctctgccgttaggcacacgccctattgccctagtttactagtagttgatgattaattgtgagcccagacagcacggcgaagtcgagaggaagaagccaaggagggagggagggagagagagagagagagagagagagagagagagagagaggaattagataagacgatcgattgccatggttggtacgttgatggtggtgttctcttcttcgtctgctcgtcgtcttcatcgctcgtcctccctggccaacagcgacatgcgagctaaatcagagaaaggctttctttctcccacctgaatcgatggatgcttcgtcacttcgcgcccaagtacggctccattcccgtcttacgttgcagtactcatctccaaccacccatgtcgcaattaattaccacgcaccgtgattggttcgggtgtgtttagttcacgtcaaaattgaaattttagttgaaattggaacgatgtgacgaaaaagttggaagtttgtgtgtgtaggaaagttttgatgtgatggaaaagttggaagttcgaagaaaaagttggaaactaaactttagcctaattgatttcagatagggtacagaattcagacttttcgtatggttttttttgtacccttttggtttgcttttgaaaaatggtatcatcggttggtttgtggtacagtatagtggttttggttttcttcgctgaaaagtgaaatattgttgcaatgatctgcttatgagaaaggcattagtactcccttctgtcacaaatgcttgtgagttctgatcgtcgagagaattttgactttttaataagcaacataaaagcaaaagacatttccaaatatagggaaagtttatttgtccctcgagggaatatcctctcgttttttttcattctagacctctttttagatagcatttataattcagattttatatatatatataattttggtaccttatggtttgcttttgaaaatggcatcggttggtatatgatacagtacagtggttttggttttctttgctgaaagaaagtggaatactgtcggaaacgaccctgcttatgacaatgatattcatacactgttttgttgtgaatacttgtcaatttaatttgacggtcaagattggtaaaattataaccgtcatctttttagagatgtaaaagcaaaaggaagttccaaatgtaggatgttagtaaggtacttcaaatgacaaaaaaactaatgattcaacttttaaaactgaaaccatatgctaagaagtgctaattataactatactaccaactcttgtctgccaaaggaataggtcgtgttagatcgaagccatgcaagcataattccaattccaaatccagaaaagatagacgagatatatatctcgatgctagctacagcgacattaataattaatcaagcaagctagtggcgtcatgaatgatactcactccgtcccataatataaaggattttgagttttttcttgcactgtttgaccactcgtcttattttaaaaattttagaattattatttatttttttatgacttactttattatccaaagtactttaagcacaattttttgttttttatatttgcacaatttttttaataagatgagtggtaaaaaacgaaaaaaatctcaaaatcccttatattataggacggagagagtaatatctaattcctagttgattagtcctaaataggatgcatgagatgaatgatttgccgttgttatcttactgtcatggagacaggccgtcagtttcggcgtgtccttgtacaatcatggtggtgatttgagtgctgggtttcagagcagatgtgtgtagtgcaatgcaaggcaaaatgcgacactgcctgctaattgatgcgtgcacacgtgcgattcgtattattgtccttctaccctcaagaaaatttgtacgtatatgtgcacacgtgtttgagctttcagtatttttttaatataaaaggaagttcagaaaaatcaatcaaaattttgcaatacaaccaaaattccaaatttaggaaatgtacttcttttttttatatataaaagggcctcattccgttgataaagaagagaagaaatgtactttaagcatcggtgaatttgaattgaagcttggaattggaaatgccatgttgcccaaccacatgtctaattcagtatttcagttatcactatctaactacgatgattagaatgtataatatttaagtacaataacaataagatgtcgaataaatgctgagatttcgatgattggattggtataaccgactgcggtttgtcttactggcgcctaaattaattgattaaaattttaaatgcaacaatggatgcattagttcgtcagctggaaaattttttttggagattaattaggacgtagctgttgcctgccaccaatcatggcgacaacacagccgctacgaaaggaacggagattacatactcgaaagagattctttatcgtcagaaaaaactgatgaccacagcagcagtgacaggccagcacgaagcaggagtagtagtatatgaattataatttaagaaatacacattatatttgtatatggtttttattattatacatgcgcatttcggatcatatgcgtatcaatgacaaacatgatgaggcaatatgaaatgctggactgcctgccctggatagagtcatgcagatacttgtcggcagcattacgcgttgcttcctgcagttgcatcatttttattttcttttgagtacttttaaggtgttctattattctactgccagtattatcatccataaaaaaaattttatcaattgatttataagttctacaactagtagtaaaaaatatttcttatactaccaacagttaagttagtagtataaatagaaatgatacattggactagaaaaggtgattataaaatatctaccacctctgtttaaaacatagcaacttttagctataaatttcaataaagatatgtttatattcgtagcttaaggttattatattttagaccagaggtagtattttattttattttcttttttgcatcatacaattttgctagttttttttattctacatcacccttccttttttattatagtttttttgagatggacagatacggtaaagagtactttggatgattgttaaactgttttggagccacagatgctgtgtttgtttgggctaaaaagttcaagaactttgttgggctagatttagtattcctccgttttgtctggtccggcctgccattctacagtactttagctggctgggccaacatagcttgatctgatttgcctcagattaattctgcatcatccacacaattgcagtttggatacacacaataattacatttaattgtaggatccgatattggatttaagtttataaactgttcccacacttaactgccagcaagaaaccataataatttcaacaattaataccctatgtagataatagatactccctacattacataatacaaggcccaactattttttttcagatttttcatatataatataaggcatttatgcatacatgcaattaattagcacctcttctccactagtccaccttcgagatcccgaattctattagctgcatgtgttatatttactagttggcatttcgcgccttgtcgctgattctgtagttatattgttaaacaaaatcgaagtttaaatggttaagggcaactctatgtatgtacaaaatgtggctttatatataccttatgttacaatacaattcatgctttatgtccccacgaaaaaaatcatgctttattttttaaaccgtcattgtatattgttataatatattttcatgcgcaatatggatcgttgtagctagatagtttgcatctctctactatacctaagtttgctctaaaaatgggttaagtaacgctacataatacttacatgctatctaatcatacgtaatgaaacaaaactaacatcttaaacaataatttaagttgtatttggaaaaaagttagcattattttttaggacttggaagagagaaaacattgtgttgtgagcaaaataggaaggtgaatatacgactaataataaatgatgaattagatggataagtagcttccccgtgatgactataaaaaatcctcgagtgttgcaacaagtgaaactattttaatcttgttattgttatatggtttagttaatgtgaaattcaatgtgagaattagcttggatatgtattttctagaaaataatgagctccaagtaggagtccgatcatcttaaattagcatgcgagttttcttaaagggatttcttatacgattctttttatgtttccaaaaagaacaaacttaaaacctgacacaaatgcggatctgtatttttaaaagcgaacgaacttaaaaacgactcgtacacggatgacgtaccaaaagtaccgacaaaaacatcttcaattttttttaatgatatggcttcttgtatatcttactttataggagtaaatgctctttaataggtaccaattatataagaagataggattagggtgatcctaactaggaggcaataataattattattattattttggattaaaggtgtctgtgtattttggaacctgctagaattactggataatatatatataaaacccaggctgttgcatcagacaaattctacctctgcattacagcaaatcaaactctgctgcattaacctcctccttttccttttccttttccttttccttttttgcgtcttccttccaatctcgaccgtccgtttctcgatcgcacggtcgatccgtggccaaaatccctaggcgtaacgctcgtgcatctgcagctgtctccgttccaccgtgcacgtcgcgctctctcgctcccgacgcgacaacatgctcgcctccgccgccgagttcacggacaacccggcggcgacagccacggtggcggcgcgacacggcgtcgacggcggcggcagcagggtggtcgtgccgctgttcctggtcaccgtgtccctgttcttcgtcacgtaccagctcttcggcgtggccgcggcggccggcgccatggtgctcgacgtctgcgccgtcgccctcgccgcgctcaatgtcacggtcacccgcgcgcgccgcttccccttcctgcgcctgtcgctcggcggggaggaaggccatggtggtggtggtggcgccggcggtggtgacgtggcgccggcggcggccgggatggacgcggcggcgatcatggcgctcccggcggccttcgggtacaagcgggagcagacggcggcggcggcggggggatgggcgcagtgctcgatatgcctcggcctggcgcgcgtcggcgaggccgtgcggcggctgccgtcgtgcgggcacctgttccacgccggctgcgtcgacgagtggctgcgcgcgcacgcgacgtgcccgctgtgccgcgccgccgtgtgcgccgccgggccggagccggagctgcccgtgtgaccgtcagccgcggtgattgttctcattgttaggtcgatcatgctgtagagaaagtataacagtagagcttttttcttccattttattagtgttggtgaatggtgatgattttatctcaaatcgaggtagccttcctgttcttctatcgtcctcagtgacatctgtaaattccgtccaaattatgtcagtgcagttaaagtactcttaatagctactccccgttttatattataagtcattttaactttagttaaattacttaaactactactacaagtttgttcaagtttgtaaataaatacagtaatatttacaacatcaaattagtttcactaatctataattgaatatatattttaataatatatttgtcttggggtgaaaatattactgttttttttctacaaactcaaaacgattataatatgaagcagatggagtaataatgcccttgcttaggaaggagtgaagcatcatggcccctgcatccaaaaaagattagattttacaacatactccctcctttgttcagattcattatcttagaatagatcacatctctatcctaggtgattcatttggacatagggagtaacttgcaacctaaaatactccatctttcctacaatatcataacctaaaactggatgagacatatccaaatacaacaaatctaaatagggttttgtccagattcattgtataaatatacattcaatttaagattgttatagtttgggacgaaaggagtattacttttgccactaagaaaaaaaataatttatcctgcatgtaacaaagatcaaacaatgtatgtttaccaggctcatcaggttctgattaataattcaatttatctttccatttactccctctatatttttttgtttgacgttggttagctcaaaattgaactaaccaacgtcatatatttgtgcaaggaggtagtaagtcttaaatacgtaaaaattacaatatatgactaacatatttggagaaaccaaaatatgaaataagtctaatatttttggaaggagggagtagattctagtgtccacgaatatggcttggttcttgcgtccaagccggctttaagtttacagcccgcttctcctctctctcctctcttctctcctacacttcagcatttagtcagcttatagcctactattatacttgctctaaggctatgttaccttcaaacttccaacttttctgtcatatcaaatgtttggacacatgcatggaacattaaatgtggatgaaaaaaccaattgcatagtttacatgtaaattgcaagacgaatcttttgagcctaattgtgccatgatttgacaatgtagtgctacagtaaatatttgctaatgatggattaattaggcttaatagatttgcctcgcagtttactggcgaaatctgtaatttgttttgttattaatctacgtttaatacttcatataggttcgtatatgttaattttttttttgaaaagtaactaaacacggcctaatactaaccagtagagaccatggtatatttacctgtttccctagtcacagtcaaaacgattgacgcagtaacttacaagttgcccaagacttagaatatgagttcatacctcactatcaagactgcaggacttttagttattccggaatcaatatccacaattcgatctctgacacacacatagtcgcctatgaacactggaaatgaatatagagagaaacatttttgaaagaaataggagggattatgctgagaaaggaacttaattattttttaaaccttttttattttttaattttaaaaataaacccttcaaaatttatttccacaatctaaaccttttggtcacgctaaaactgtcacgcacgttgcaccgttgcggatggtgtgtcagtgatgttttaccatgccaggcgggctggcgtggccaaatgattcagattctagaaataagttttgaaatggttcatttgtaaaattaaaattttaaaaagttcaaaaaaaataaaaaaaatcatgagaaagagcatttctaacctaagcactactctccttctctatcaaaagtacctccccagggcttatctagcgagtctcgcttaatcaattcatagtttcgctcccagcgtagcgtgtgttcgctgcagcctgttaccggcgttagctatccattagcacgtgattaattaagtattaactatttttttaaaaaatggatcaatatgatttttaaagcaactttcgtttaatttttttttcaaaaaacgcgccgtttaacagtttgaaaagtgtacacatagaaaacgagggagatgggttgggaaacttgggggtaagaacacagccagtgtggtttgcccctcctacaaccaatttgtatggttgaccgatattgtatggttattctttgcttaattttttatatggaaatgctttacatcctagcctccgtgtacatagccaaaattttctcttaattggttagcaaaattgctaaaggacactcaaaaaatttgatcattgctaagaatgtgaatttgtccaacgacgcttaaaaaccggggcaattttctagtagacaccatatatattattttatgatttcctgctatttcggagagagaattttcacaaaactatagctttgcccttgggtgattgggtccaaattgctttcgtcgggggagaggtcaggcggtgggtgacaaggcgaggcagtcacatagcaaaggagacagtgggcaagggagagagcgccgacgacagagaggctggaaagctggtgggaaaccaagcgaagccggtgtcgagcagaggaagaagtccccctcgcctactcctccgacagcggcagcttggcgtgactgcaaatgatcgcggaagagggccacgatggtagaggggatgccactcccccatgtgtctgcggttcctagcaatgaagccgatgggttggtgcgggatccgacgacgttggaagaagctgagcgaagggcgccgtgacggtggaagtgaggatgggtcgccggtcgagattgatgcaaatcaagctggaatcgaggttgatcgacggcttgggaaggagctcgagggcgacaacagtgagagcgtctggcacgaaggaagcaaagatggcgaggacgaggaccgccacgacagctaggtggagaagcaggatgggagcccgatggcaccggctacgtcggccatgtcgaagcagatcaggtgggtggaggtgactaaaacctcttgagagaaagaatatgagggtaaaatgaatattttatatggtttctctctcctcaactaagtgaatgttgtattttaatactcatgtgttttgcagtaaattatcatactttctgagtactcgaacaaattcacgtttttacaatatcccctagaaaaaccacattctttgatttttcctgtagcaattatattatttttaaaagatattgcagcaaattaaagagcatatagatcctatccttgacataaaaaggagaacttcttttgaaaagatattgcataaatgaatccataaattagtcaataatgttgacagcatgagtcggcataacaaaatttgttggctcaattaatggatctcgattaatctgtcacatataaaatgtagggtccattgaatagcaaagtaaagatgattgccgtgtccttgttatatgtgtatattctcctatggtactatgctgtcgttgaaactttgattcagctcgcggtacataaacgggggaaaatacgtagtgcaaacacatatccagtgaaaatctagacatctgagattcattcacgtcaccatgaataaaaaattttactcgtaaatttactcatgagtaaaagttttagtgggagtaaaatttttactcatattgacgtggacaaatcatagacgtcctttttcgatccaactatagtttcaaattttcattacgtatgtagttttcaccacatattttctctaaaaacaggaatgcactccacccataaagtggactggcatatcgtacttgcgccttcactgtaattattgtggaaagttgttttcatgaaggtgatgtggcaaaaccacaagttgtatgagtatatagggtgtgtttagttcacaccaaaattagaagtttggttgaaattgaaacaatgtgatggaaaagttgaaagtttatgtatgtaggaaagttttgatatgatgaaaaagttaaaagtttgaaaaaaactttggatctaaactcggacatagctgaggtttttcctagcaagtgacagggttgaaatatccatcttctacatatgtgttctcatggttgtgtgtgtcagtttgggaaagtccttttccactggaagggatttccaagtaattatgcaattttttaaataaacaaaatatattaatatatgatatattactacataaatatataaatccagtttatgcaagttgatgggaaaaaacaaatatggccatcaatagtacacgtacttgttagattttaatttgtttttataacttctattcattaaatttggtcttatatgtatgtgagtgatataacttatatttatctgtgttattatctttttaagaaaaaatttaactattttaatgatatggaagaagcgaggggcatcttagcatctactcgagggaaaaaaacatgtcctgttcggtctagtttctgaagaaagaatccacaagtctttgtgctaaattcaaaaatgaaatcatggatttcggctgatctctctgactccctgtctcatctgaacttgctctatacggcagcgcgacgtgtgggtaaattagcaattgacaatgggcagcatgccactgttaattaaatcgtccaaatcaaagataagtgactgtgagtacgtgaccggctgtgattctctgttagtgttgacgaactgataggtcacggcaaataaagtgcaccgtctggaccttgaagacccagacagtgtcacggcaaaatgccccatcctaagggggtgtttgggtgtgagggaactttagggccagtttgttttgtgacctaaattagtcttataaatttttggcaatgccaaattttggtaagttttgacatgacaaattttgaaaaggcaaagttgtgcttggattgaagccaaaatagtctaagttaactattgaaatggcctattttcttaggcatgctaaaatttagcttcaaaccaaatagacactaaacactattaaaattatcaaatattggtaagccaaatttaggcctcaaatcaaaccagcccttagtcccaaacaccccctaaatattcgatatacactctccatccaaaaaaaataaacactcccaaaaagaatatatttggaacgaacttctagttttaatcatgagaaccctatgcaaagtaatactagtacctactccctccgtttcacaatgtaagtcattctagcatttatattgatgacatcaatatgaatgctagaatgacttacattgtgaaacagagaaagtaaaaaatagtaaacagaactccgtgatctcattattctagattctatcaaagtaaaattaaaatcacgcaaacataagtacattaggtcccatcgtttcgctttttggggaataagccaaacggcatatttataaatgaaaaataatttataagtaaaacttttatatacgtgtttttagtgatatcaaagcaaaggttgaaaaataaacttcgatgaaaaaaccctaaaattaaaaattcaaattttgaccgataagtataagcataagcaaagaaaggacataggatatattctatctatactactttaaaatataatagcagtgatgagatgaatttatcatcatcatccaactatcatgcagaacccacataaaccgtgagtccctgagataagattttccatattttcgattcccataggccacacagatcccatcatagaaaaatgataatatcttgcaagataataatagcattatctatggctaactgtacctaagaagttacagcaaaaatagcacaattacgcgagatatatatatatatatatatatatatatatatatatatatatgaatgaaagattacgatatatatattagacaacggaatagtttttagggacttaaaaatgcatatataatgagttattgtttttttaaaaaataactgtctattacaccgtacgaatattttgctagtccggacaactctaccctgaattttctgaatatatggatttagcattttcaggtgccggtaagtcttctcgctgaagattccattgccaacctgatggtacgaccgcacgcgcaaaatcttagccatttccttgcaaatgggcttggattggaaacctcccaatttccaagcaattcagagcattcaaccaacagctacgcttaaggaaagtaatttgaaatgttttttcatacttttttatgataaaaggaaatggtttgcattcccgccctggcctttggcttaagtaggcagaccgtcaatagatttttctacttatacatacttgtctggcgaaatttaaattttcaactttcaaatttagagttgattttagatttttttcatcaaagtttattttccagtctttgcttttaaatagataagaacacgtaacttttatttacaaaatacttttcatttgtaaatatgccgtttggtttattccactaaatgaaaagacaaagtgatgggatatatctctaggccgtgcaaaaagaaaccatctaaaatgctataaagaccacgtagattatactaagtaattttacatatcttcacataataagagaattttagctattgacttcaaaagtgtagcatcattacacatagcattatactacgtctatgataacactatactttaagtggatatcccttcgtaaccttgttataacatcgaataatcataatctttttcaattcgtttaacgattattcgaatgacatttgaaaaaaaatatatagatgaatgttatgtgttcgctataaatacagcacaagtgtaatgtattttcagacacaagttgtacactgggaagctagcagtgaaccgcgaaccgcggatacaatggctggctacgtcactattattttgttgctgttgctacccgcggcggtgtccggcgcggcgagcggcggcggcggctgcattggcgccatggtcgacgacacgagccgtgcggggaaggaggagaagctcgccatggaaatggccatggaggacttcacggtgagcggcgtggacgtcggctcgccggcggtggcggtggtgctgtgcacgatggcgtccaatggcgacccggtgcgagccgcctcggcggcgctgtcgctgatcaacgagaggggagctcgcgcgctggtggggctccactcgtggcaggaggcggcgttcgtcgcggagatcgggaggcaggcgatggtgcccgtgctgtcgttcgccgcggcggcggcgccgtcgacgtcccggcggtggccgttcctcgtgcgggtggcgcgcggccagcacgcgcagatgcgcgccgtcgccgcggtcgtcgggtcatggcaatggcggcgcgtggccgtgctctacgaggacgccgactacggcggcggcgccggcgtgttcccgcacctcgccgacgcgctccgcgctgtgggctccgaggtcgaccgccgcgtccccgtccccgcgtcgccgtccggcgacgccctgcggcggtcgctcggcgacctcatgggcgggcagtgccgggtgttcgtcgtgcacacctcggcgaaggtcgccgtggcgctgttcgcggaggcgagcaggatggggatgatggcgacggggtatgtctggatcgtcaccgacgccatcgccggcgccatcgactccctcgacgccgccgccgtgtccaccatgcagggagtcatcggcgtgaggaatcatatctccatggacaccaactccaagaacaccagagaccgcctcatcgcgaggttgaggaagaggttccggtcacagtatcccggcgacgacgacgacggcggcggcggcggcggcggcgacaacgacaagacgagagggccgcactacccggctctcctcgcctacgacaccatagtcgccgtcgcgtcggccatgcggaagaccaacgccaccgctccaacccgcgccaccgatccgaatccaagctcgccggactccggcgagacgatcaagatcgccgtgtcgtcgaacgggaccgagctgctcagggaggtcaagagcgtccgcttccgcggggtgagcggcgagttcggcttcgtcgacggcgagttctcgccgccggtgcggttccagctgatcaacgtggcggcgccgagataccacgagctgggattctggtcgccggagcacgggttctccaagagcgcgggaggctgcagccaccgcggcggcgacggcggcggcgagtgcgagccatcgatgaggttcttggggccggtgatctggccggggaagccatgggacgtgccgagggggtgggcgccgccggcgaacggtagccccttcaccgtcgccgtgcccgagaaggccgccttcccggacttcgtgaaggtgacgcgccaccatggccgtggcggcgacgacgacgacgaaccgagcttcgagggcttctccatcgacgtgttcaaggccgccgtcgaacacctgccgtacaacttccactacaagttcgtctccttcaacgggacgtacgactcgctcatgcagcatgactacatgaaggtgatctatccatctagctctcactcctttaaaaagaaaatttccggggccactttatttttgaaaattgagccatgtgtaaaattacagagagaatcccttatataccactccaaattaaccggttcccttatatgccacttcaaattggtttctcccttctatgccaccggttcaagtttgtcatcccttttatgccattgccgtcactccaccgccagttgaccgttaacttcatagtaaaaagacgcatttacccaagagttagtatacaactaataataagtattttagtacaattggatacaacatatgaaaattaattttttttcatcacatgcaattttagccatcatcatcacaaataatttttcaatataagcatgaaacatgcagttttccaacaatatttttaatacaaagagcattttcactggttctaacaaaattttgttcactctaaaatgatttaaaataaattagttatgtttttgtaagtttacacatttttttagttgagagggcatattggtcatttacgaaaaaaactaacatttgactaacagtcaactaacactatagtgttggaagtggcataaaagggtggaaaaacttgaaccagtggcatataagagagaagccaattttgaatggtatataagggaactggccaatttctagtggcatataagggattctctcaaaattcaatcatcgatcctaagacaacctcttcgtaggtatttccttagaagaccctcatgtgaaaataggaatatttttatagacggtggtatttggttatatcagacgtatacttaaaagtcctcacatttcacacttccccctcacttttccttggctcctcctctctctttactcttctccttgaatcgacttatcaagcttttcaaaggtcctaagatcagttgagctacgacggataagtagcagaaaaataaacaaaataatttatggataaaacttttatatatgtgcgtattttagtggttttaaaagccacatatgtaaaatactacattgaaaaaccttttcaaattttaaattcggctgtagctaatcagtaataaccagggttttaaatctcccgctaaactgccgctatctctcgctatagctgtttatctatttgctcttatgtacaatttttagccgctatagctccatttagtccgctatagctgctatttaaaacattggtaataacccaataaaaataaaccattaaaagaagtgttttttttatacagagctatgacatccttgtcggcgacacgagcatctcatcaggaaggtacaaattcgtggagttctcgcagccgtacaccgagtcaggactggtgatggtggtgccatttagcgcggacacgtgggaccgttcgtggatcttcctccggccattctcgccggcgatgtggctcctgatcgccgccgtcaggctgtacaacggcgttgccatctggctcatggagcgcaggcacaacggcgactaccgcggcggcgtctggaagcaggtgaccatcgtgctctggctctccctcgccgccctcctctcgccgggggagaaggagaggcggctgaggagcagcctctccaaggcgtccatggcggtgtggctgctcgtcgccgtcgtgctggcgaccaactacacggcgagcctgagctcgctgatgacggcgcagcggctggggagggaggcggcggtgacggcggagtcgctcaggtacgtagaaaaatctaattgttgtatttttgatgttttctgatttgttacatcgaccctctcaagggtatatgtataggagtacatagagtatatgtaggagtacatagcggatagagggagtacaatacaggtaagattatgagtagatttatctctattactccatcttatctctagaattttatctctaagactctattttatctttagaattttactttatctctatagtttatatttgacttttatctctgaccgacgtatttctacttctaacaaggtccgccgccggcgcggtggtcgggtgcaccgagggctccgtcgtcggcaggtacctcgaggaggtgctcatgttcccggggcaccgcgtccggaggctcgccggcgacgaggagcaccgccgcgcgctcgtctccggcgaggttaaggccgccttcctccgcgtgtcgcacgccaagctcctcctcgccaagtactgcaacgagctgatgaccaccggacccgtctaccacgtcgctggccttggcttcgtaagcatccatcgccacatcgcttaatattgcaaattaattaatgagtagagtgtatggccgatacttaaaacatattcggctgtgtcatttaggttacgtttatatatcttatgcacgaagaaatagatgatatataagcgcatgattatttaaatattaatttagaaaacttgataaatagataaatatatttttaaagtaattttcctatcgatttgttttaaaaaattgtttgccattattagttcgataagagtgcaaaaaaaatgagcgagttagaagctaggaagaggggttgccaaaagcgaaaaatcaaaatgtagatttagcatcttaatcttgtcttgtgttcacagctggttttgtttcaccacgtggagccatcgcaagttagggtttatttggtacagatttagctttagctccacctcttatagaactggagtctagccaaacagttttagtttcatctaaattagaagcgaagaaacgctctcacaaaataaactatatgcctgctcccacaatttcactccaaactcaattactagagctaaattaaaaagttgaacctctaccaaacaagcatctagggtcacccgtgaaaaacattagagcgctaattctgtatttcgagagtacacgaagccaagggacaccaatgaataattaattagttagttaagcttaattacagtggcttaactctggatcaagattcaagagttgattaacctacaaatttatagggtgtgtcgtctcaggtgttccccaaggggtcgccgctgctggccgacatttcgcaggcaatcctcgaggtgttcgagaacggcaccatccagaggctggagacggcgatgctgtcggcgtacaactgcacggcggcggcggcggcggccgccatggacggcggcgctggcgacctgtaccgcctcggcccggagaactactggggcctcttcctcatgaccctcttcgcgtccaccgcctcgctcgccgcctacggcgtcttcttccaccacgacaccagctgcggcagcggcggcggcggcggcggcgccgtcatcaccggcggccacaggaagcaaggtgatggccgtaaggattctgccactgttgacccaggaggaagcagccatggtgatgaagcaccttcatcagcatcagtcacagctgggcatggaggaaaggatacagagatggtagtaataagcatggcatgagagcttttacttcttgcttgcctcaacagaaataatgatgaacaaatttgtctgggattatgtcaatctaggcacaggtatataaacaatgcgtagcgttcaggaggatcacaccagaacaagaagatgaatgttttttttttcttttttgtatttacaccaattctgaaaagtcattaaggcacaatgtatgcagacagaaggtctgcttgacagaatctatctttctgaagaaagaaaaaaaaagatcatgagaaaagggcaaagactgactgcaaatgtgcatttttatcccactatattcacaacatccaggctagattttttttcttatctgttccccctctaatcctatgtttttatgtgacaaaaggaactacaagaacaaacaaacacgacccagctaaagaataaagcactgccaaatgctaccgccaagttagccctggagaactagccttggcccgagcatcagccaacgaaagagccatggccagcatcatctgttcttcgaaactatcaggaatactgccagcaccagtgtcggatccacctgaattggcagctccagcctctgttgtaagatcagagccggtaaagctgctactggcctcggccatctctgaccaccgctcattagaatactccataccctcccttgtttggtgcattttgttgctcgatggttcctcagacctagcgcctgaggaaccactcccgtttatgctcagatcctctgtaaaagatctgtctgacctgctgagaatgtcacatcttgacgtgtggcaagtagcggtgctagaagcttctccatacatctgctgttgctcggctaaagctgcgactgcacaagcaaatgcactactggaagaagctgcttcagctggaattgtcatggaaccttcaaagcttctcggaggatgtactgatgagactgtgttaccacaggttggatttcccgaggcttcctgatcctgtttaaagaaacaaagttcagactgaaacatgtaagcatggtgagtaatcctgcatttactatgaagtttaccaaaattaaattttatttatttcttgaaagaatgcacgctttctactgaaagatatatatcgacaaacacaacaaatgtgtgtgcataattgttacaaaaacgagtgcagggatgcataattgtttgtgcaggttcacgtatcaagcactgaaccaagttcaggtttaattcaagaagcaaacactaaatttgcacaaactcaaaaggatatgataatgaaatatatacaaatgagatgaaacagacatattataccaatgaagatggtaaatgagtaaaagatgtgccccactaaaaagaaataggttatttctttaaaaaataagttaaagatattatttatttctacatgtaagttcagcaacatcatttttatgtacctgcagagaaagccaaagtgcttcaacaagcataacttcgtcaggatccatgtcaaaattattattcctgcgctttaaggaattcatcagtaattattcccagcaaatcagcatttgtggcatatactagcaccataaaaggaacacattaattaaggaaggagaagtggatagcagaatgtcatcaaacaggtgtactgtggaaaagaaattttcagaacaaatactcatttcaatatcaaaatcacccacaaacaaattaacgttctgaactttgcagaggccataagctttcagattatacatgtttgcccgttatacttcttacataatagaatgatttctagataagtcaaaaacaaaaataactatcatttactacacatgctgtggtgctgcaacaaacattagatcaataaaattgaccccccccccccccaaaaaaaaaaaagaagaagaagcaaaagtcagagcaccaaaaccaagatttgaaaggcctgtacttatctagtcgacggattgacaaaacaataaaaaaacatctcaggaaaaagtcttatatttgttttgtcaactctgcacgttatttaatattgtctccaattccaataacggacagaattcgtccctgaactatcaacaccatacaaataatgtccctggctaagtacatcagtggttttgtcctgaatggcatcctattgggctgaatacatgggaaacaagtcacaaaaataagaaagtaattggatatgttagataacagattatccatttaggtttattattttcatccccttcctcgccatttgttttctattaaaaagaaagaggaaaaaaactaatatgtgggtttgcctgatgtggtaaaagacatggcaaaaaaggatggcgcggcactcaaaaccacttggaaaacatgcccaagaacatatttagacgttttgatagttgactgatgagttctggctaatattggagttgagggacgaaaacttaaactatttgaggattggagggaccagatatagacatttcagatcttaaacggtagtcagtcattgagatactgtcatgactttgatctaaattgcactgatgcaacaataagcagctacttttacagaatatcaagcacaactcagtaagcagtacgaaccgcatctgctttaagcgttcagaagtcttcagcagtaactccgcatgctgcacttgagatgagagcatatcactgccttgcccactgcttttgactgtcaacataatagacagggttagagattgcatgacaaaagaataactgagaaacaaagttagcacattccagtgcatatacctgtggtggatgcgccaccagtatcacaatgttctacttgtgcagttgttaccacatcggtcaaagcagcagcctgcttcttcttcatccgctcagcatcgtcctggagctcctgctgccgcatccggatctgcgcctcgatcaccctctgctcctcctatccacaccacaagttccagctccaaccattggcaaaaatacaaaacatagaagacaacactgaacgaaatcatgtcttgcggacactcacaatctgctcagtgcccttttcctccttcgtcttgacaccgcggtactcaaccgcgtaactcgccattttgcagtaagggcaccttacaagtcaaggaataaccaaacaagatgacacataatacatggcacgcacgcaggattcctaacatcagcaatgaataatagcactgaagaacatctaagctaaacaaaacaaaaaaatctacaagaatttgggctaaggatactgcgtcggccggcacgaggtgggcgtcctcatctggagaaaacactctgcaggcagcagaag

SEQ ID NO: 82812 - DNA, 2594 bp, Oryza sativa
aaccacaatgaactatttaggcctggttttttaccggtttggtgattttggttaattgctttagtttccgaaaatccggaggagaagcgtttacgttgagaaaggttcagaagtgtttgaattagctcaaggcaagtcacacagatctgaaacaaccctttgagcatgttgaacctggttaaagctaatgttttatttcaacttatgcatattttcgaatgtcgtgggtggtgagctttcccagttaataatgccgacaatgactttattttctatgggtaataattgaatagcttggaccttatatattggttgggttaagctaggtgctatataggtataattgcttagccatgcttagaaacattagctcattaatggggttaatcatataaggatattacttatggttatatttagtggtagctcacgatggttaatcgtgttatgataattaattgatacataaacctgattaaagtgggttgtgagtacatggttttgatggtcgtgctcataacaattaaggaccgtttcacgagctactgttgtgaaacatttaccgtgccaaccacaagccagcgtgggcaacggctttaccttttgtatagcatgattcattacggggtgccagactgtgaagcggcgagaagtccgtgggggtcgcgagggagtccattgcccctggttatgagggggagattatgatcaggaacggtgcaatgtggtgagttgtgttgtgtgagaggtattgtcatagttcctttccaaggtaccgtggtggtactgaggcgcatgctgacatgttgtggagttgtgtcttgtgggtacagtggtacatatctgatcagagtaaaactattcgaatagccgtgcccgcggttatgggtgggtctaacaatgtttttcgtgattagtctcacattactcagtattaatgaaaatactgtgataactaaattgactcttggtttggaatggtatatttcctagtttggaggtttgatttgtacacctaggggttggttgttcagataaggttgggcctatgcaacatgggtgtgttgtatagtgtttatttaatattgcttaattacataactgttttactattctctcaaatgtttattaaatgctgtttatgcgaatgagcttaattatgccatcctttgttatcctgtgcatttgcatatttgctgtgtggcttgtcgagtatatcatatgctcattcttgcaattttcattcttcagaggaggagtgcttcagtgaaggtgatgatcaggaggattaggctttgttcgggtcgagttgcttgtggagtggagtcgccaaagatgtttagtcttttgttttttttccgctgcgtagaactttattctttgagaggaactatccacctctgtaataatttattttgcacacattaattagatatttgatagtactctattatcatttgttattgtgtgcctcggctgattcctggatgagggtttaacgcacatgtaagcgtttggaattttggatagaaattccgggcgtgacaatcaacccctggatcagtagattgatacaggttcaacaatctgaatcttcatcgcatacatttgattaaggctccaatggaaatttctttacataaaataattgggtatttacaagattgtggctaactattactatagaagctataggatgagccaactctaatgttttgctatagaattaaaccatctatctaatctagagttgggaactaagttggaatgaaactaatttatatgattaaactcctggcttcggcaaaatctcaagtaatgagtgcatgaaatagtaatttcatgttttagggtaagccctaaaccctatacaaaaaggtccctgggcattaggtgaattgcatttaggtccataaacccacatggcaaacaaagcaattttacaaaaagaaccttacaagatttaaatttctactaattaaagtccttagcacctaatgaagtggctaaacagccgggcccacatgtcagtgactcggcggcaagagaagcagaggcagcaggagagcaacggcgaccaacagcgttcgtggcggcgtattggcttcatcatatgtgggcgtcgttctgctgggacctaggcgatgtcagtggcgcaatggtacagccggagatgattcgagttgacgggaatgacaaagtgggacgatggtggcgctctggacaccgggaacgccgacgagcgcaccaccaagtgttcgatctatgccaaaaaagaaacaaagaaaatggatcgatcaagtagagaaggaacttcatgaatcactactatagaaacgattttcctggatagggaccttttagattccgtgagggcggtatctcgttgcttctgggaaaatcgcctcatcggctctgttgtcaaacgcgttttgcactgtagttaaacaaaaataacttcgccgaacttcttccctcataaaattattttcaccatatttcccccctcttttctagaaatatggcccgcattttctctaagaatcatttttgtccagaacaagtcttcaataccaagaattttttccgaaacc

SEQ ID NO: 82813 - DNA, 14775 bp, Oryza sativa
gcccccaccgcgctcgcctctcctccgcccccgccgcctcgccgctgcctcctccgccgcgcttgctgcctcggccgttgccgtccgaaggagaagagggagagagagaatgagacagtgagagatagaagagataggagagagatagaaactgacaggtggggcccccctatttttttattaaataaattgctgactgaactgccacatagcccaaaccccccgcggattagatccaagggggataattcgtccggtttgtatagggggtgaagaatatctggttttcgcacgcccgcgatagttcgggggggggggggggtaattcgtactttttcctttttttaatccgatcgcgcctcccgggcgctttgtcgccggtttttttccgtgcgcttttgtttttctcatctggttttttattcctatctgttcgccacacgcctcctgtgttgaccgccatatcgattgtgtgttttctggtccaatttggttgcaaaaatcgatttctcattcctccctcatcattttctccattattttcactttagattcggcttataatttgtcagatttaatgtccgttcggcgatcatcttggccatttttatcccgagttttacattctgattttggaaaaaaggaaagaggagattgagtggataaaaaaaaccccaaccaattttgggtgatcgagaaagattcggccggatttgatgggggaacaaatagttttacactctaatttgagatgtttttatgggtactttgtacgtgatccgtgttttatgctatctgtgctacttaaatctccattgtctgttaaaaagaaaataaaagtctgactcaaagaggtaaaagaaaaagtccgactcaaaagcgataaaaaagcttgtgtcgtcagtaaaaataaaaaacaaacatctcgtcgtaaaaaaatcatccgacttccttaaagggaaaaatggtctcgccaataaaaaacaaaaaaaaagtccgtttggtttttttggcacggtttttttttctattcttttgcacgtgaaagagttttttttacgcacgcgcttaggctcttggttttttcatccgttttttaatccaatcacgtctctcggacgctttgttgccggttttttctcccatacgcttttggtttttctaatctcgtattttaatctgatctgttcgcgcacgcctcctgagttgaaccctgccaccgcgccgccgccatatcgattgtgtgttatctccttcaacttaattaaaaaaatcgattccccactcctttctcatcattttctccattatttccactttcgattcggctttaatttgtcagatttaatgtctgtacggcgatcttcctggcaccatttgtggctgggtcgaagggaagcgggccaaacggtgggagatagcggactcgcctagggctaaaacggaaggaaggctatcgcccctaaacacgggaaatattttcattaacttttttaattataatctatagagatcccaatattaggattctcgttaactttttcaattataatgtatatagcgaacacaatattttaatttattgctcagctcttaatatatcagtgaaaaaacgtctgtacctgtttcaaggcacaggtattatttctagtatatataaaatatatataaagtttatttgtattaatttaaagtatatagatatgtattgatgggactaggggtgagttgatcgcgccggtgtagcctcgtgtggctggccgccgatcagcagcccccccttggagtcggtttgagacggcaccgacggatcgggattcgagtggtgccgaccaggccactgctaggacccgtgttagcccaccgagtatttagagccagcttgacatggaattcttatatataagtacgaattacccttccctaaactatcacggtcgatcgaattatccccctcgacccaatcgagagcggttttatcctacggcatacacatgtcaatccaatgagcatttctttttttaatggtgtggcccacctatcagatatactctttcacatcctcttcccctctctcgctctctctctcaggcgtcgttgggcgcgggtcacgcggcggcaggcgttcggcgtgcacggcgggtagtgggcggcgccgcgggatgcggaggcagcggcggctgttgatatttattaacgacattactataaatataattcctagcaatgacaccgaaattttcttggtatatttatggttacagatatgatttgcaagcgcacggatataccattgtagcatttcacctagaagtaatctaagatatcgtatttatttaatcacaggaaaagatatgataagaaagtactatactaataattcacattacttgtataaaccaaagtctaagcaggggttaatcaattcatgggtaggataaggttgacacacagaagaaaaaccaaggtactcttcactaaaatataatctaggctaagtggagaaagaataagaaaagaatcattcctctacttcttttatatagttaatttagtttacacttgctagtatacaatcatgcaaccaataccccctaactatgccctcctagtgtttcgagagaccatatctgattgctaagttccttatggcaacccgtcatggccatttgaccggtaaggaatacggaggagtacccataccaggaaagtgtcttaggattatgtactattgtggaggaatatccgtaccaagctgtcaccatcagcggcccacctctactgacccgtagcatataaccctaattaatggtatcaaataatctaagcaccacgctcacactactaaatactactccatatcgttacagcaaacattgagcaatcatagaaatgaacattaaacccacaccaaagcatatctctggtaagctacctacacaattatattgaaacaagtacgaactaaagtcaatactcgagtaatatgaattaagtaaaagactgaaactatataaagaaggaagagctagtagagccataccaaccaaacccgaaatctcctgaagactcgaggactaagagaactactctattcctattccactagcaataggacactaaactaaacttgagagagcttcttgatcttcttcttgagtgtgtgttgaagtggggtgaggtccttatataggctcccaatgacggttacagcggttggaaatgtcgcaaaaaacaccgcagccatcattgggaagcaatcctggatgtccacgtggaaggagacacggtggagctgggggttcggccgaacccccaatcggcccaaatctttgcaggtttgtctcctaatgactccccagtccagcggtggggtggttgggcccatttgatattatttcattggatttgtaagcctatccacccataagtctacctctcgatggatttcgattgatggttcggttaatttccgttgattctcctccaattatgtaaagatctttgcaaacaaataaacttccaagtacaagtgttgatagattagtcttaaacaaaaatatgcatgcaagcatagctagttctcctttattttggatatattgacggtcgaaatgggtctataacgatcgacaacagcagcgtgggacgcggaagcggcggcggcacgggacacaaaggcgatagcggcgaacttagggagggagccaaagttgtgggtggcacccccatgtgcacgacttgcgctggtggccaccgatgcccaagagagagagagagagagagcgggaggagaaagaggaggcgggacccaacgatgcaagtctccaccgcctgtcgtccctcttccggctttgtcgacacggctccgatgaggcgggccgctcgctgctgaccaaaccctcctccacgttgctcctatcaccgccttgagttccctctcctagccgcgccctatccctgtcgttcccgcagtcgaccggttccccctcccatccgtgcgcgcagccgagtggagccacccagccatggttgcttcggctcggtgacgactggttcctatcttgtcacacctgccgctgctcgcctagccgtgcccacagccgctcgggggaggaggatgggaggagatggaggcggggggccaccactccggctccctcccggagttctccgctcctgcctccgcgtcctgcgtagccgcccattcctacgcactgactgcctattgacggtcattacagacaaatttcgaccatcaatataactaaaataatagaaaattagctatgcttacaatgcatatttgttttcaaataatatagttccacttgtacttggagaataacatgttgcaggaatttatcaaataaaataaagagaaagtaaagaaaacctcactcctaagcaagttagacgataaggtgggcccacatgtcaggtgtaaccgtcaaaaaccgaccttagctgccacaaccgcctaaaggacccacctgtcagtgaccctgctgaggctggaggcctgctaggctggcccaggttcggctgaaccctggttgctacggctcagctcggccctccacgtggatgtccaggatacactctcaatgacggttgtgagggtaaaatggaaaattcgcatggctacaactgtcataacggccctataaaaggaggagctcattcactctctcaacacactcaagcaagcttaattcctcttcatacattagtattagttgtatagtgctaagtggagtagtaaagaatagtgttcagagtcctcggagtcttcggaagagtttttggtatggctctagcaactcttgtaatcccttctgtaataccttctgaattaatgcaatactcttctttatatatcttcggtgctttgcttagtctgagtactggtcttactttatatctatattatattagttgtgtgggtagcctaccagagactggaggtgtaatggtgcgggtttaatgtctgatttatcagttgctctatgtcgggtgcacgggtatagagtagaatttagtaatgtaagcatggtgcttagactatgaaatatcattaattgtgtatatatgctgctggacagtagaggtgggtcgctgatggtgatagctcagtacggttattcctctatgttagtatatgttcctaagacaaattcctggggagagtactcttccgtattttgccccggttggacggccataacaggttgtcataagaaacttggcaacccggggtgatctctcgaagtaccaggaggacactcttagggggtattagccacatgattgcatattagcatatgtaaactaggatttgagtgtatactagaagtataggaattgaatgccttttctttattcttccacttagttagaattattttcattatgaggatttatcagctttgcttcgtgtcactttacccttatattatacttaacccctacttaggctttgacaattacaagtaatatatgtataaagtgcattagcaaaattcactcttattatcttcccttgagattaaaaatatgaaaccttggaatacttccgggtgaaatgctacaacggtagatccgtgcgcttgcggattacttctgtaaccataaatatatcaagactatttctagcgccattgctgggaatgaatatttgtagtaatgtcgttaagaaataccaacaagcttttctagcaccgttgccgaggaagattaataatgagatgactaagctaataactttatatatatatatatatatatatatatatatatatatatatatatatatatatatatagtacctctgtatgagtcgttgtcctttgcaggcaaaccttgattgttttcacttgtgtcgtgaaaacaaggtagtgtatgactggtttcaacttaccggagtgtcaagcctcgtgtcgtccctccacagaagagactctccgaaaagaaaccagccatccaagcatcaccaagttttagggacatggccgagaagacccttcgcgaattcgttgccccgtctgctgacaacgtgcctgttggcccggctatcaacatcggagacactgatttcgatcttaagagcagcctgataactacagtgcagcaaagcccgttctgtggcaagccgaacgaagatgcaagcactcatctgcagcaattcttggagatctgcaccacttacacggtaaaaggtgtcagtccggacgccgtaaggctacgtctattttctttctcacttttgggaaaggcaaagcagtggttctacgtgaaccgggcgactgttaacacttgggacagatgctccaccgcgttcctcttaaaattcttcccgatgggcaagaccaatgaccttcgcgggagaatatcaagcttctagcagactagggatgagacgattcccgaagcatgggaacatctgcaggagtatgtggctgcttgtcctcatcatgggatggacgactggctcattctgcagtgtttctacaatggactcactccctcgtccagagatcatctggatgttattgctgggggtgccttctcaaagacggttcatgtggccattgatcttatttagaagatggtatccaacatgggatggagtgaagaacgactccagacctgacagcgcggcatgcacaccgtcaaggagacggagaaacttgccgctaaactagatctactgatgaagagacaggacgaccaggagaaggccaaaccgcaggccactatcagggcaatagactcgcacttcacatacgaggtctgcgggaacactggtcactaacttgcacgtgcgaactagtggtggtgcgcatcatgattaatcattgacatggtggtggtgcgcatcatgatttcaccgcacaaactcgcacgtgcaaactcgtgacatcacttgtgcgagtttgtgagttcactatgggaactctatgacatgatgccgcaaaattgtgcgagttcgcgcgtggatggtgcgaactcacccgctgaggccagctgaggcctacatctccggggcactgattacgggcgctcctccccgatctcgcatattaaagcatatcagagttacaacgactcatggccggacgccctcggcagccgcttcctctcgcaatgctatgtcgccatacggttacaacaggcacacgccctctatttatgagagatccttggacagagtccaacatttactctagtcctatacctagtacaactccaagtcctaaactgtaaccgactatgtacacatattcgacacaaactctaacaaagtccatcttggcgaatatgccatgccaacctgaatttgctccttgcgtgaacctccgtgtaccaggactttagttgatcctttttcgctgctcacactgagccgcccctacaagccttcaccaggctcaccgtaaacaagagacaccgctattcttacaacttcttcctcttgactccacctgcaatagtgctccaccttttctcttatcaccatagttgtcttgccaagcgaaattggattccttcctagttatcacgtcatagacttcccgaagaccatattcacctccatctactatcttaagtttgacttgatctaatccatggccagataaccgatgtcatcaccaaacagataaatcaaactcaccagacacgaagagaaccctttcttccttgtcgtcttatgaaccgagctaataaatccaacatgcacgcttctccagcattcgtagactgaatacctgataattgagaaaaccatcgttgcttgaatcactgaaagaaattaccaccatagcgctcgccctttctcttcagtgacgcaggtctcatatatctccatcttgcaaacctcgcagattctggatataccctgtactgctaaacataccgttgacgtcctcaatgattttcacccactgttgcccgggacctctcacttgtcctcccacgactgcctttaccgaatcataccaaaacataacacatcattgccttgctagttgctacatgcatcaatctcacatatgtcaaggttctacaagaatcaagcatgttcatagacaaacaagctagcgcgtccttccctgtatacatgaggccacctcagaacagaagcttgtacgtgcatgcatagacatgcatacccgtccaccctcacatgatcacatatttggtactgaccaaactccaatgcaccacgaattaatgttccatgcagcccatagctttttgacgtgcaaacactttgactcaacaagccagccagaagaaaaaaaaccagtctgactagtactccgtcttgcatctgatcaatcaaaaaacaatccttctcgatccaccggcctgacttttcctagtcggactgcagcggctccactagaccgttccacgcacaaccatacatccccatgtgtgtgcgacatcatctcggacagccacgatctgctccaactacttcggcctcgggcccacaccgaaccatctctacattgcttgtgctccgcttggttcacgaattgctgcactacacaaaacaaacactgcctcatcctccgaaatcaatgccgcttccacctggaactgccgtcttcttcaccaaagtcggcctgcctcagaccccgccgacacctgcacgcgaccgcacaaaggccgtgctcctgccgcccggagtttgatgccaccgttgctgctccaccttgagcccgcaaacccactccgactttcgatcaaccaccaatcaatctagccgtgagccgaagccgacaaatcaccatgccatcttcccagccgccgaacgacccgagcgctacgtctagctgtctccttgtcgaacgcagctcatcgaaaggcccggtccaccccacctagagtgttcgatttcaccgatcgagaacggcgaccgcctccagcttcaaccaacccgagcatgcggccgcacgtctccctgttgagactagctcaccggaaagtccgggccacccgcccaaagtgtccgacccaccgattggatcaccaatcgcttccaccaccatcaacccgagcaccacgtctggtcgtctccctattgattgcagcgatcaaacggtttagaccgacgcctgaagtgttcaatccaccgatcaaattccgttgatcgccgccatgctacaccatccatgtccatccctggacatcctgtgcggtcgtcgcagtgtggagcacctccctcgcacctctaccttggatctcccgcaggctctgataccacttgtaataaaaccagtcccgatagcacaccgagaaccaaacgcggaaaaaacgctataggatatccaaacacgatgacgacacgaggtgttagaataggtgtcgaatatactagtcctatttggttacagttggacttggtgttgtaataggtgttaagggtggagttagagtcgaactctgtaactcgcaactctcttaaatagagaggggggcaccactatataaccatggcgactacaatgtagcgtacacacgcagggagatgatggcggcgtggccatggactcgtagcggctaggtgctatattggttggggaggagcacccataatcagagccctggggatgtaggcttcggctgaacctcgttagcaaatatcgtgtgttcctgtgtcgtcatctggtatgtcttgggtgatcaatgactgaagcgatcgggaagattagtcgtcgttctgctatatcaactaacttttctaacaagtggtatcagagcccaaggtttagaacccagtatgatttccatgggtcacagggtgggaaggccaagtaacaagtctttggggtcacatgagttgatgtgatgggggagattgttgggcccgaggccaggtaacaagtcttcggggtcacatgggttatgacagggaagattgttgggcccgatgtgtgacgggggtgattgttgggtttagtctcacatcggaaattgatgatgggggagcacgacttaaaaggtgtgggtggtcctcacccattagactagtcttttgggttgtgtaggcccaggacctaaagttgtggctctggttgggcctgtggtggagcaggcccaatgtgacctgggttggcctacagttggtgggccgggctatacactctaacaagtatcccttacatgcatcgtgcacacctgcgcccaccctggaacatgttacacgcacaagctatgcttgcacacgtatatggaacatgcatacaaggcaacatgcatgtatgtacacgtgtatgctaaattggaaagtggccaacatggatgtacatcaaggttcggttattctatcaatgttgaggcagccatgattggacagcttgcagtacacgattaaacctatgcaaaggacagctactaggcaaagcagatgagggcgctgaaagatcgaggagtccaggatattcccgtgagcgtgttcgacacagtcttggtgtcgtgctaggagaggccgaaggcaactcaatctctggttgttgtgggagtcatcgcactcggctgtcctatccgcgattaatgagaccgactctaattcagttgcatgtgctctttaaaagcatcgccagggtggagttcaggattaatagacgacggacgaaggatcaactcagcaagtcaatggctcatcggtgcggaggcttgaggtggtgtctgagtaggctcggcaagaaaaggaggctcgaggtggtgtctgagtaggctcggccagaaaggcctgtgaacatatccgaaggttcctagtggatagttcattggtctatgtcttagatcggatcacaagacgagactgtgaggacgaatacagacggtacagaatagaagggtgagtattctggtggcaacaggccagtcaggccgcgggtgagtattctggtggcaacaggccagtcaggtcgcgggttggcaagatgacgccgacaggtatgaaatttgatttggtgaaatttgatggctctggaaattttcgcttgtggcagactagggtcaaagattcgttagctcaataaggagtttcaaaggctttgaagggtgtcaaaccggccaagatggaggatgacgattgggaggagatgtagttgcaggcggtctctcatattaggtcatgtaccatgtgatggaggagacctgatgtaggaaggggcggatctgacagcacatgtgaacgttttcaatcaactagtcacagatcttgtgaagatggatgtggaagttgacgatgaagacaaggccatagttcttttgtgttcgttacctgaatcgaatgagcatgtggtgactactttaacgtatggcaaggataccatcaaaactaaatatatcacttctgtgttgctggctcgtgatcagttgagaaagaacaaagagggtgaaacatctcaagcggagggtttgctagtcaaagaagatcatgttgggcgtaaggtaaagaagaacaaaaagaagaagatggtgcagtgcttcagatgtgatgagtgggggcatataagcagggagtgtccaacactaaaggaaaaagcaaaggctaatgcagtgacttcttcaaatgactcagatagtgatggttgtgatcttctcacaatgtcaagtgcacagtctaaggatgtagaagcgttgatattggattcagctagctagtttcatgtgacaccaaggaaggagtggttctcttaatacaagtctggtgattttggttttgtctacttaggggatgacataagttatccggccgtgagagtaggtgaagtcaaaatcaagctagaagatggaggcgaacatattcttcagggagtcaggcatgtagcagggctaaaaaggaatctgatttcgcttggaaccttgcataaagatgggttaatattccacggaaatcggaataggaagaccatggagatcatgatgggcaagacaactgtgatgactggagagaaggtggagtcccaactttacaagctgcgagggtgtattgttgcaggtggagtctatgaggaagcggttgctgggatagcaattgcttttggtggtggcgggtctggcgcagattcatcgggcggcttgcggtgaagctgcaaagaagacaacccaattctagaggacatgtggatcggcatggtgattttactacttctaggtggcgtatattcgccaaggtggagtttgttagaataggtgtcgaatatactagtcctatttgaatacagttggacttggagttgtaatagttgttagggggtggagttagagtcgaattctgtaacccgcaactctcttaaatagagaggggacaccacaatgtaaccatggcgactacaatgtagcgtagacacgcagggaaatgatggtggcgtggccatggactcatagcggctaggtactatattggttggggagggggccccataatcagagccccggggatgaagtcttcggctgaacctcgttaacaaatatcgtgtgttcctgtgttgttatctggcgtgtcttgggtgatcaatgactgaagcgatcaggaaggttagtcgtcattccgctatatcaactaacttttataacacgaggcacaatatttgataacggaattcagccgaggcctatatctctatggcactgattacgggcgctcctccccgatccagcttattacagcatatcagtgttacaacgactcacggccagacgccgctggcaggcgctccctctcgctacgctatgtcgccatgcggttataacaggcacgtccctctagttatgaaagatcctatgacagagtccaactcttactctagtcctatacctagtacaactccaagtcctaaactgtaaccgactatatacacatattcgacacaaactctaacagagtcgaataacagtggtgtcggtcctctccttctctcatgtcgccttccccaactcttcccttccaatggcctctctccctctccctcgtggatctgtcgccggttgtcctcatccctcccctccaccaggcactccccctctctgtcgtggatctatcatcgacagtcattgggaggcggggcacggaggaggaggcgacagccatggaagggctagatccattgatggcggccatggaccctgagctagcgtggcgagagaaggcttcgatctaaatcatgttgtggtaaagcttcaatttgaatcacagctctattttttttatctcgatcccttctctcaagcaaccacaaggaggaatccgttgccattgccagtggccatgggagggtcaaatccatccccggctgtcctcgggaggggcggggagcagtggagagggcgtctgcttcatctccacgacctcgacagtgataatgttgatgaccaagacgtgcttgctgcaacaacggcaggtggggacgtgggcagcggtggcagcggcagtgcgtggacaccaccgtcgaagctaggttttgattttttttttgtatttttcattttttgcacgcgggcaacataactgactgcatgagaaacttgcaattttataaattgaatagaaaaaatgcccatacgttacaacgggtaaaaatatttttggatcactatacattatactccttggttttggccaaaatctcattccttccttccatttcagttccagctcagtccgctatatccgttcgtttggcctgcctctctttggtctagttcacaagtggagctataggcccagctggagtccacaagtggagctataggtccagctggcatagtcgactgtcatcttcaacctccagaagacagtcctctgtctgtatgatgccagaactaatcctctccatcaaatctagttgatctttttccatgtcccaaaattggttgagggcttttgattcactcgatcttctcttttcgtttttatcaaaatcaaagcgaatgcacaaaactcaggacaaaaactgtgaatcttaaatggagattaaatctagtgaattaaagcagaatcgaaagggaaaatcatggggaaaataatgagggagtagtagggaatcgatttgtgaaagggcttgtagtctagtggttacagccttggtagtaccttaggtcctgagttcgactccccataggagcgattttttcaggatttaacggcattgtgctttcagaggtgtctgtggtgacttcgtcaatctcaaggatttgccggcctaatagaggtagggtttgcgtgcgtgcgttgtgagtgtctgtattgtagtgtgtaattaaaaaaaagtaggaaattgatttttgcaattaattggaagagaaaacacttgggaggtagatgacgtggcggcagcgctaggttcggcccgtcaacgaaaaaacagtcagattaaaaaaactgcttgcacacacccttccgcgtgataaaaatcgctacttaataaaatagtgataaaaataaccggaaaaaaggcgagaaaaaaagcgaagtagaaaaaaaaccagaaaatagggatggaaaagaatacccggaagttttatgtattttttattagttatattgatcgataaattacaattttatgggtgtgtttagttatttgggtgtaaagtttttgaagtatacggacgtagatttgaagtattaaacgtatactaataacaaaacaaattacagattccacctgtaaactgcgagacgaatttattaagcctaattaatccgtcattagtaaatgtttaatgtagcatcatattgtcaaatcgtgg

SEQ ID NO: 82814 - DNA, 3931 bp, Oryza sativa
acctgagttagcccatatataattttttatgcttaacacaacaagctaacttgtcaaataggaaatgccaatttatgtgtttcaccctactttggttgattctctgataatgctaagctaactttgttgcagtggtttgaatacataagctgcggagctttcttgctttcttgtttttcttgcttgcaatattagtacacatggtaaacaggaacccaagttcacagttcatgtagttgggattgatcatagaattcactgtagcgaattttatatgattgataatggagtggccgcctggccggtggacactcatgttgcgccgtataaatatcaaatagaaacttacacattctgaagagcgaacaattgttttgaatctttctgacatgtgctaccacttgttttgcagagcaaacatttcctgtccctttactggttggcaaggttggaagacgtccgtttcctgtgcagtgttctatagttcgatgctgcttgtcatcaactgatgccatccattctacaagtgatgacatccatgaagataatggacacggccattttcttatgaagtctacatctgaccttcaggtatgatggtgagtcccatgatatatatatatttttatcctgttatgtttcacctgattcttaattatataatgctgtaaaatacccctttattcatttgcattatttttcttaaaatagtattgtatcatctcgatttttagtacaagtcaatctttactccttgggctaatgtttactgataacatcaaaacatcttttttcttttcagaaagtgatatcttcctgttttgggaaagcatgtcttctcagttctgtcatgcttgttctaccacccagttgtttcgcagaaccgtgtgagccagagtactctctacctaacatgcctttgctttttgcaattgccatgattggagctaccgttggaggtaagatcattacaatatgaagtacagaaatgatggaggcatgtagaaacatgttgtggatagcaaactggatataacattcagccttccagtacacaattttcttatatatctacggcatgatacttattgtgcagaatggtttgaagaagattaaggtaatagaagagagtgagagacaaattggaatgagagaattagaagtattgagatatagcaaattgaagaagagaaatagttattatttcttaaccatcatccttgtattgaggatgttgctatgaacacatagaccatatctccaaatatccattactcaagtctccctgaaggttgttttggcctcttgttagtccctcccatccagccatggtgtcctaaccctcctttttattgtgtttatccccataagtccactgtggtgcgtacaatcctttcactttttgaaaaacacatacctggtacaccaaatgtacattaatgaaaatttcaataaaataattccaaaggagttcatatgtacagtacacaactaaaagctaatactttcaaattaactgttcatatttgattggttgattggttaatatttaaagtacaggcatacccactttacctaatgtttgacatgtaatcccgtatagtacacagaatagaccgattcatatggttatcatttacacacatcctaagttccaaacatccaatcttgttttgtttcttcaatatattgttatttacaattgtaaaaaaaaagcagtaaataacacaactctaggcttgaggcatttcacgacccttagagaaatattaataagtgcatgtgctgagaatgtgaattgtcgctcaccaatgtgggcatatgctaaaaaaaagagtttaatcctattttttaataaaattgcaaaatatgcattatagatgcctcaaagcctcaaaacccagagttttgtgaatttgactgtaaaaaatatcatctatctgtgtgtattctagatgtcttgcctcatatatctttttagcttattgttgcttttattcatttctgatccagtaccagttataaagtcttaaactggaagtgtgatatcatcagattattcaattcgcatgtttccatttatctatgcaactatgtgggccagtatagttggtacatcatactacttcatcctctttaagttggttttactatttcttaatatgttgaaaaatttagatatcctgtagggctccttgcaagacaacggagaggggagcttaaacgattgaatgatcagctacgtcagataaatgcagcactgagaagacaagccaagattgaatcttatgctccttctttgagctatgcaccggttggtagtaagatacctgaatcagaagtcattgttgatccccagaagatcgcttaatttcatatctgagggctgggaagaactatctgagaaaccaagcccctgataaggcatttcctgagtttaaggctgcttttgatcttgcacaatccttgggtgatcacgtcgaagagaagaaggcggcacgtggattaggtttgcttcccatcaataatttactttcatgcctttttccatgcacgtttgaaactggatgttataatagccaccttgattgttgtagaatcccctatagattgctttttttatgaatgaacgtttttgaaatgctcgataatgagacacatgttcatatttatgctgattcctgaaggatcttttttccatgttcaataaaaattcaagaaatgcgacctgcaaaaatgaaaacagcaaacaatctactgatgttcgttttttatttgcattctttaggagcatctttgcagagacaaggcaagtacaaggaagctataaagtaccactccatggtgttgaacatctctaagctgaccggagaggacgcaggtgttacagaagcctacggtgcgatcgccgactgctacactgagcttggtgagctcgagaaagcaggcaagttctacgacaagtacatcgcaagactggagaatgactgaacagatttaaagaaccgtgtgtgcaacctttgagagctcaagtagggctgtgtcccatcttttgccttctttggcctgtcttgtagcaacgtttttgtagtggacgctcagttcatggctgtaactgaggcacatgccatctttcaagttatttctactaaatagtgtcatcagattttttttttctttgtctggtcaagatcggcaccatgttgtgtaaaatttctccatctgttccaagttataagcatggctatgtatctggctatgcttgtcctgaatcaggaatgcttatgttttgaaacagaggggagtagttgtagcagcaggaaggcttgttcttaaccttgttttagataaaaggtttgcaaaaaataatagctttaattgttttagataaaatattcgcttgagattttggggagtgacggatgacaccgttacctatgttatgcagttttttccccctaaaaaatggttataggttttctgtgagtttgaaataattggcctagccaatcatcctttcagcgatacaaattcatcgttctggaaaataataggttatatagctgctagtttatgtcccactaaggatgcttggatttgatatgattttgcccggaaattcttgagcaattcaatcacaatactacatggagattttccaacattgcaacgtcaaacactacatatgaagtcacctaaccgaatttggtttagtataagttataaccaaggacgcatatactgtgcacgccagagaaacttggaggtcaaagatatcttcttatctgttgaatgaacatgtacgcatgtgcatactctaaataaatacggactaaataacacaccttcgtagaaattttgccatcaagggtaaatatttcttgagttcacaaacccacatgacgctttaagtgggccaagggaccatttt

SEQ ID NO: 82815 - DNA, 5115 bp, Oryza sativa
gtgatccactttagtattcatcaaatggaacgcagaaataacatggcagcagatctctcagaaggaaaaaaaaaaagcaagcgctgcatcagccgtcaatgacattcaaaacggtgatcaggtaaactgaagtgtggtcagctacgaggccaacccccaccagaagagcctagctgtcggtacgggtattgtggaacccctcgtgcactgtagtttgtatcctctaaaggtggagcatacttgtccataaccgagcttccagatgcacttggaaccagggcgtacatgtccataactgagcttctttgtgcacttggagccaagaatccaggagcatacttgtccataatgctatatggtgtactcgtaccggggagtccatatgaagatgtttgctgaccatatgtagcacctgaagatccaagggagtattgacttgtctgtaagtaaccatcagcatgtccaacatgcgttcttggatgtgcctgctcatgcaatgttgatgggaccctactggtttgtagataattatcatcaccaacttgtcgactgtaccttgtggggtgtccatgcaaaggtgcatcaccagttgtgctctcaagagaattagtgttcctgtcttctgagcgctgcgtcctataaaacctgtcactatctcttagagattgcaaactgtacacgttgccagttggggcagtgaaatgctgcctgttcacttcgaagtcagtaccagggctgaacttcctggagatatcatcgatattggtatgaaatggaggatcaatcttcccttcaaatgcattgttgcattcattattgcttgctaaatatctgccctgataagtagcctgcttagagacaagatgttcttttggaggataactaataaaactatctcgacctgtactcttatcagcagggtgtccaattggaataaaaggggaaccgcttctggatttgttttgagcattactggagtcagaggatgacatgctcatgtcagagttcgcttgttctgtgaatttggcacccataatctctgatcctctatgagcatttaatctgtctcctgcatctagttgtttttcttggtgagtactcttcttgataggaatagccattctttcctcataagcaacttccacttgtttttctggagggaggctcccatcaacctgatcaggggttcttttcctgctcctgttatgagtgctattgctttcatccatgctatgctctttctcctttcctgattgagagatttgctggtaattagtctcagcttgtttcttcacaggaaggctatcggatctatggtactctttagctttcacttgtccatatccagcttgtgtcttcacaggacgatcatctgatagaataacctctctgacatcgcatgatgtcttctctgtagtctctttctctttgcctggtccaacatttcgtttgttgccagcttcagcctgtctcctcacagggagatctgatagattggtccctttgagattgcatgaagtttgtcctgcattctcctctttccctgatctagagttatgtataccataagattcagtttctttcatcatagggaggttatctgatagattatcttcttcaacatgggaagcgatcctccctatgctagtgtggttatgctcctcagctactttcctgtgcttccttgtccaatcaggatggctccataaatggagaggtggtgcagaggcattccacccttcaactactttatcattaacatcaacagaaccaggcaaataaaatgcctaaattacaagaaaaatgttaggaagaacgggtatatgataaaaaggggaagtttaaacttcaataaattttcctgacggtctttacctttcccgaaagacaatcactatcctcccaaatcaaatcataaggtgtcttcttttgatccaacctgatggccaaagagtggagacagatatggaagtaaggaacatacgttacaccaaaataagtgatattatgtcattatgtgaaagcaatatcaggtgaaatctattttttttaaaaaaaacatagttaaaatccaatcagccccaatttggcccaggcgatcagatgcttcacattaaatactttagatcttcacctgatattttgccatgtgttagtaagacaagttcaactcaattttctaaggaatgggtacgtgttggttacctttttgtttcctttgggacaatcaatataacgagcttaggcttaaaggtcaatgccttgtcaataaatttgttcgcaagagatgctttgactccaaaaggaggattaagccccattatctaatcaagaagcaatcagatgttataattattttaaattagcaaatttgagttaaataatgtccaaattaaacatactagtttggatccatgaggcaattcttttggccgtacagtcatccaatctttcctttcgaaggcgaagcaattctgcaaaacacatacacaatgcatgcttatcagaatgtgcatgatgacctgttaaatgctaatagacttcactttctggctatgataatagagtttggaactggctgagttctaacgcatttgcattgaggagttctatttaatataaaagaaagcaatggcattccaaaggatcataaaactcagattttttttccccagaaggaaaattgaatgaaaaatgattgatggcctccattttacctgcggctggataagatcataattcttgaaatgacacttcttctggactttgtcaagtttttctttcatcaatcggctgaaatcatttgcaccacagcagaagtccactatctacagttaattaaatttaaaatgatcaaggactggtgtaaaacacagcattggactagtaatgttatatatctgtttcagtcaagggataatttttttttaattagaacaatattttcagaccaaagaccatatggtccagcttctattaaaagctgcaaggaacaagtttcttttgcacgggacaccagcttacagtgccgggctgaaagcacagggacctatttggggacaaccatccatacaccattcgaaagacccaacagaagaactcagagataacccagctcgatttttatgagaacagtaaaggtgagccatactcaaatatttatatcaatataaaggtgtacaattatcatatgataccagatacaaacgtatcaaaattgaatattgatatggataaaagctctaatcattccttaaagagcaccaactaagataacctgccaaattagacagatcactactactatagaagtgcaggcactactggtagcttattaggccacagccattttattgtattacactcatcatatggaggatgtaatctaccaatgaataaacatgtgattcttgtactaaaaaatacataccgtgtcaccaggttccacgtagcaatgaagcttatcaacaatctataccaagaaacaagaaaagtaaagttacaactatattacccaatcaagagaaataacacataaacaagaaaattacataaaccacatgctaaaggttatgttagcagaacaccgcagatttattggctaatggcactcatccccaaggtattgcattcggttggttttactatggatcaatgaacgttgtcaacaaatttgtccctgcctccaacaaaatcctactaagcttagctttggttgagacacaaccacatgagacaatggtacagtactacagttgttcaccttgctagcagacatcaatttgaacacaagcatatgctacattttggctctggttaggtctatgaaaatttatgaccacaagccttgtttgggtgcatttagacatgaaatttggggttctctagagctatgaccataaatgtgcagttttttttctcgaaaatgcaagagaactgcgtttcatttcattaaggggaagaaaacaaagcgaagataaatgtgtggttttaagcgatgtattataagaaatcatggaagtatgcatgaggtgatgactgcaagaaatcagagtcaggttttatcatttgtgtttagaagtaatatccttgacaagtttatggtgtccagccaaaattttcctagggaagatccagtttgttcgcacttgtttccttctccttaagtcattgtatgtatagtgaataataagataagtctttataagacatcaacatagcatactgacattcttatttgatgatctacagtgaggataagaggattaggaaaacatgtcaaaaaatctgctccctagccagatggcaaaaaaacatattctacaatgttttttttttaagagcaagggttttcaagattctatatttgaatcaggtatataacacataaaaaaaagcatctattctacaaggaagaaagatgtcatttatgccttgaattggacctttttaaaaaggcaaaaaatcagacaggatttctggtttttctctactttcttaaacctagtctgcaatatttcatttttttttgaggcagaaaacacttctcaacaaattgcacgcaagtgtgtgtgtgtgtgtgtatgtatatgtgtatgtatatgtatatgtatatgtatatgtatatgtatatgtatatgtatatgtatatgtatatgtatatgtatatgtatatgtatatgtatatgtatatgtatatgtatatgtatatgtatatgtatatgtatatgtatatgtatatgtatatgtatatgtatatgtatatgtatgtataaccgcagttaaatgccaatgtggttatcataactcataaagccatcagccatgctagaaaacagatgagaggatatttgtttacaagagccatcacaagatgacacttagattgagactggagactttcttttcaatgaatctctgcatctaacatccggtttgtggtgcctttccaaatagatccggagggttaataggtatatagttacgcatttatatacaactcactatcaacatatatctggattcaagtatacctcaacaagcttttccacctttgtaaaatgccgaccaaacgaactgtagcgagtaccataaatgaaaggtgatatatatact

SEQ ID NO: 82816 - DNA, 1467 bp, Oryza sativa
  unsure (1)..(1467): unsure at all n locations
ttggatttcagcacttttagctccggttcgtgaaggaccagagaagctttctagttatgaatcgggtatagaacccatggggggggcttggttacaattccgaatacgctattacatgtttgcgctagtttttgttgtttttgatgtggaaacggtctttctctacccttgggcaatgagtttcgacgtattgggtatatccgtttttatcgaagctttcattttcgtgcttatcctagttgttggtttagtttatgcatggcgaaaaggagccttggaatggtcttaactgaatattcagacaaaaaaaaaaaagaaggaaaagattccattaagacagttatgagtttgattgagtttcccctacttgaccaaacaagttccaattccgttatttcaactacactaaaagatctttcgaattggtcaagactctctagtttatggccccttctatatggtaccagttgttgtttcattgaatttgcttcattaataggctcacgattcgactttgatcgttatggattggtaccaagatcaagtcctaggcaagcggacctaattttaacagccggtacagtaacaatgaaaatggctccctctttagtgagattatatgagcaaatgcctgaaccaaaatacgtcattgctatgggagcttgtactattactggtggaatgttcagtacggattcctatagtactgttcggggagttgataagttaattcctgtggacgtctacttgccgggttgcccacctaaaccagaggctgttatagatgccctaacaaaacttcgtaagaagatatcgcgagaaatagttgaggatcgaactctatctcaaaagaaaaatcgatgttttactaccagccacaagctttatgttcggcgcagtactaatactggaactatgagcaagaattgctctatcaatcaccatctactttagacatatcttctgaaacttttttcaaatccaaaagtccagtatcttcctacaaattagtgaattaggaggagctnntgtgccgaaaaagaaagagcagggcaatatttcaaacttgcattcgaactgcgaaatatttatacaaaggaggagagatcaagataatgcagcagggttggttatctaattggctagtcaaacatgaggtggttcatagatctttgggcttcgatcatcgaggaatagagactttgcaaataaaagcagaggattgggattccattgctgtcattttatatgtatatggttacaattatttacgttcccaatgtgcttatgacgttgcacccggtggatctttagctagcgtgtatcatcttacgagaatacagtatggtatagataacccagaagaagtatgcataaaagtctttgcccaaaaggataatcctagaatcccatctgtcttctggatttggagaacttccgattttcaagaacgcgaatcttttgata

SEQ ID NO: 82817 - DNA, 4193 bp, Oryza sativa
  unsure (1)..(4193): unsure at all n locations
aggcaccagggctccttcctgccaagcatgcttggaccttctttccgccagctcaaagctttaccgcgnaaggttcttccggatcactagtcaacgtcacccgacagacactttctcctcatgggggtcatagggaatctggcaatactcggggcaaacctcgtaacttacttcaaatgccatcattctcagctccctgacgaatcctagcacctcgatcgagtttttcggcggatggggcggcatataaaggaacattgaaaggaaggaattaatgcatatttttaagttagctgcacaaactagacttaattaaattggacccaaagaaaaagaaaataaaagaaaaggagcaaacatgactcaatttttttttctttttggaacataaatcaaccttgaacagagacaaataacttttgacaaatgaataaattaaaactaaaatatttaggatctaccaggagcacggtacagagtcaccattaacagggatgagtagtactgatgccatcttgattgaatcgataccataatagatgtacagtgccgactaaccaatgaaattcagaaaattatactatttaataccctaaacagtaaagttctttttctttcaaaataaaagaacaaatttctgttttgctaaattagaatttaataaattttgtacataaccttgcatgtggtgccaacttaattaatttataagagaatagagaagagcagttctattttccaaaataatttgaaggaaacttaaggtttaccatttggcttgtcctaaggtcaaggtggctctgataccaacttgtcacgcccggaatttctatccaaaattccaaacgcttacatgtgcgtcaaaccctcgtccaggaatcatccgaggcacacaataacaaattgataatagagtactatcaaataattaattaatatgcgcaaaataaattattacagaggtggatagttcctctcaaagaataaagttctacgcagcggaaaaaaaaacaaaagactaaacatctttggcgactccactccacaagcaactcgacccgaacaaagcctaatcctcctgatcatcaccttcattgaagcactcctcctctgaagaatgaatattgcaagaatgagcatatgacatactcaacaagccacacagcaaatatgcaaatgcataggataacaaaggatggcataattaagctcattcgcataaacagcatttaataaacatttgagagaatagtaaaacagttaagtaattaagcaatattaaataaacactatacatcacacccatgttgcataggcccaaccttatctgaacaaccaacccctaggtgtacaaatcaaacctccaaactaggaaatataccattccaaaccaggagtcaatttagttatcacagtattttcattaatactgagtaatatgagactaatcacgaaaaatattgttagacccacccataaccgctggcatggctattcgaatagttttactctgatcagagatgtaccactgtacccacaagacacaactctacaacatgacacaactccacaagacacaactccacaacatgtcacaacatgtcaccacaaaaaggaatgtgtagcaccggaatcaaaaagcacagttgcgggtatagagttagtaggaaacgtacccaaaaccacatcaggtgtattctgggcttctgcggctgcaacatgattaacacgagccttcggtgctggagcattggagttgttctgaacaggagcattcttcacacgccgaggcttgggacacttatcagcataatgtcctggatcaccacaattgaagcacacccctggcttgcttccctgttccttcctgacaggatgattctgagttggagctgctacaggacgagtgaccatattacgattatcgttgctgcgattaccagtgttgttgttgtagaactggcgttgagggcgagcaactgaagaggatcctccctgtgggtatggtgcagcttgaggtcccaaagcaatgtgcggcctctggctactaccctgttgtgccttgaaatgagcagccctacgctttttctgttccatcctattatacttgtcttcttggcgaatcgccttgtccatcaactgctggaaatcccagtaatccatagccatcaatgcataagacaactcatcattcaatccctctaaaaacttctcctgatgttcttcatcagtgcgacatcttctggggcataacgagctaagcaattaaagtcatggaggtactctgtgacagaacgggatccctggttgagtgctctgaactctctcttcttaagggccacaacacctgatggtatgtgtgtcttcttgaaagcagcagcaaactcccgccaagtgataggctgtccctcggctctgtttagacgaaactggtcccaccacttagcagcaggaccatgcaactgatgtgaagcaaaggaaaccttctcctgctcagtgcactgaatcaaatctaacttcttttccacagcatgcagccaatcacctgcctctactaggttagtggtgcttgagaaggtaggtggtctcacacgtagaaaatctgccaacttgttctacggaggtggtggttgattgttgttatttgcctgttggttctgcgcttgctgcactaacagattaatcaactcggtttgctgggccaaaacttgggcaagtgtgggatctccttcattgtgaccatttccacttccacttccacttccagtgcgggtgttcaccatctgaagaaaagcatgggcaaaaggaaagaacgacagagagatacccttagaacggagaactttaattaatttaaattctatattgctcttaactgtgtatgattacatttaaattgaattaacactatctcaccagctaacttactctctgacaagcaaaagaactaaactcatgtagttacatcccaccattgatgtaagcaacatgctaaacccacacacggacaagcaatcttaagctagcaaagtaacacagcgaactacagcaacggtctaactagacaactactctcgccttgcgtcagaatgaagagatggatcttcctcctctggagtagctggctctctttcttctaggtcttcctcttcttcctcatcacttaagacatggatgacaggtttagcatgatcaggcacagcgtctcccaccacaccagtcttcgaagctaactggagacgaggtggtggacgggttctcttccttgcggtgaggcgtagcttgggtgctggcggtggtgcttctcccttaagctcagctagttccttctgcagacggtacaccttgctctccaacttacaaatcctgccacggttccagttttccctatcatgagctgctttctcccgctccacgcctactgcatccatggcgctaagcatatacacggcgtgcatcacagtggcactaccttcaccttcgggacagttgtaagttccatagtcttgaccatgaggcttgtgtgggtgatactggaaagctgatgactctaactcctcatcaaagcgatgacgtagctctccaatggccaccaaggctgcttcctgacaagcatggctgtactttcttcccccagcttcaaactttatcgacggaaggtcttcacgatcactagtcaacgtcacgcgaacacgacacttctcctcattggggtcatagggaatctggcaatactcgggggcaacctcgtaacctacttcaaatgccatcattctcagctccctgacgaatcctagcacctcgatcaagtttttcggcggatggggcggcatataaaggaacattgaaaggaaggaattaatgcatatttttaagttagctgcacaaactagacttaattaaattggacccaaagaaaaagaaaataaaagaaaaggagcaaacatgactcaatttttttttctttttggaacataaatcatccttgaacagagacaaataacttttgacaaatgaataaattaaaactcaaatatttaggatctgccagcagcccggcacagagtcaccgttaacagggatgagtagaattgatgcctcttgagttgaatcgatgcgataatagatgttcagcgccgactaaccaataaaattttatntgtncgtgcattcgatggcattcatggcccgcg

SEQ ID NO: 82818 - DNA, 11110 bp, Oryza sativa
cgaattcgagctcggtaccccgatctcgatcagggaggaggagactcgcgtgttggcggtggcaacggaggtagccgggcgggtagcggcggcgtccctgcgagcagcggaggcgctgtggtgccggtcagaggcgactggacccgtgcctggccatgggcagcagtgcggtagtgcctcggcgctggtccgacattgaggcggagcgaggaggcgaggtcgctggtccggcggtggaccgtcgtgaggagaggaggcgcagagcgaggatgcgggcggggagagaggcgcggagcgaccaggcggaggagtcatcgcaccggggatttgcgcgtcgcagttaccgcgtcgggccgtgggggcgaaatcgctggtgggatgagatcgggccaaatcgctggtggatatagatctacggtgtacagcggacggctcagattggatgagagggtggatggacggatgggataagagtggttgatttcacttgtaggattgctaggggtgaactcctcctttttatattagtacagatgaatcctccaaagagattaattgcatattgccagttcctcctgacctattatatgcatgtaagtgctctctggtgcggtgcaacgacgagcaagagtgcgtacgtttatagtagaactgagggggtgcgccttatatacgccggacgagcaaagagtgcgtacgtttgtagtgacgtctccaattttagtgtctatggtagtgaaatattcgacgtttgacacctcaaaccggagaaaaactggagctgtgaaatgttttcttttttttatatgcgtggagctctgaaatattgatagttttgtttttttctattaaaaaagccaagaagagttgacgacttatcggtaggcgctcctcgatggagggagatgagcttaaaaagtttcagtaaatggacccatgcagtggaaatgcggagtggagtggagcagtaataaaatataaaatgccacgcgcagggcatctcgaccacgacaggactctccttgagatcttcgaacagtgtgtgcttgctagctgaactgcagcagtggaacagtaataaaatttaaaacggatgtgcagtgttcacagaggacgagtgtgctctgtgttctctgcttgtgaatagatatggcgatctctgcttgtgaatagatattgcgagtactatagtacgctacaaacacaactaagttaccttatgaaggactactcaatagtacacttaaaacattgttactcgttgccttttacatcgatttttccgtgccatcctcttaaaaggaccgcacgtgaaaatgagccgattttcccagaagcgacgagttgccgcctgcacggaatctaaaagggtccctgtagtagtgattaatctagccaactcgccactgtgaacctcatctatttctcacagtgttccactatgcaaaccaccaaaaactacctcggaatctccaagaacttccacttactcttttcacccgaaggagtttcatccatcgcacatattctctggtgagcttcaccgcactccaaccatgggaacgtgaagttccttctctacctaatcaatccattttctttgtttctattttggcatagatcgaacagttggtgatatgctcgtcggcgttcccggtgtccatagcgccgccatcgccccacttcgtcattcccgtcgactcgaaccatctccggccgagccattgcgccaacgacgtcgcctacgtcccaggaaaaagacgcccaaatatgatcaagccaatacgcagccgcgaacgccatcagtcgccgttgccctcctattgcctctgcttccctagccgccaagtcaccgacatgtgggccccggctatttagccacttcattaggcgtaaggactttcattagtagaaatttaaatcttgtaaggttctttttgtaaaattgctttgtatgccatgtgggcctatggacctaaacgcagttcacctaatgcccatggacctttttgtatagggtttagggtaagtcctaaaccctacttagagattactatttcatgcattcattacttgatataatagcttgatgagtatgttgtactcaccattgctttaaccctctctttgagaatcaatttggagtttttgctgaagccgtgagtttaaacatataaattagtttcattccaacttagttcccaagtatagattagatagatggtttgattctatagcaaaacattagagttggctcatcctatagcttctacagtaatagatagccacaatcttgtaaataccctattattttatgtaaagaaatcacctttggagccttgatcaaatgtatgcgatgaagattcagattgttgaacctgtatcaatctactgatctagggcttgatacagtttaaacatgtcggttaccgaatctataattttgggacctgacatggtgtgtgggtgggggcctagagcggccatcccgctcccccctcccacccgagccggccctgactacatgggccttaacaggccacatggcatcttatcatgatttcttggcttgatggtgacgaaaatggacgtcatagactgtatgacgacagaaggatcatcactagattaatgacgaaaagataagcattctttatagaacgccattagagatgcatgataggtgattcgtcacacgaacgttagatttcacaacatgacttaaaattcaattttcatgacgtaaattagcgtcacctagactggtggagaaaccctttttccacccggttcgtaacccccctttagtcccggttatccaaccgggactacgaatccgggactaaagatcgctatctttagtcccgggtgaaataacctggactaaagatcgatctttaatccggtcagccacgttgccagctaagccatcttagtcccggttggtgtaagatcgatctaccaatttttttcttatttgcatggccctattgctgcatggtttagggtttatgttacaatacatatatatgcattttatatatatatatacatatatatatatatgtatatatatatataggacggctctttcgtacacccaggtgtatgtacacccttttattaatggatgatccattagcattcaaattaactgtgaaaaaaattaataatattaatttccaaatgactgcatgcaagtggcatagctgcacaccggattgggtgcagacttgaacaagatcgttggcatgcatttgctttcaaatttgataacgtaccttagatatccccaccttttctagtatgcaacagtatatactgttttttaagccgcagtatatatactctttgaagtgatgagcagtactatatactagttttttttgtgtattagcagtacctaataaggagtaccttatatttttgttgtagcagtgaatacatctttttttaattagcagccgaatatacttactccagaactaatgagtatatatatactgattatgtctttttattggtacgtgcagtatatactactgcaacgagcgaatgagtacatactgttctttctcggaatgagtatatactgattttttttttggaacgagtatatatactgacttttctcggagtggtatatacttatttcttctccaatcggtatgaacagctactcggagtggtatatacttatttcttctacaatcggtatgaactgctctttggtcagtgtatatatactacattcctcattgaaggagtatatactgcttctttttttatcagtatatacatttgttattaattgagtatatactgtatgcactacttgttctgtcagtatactgcatatactaattgtcatgtttggtcggtatactgcatcgtcctcgctaaaggaggttatactgcctttttgtttgatcggtaaatactacgtatactactttttttcactcagtatataaataagtatgtaccagtatttcttagataagtcgtatatttgctatccatggaagctggatgcatatgcttttcagttgaatagaataattaatatgcttttcacgtgcaaattcagaagtatgcctgaatcactggcaaagtatcggctgttgcattatgaataaacctaaattaatgaaataccctagaagggcactgaattctgaatggacattaccagaccaaagaaaaagatcaacgcagactatcggaaactaagaacaaaacataacgggatcacccctcgatgtggctcatcgaagaatctctgcatccccgcagacatatctcggttaacatcgatgggatcacgccgaccgcacgccggagagaggtggacaagaatgtgtcttcctggattaacaccgttagctaggaatcacgggttcgatgccgacgacgatgctgttgccgcacggccacacatgctggactgttctgtcatcagcaccatctacgtccacgatacatgcatctcgcatttgcatgcaccaaacaaattcgatctgcatgcatgcattatcgatttgcaacctagaaaaagcaaatcaagaaaatcggaagaaggaaggacttgcctgcagcatagtcgatgttccagttccggacgacgctcagcgtcgtcttgatcgtagcatgggcctgcatcgatgccgtcgccgtacggccacactgacttgcccgaagatcaatggcgtcgttgtctggtcacagctcttcggccagccagtcgcctgcggatagtcatactgaaggcattggtaatggaagacgccggcgtagacatcagcagacgccgtgaccttcgaatagccgatgggtcgcgccgtcgtcgccttcgaatcgccgatcgcgataacctgcagatcgatctatcgattctgtttacaaccacccacgagattttaatacgagctattcaaaagggttctggttagtacggaataattcagattatgaggatttttttcgtaactagaaatcaaaacgggctcggtatatggatccgcttgctgatttgatcggtggtgttcgctgatggacggtggatggaaccgggagtacctactcctgggagtatagaatcattatatatatatatatatatattatatcctactaccgggagtagctactcctgcatcatctgctatacgtgctttcaagatttgtgcagctttctgctaattcgaatttgtcattagcgggttaattaacccgttaaaatatgccgatcgctattttcgtgggatacaaacttttgaatgcattatgcacgtcagatgtttgcattatctgcctgacggccgcatatatatatgatctgctcgtccacgcatgtatttcgcatctatagcatatcatcaaccacaactaaaatgaacagatgatgttctgctggcacactgcgtgtggtaattacgtactgtccaactatagccttgtgaacaagataattaaattgagcagaagatgttctgttctttctctctatatatacctattcaaagaataataaaaaaaggcagcacatattctgctacctttcatggatgggaagaagatattctttttgaatgaagcagaacatgcagttttctagtttctgctcccggttcacattctgcccattttctaggttctgcattttgaagttctggaggagcagaacgtatccatgctggtattcaattacacaatcagaacttgatatggggaccagaacaaaaatgttctgctcttgtttctgctggggccttgtcgaaactagatttcggcaatagtaaaagggggtggctatcaagctagaaaagtgtatgggtttggagacaaaggatttatacaggttcaggccttcttattcaagaagtaataccctactcctgtccggggatggatccgccgagtgtattattgattgtatgattgggagaaaatcaacctatgccccaagaggcacccggaccctccttatatatgggaaggagtccgtgttacaaaagataatctatatccctaacggaatatgcagatacaggtaaaatacagtcgtaaccgactaagtctcaaggtgtttccttgatgtacaagttaagaaacgaacccgagatacaaataagatattctatatatattcggtatcctatatccagtccaaatatcctcgccgtgtagatatgggatatccataatctccacagtagcccccgagacctttgcagtcaaccatcatagccttctcaaagataataatccgagtgcttcaaacttttcatgccaaggcctgccgagtagcgaagacgaagactgtaaagggcgaaaaaataaggaatatggtgcatcgaatagatgcacctaattaggtgtagcccccaactatgtgattagttaacaaactaaacatatagttgagaacaaaataatagcacaatcatgcatcatatgacagaagcatatgcggcgcctaaagaggcattctagccgactgctttttagtcataataaaaagaatccgagtggttaacactctaaaaggttcacgaatgaacacacttgacaggcatccgaataaaaaactctaaagattacccaccaaacattataaaaattatggtaatgaataagtctaatagcctaagctatgactatccatcataatgaaaacaggcatatgtggtgtaaaatccgagtaaataaactcataaaggatttaccaaccgcctaaggaaaaatgactataatatataatcagcctaagccataatattggtcaataaaaaatgcacacttacgtggcaaaaagcaacgatattgtatccaatcaattgcttaaaaacccaaacagcaccatgactatattaaaaagtcagcggggcagctatataaagctttactgtttgacaccttttaagatgcattgtaccaactcttaaaaagttgagtaactgcggtataaaaggattttaaggtattgagcacttgatcacgcgcactttggcctaagcgaaaagtgcctgagtccctaaaagaacgtgacaggccacacctgaaaattcgcattgtaataattccgaagaattatatgaccgcgtaaaaaaagattttatcagcattgggcaacactattgtgcgcataagttgccaaagcaaaaaatgcctaagtccctaaggagcacaatgggccacgctgttaaaagtattgggctgaggtactgttcaagcctaagcccattcgcacctccgatacccttaacaaaaaatcacgtgatccaagcgccacttcgtcttccccgccagaactctcgccattttccccacttcctgctacagtacagagctgcgccggcaaactagggttcaccattccactcgaatccaccttcgaaaagttcattaaaatccttcctgtgatccaccgcctcaattcctcacctctcccaagccatccctcgaatcaaatcagcgcattcaggtaaaatcgatggcgaaagagaaagaaagcttcgaaggccaatgggcaccatccgacgtgacggaggagaatctgaaggagatggtggcgcacggtgttctccctgccaaggagatcattgggtggcgaccagcgtgcggtgaggtttttccgtcccccgacacacatgaggttgtagttttttcccatttcttctatggcggcttcgctcttccgacctcaaaatttttccgcgggatattaaacttctatggaatcagcttgcatcacctaaacccaaattccatagtccatatcgccaatttcatccatgtttgtgaagccttcttaggaattaaaccccacttcgctctgttccgccgaatcttttttctcaagccccaaccgaacaagaataagccatgtgtagtcggaggggcaggatttcagttgaggggaaccctgagtcagaagtatttctctatgcccttcaagacctcaaacaaaggatggcatgcaaactggttttatattcagaaccctgagcctgctcttcccgagtactcttgtcttcctccggtgtaccaagatacttggaactctcttccgatcggagatgaagctgctcaagccttggagttgatggaccgcatgctaaaactcaaagaacaaggtttacaaggagagcagattactcggcatttcatcaaatgccgattggcaccaattaaagaaagatcccgcacagcattcgagtttgacggcaagcatgatcccaatcgtgaagaaccagactctctggactttaaaatcatgaaggagagaatgtataaaatcttctcaaatgctattgtcgtcagctactcacatcaactgccagttgtgccatataacgcattcaatccgcctccgcaggtatgtatctgaaatcttcaacctatgaccaaaatagtatcttgtcttcatgttgagttaactaaccatggaggcatcttattcaggaatatgtactgataaaatctgatcccccaatcactcagcgccggtctcctcgccagcacaccgttcagggaggtggaggaccaacaatcagaccagattcgcaacctcaaacctccaatccaactggacagacaggttctcgcaagagaaaactggtgccaaatgacgacgaaggcgacgagaaatctggggacaaaggctcgcctaataaactcccgaagcgtaccatgcccaggaaaaaactggctggccgtccaatgccaaagattagaacatcttctaggtataaacctcttggtaccattttatttcggcatgctcctctcatgaaaataatactgaatattgaaagaacattttgcaggaaaccatctgacatagacccaactggaaaagatcctgatccggctgccacagagccaaatttatccaaagatgctgagccgactgccgaaagccggccgattgccgaaagccagccgactgccgaaagccagccgactggtgcccatgcttcggatgacaaggcccatccgagtgaccagccgccgactggaaaccagtcggcagcaactgaaactgtaacaacccaagagcccccgactggaaaccagtcggatgtaagtctaaatcaagagattcctgaagctgaagcgcaggcgacaacttctcaaggaccaaaggctggtaatgactcgatgattgggtctccaaataaagaacaaggatcacctcacgctcagctaggaacatcctcaggtaactcatcttctcaagtgataccgatttaaataactccagtttatttgcctaatgtcttggaaatacatcaggaccaccgggcgatggcgaagaagaaattccccgcataaaggcggctgatgattctcgtcctcctatcttgctcaaatggtgggatgagaactcacaggttgccggcatcgtcataaaccgtcaaaaagaagatgaggaagtgtgccagctgaagaaggcgcttggagaaactactcgcattgtgaatgtaaatatttcaggcgactgcctttgatgactttgttttctttttagctgaactaaaccatgaaccatcatgcagagaatccatcttcgtaatgaagccaagaccgcaactttggagaagctggttcctcatttgggaactcttgaagcagttagggaccagctacacgaggccaaggagctcgccaaaaagacggaaaaagaattaagggagcaaattgctcagctccaggattcaaacttcgagctgagtggttcgtcaaaaggtaatcttctagacctgtcccattaatctatgctgtcataactatatcctcaaccatttggatttcgaacagcgcaagccaccaggatggttcaaatggagaaacaaattgaagccttgaaaaaagacaaagtagaactggctgcgcaaagggattcggccttgaaggaggttgaaggtactgccagctagcaatctggacgtctctcttttaaatgcagcagattcttatcataaatgtgttttgtagatcgtaaaatcaaatctcaagctcagtttgacgtcctggttagtaagatcaagaggcttgaaggagcaagagatgaagtcgccaatgtcgctataccactcgtccaagctatgttcctcaataacagtggtccgagtgcactcgacgcaaccgaaattttcgacaagctgagagttgctccggatgtatatttcaagaacatcaagaaagctggaagtatgggagctggcatggcattagcgatgaccaaatccttgtacccgaggattgaaattgacgccattgatggatatgcagacgggacaagcgaagaggctgctcttgataaaatcaacaatgctcaaaacgcggctgacaggattgcaagtgacgttgtagagcaattccgcaacaacgaccttcagccgagtaacaataactctgatgatgaaaggactgattctgactgagcataaatgtaccaaatgaaggctcaatttgtacaatactggtgtatttatgctgtgcttgataactctagccaagtctttgatttcttaaaagcttttatcaagctctgttgagcctaaaacccaaagaagctattaaaaactttcagtcctcgcaaactaagtagaaaaatcgaacaaggcaatgaaaaaccaagtaggcaaattgaattgataaaaaatcacactctattattatgatgatagcccccgactgacaacttcgaggagaaaacttgatgttgacagtcaagacagggaagtacaatgataagcctaagcgtagaaacgacgaagatgttcaatgttccaagagttgtcgacgagagtaccgtcttcgcgcttgagtcgataggaacctggccgggtgacttcagagatgataaatggcccctcccatagaggagataacttgtgccgatcccgtgtagtttgaattttccgcaaaaccagatcgccgactaaaaaggcgcgggatcgaacattgcgattatgataacgtcgcagcccttgtaagtatcgagccgactgaatcaaagccgcttcgcggacttcttccaatcggtgcaagtcatccactcggtcctcttcgtagcgttcttcacggaaatttcgaaagc

SEQ ID NO: 82819 - DNA, 8445 bp, Oryza sativa
tgttctcgacagattaatctaagcaaaacccaaaaacctaaagatggcggtgggtactgatatatagagtttagggtcgtgcaaacccctctcgacgccaccctaatgggttccaacactatacacgggccaaaggcccaaatacggtgacgcagcaccgggacagattctggatgtcaatttgttcggtcatttcccattgactcggaaagaatttagacgtgggaccaaaaccattggaaatgttatcttcttagctttccatccatataaagtatgccccaatccggacacgtatgcgacctgggcgcccgttttagtgcagactggtcctggactccgaattgcacccgacgtcgacttggtttgggcctccaccttgacttggacgtcccagatgatcctccatggctctaagtccttctccaagtgtctccttgtcccctccattgttcctaattacaacataatcattaggtagcaatctattctcgaattcatacaaagaagaacataggaacgagctcacctctaaatttaattgtcgcgcacgagctcttgttatcggtccttgaatgaccgttggaggattgttgtgtgtatccgaggtagtgatgtccgcatcagtaggtacacaggcccgagaataccgatctctttgacaaggtgacaaagcagatgcgtcattatattgaaaaacgaaggtggaaatgtcaactcaaagctgacaagacattgcaccacatcattttgaagggcttctaatctatccggatcgatgaccttctgcgaaattgcgttcatgaaagcacattgctttcttattgttgcccggacattgtctggaaggataccccgaattataactagtagcagttgtgtcatcaacacgtgacagtcatgagactttaggtttgtgaacttcttctcctttatgcttattattcgctttatattcgtggaggacgtccaagaattcccaatagggtaactcccaaaatatagagttctttttccacatcgtcgcgtgaccatctgcgctatcattaggttggctgccaggcccctttccaaacactactttaagatctttcaccatagcaaacattgttttctcactgcgatgtttaggcttcgtacagtggtccgccttatgttcaacgtgcttgcctttctttcgtacagggtggtttgcagcaaggaatcgacggtgacccatgtacacaaccttcctacagtgcttaagatacgtactttctatttcatccatacagtgagtgcaagtcttgtaccccttgttaaactgcctggataggttgctaagtgtaggccaatcgttgatggttacgaacagcagcgctcgtatgttaaactcctcctgtttgtcctcgtcccacacggggacaccttctttcttccacaacagtttcagatcttcgaccagtggtcttaggtacacatcgatgtcgttaccaggttgcttggggccttgaataataatcggcatcattatgtacttcctcttcatgcatagccaaggggggaggttgtagatacacgtcgtaacaggccaagtgctatggccgctgctcatctctccaaaaggattcatgcctgtcacgcccagaaattcactagtaatttctgaactaatttatgcatagaatcctcgtccaggaatcagccaaggtacacaaactgacaatttaatatacaaattcatcataataataacgttacatacttacaaaacaaaagaaaaacaacagcggaattacgatctagcgatggcttcagctccactaccacaggcagctcaattggggtataagccaaacgtcttctccttctggatcctttttcttcagctgaggttgattgattattgcaaggtgagcatatgacatactctgcaagccacatagcaaatatgcaagtgcacaaggataccaaaggatggcataaataggctcatttgcaaaagcagcatttagcaaacatttgagaattgaaaaacagtagagtaattaatcaatgttattcaacatgaacatcacacccatgctgctcaggcccaaccatcctgtacacaaggagctaagcaaattattaccagttatagcatcaataattatttgagaggtgtgacactaatcacgaaaaatattgctcaacccgcccatgaccgcgggcacggctattcaaatagttttgttctggccagaggtgtaccactgtatccacaagacacagctccacgatatgttaccatgcgcctcaataccaccacggtacctcggaaaagaactgtgacggtacccctcgcacaacacaactcatcatagtgcaccaatcctggatcataatcaccccctctataaatataaccagaggcatggactccccagcgacccccatggacttctcgccgcttctcggtctaatgtcctgcaatgaaccttgctatataaaaggtaaagccgttgcccacgctggcttgtggttggcacggttaatgtctcacaacagtagctcgcgaaccggtccttaattgtcatgagcacgagcttcaaaaccatatgctcacaacccaccattatcaagtttaaattatcataacacgattaaccatcgtgagctaccattaaatataatcataaataataatgtagtatgattcattccattaatgagctaatgtttctaaacatggctaagcaattatatatatagcatttagctgaaccaatccaatatataaggtccatgctaatcaatttattacccatagaaaaataaagtcatcttcgaccataattaattgggaaaggctcaccacccgatggcattcgaaaataatgcataagttgaaataaaacattagctttaaacaggttcaacatgctcaaagggttgtttgggatatgtgtgacttgccttacaataatcagtcttcaattaatcttctgaaccacttccgacgctctcacgaaccttcgcaatgacggaaatgacaagctaacacgcaaaacgaagaaaaagactaataaaaaccaaataaacagtacataaaaagtaaacgaacatgtagatcatgattttagatgaattatgagacttgaacggcctcattctgacttcatatgaattagttatgaattttacaagattaagtccaattaaacctattaaagaaaaaaaactattccaaattaattaaacaatttacaaataatttataactgagatataagactaaagcatcctccggaaattattggaatgaatttagtagacgacatatagtaaaaagaactaatatgccattgaaagggataacatgatttatattgattttggaaggctgagatcaactttgacctagttgaccaaaattggatggctcggattgatctgatctaaggttttagatggctgccacgtgggacaaaagagatgacgtggcacttaggtgccagggacggtagctgacaaggcgatgacatggcaaccacgcgggatcgacgtcggctgctctgttcggcggtgaggacggcaaacggcggcacaacggcggaaaccgagagcatggggaggatgaggatgacgcgacgatccttaccaacacttacgcagcgatgaacagcgaaggagatggccggcgacgagatcgggagtggcgatggggtactgatcaacgacggcgacggcgttctccttacagatgcaaatccaatggaggcaacggcgaccgaaggcgacgacggacgacgacgaacagcgcgactggagatcaaaccatggcaacaacccacaggttcacggcgacggcaaccttccggcgggattcggcctcgggtaaggggtggacggggtgtagcttgaccttgcggagccgagagaggtggcggcgtaggagggcgacggccgaggcgacgacaaacggcggctggagcgactgccggcggcggagaaagaagacgagcgtggggaggcggctagggttagggaaaacttcgggaaacagaagaggaggctgaggggatgctatttataggcaaaggtggaggagatcggctcgggaacggatgaattcggtgaaggaagttaggatttatcctgagtttccccggataaaaacgaccaaaattcgtgagatagataacgaatttgatgaggcatcttagggatatgatagaggagatagggaggaatccgtttttgcactcaatttggaagggaagcaacggatgcatcgaatttgatgcaggagacggcggctctcgggaagaacacggcctctagacggctggctggagctttaagacgcactgtatcgcgggggaggccaaacagactttaggctgggctgaggaacagggagaagggaggaaggaatggtcccaaaagggcccaagctgaggaggaggatttttattgcttttccaaataaatcaatcaccaaaatgatctttgaattgttaaaaatacttcccatgctcaaataatttcaagaaaaatcctgaaactaattggacacccaaagtacttaactatattataatcagaccatttacggattaatttattatttcaataattgctgaactgctctttgtattattaaaattaggaattgagctctgaaaaatccgagaaaatttcagagagtataattaaccatggagaatttaataaaattaaatccagccattctttatatttaggaaattttatttcccacatttaacttcacttgtaatttaatgagcatttaatataaattctaaataaacacaataaactcataccttgccttagcatctaacaaacggcggctcaaagatgtgatgttgtatccgtcgctgttcatcttctcttggttccctcataagcataataatgtcttgccccttgagcaaaatcggctttcttgattgcacgatttcaaaggcaagacgaacaccgcaccaacatccatagcatcatgtgaaggagacttatctctaatgaccgatgattcttctctcatcatattggatttatcactagtttgggaaatcaccgatctcttaccttttacttctataggtctccacactcgcttaggtgtcattcgaggctctaaattattacatgttttgttctccatatattcggcctccttttctttttgacctatggcccgaagacgctgtagcctcctcttttgagagcgagataagtcagaaggtatccatttcgactgtggttgttttccaggagctaagcaatgattcttcatatttttggtcaaagtggaagctcctgtgttgctctcaattttctcactcttctccaatgcccctcggtcaaaccggcctctgagctcggtcagaccggccacaagccgtcggtcagaccggccaggagggtcggttagaccggccgttgtctggcggttagactggccagctgttttggtcaggccgccgatgttgacagtaacggcgtcggcttcagtctcctccgcttgtatagttttcgccgcatctccagtaggtacatgaacatcttgagattcctcattgatagcaacgacctccggagctttggcttctttcctcacccacaccttcttcacctttgatccaccggaccgattcttttgtgggaaacgatcttgtcttgaattagatgaatgattctgtactgacctaggtgattccttccactcttgataatacggcataggtggttgatgcatccacggcatgtaatacataaaaggataaccaaacggtgacattggatatggataccatggcatcacaaccggtggtttatatggagttggtatagttgatggctccgattgctttgatgtttgaccaaatctcctcttacgagatgatcttggtctttttgaatcactagtttgattatcaaatcgttgaccggctaatcctttcttgtacttagccataagcatctcaaaagtgagcttcggctttttggtcctttggaaactagatgactcatcctttgcaactttatgatcttcggccttcgcattttttattctattcttgggccgaggatccccaataataacacttttccatttctttttgtcaacatcaatagaactaacagggagagaatcactaacaattccggtcttaggcatagaaataaccgaaatagtttcacaagtgaccgatgaatcatcaaccgatcttttctccatcaagcttgcatctttaaaataatcatgaaactcatgctccatttgtaaccatgtagaaattgaagtaggagcaaggaaactataccatgtagatgcaaagtttgacaaagaaaggggaaacaacttcaaattaagcaaatcatcactatcgcccttaccacattaataaataaagcggccgatatgctccattgtagtcatagcattctcacctttgaatttcgtgaagttgggcacctcaaatacttgcgggtatgggaccgaatctacatgttcaggatatggcctttgatatgtatgcatagctactttggattctatttcaccactattgtcacaccctaaaaatctccaaattataaattttcgtttaattggaattagtagaatttattttaaaagcctagaagagaagatctaattttaattaataaattccaatataaaatggggccagataaaattttattaaatactttgcttaattctataattcctagatttttccgggatttatttgagctaaggaagtatttttaataaatggaattgcatttaatgaataatttaaatggaaaaaggtttttaaaattcccttttggttttgggccgaaagtcggcccaaaccgctctctctctctccctcggcccaagttggcccaagccgaccgcccgcccgcgcgcgcgcgcgcgaccgccgctgacaggtggtgacccctttcctctcgccgaaaccctagccgagctgcgccaccgccgccattccaaatccagccacccctttccgtttccggtgaaattgattgaggggaaaggatccccatgatccactctaccttttcccttttggaaacatcgtctaaatcgctttggaaatcgccggatttgagttcgattcggatcgatctctctcctccaaaccctaaactttccttcccgtcgccggtcgccgtgggccttcgccgccgctccctagcccctataaattgacccccgagctcccctctacccgtcgccactctcgccttagcccgccgccgtctgtagcgccgcctccgcgtgagaccttgagccgccgtcgctgccgtcgctccagccgtgcgccgctgtcgctccggtcgtcgtcaccgctcgggaaggccgccgtcgtgatcgccgtctcgttgccgtctccatccgcaccttctccgtcaccgttgaccgccggaacgccgtcgccgtcgtcaagccgaaggttgctgccgccttttcctcgtcgccgacgtcgtccgttgctcgtccaccgtcgctttggtaaccggtgagttcgcagcgatgcccgcatcgtttcggagccctccgttcgcgccgccacgccgtcattcgccggcgagaatgcgtgcccgagccgccgccggtggtgacgtcgtcgctgacgtcatcgtcatcatccctcgtggtctagccgtggaccgatggatctcggccgtccattttggatggatcgatctcggccgtccgtttcgtgaaccgccgccgtgcacccggtcaaccgtaaacccgacccgctgatgcaataattcccttttccttttcaaaaataattaattattgcgtcataattcaattaaaatctacataaatgatttaaatcgatttaatctttgaaaattcataactaattcatcttagctcggatttagttggttcaagtctctaaatttttctaaaattgagatctacatgttaaaaatatccacatgtactgttcatgcgtgtttatgtgctgttttggtgattttgttcttttctctttagattccgacgttccgggagagtctgattttgcaggagaagactttgaggatttccaaggccagcaaggcaagtcacacagattcctaacaaccctttgagcatgttgatcctgtttaaagctattgtttctattcaactattgcatttattttcgaatgtcattgggtggaattaacctattatttgttatggcccttttgttcttgattactttattctttgataccttgggttaatgtaatttgactagttgagctttatatgatggttcagctagatgttaggcataattgcttagccatgcttagaaacattagcacactactgggataacttatgcttcactattatttaatgatggtttaataatagctcatgatggttaatcatgattggtttatcaattaatctgccaacta

SEQ ID NO: 82820 - DNA, 5711 bp, Oryza sativa
  unsure (1)..(5711): unsure at all n locations
ggcgtactaaaggnnngccctaangctcgcttnnngcnnngnngtnnnncaagggcntcgagcggtagttcgataccaataagattcattagccccgccccccacaaaaattttttaaaaaaaaacccccccccnccccccccccaaaattttcccccccccaaatttttttttccccccccccaaaaaaatttttaaaaaaaaaaatttaaaattggggggggccaaaccgggcccaaattgggttaattttttntaaaggatnnttattctttgaccaagaattagttttaatttacaaagatatttgatagaaaattagcatcatttcaacctgtttttcaatacgaatacaacaattctatgtatatattactagtcatcaacctgtgcacttgcatgggctagaaaaattacgtgacatcaattaactagcgtggaagctttattggtgcctccaattactagatataagattttttctttgtttctcaattctttcggtcaataacgagcatgtgtgttattcatagaaacggaggtaggtagtatttgtaagaagtacggtatcgaatttcaaaaaagttccgaccttgtgcgataatatacacacatattaacctacataggcaagctagccagacctagaaatataccatttctaaacctattcggtcacttactcacgttggggagcctaactaaactaacatggactcacatggcatgcaagccagccatggtactaactcggctactacgccatagtacgctacaaacacaactaagttatcgtatgaaggactactcaatagtacacttaaaacaatgttactcgttgccttttaccttcatttgacgggtacgacctaagtgtatctgaaaatcttctcttctgtccatcggcgaaagcgtgcaaatgtaaaattgcctggtacgcaggactagatatgaagagtttgttcagagattgtgcaataaacatgtacatccatcaactgtatacatgcataggatatatacatacaatggaggtagccatttgcaccatatccacaatatacaagtaggcagccattcacaccttatccataccaggacgatccatttgcaccttatccacatcatcacataatgcttctgcctataaatagcagcagcaccttacattcaagaatcacctctcaacacaaaactaagaaacatagcaagataaccagggaaggtagcatcagcaacaggaggcaatggagggaaagaggactaccacttcgatggtgatcatgtgcctggtcatcttgagcctcactgtcgactccgccaccgcggcacagtgcggctgctgcatatcctctcgggcaaaagcatgttgttttggttgtattgctgctggtggctccgactcagtctgcaagaacacttgttgtttcccatgtattctggccgattctggtaaattcactaatgtcactctatttaatgcatttcttatatgtagatacagactttgtagcatatcgtggactaatacatatgtacattgtcctcaatgtacattgttgatttcatttccaatctcacgacttcaggcatatatcttgcaacacgaagacatcttatgctctacttccactacaaaattgactaatgcgctaatgggattttcatattttaatttcacagttgttgctaagatggacgaaatgggagttcttgctaagatggacgaaatgggagttcttgctaagatggaaggacaagcctaaaacaacatgcttgcattgctaccagtcttaatgcctatcataagaatatgttgttttgcttcaagttatggccaagttatgttaatgttatcttcaataaattattgaccatatgggacgatctatagtggatccatctgttggtctcaactctatgtatgtcgtgcatgtgtgctctcacaagcatatttaatttctcttgctgcttttaataaggccatagcactgtccattgtgtcatccgatggtctctgaccttagcaatttattacgacatgattaatattatttgtgtatgcatgttctttacttaatttattcttagcggatttctgatgtttttgtgagttttagactatgggacataattaagattgtcatgccaaaaattattgcaaaacctagtaggaaagcaaaagaggcggggggggggaggaaacatggtcaatttctcggctgctatcacattcctcgttttcaaaggtttgggagacatatagccacactaaaggcagtaaacctgaggaatgacaaccttactcacaaggacaaatagtcgttaaaaaactatgacatcactaaccatatcttatttcagttcaccaaacatacatttaaatttaggcagtattacggagaactaaatgaacaaacaacaaaccatacttcattgtcaaaacaaattgccttctatgtacttcacaaattctcacaagatcatatttgcaatttttcctaaactaattaaccaagagcaaatatgcagtggagcattccacatataatttcacattataagtacataatacagtatggtataatacacatatgcatactagggcctacggcaaaagaggcaaagatcaatgtgcatgctaacttgtgtataatacacatatgcacagtactttgaaatacgcataccaggatatatgcattagttcacaccattcattcttgcattcttgcactttcaacaacaaccagatctaccaagcattcttgcacattaaaccacaagtagatctaccaatgaatcaccaacttaggtagcaatgggggtaatcggaggggaaaaccttacctcgtcagacgacggaaggacaggagacggcggaagattcaccggctgctcaccatggcgcgcggatccctgaggtgtgggcatcacatctatcagcaccaatgacatcggcgggggggggggggagggggaggactagggctctttcatagaccgatgtaaactagacttattggcttcgatttagggagaggaaggaaaagagatagactttacctggcatggctttgggcctgcacggagaggtatagtagttggcttggtttcagccaaaagatatgaagagaattttaaattattttttcaatttaaataatgaccgaaattatgttagtattattaaaattacttctttagctcggaaaatttcaagaaaatttaagagagcataattaattattgagaagttaataaaactattccaagtcatattttacaaggtaaaattttatttcacatatcaacttgtaacatacaaggaatttcaccatggaaaaattttgtggaaaatttaaaactttttgaattcaaaagtttttggtgaacatagaagcatactagagcatataactccctaaaataaaataaaacacatagtttttttggccaaatcaaaactaagtccaaaagaaaaagtttacaaatcttgtggtaaaaaattttaaaacaaaaattttgctttgaccataaactagaaacctaatcttctcggttttgcattttcaacctaactaaaaaaatatatttaagttaaatataaaacaaattgaaaggtcagtatcaaaatacgcaaacctaaattgagataaaaagaacttgcttgtatgtgcatattattcttttaagattgtttttggatattcttggtacatctcataataggttgcatatgcatgctttgtctaaagaaaattcctaaaaataaatgaggcaacaataaatcccaccaaaattctcataaatactaaacaataccctaagctcccagaaattttagttataataatttatcacatcaattggtaacccaaataaatccttgaactcagctaaaaaatctggaaacagcataccaattagcctactttgcaccttcaccaaaattaaaccataactcatcttgcaaaatctctaggtcagaatgttaaacatactttactctatcatctggtgcaatggcttagtctaattcgaaatgtaacctcataaaatgagagccataagttaggtaaacagtattctggactgtggtcaatagattaactagtcaactttactaaattaccatggcaaaagcaaaagtaattaaactttggaactaggcaccttgaacaatcaaatccttgtctaccttgctgtctccctgtcaccccccccccggccttaattctaaattaaatggatgagagaaagagagtaatatagtttagtgtgatagtgccaacacatggaaaatttagagcttctagttctctccttctacatctctcttaaatgtgggaccaagtccttatggggcccactcatcatacaaccatagccaacacatcatctgctcttctctcatttaaatcttcttttatttctcaaaaggtgagagaagggtttaaattgaatttccacccaaaatgccactctaccactccaagccttctaggaaacatctatatatgggcctatttgtcgtccaaatacctacaaacaaccttggtgaatcatctctttgatcctaaattatattttcaaagagagaaagaaagagagagagggaattaaagtccaatttacacccaaatttcaccatacctctcatcttctcataggaaacatctacatggggccactagacagccactcatgctaggttgagtgaagtacaagtgggatcatagcctcaattcactgccaactcctttaaatcgtttctacccctcatgttgacacctagctctcactttccaccttcactttcaccattcactactacaaccaagatttttgtgtgagggctaaaatgatttttgcgtgcgggtaaacggcccgcatgcacttaggggtctgggaaaatgacgatttttgcgtgcaggtgaagcaccaccacaggaaaacaaaaacccgaaaaaacataaattttctttaaaaatgaaatcctagaatctggtggtggcgccgccgctcttgcttgccgctgccgcctcctcgtcgtcatcatcatcgtcagtggcggcctccgcgccgctcgcctcggatccgtgctcccctccggccgcaccgccgccgacgcccctcccctccgccggatctagggagggaaggaagaggaggggaggggagatggatgccatgcggggggagggcggccggccgctggatccgtgcgtggacgaccgccaccgctggatttttgcgttgatggccgctgccgctggatccgtgcagggacggccgccgcccgccggatcccacgccctccaccgccacaacgtggaggaggccggcgcgtgcctatgcccaccgcggctgtcaccgcgcgccgccgccgctgccgccatcgggaggagaggagaggacagtggagagaggagaggacattggagagaggagaggagaagcgtgagagagagaggactgagagaagaagctctgcgtggaaattttaaagttgaaaatgggattgaggggaggggagaggagagaaagaggtgaaattttaaagtgtgtgagtgggaaaagagggagttagtatttttgcatgcggccctcttaataggtccgcacgggaaaatcggctcattttcacgtacggtccatctaagatgatgtnctacttgcngtaggagacggtccttatctggcgcgcg

SEQ ID NO: 82821 - DNA, 6158 bp, Oryza sativa
catgtgaatatttttaacatgtagatctcaattttagaaaaatttagcaacttgaaccacctgaaacggatctacggttatttagttatgatttttcgaagatttaatctattagaaaaacgggaaaaagaaaaagatgatgatgtcatgatgacatcatcaatggtggccggaccgagatggtgacctcgccggagattggatggtcggctgcgaacatggaggacatgtacacgtagaggacgacgagacgaacccaacggtactcaccctcgagccaaacgacgaacgacgacggccggcgacgagatgaacggcggcggcggctccggtcggtggtggcgagtaggctccggtggtcggtggctacgggggacgggcggccgggcttcccctcaccttggcacacctattggcggcggcggcaagcggcggcgacgacgaaggcggcggcgcggcgctaccggagttggccggcggcggtggcgagctaggcggcggtggcggcggagctacggagcacgggaaggcttgggagacggggaaaacgaaagaggaggactaggggatcctatttatagccttggattgaagagatcggactcctcccgcaagaaatcgatccgggaaatcaaaaactcggttttggagataaactcgagaacgagtttgattcggataaaatactcaacgattagctccaatttttgggggtaaagatagaggaggatgagaggatcaaaaccccttaaacaatcgacttcggggagcccggatttatttcggttttgcagggaaaagggggcggctcggcgggcatggctgggctcgcccagccgactgctagaggttagggaagggtccaacatgtggggcccacatgtcggtctcccgagtggagggggtggctggcgggttgggttgggccggctcggtggctttgggccggctcgggcgcgcgggagagagagaagttgggccggaatcggcccaacgacttagggaagggatttttgaactttttaattaaaataatttgtgaaatgttgttccaattattaaaaatacttcccttgctcaaataattcccagaaaattctagaaaatagaggaacaactaaagtatttaataaaattttatctagctcatttttatgttgaaaattttcctagattattagagtttaacttgtaggcttttagaataatttctaaaaatgatttaaaatatgcatttttaatttaggcgatttttagggcgtgacagcccctctgtcagaatagagatccaaggtgtacctttcctgtttaaccttattctgttagaatctaaagatcatgatgtcatcctagggatggactggttagccagatataaaggtgtgatagattgttccaatagaaaagtaactctcaccagcaatgatggtcaagttgtaactgttcatgcattgccctctgaacctcgaaggtcaagtctaaaccaaataactttggaagagattcctatagtccgggagtaccctgatgtgttccctgatgatttacctggtatgccgcctaaaagggatatagagttcagaatagatctggtgccaggaacaactctgatccataagcgaccatatagaatggcagccaatgaattggaagaagtcaagaggcaagtagatgatttgcttcagaaaggatacatcagaccgagttcatcaccatggggagctcctgttatctttgtagaaaagaaagaccatacccagaggatgtgtgtggactatcgcgcacttaacgatgtgactatcaagaataagtatccactgcctaggattgatgatttgtttgatcaacttaaaggtgccaccgttttctccaagatagatcttcgatcagggtatcaccagttaaggattaaggaggaagatatacctaagatagcttttactactcggtatgggctgtttgaatatacagttatgtcttttggacttaccaatgcccctgctttctttatgaacttgatgaacaaggtgttcatggaatacctggataagttcgtggttgtctttattgatgacattctcatatattcccgaactaaagaagagcatgaagaacatcttcgtcttgcattagagaagctgcgagaacatcagttgtatgccaagtttagcaaatgtgaattctggttgtctgaagtgaagttccttggtcacgtcatctcagcaggaggagttgtcgttgatcctagtaatgtggaatccgtaaccaactggaaacaaccgaagacagttacagagattcgcagtttcctaggtctcgcaggatattaccggaggttcatagagaatttttccaatattgccaagcccatgacacgactgcttcagaaggatgtgaagtacaagtggtcagaagaatgtgagcagagttttcaagagttgaaaagtcgcttaatatcaactcctattttgattttgcctgatccaaagaagggtttccaagtgtactgcgacgaatccaagcttgggctaggttgtgttctgatgcaagatgggaaggtggttgccaatgcatctcgtcagttacgtccgcatgagaagaactaccctacttatgatcttgagttagctgcagtggttcatgcgttgaagatttggcgtcactatcttttcgggactcgaacagaggtgtatacggatcacaaaagtttgaagtatatctttacccagccggatctgaacatgaggcagcggagatggttggaattgattaaggattatgacctgggaattcattatcacccgggaaaggctaatgtcgtagcagatgccgttagtaggaaaggctattgtaatgctatggaaggacgacagttgccattggaattgtgcaaggaatttgaaagattgaatctgggaattgtcagtagaggctttgttgcagctttagaagcgaagcctactctcattgagcaagtcagagaagctcaaatcaatgatcctgatatccatgagatcaaaaagaatatgagaagaggaaaagctattggatatttggaagatgagcaaggaactgtatggttgggtgagagaatctgtgttccagagaacaaagatttgaaagatgcaattctgaaggaagcccatgacactttatactccattcaccctggtagtactaagatgtaccaggatctcaaggaaagattttggtgggcaagtatgaagcgtgagatagcagagtatgtagctgtgtgtgatgtttgtcagcgattcaaggcagaacatcagaaacccgcaggtttgctgcaacctttgaagataccagaatggaagtgggaggaaatcggtatggatttcatcactggtctacccagaacgtcatcgggccatgactctatttgggtgatagtcgacagacttaccaaagtggctcatttcatcccggtaaggacaacatattccggaagtcgctaggcggaattgtatatggcaaggattgtgtgtttgtacagtgtgcctaagaaaatagtatccgatcgaggtagtcagtttacttcaaagttttggaagaaacttcaggaagagatgggttctaagctgaacttcagtaccgcttatcatccgcagacagacggacaaactgaaagggtaaatcagattttggaatacatgttgagagcttgtgctttagacttcggtggaagttgggataagaatctgccttacgcggaattctcgtacaacaacagttatcaagctagtcttcaaatggctccttatgaagcactgtatggtcggaagcgccgcactccgtttttgtgggatcaaacgggagaacgtcaggttttcgggactgatatcttaagggaagcagaagagaaggtaaagatcattcaagaaagattgcgtatagctcagtctcgtcataagagttatgccgacaatcgccgcagagatttaagttttgaggaaggagatcatgtgtaccttcgtgtcacgcctcttcgaggggttcatcgttttcacaccaaaggaaaattggcaccgcgttttgtgggaccttataagattgtcagtagaaggggtgaggttgcttatcagttggagttacctcaatccttggcaggtatccataatgtgttccatgtgttacagctgaaaaagtgtttaagggtacctactgaagaagctaatcttgaacagatagaagtccaagaggatctgacatatgttgagaaaccaatccgtatcttggagatagatgagagaagaaccaggaatcgagttatccatttttgcaaggtacaatggagtaatcactcagaggaagaatctacttgggagcgagaagatgaactaaagtcagctcatccgcatcttttcgccagttcttccgaatctcgaggacgagattctatttaaggggggtaggtttgtcacaccctgaaaatcccaaatatgtaaattgttgtttaattggaattattagaaataattttaaaagcctagaagagaagatctaattttaaataataaattccaatataaaagtgggccagataaaattttattaaatacttcacttgattctatagttactagatttttctgggatttatttgagccaaggaagtatttttaataaatggaattgcatttcggcccaatgccaaaatgaggatttttaaaactttttcaatttaaattaacgcgcgcgcgccctcgccgctgactggtggggccggcttcgtctacctcgcaccgccgccgcagccgaaccctagccgagccgcgccgccgtctccttccaaatttgatcgcgtctttccttctccggtcgaatcaatagaggggaaatgatctccgggacctcctctaccttttctcttttggaatcatcgtctaattttgattggaaagcgccggattcgatctcgagtcggattcctctctctctcccgaaccctaatgtttccatcgcagtcgccggccaccatgggcctccaccgccgcccctagcccctttataagaacccacgagacctcctctccctgccgccaccctcgccttagctcgccgccgcctgtagcgccgcctccgcgatcaaccgtgcgccgccgatgccgccgcgagttcagccaagcaccgccgtcgctctggtcgtcgtcgtcgctcgggcaggacaccgtcgggatcaccaggtcgtcgccgtcctcgtccacccctccgtcatcgccgaggatcgccggaagaccgttgtcgtcatcaagccgaccgtcgccgccgcttcttcctcgtcgccgtcgtcgtccggtcgctgtccgccgccgttcgtgcctcggtaaggatcgccgcatcgcccgcaacgtgtagatgccctctgtttgcgctgccgcgccgtcgttagccggcgagcatccgtgtccgagccgccgccggtgatgatgtcaccgctgacgtcagcgctgacgctagccgtggaccggcggtagatcgataagatctcagccgttcgttttcgtagaccgccgccgtgcacctggtccaccgtgaacccgagccgctgacgcaataatccctttttcttttcaaaaataattcattattgcgtcataattcaattaaaatctatataaatgatttaatccgatttaatctttgaaaattcataaataattcatcttagctcggatttagttggttcaagtctctaaatttttctaaaattgagatctacatgttaaaaatatccacatgtactgttcatgcttgtttatgtgctgttttggtgattttgctcttttctctttagattccgacgttcccggagagtccgaatttgcaggagaagactttgaagagttacaaagccagcaaggcaagtcacacagatcccaaacaaccctttaagcatgttgatcccgtttaaagctactgtttctataaaactattgcattcattttcgaatgtcattgggtggaaataacctattgcctcgttatagcccttttgctatcgattccctattctttgtcacttggtcaatacatttgatcagctagaacattatatggctttagctaaagcgaataggatgcttacccatgcttagagacactagctcatactaaggggatactcatgattgactatt

SEQ ID NO: 82822 - DNA, 4745 bp, Oryza sativa
ttttcttgtgcatcatcctagtagagtatttgtatctaagtcaatatccaaaatttggaaatggggaggggccagtcctatgcattgtacaaagaaagccctatttaataatatttaaatatcgagttaataatcgacattccttgccgatactataataaaaaagaaatgtattccattgaatcttaaacctattaataaaaaaacaggataaatactagagttagggaataaagagggtttggggatagagggacttgaaccctcacgacttagaaagtcgacggattttccttttactagaaatttcattgttgtcagtattgacatgtagaatgggactctctctttatcctcgtccgattaatccgcttttaaaaagatttcgaaaactatgaattgaaggatttgattactcaatattcgattggaatggattcacaacaattctaaaaaaattatgaattttctatttcataatcattcctattttcattttaaaaaagaattaaagaacctatattatgatatgagttctgtgattaatcgtttgctatgccagtatctatacgtgtgtattagatttcgaaagcccttctttccctaatttagaagggagttccgctagcaacacaacgtaattaactcgattcgttagaacagcttccattgagtctctgcacctatccttttcctttgggttctagttcgagaaccgcttgttttctcaaaacatggatttggctcaggattgccccttttttaattccagggtttctctgaatttggaagttgccacttagcaggtttccataccaaggctcaatacaatcaagtccgtagcgtctaccgatttcgccatatccccattttctttttctttgagaccaggattccttgtgcaatttcctccatctgttagttttttttgaatcgttgaattcattactctatgtagtctagcggttcgtctctagttgagagactccgcttattgcaattcagcattgaattgattctatcgttgatgtatttgcaattcaatgcgaatcaatatatcccaaggtttttctctcccccacctaccgcgttccttttttagagtattcaaaatcatactataacgcttgatattcattctttttttttgctaatcagaattagcaatttcatttgctatgattctatgttctccttagtgaaatattaatcattaaattattagcaaataacaaaaaaaaacaaaatatctcaaaaaatgtctataatgatggactgaaaatacaagaaattcgcatgttctctttattatgttttcgtatataatatatattatttattcttttccatgtattagattattcgtccgagccatatcaaattaaaaatatctaaaatcaaattcaatatagaaattggaatagattctattagaaaaatagatttgcgaattagagaaaaaagaaagttcaaaaaaatctatctaactttattttatgaagttctagtatttttttctaagtagaacttccaatttcgaactagttaatagctaagattaataattaagatctgacattttacggatttcctatactatacatatttctatttgttacactatttctgttatgtaagcccacttagctcagaggttagagcatcgcatttgtaatgcgagggtcatcggttcaaatccgatagtcggcttttttctctatcaatgttccatgaacaaaaatacctctttttctccgaattaaatggagaagccaggatctattatgtcgttctaccctacaattttgctagatacaaaacaataaaataaataatatatatacaaaaattcagatgttgatgaaattccatttttttgtggtacttttagtagattttactctgtttatcctttactttaattcagttttaatttcgatgtattctgtaatgtaaatacaatgaaattaattgtgtaaaatgaaatttcaataaaaaaaggagtcttcatgtcccgttatcgaggacctcgttttaaaaaaatacgccgtctgggagctttaccaggactcactagaaaaacacctaaatccggaagtaatctgaaaaagaaattccattctgggaaaaaagaacaatatcgtattcgtcttcaagaaaaacagaaattgcgttttcattatggtctgacagaacgacaattacttagatatgtacatatcgctggaaaagcaaaaagttcaacaggtcaggttttactacaattacttgaaatgcgtttggataatatcctttttcgattaggtatggcttcaaccattcccaaggcccggcaattagttaaccatagacatattttagttaatggtcgtatagtcgatataccaagttttcgttgcaaaccccgagatattattactacgaaggataaccaaagatcaaaacgtctggttcaaaattctattgcttcatccgacccggggaaattgccaaagcatttgacgattgacacattgcaatataaaggactagtaaaaaaaatcctggataggaagtgggtcggtctcaaaataaatgagttgttagttgtagaatattactctcgtcaaacttgaacttaaggaaaaacggaaaggttcatagaattttcttccccttcccctttccccgaactaaatcgacctaaggctcttaattcgtattttcccattcacctaacagaaatggattaaccctaggattcctttttgttttttgttctttcctctatgtgtattttacataccatagtaatttggtatagagaatttctattaaataaaggtattgtattattgctggaataaattgtcatttgatttgatacattgtaatcattaacgttgctgaattaagaaaaacggaaagagagggattcgaaccctcggtaaacaaaagtctacatagcagttccaatgctacgccttgaaccgctcggccatctctcctccataatcttattatggaaaaaaaactgagtgaatagcgagttttcctattcctgcagtacaggtacaaccacaaccgcgcgagagttccattgttctattagatagaaaaattccttttcatctaagtggacgggtccaggatttttttactaggaattccgctccctcgaaaagttttagtttgggttttccccaaaccaaagaaaaagagaatggaagaattcttcttattcgataaaaaaggaaccctagaattctgtttgcataaggtatcctaccccatacaatcaaatagaaaatagggtatgggacgattaatgactttgaaaatgcgaaatagttgatgagagaagttgttgttgagaaaagaaataggaaagtggaatgaaatccaatcttagtcaaatattttctatctcttcttgttcaaacagaaggaaaaagagagaatttgggctgagcagaaatactttcttatccatttgaaccatagggatcgattaataagaattgaatgcattggttttttttttatgttattttgtgaaggaatgaaaagaattctatatagaatgatagaatgggttgggaattatgcctagatcccgtataaatggaaatttcattgataagaccttctcaattgtagccaatattttattgcgaataattccgacaacctccggggaaaaaagggcatttacttattatagagatggtgcgatttgactcttttttttgtttttttagccctacctacaccccggttttacgagaaagagtgggggttcgcggagagaaaaccaaattagtaagggaaacccacgcttagggaaggtgaggtgaactaacaactccttctgtcgtgtatcctcgactgacgcggcctcggatgcttcaattgtagattttagtattgagcgaaaggttacacctacaggataggttctgtattacaggctaatcctactctactagtactaataggtagcataggggataaaagcactacacctagaaataggaatcaacaagagaaaaactttgttagaaattaaccctttcctgattggtatcagggctgggaagaatggttgggataacaaacaaccatcaagtttgtactttggatacccctataaccatcaaagatcgttgaagtggctaattcctctaaataggaggcgttgagaacaaagaaattcttggagctatcgttttcctctagcattaatagaattcattggtgttaagaaaaacctcttgtgggaaggttggctagagatttcttggaaaaataccagcccctttcggtccataatgagatggaactaattctatttttattctctagattttttcgcttagtactatgtacagaagggaggagccgtatgaggtgaaaacctcatgtacggttttggaacggagattttttgaatagaacgaacgaccgtaacggatgttggctcaatccgaaggaaattatgcggaagctttgcaaaattattatgaagctacgcgactagaaattgatccctatgatcgaagttatatactctataacataggccttatacacacaagcaatggagagcatacaaaggctttggaatattatttccgggcactagaacgaaaccccttcttaccacaagcttttaataatatggccgtgatctgtcattacgtgcgactatctccactatagaaagaaaaataagaaaggatcaaattttctagtatttactagaa

SEQ ID NO: 82823 - DNA, 1103 bp, Oryza sativa
tgaagattacgaagcgctttgaatttgaataagaccactctcctttttcagaaaatgggggtttggttgttgatccattaatcaaataaattaggtcggaagatcgaatcaagaatttcattatatctctttcctctgccttctattttatattatatttcataaggataaacgatagggtctagaatagaagtaataaagcgaataaaaaggggcaatataaatattgctaatatatcaggaccatcttattaataattctaatgagttatcttggaatttggaatcgaataaaaaaatctatattatgctcaaggaaagtagatatagatagggacttatactcttaaaaaaaatagactagctttttaattaaaaaaaggtttttttgttacgtggagaaatccaagataaaaaaagtccgttaggcacccaatccttatgtcataatagatccgaacacttgcctcagattgacttcaatatataattgctccagtgaataactaaaaaaaaatagaaggacggtagatagtaaagaaaaggactaatcataatatctatctttcaaaggttcactaaaaagttggcgggtctctttgtatgtcttgtccggaaagaggaggacttaatgatgattcgttcgccggaaccagaagtaaaaattgttgtggatagggatcctgtaaaaacatcttttgaggaatgggccagacccggccatttctcaagaacaatagctaagggccctgatactaccacttggatctggaacctacatgctgatgctcacgatttcgatagtcatacaggtgatttggaggagatctctcgaaaagtctttagtgctcatttcggtcaactctccattatctttctttggttgagtggcatgtacttccatggtgcccgtttttccaattatgaagcatggctaagtgatcctactcacattggacccagtgctcaggtagtttggccaatcgtagggcaagaaatatcgaatggtgatgtaggcgggggtttccgaggaatacaaataacctccggggttttttcagatttggcgagcatccggaataactagtgaattacaactctat

SEQ ID NO: 82824 - DNA, 611 bp, Oryza sativa
tcggacggggactgcggcgctctggcggtcggcgagctcgacaagggggtggacggtgacggcggcggtgcggcgaagccggagaatgcgacgctggggcgggaaacggtcccggcgagcggagagagccggccgaaggtcgtcggcgacggaggagagagagggcgacggcgcgagctcgattccggcgtggagaaggtgcggcaaaagggtggaaacgggcgaaggaggtgcggggagggtttaaatggggttggaagggggagagggcggccggggaaggaaggaaaccggccgggaggtccgaccgccatcaatggcgccggcgagatttgcgggagcaaatccagccgtttgaatgcgagagagagagagaggggaaaatggggggaaacggggaggggatcacggggagtaattcccccctattgatttcacgcgggacgacgggaggcggcgggattcacggcggcggcggcgctaggcgcgggcgaggcggcgggagcggcgggaggaaggagatgacgggtgggccccacccgtcagcgagggtggcgggcgggcccacccgtcagcggcgcgcgcgtggggagaggccggatgggccgtga

SEQ ID NO: 82825 - DNA, 10495 bp, Oryza sativa
  unsure (1)..(10495): unsure at all n locations
actgaagcaaaccaaaccatgtggtaaagccagtctaaggtatatcctcctccggatttgaagttggtgatatccggaagaagatctatcttggagaaagctgtagcaccttccagttgatcaaacaggtcatcaatcctaggtagaggatacttattcttgatagggacctcattcaatgctggataatccacacacattctttgggtatgatctttcttctccacgaagataactagtgctccccacggtgaattattgggtctgatatatcctttctgaagcaaatcatccacctgtctctttacctctgctaactcattagctgccattctgtatggtctcttatggatagggttggttccaggtactaagtctatccggaactctatgtctctcttaggtggcatacctggcaaatccccagggaacacatctggatagtctcgtactattgggatctcttgcaaagcaacttgatttaatgtcaaaccgtgagattttggggatgacacaaagaaagacactgtttgtccattgctacttgttaaagtcacattacggttagcacaatctataactcctatgtgacgggttagccagtccatccctaagataacatcaagatctttggattctagaaagataagtgaggatgggaaaggtatttcttctatttctatagtaacggaaggacagtactgcgttgaggatacttgattgcctggggtattaactagtaatggtctcccaagactaataacttccatcccatgattgcccgcaaaacttttagacaaaaaggaatgtgtagcaccggaatcacaaaacacagttgcgggtatagagttaataggaaacgtacccaaaaccacatcaggtgcattctgggtttctgcggctgcaacatgattaacacgagcctttggtgctggagcattggagttgttctgaacatgagcattcttcacacgccgaggcattggacacttatcagcataatgtcttggatcaccacaattgaagcacacccctggcttgcttccctgttccttcctgacaggatgattctgagttggagctgctacatgacgagtgaccatattacgattatcgttgctgggattaccagtgttgttgttgtagaactggcgttgagggcgagcaactaaagaggatcctccctgtgggtatggtgcagcttgaggtcccaaagcaatgcgtgcctctggctacaaccctgttgagccttgaaatgagcagccctacgctttttctgttccatcctattatacttgtcttcttggcgaatcgccttgtccaccaactgctggaaatcccggtaatccatagccatcaatgcataagacaactcatcattcagtccctctaaaaacatctcatgacgttcttcatcagtgcgaacatcttctggggcataacgagctaagcgattaaagtcatggaggtactctgtgacagaacgggatccctagttgagtgctctgaactctctcttcttaagggccacaacacttgatggtatgtgtgtcttcttgaaagcagcagtaaactcccgccaagtgataggctgtccctcggctctgtttagacaaaagtggtcacaccgctcagcagcaggaccatgcaactgatgtgaagcaaaggaaaccttctcctgctcggtgcactgaaacaaatccaacttcttttccatagcattcagccaatcacctgcctctactgggttagtggtgcttgagaaggtaggtggtctcacacgtagaaaatctgccaacttgttctgcggaggtggtggtggttgattcttgttatttgcctgctggttctgcgcttgctgcactaacagattaatcaactgggtttgctgggccaaaacttgggcaagtgtgggatctccttcattgtgaccatttccacttccagtgcgggtgttcaccatctgaagaaaagcatgggcaaaatgaaagaacgacagagagatacccttagaacggagaactttaattaattcaaattctatattgctcttaactgtgtatgattacatttaaattgaattaacactatctcaccagctaacttactctctgacaagcaaaacaactaaacttatgtagttacatcccaccaatgatgtaagcaacatgctaaacccacacacgcacaagcaatcttaagcaagcgaactaacacagcgaactacggcaacggtcaaactagacaacaactctcgccttgcgtcggaacgaagagatggatcttcctcctctggagtagctggctctctttcttctgggtcttcctcttcttcctcatcacttaagacatggatgacaggttcagcatgatcaggcacagcgtctcccaccacacgagtcttcgaagctaactggagacgaggtggtggacgggttctcttccttgcggtgaggcgaagcttgggtgctgacggtcgtgcttctcccttaagcccagctagtttcttctgcagacggtacaccttgctctccaacttacaaatcctgccacggttccagttttccctatcatgagctgctttctcccgctccacgcctactgcatccatggcgctaagcatatacacggcgtgcatcacaatggggctaccttcactttggggacagttgtaagttccatagtcttgaccatgaggcttgtgtgggtgatactggaaagctgatgactctaactcctcatcaaagcgatgacgtagctctccaatggccaccaaggttgcttcttgacaagcatggctgtactttcttcccccagcttcaaactttatcgacggaaggtcttcacgatcactagtcaacgtcacgcgaacacgacacttctcctcattggggtcatggggaatctggtgatactcaggggcaacctcgtaacctacttcaaatgccatcattctcagcaagcatatgacatactcaacaagccacacagcaataacgagcatatgacatactcaacaagccacacagcagatatgcaaatgcacaagataacaaaggatagcataatatgacatacccataaccgtgggcacggctattcgaatagttttactctgatcagagatgtaccactgtacccacaagacacaactccacatgtcaccatgcgcctcagtaccaccacggtaccttcgaaaggaactgtgacaatacctctaacacaacacaactcaccacagtgcaccgttcctggaacataatctccccatcataaccagaggcaatggactccccagcgacccccacggacttctcgccgcttcacaggctggcaccccgtaatgaatcatgctatacaaaaggtaaagccgttgcccacgctggcttgtggttggcacggtaaatgtttcacaacagtagctcgtgaaccggtccttaattgttataagcacgaccatcaaaaccatgtactcacaacccacctttaatcaggtttatgtatcaattaattatcataacacgattaactatcgtgagctaccactaaatataaccataagtaatatcgtaatatgattaaccccattgatgagctattcaatttattacccataggaaaataaagtcattgtcggccattaattaactgggaatggctcaccacccgacgacattcgaaaataatgcataagttgaaataaaacattagctttaaacgggttcaacatgctcaaagggttgtttcggatctgtgtgacttgccttgagcttcttcaaacacttctgaaccttcctcaacgtaaacgctctcctccggaacatcggaaactaaagcaaataaacaaaatcaacaaaacagtacaaaaacaagaataaacagtacatgtggatatttttaacatgtagatcttgattttagatgaatttagcaacttgaaccactcgaatccgagttacgatgatttagttatgaatttccagagtttaatcgattttcaactaataaaaaaactaataaaaatgatttatgacgtcatcgatgacatcatcgccgggcatggcacggctccacgcgaccaccggcgatagagagctcggttgggctatccgaggacacctacgcgaagaggacgacgacgcgaactcaccggtgcaagaaactacgacggacgacgacgtacggcgaccggcgacgaggaccaacagcggcacggcttggcttgacgacggcggcggcgttccagtggcttgcgacgacggcgaaggggcagccaaggtactcctccaccgtgcgaacccggcggcggcgacggacagcgacggaggtgacgctagcggcagcgcggcgtgactggagagtcgccagcgacggcggcggcttgagctacgcggcggcggcgctacgagcaacggcgagacacgggacttggggcaaatggaagaggacaactaggggatgctttatataggcttggattagagagatcggactccaaccgagaggaatcgagctgggaaaaactagggttagtttggagagataaactcaaaacgaattcgatttggtttattcgggcaaaattgatctccgaaactctaggggaaagggagaggataaggaggagatgatttcccctcaagcagttggactcgcggacaaccggttgaggaggaatcggaggagaggcggcggcgctcgggctcggctcggctcggcccagccggaggtacgggatgaccccgacatgtgggcccccatgtcgatgactagaggagacgaggggcggctcggcttggattggcctggcgtgggccgcacggccacgtgcgagggagagggatgttgggccggaaatggccaaacggccaaggggaggattctaaagactttttcaattaaaataattcgtgaaatgatgtttcgtttattaaaaatacttcccttgctcaaaaaattcccagaaaaatctagaaaatagataaacaagcaaagtatttaataaagttttatctagctcaattttatgttgaaatttttcctagattataggagtttagcttgtaggtttttaaattaatttctaaaaatgcattaaaaactgatttattaaattaggcgattttcagggcgtgacattgatatagtttaaacatgtaggttaccgaatctttaattttgggacccgacaaggtgtgtgggtgggggcccctgcgatttgggagcctagagcggctgtaccgctcccccctcccaagcttgccctgaatacatgggccttgaaaggccacatggaatcttatgacgatttctgggcttgatggcgacgaaaatggacgtcatagactctatgacgacagaaggattgtcactagattagtaacaaaaagataagctttctttatagaatgccattagagacgcatgataggtaacgaatgatattcgtcacaagaatgtcacagagttcacaacatagtgaatgatctatatatgggcctatttgtcgtccaaatacctacaaacaaccttggtgaatcatctctttgatcctaaattatattttcaaagagacaaagaaagagagagagggagttaaagtccaatttacacccaaacttcaccatacctctcatcttctcctaggaaacatctacatggggccactagacagccactcatacttggttgagcgaagtacaagtgggatcacagcctcaaaccactgccaactcctttaaatcgtttctacccatcatgttgacaactagctctcactttccacctttactttcaccattcactactacaaccaagatttttgtgtgagggctaaaacgatttttgcgtgcgggtaggcagcccgcacgcacctaggggtctgggaacatgacgatttttgcgtgcgggtggcgcaacccacgggaagacaaaaatccgaaaaaacttaatttttttttaaaaaaaacgaaaccctagaatccggctataggctttcacccgccgcccgccggccatagtgccgcctgcctcccgccggcctccgcgccaaccgccgtcagatccgcactcccctccggccgcacagccgccgacgcccctcccctccgccggatctagggacgaaaggaagaggacgggaggggagctgtatcccgtgcggggagagggcggccggccgccggatccgtgcgtgtacggccgccaccgctggattcttgcgttgacggccaccgctgctggatctgtgtagggacggccgccgcccgctagatcccacgccctccaccgccgtcacgtggaggaggccgctactcccaccgccgccgcaccgctgctgtcaccgcgcgctgacgccgctgccgccgtcgggaggagaggaggggagagtggagagagtggagaggagatgcaagagagagagaggactgaggagaagctctacgtggaaattttaaagtggaaaaagggatagaggggaggggagaggagagaaagaggaaaattttaaagctggtgagaggggaaagagggagttagtatttttgcatgcggctctctcaataggtccgcacgggaagatcggctcattttcgcatacagtccatttaagaggaccgcacggaaaaatcgatttttccatgccatcctcttaattgaaccgcacgtgaaaatgagccgattttcctagaagcaacgagttaccgcccctacggaatataaaagggtccctgtccaggaaaatcgtttctatattagtgattcgagaagttccttctctacctgatcgatccattttctttgtttccgttttggcatagattgaatacttggtggtgcactcgtcggcgtttcgagtgtccagagcaccgccatcgccccacatcgtcgttccaatcgactcaaaccatctccggccgaatcattgagccaccgacgtcgccaaggtcctagcagaaagacacccaaatatgatcatgccaatacgccgccgcaaacgccgtcggtcgccattgcccttttgttgcctctgcttctccagccattgagtcaccataagtgggcccgggtgtttagccactacattaggcgctaaggactttaattagtagaaatttaaattttgtaaggtttattttttaaaattgctttgtatgccatgtgggcatatggttctaaacgcaattcacctaatacccagtgacctttttgtatatggtttagggtaagccctaatccctactcagaaattactatttcatggatttattacttgatataatagcttgatgagtatattgtactcacccttgctttaaccccctctttcagaatcaatttggagtttttgccgaagccaggagtttaatcatataaattggtttcattccaacttagttcccaagtatagattagatatatggtttaattctatagcaaaacattagagttggctcatcctatagcttctacggtaatagttagccacaatcttgtaaataccctattattttatgtaaagaaatctccattggagccttaatcaaatgtatgcgatgaagattcagattgttgaacatgtatcaatctactaatccaggggttcatatagtttaaacatttaggttaccgaatctttaattttgggacccgacaagctgtgtgggtgggggcccctgcgatttggccagcctagtgcggctgtaccgctcccccccccctaagctggccctgactacaagggccataaaaggccacatggcatcttatgatgatttctgggcttaatggcgacgaaaatggacgtcatagactctatgacgacagaaggatcgtcactagattagtaacaaaaagataagctttctttatagaatgccattagtgacgcataataggtaacgaatgatattcgtcacacgaatatcacagatttcacaacatgacttgaaattcaatttttataacgtaaataagcgtcacctataataagatctcttgtagtgatggcttgtttggctattagagagacagtttgagacatacaacacacagagctaattgatcggcgatccacttgggtttctggtgatcatatgcaacatggactaagttacttggatttgttcaaatgatctgcttcttggatgctgtccggccacgtcgccatgcatgcgaattttgtggatggagccaaaagctgcatgcacggagctgagtaggagacgacgtagacagatctgcacatcgtggaccatgctgcttgatgtggtcggatgtaggtgcagtaggaataatccttttcataatagtgaaactaaagaatttcacttgccaactagtttttttagagtctgtacagaaatgaaactttttgaaaagtgctccagatgaccaagttcaattcaccaaccgtaatcgcgtgttggatttacatgaaaaatacgagacagacaaaaatgatatctttcggttctaaattaatactcccggccatttgagagtgtaggatggtaaagggcctttcccaccccaaaagctagccattgaggtgaggggctcccccacttatatcttaggtcctttgcccttccacaaccaatgtgggactattcaacaatctcccccttcacacattggtgtctctcagcccttcaccgccccttcaccgtatccgggcccccaccggcccacggtccatcaggtatacgggtcccgcaggcacccacggtctatcaggccttcacacacgtgtccatcgggccagagaagttaacctagcctggctctgataccaattataggatcgtaaagggcatttcccaccccaaaagctagccattgaggtgaggggctcccccacttatatcttaggtcctttgcccttccacaaccaatgtgggactattcaacagagaggagcaatatgtacatatgcatgcatcacatctcagtgttttttttcttttttttccttggagttttaagaatgctcataattagggcatgcaagttgatccattagtatattcgcaatatttgatgatttttttcattttaaaaattgttgacgatattagcttaattttggtatggaaaatatcggttaatttattcccaatttttatctcaagcgagaaaatgaaccatgagagttgaggtgctaattaaccacaggcaaatattcattttaatttgttgtgtatatatatatatatatatacacgagcatacatgtgaagatggaaatatgtgaaaaatataatggtgctagtagatttgtctaaaacacttccacaatacaatgatcatgacactcgatcaggtctcaaagttaaattttagggattgtgtcaatatcaaaattatcaatgaataattggccagagggccgggattagcaagggtctactactgtcctgccatttcattaattaattagattaagtccccgattccttgcatccctaattggcctacgagaatcgacaaaaatcgcaagatgagaggattgtggtaggtaatcttctccaactgtgcctctcaatcggccataacatattagctagaaggataaacaaacatcaatctgccttcacagttttgatcatctcatgagacacatatatataaaccacccataagcaagagtctccaaggtgaattaattaactatgttgatacacatatacttaattggtataagagcattagtagtggtagttaattagtataaaagcatccatcaaaaggagactgttagctagctaggagaccgggcaagcaaagcaaagcattgatcttgatgaatcctccagagagattaattgcatattgtccagttccccctgacctattatacacatgcaagtgctctatgtacttgtgcggtgcaacgacgagcaagagtgcgtacgtttatagtagaactgagggggtgcgccttatatacgccggacgaggaagagtgcgtacgtttgtagtgatgtctccaattttagtttctgtcatagtgaaatattcgacgtttgacacctcgaaccatagaaaaactggagctgtgaaatgttttcttcttttttatgcgtggagcactgaaatattgacagttttgtttttttctataaaaaaagaagaagagttgacgacttgatgggcaggctctcctcgatggagggagatgagcttaaaaagtcgcaataaatggaccgatgtagtggaaatgtggagtggagtggagcagtaataaaatttaaaacgccacgcgtagggcatatcgaccacgactggactctccttgagatcttcgaacagtgtgtgcttgctagctgaactgcagcagtggaacagtaataaaatttaaaacggatgtgcagtgttcacagaggatgagtgtgctatgtgttctctgcttgtgaatagatatggcgatctctgcatgtgaatagtgatgancttcttgcagtagcnagacaatgcacntcaaatggcgcag

SEQ ID NO: 82826 - DNA, 7812 bp, Oryza sativa
ttgcctgtggagtggagtcgccccgctgcagaagtcaagcttccgagtctagctcgttttttcttttccgctgcatttgtaatcttttatatttttgtaagacgtggatctgtatgtcaacaactgtcgtttgtgtaccctggctggtcctagacagggatttaatgcacattcagcttaaaaattctggttcgtgaatttctgggcgtgacacgtaacgatagatgacagtgggatgacaacggttgaccttaacaaggttcgatactcggacgaaccttttgtccttgccaatgatgtaacgcaagttttttatgtgaaggacatatctagcaaaggaaagaagggcaaagggcctgatgagccgaagtgccacatggttctcccaggcaaaagaaaaatcatcggagttgaggacaagactgacgaggattatgatcagtgttatgggcaaccccctttcacggtgacggttgaccctatcatcctcctatcaaacgaagacaccccttactcacgtagcgatcacaaggaaggaacaattgtgaggcggaagtacgtgcggtcaaccgtcatcgccgatatactgccataattgttgtgtacacgatgtaaaatattttagatgtattgaatatccatataaatcaattgttgtatggcatatgttaattatgtatgattattagaatttttaaaattttaaatcatgcatatgctacttatatatgataattagaatttttaaaagttttaaatcatgcatatgcttattatatatgattattagaatttttaacaattttaaatcattcatgtggtatttacatatgattattagaatttttaacaattttaaatcatgcatgtggtatttacatatgattattagaatttttaacaattttaaattatgcatatgctagttatatatgattattagaatttttaacaattttaaatcatgcatgtggtatttacatatgataattagaatttttaacaattttaaatcatgcatatgctaattagatatgattattagaatttttaacaattttaaatcatgcatatgcttatccacttaatatatttttaaggttttgtcattaattttgtgacgtgaaatcattatttactattttagaaacccatacataatgaaattaaatatgtagtgctattatctttagtccaggttcttaaccctaaccgggttaaaaaagatttggcaatcgcgggaaaaaatcaactaggactaaagatccgatatgctcgaggcgcacttgtcttctccaccagcacttagaagtttttctccgatctcggcttctccttcaccgccactgcctagggcatcccacgcgccgacgccactgtcgtctctcaccgtcgtctcgctgtcgtcgtcgtcgccgccgccgccttctcgatctctctctctccaaaccgccgccgcctcgtcgtcgtcgtcgttgcgacaccgccgtgccacgccgatgccgaccccgactccgcctcccgccgatgccaaccccgacgtcgacccggccggcactgtcgacgacgtacgccaaccccgtcgacgccgaccccgcgatgcgccgtcactgccaacaacgccgccgccactgccgcgccttgccatgccgccgcccccgctgcggcacgccaccgccgctccttttcggtgccgccccatcaatgccgaatgggaacgaacgcgaacggaagtgaacggacgtgaacgaatgcgaacgaacgcgaacgaacgtgaacgaaacgtgtgaacgaacgcgaacgagacgtgtacgaacgagaaaattaaacgattattagacttagcatatatgattatatacttgaaaacgtgaacgaaaaatatatgttcctttgcatttcggctaatacattttttttgcatgttgcagaaaatatgtcgtcgtcgtccctcaagccgaagtggtagctagccctcggaggaatttgcgcaggcaagtgatgtaaagatatgattatctagagttaccacatatgattattagacatagcatatattaattattagagttttaatataagattattagagttttaatatacgaaacttagactgaacatatatgattattagagttctaatatatgattattagagtatcaatatatgattattagacttagcatatatgattattagacttatcatatatgattattagagttttaatataagattattagagttttaatatacgaaacatagacttagcatatatgattatttgatttctaatatatgattattaaagtattaatatatggctattaaagtattaatatatgcctattaaagtattaatatatgaaaatgcccccaagaagaagtaccatcaccacctgggtcaggcggctatagcgtcgcagtgccaaagtggaggagatggaagcaagcttgattgagaggggtatcgaaccggtcaccgctaaatggccggatcgatcgaagttctggtactatgctcacggtggaacgcttaaccccgttgttgtcttccgtgaattagattaagtgcagggatccgtttacaattgtagaaacacactgacatatgggcctaggactgcgggttgattcctagaaacctcaagggcctttgtgcatattggtccctcacagccacgtggacccatcctttaaaatctgaagaaaaattaggaaaatgcccaaacaattatatgtttagcagaaaaatgcacaaagttgtaaaatctatataaaatcaaatatagctcattttgaagtgattctagttgctgtagattcttgaagttatgaactttattccaggaatataaaacttgacactcactgtacaaataatgtctctaaaatttatctaagataggtcatacataaaacatgtacaaacttataaaatacatagaaaattcatcacaactcattttgaaacaaaatcaaattctacagattcatcatcatacagtctctgattaggtgaaataaaagtaattacttactttgcatcaaatgcctctaaaactattatctctataatgattagttttagataagctaaactttagaaattcatgtagaacccaatttagcttcaatttgagtaaacttaagttctgtaggatcactaaacatgtatttctaagttatgaaataagattatatacttactgtgtagtaaaagtctctaaatattcatataaggatttactaacatagagcagcctttaatttgtaaaacttgtagaaaatttatttttagtccaaatgaaatgaacaaagtttctatagaaccagcaaatagttatcttcaacatggtaaaataaaatttggaaccttttgtagagaacatagatcgaaaccttaacttagtgaaataagaatttaaacacatagttgtttaagtaatacataaacatgtataagtatatatatacactttaggtctaattaaacctaaataaaaacttgattgaccagtgaagccatagttccatcctcatccactaaaacttagaagaacttggctcatataacaatttctaggttaatataatatattgctagtttagattagagcatctctagtttataaaatatgaaccatactagtaaagaccataaacatgtgaactaaaaatgttttagataaccaaattattccttttattcaacttaaacaggaagtagcatgttctgaacctataactcaaaagtcatgaacatataaaacactatacaccaataacacgttataacttgtaaaatgcataaagaattcattataaatccaaaaattgtgaaaccaaatgtgttagtattagaaaacacatctccacacccctgtgaagtctaatctagtaaaaatcactttacaaaagtatttcataacactacctaagactatactactataaaccgataaaacttctaaaaagttcataactccctaatggaataagttaaaataaaaattctttcacctaaattcattttagatcagtaccaacccactgtgcataaatcatgcattttagagcattttggattttcagctctttcggtgtttaattgcatatcgtgtccttttatctagataattgcataatcggtgaaggagtggattaggtgctaacaattctctgatcaaggcaagttttctcctcccatcctttgaacacattgaatcccatgatttgaggaatgaaaatatttgtttgcaaagttgcatgtgaacttagattatatcggtatttgaaattgggttaaggtagttatgacctatttgctgcataccccaccttgaataattgatcctcttgctgtttgaacccctagaaatggttagagtacactctttgtgctcaaatgggtttatatatgctctatgtgcaactactttgcttagccatgcttagaaatatgcaaatgctcattccatttataattaaaatgtggttttgatacttgaaccttcgctagaataaaatgaatatgatgggtatttgcgaactaaaatgtgtaaaatgtgattttacacttgggcagcaagtggtgtgcatacagtgttagttgcataccgatagggggagtgtttgcccaagtccataaggaccgaacttgtgtcacccatttaaagttattcgtacatccatatgtgctagtatgggatggcctaagctgattaatctatttaggactagccttgcattctggtaggccggtgtgtatgagttcgtataattcagaggagcttcctatttaccccgacgtggtagtttaggtgactaagcgtgtccaatacaacggtattgtgccacgtggtgggttcccgtcgtgtccgccaccacggtgttaagtttaaggcgtgggcccgccacttaacggttctaggtatattccaagtatgcctaggatggaggaacacgtatcgtgctggtgcaaggctagattctaagtagtgtaaaggcttcgttatgacctctagatcacattcaacatgaagagtgtgatggagtcttgcaaactcaaaacaaactagagagttcatatcatgtgggtaaagctgtacaaactctgcagagttctttaaactaatcgattagccgtgctcacggtcatgagcgctttggtgatgtgtcatgagtatagactatgttttaaaaatgtgatcatgtgacattggtttgaaattgataaatgtgttgagttgtgtgtgtggtgatacattatgacttattgttaaatatggcaataagagattgattatgatggaattatgaagaagttaataatgaaactcaaaacttgtctttgttaattgaagcatcaactcttttacaaaagaattgcgaaacaaaacttgctttatgctgaaaatgaactacatattgtcttcctttgatatatgccttacatgtagtatagtaggattgacttgtgcttgccagtacattaacttgtttaatgtactgactcttgctgttgatataaccttttgtttgcaggtttagtcttagtctttgagtgatgcgggttccgattgcttcttctaggatgagaacttaatggggtaaacccctagtcggtgtgcttgtgattgggtagtcaagcttccgctgttctctaataagtctatttggccggttggcctatgtaattattaagttgttgtaagtcttaagtttctttcatcttagttgtgtttgctatgtgtaatcatgcttaagatgaaagtgtgaatctagtgcacatcctgggaactagattcacatgagtatgagttaggaatatttgagaggttgtagatctttagctatttttatcaagtctcctgaatgtgtaacacatctggtcgccgccttcgagtggtttgacgggcacatctcaggctgaagttgactggcaggctaagggctcagcaatgtctccaatattcctctctcgaggcgtcggatgtttcattatgcttgtttgatgacttgaattattcacttcatctcaaatataatggaaggtccggagagcctacgacacttagtcttgggagacaaatagccacactaaaggcaatacagccgaggaatggcaaccttactcacaaggacaaatagtcattaaaaaattatgacagcactaaccatatctaatttcagttcaccaaacttacatttaaatttaggcagtattacggagatctaaatcaacaaacaacaaaccatacttcattgtcaaaacaaatggccttctatgtactttacaaattctcacaagatcatatttgcaatttttcctaaactaattaaccaagagaaaatatgtagtggaggattccacatataatttcacagcataagtacataatacaatatggtataatacacatatgcacagtactttgaaatatgcataccagaacatatgctttagttcactccattcattcttgcattcttgcacattcaacatcaatcagatctaccaagcattcttgtacattcaaccacaagcagatctaccaatgaatcactaacttatgtagcaatgggggaaatcggaggagaattaaaaccattcctcgtcagacgacggaaggacaggaggcggcggaagattcaccggctgcacaccacggcacgcgaatccctgaggtgtgggcatcgcatctatcagcaccaacgacatcggcagaggcaggggtggactggggctctttcgtagaccgatgtaaactagacttgttggcttcgttttagggaggggacggaaaagagataaactttacccggctggcctttgggcctgcgtggagagggataggagtttgcttggtttcagccaaaagataggaagaggattttaaataggttgcatatgcatgctttgtctaaagaaaattcctaaaaataaatgaagcaacaataaatcccaccaaaattctcataaatactaaacaacaccctaagcttccagcaattttagtttgaatttatcacatcaattgataacccaaataaatctttcaacacagctaaaaatctggaaacagcataccaattagcctagtttgcaccttcaccaaaattaaaccataactcctctagcaaaatctcaaggtcagaatgttaaacatactttatcatctggtgcaatggcttagtctaattcgaaatgtaaccacatgaaatgagagccataaattacgtaaactttggaacttggcaccttgaaccatcaaatccttgtctaccttgccgtctcccccctaattctaaattaaatgtatgagagaaagagagtaatatagtttagtgtgatagtgccaacacatggaaaatttagagcttctagttctctccttctacatctctcttaaatgtgggaccaagtccttgtggggcccactcatcatacaaccatagccaacacatcatctgctcttctctcatttaaatcttcttttatttctcaaaaggtgagagaagggtttaaattgaatttccacccaaaatgccactctaccactccaagccttctaggaaacatctatatatgggcctatttgtcgtccaaatacctacaaacaaccttggtgaatcatctctttgatcctaaattatattttcaaagagagaaagaaagagagagagggaattaaagtccaatttacacccaaacttcaccatacctctcatcttctcataggaaacatctacatggggccactagacagccactcatgctaggttgagtgaagtacaagtgggatcat

SEQ ID NO: 82827 - DNA, 5643 bp, Oryza sativa
atagtagtgattcatgaagttccttctctacttgatcgatccattttctttgtttcttttttggcatagatcgaacacttggtggtgcgctcgtcggcgttcccggtgtccagagcgccaccatcgtcccactttgtcattcccgtcaacttgaatcatctccggctgtaccattgcgccactgacatcgcctaggtcccagcagaacgacgcccacatatgatgaagccaatacgccgccacgaacgctgttggtcgccgttgctctcctgctgcctctgcttctcttgccgccgagtcactgacatgtgggcccggctgtttagccacttcattaggtgctaaggactttaattagtagaaatttaaatcttgtaaggttctttttgtaaaattgctttgtttgccatgtgggtttatggacctaaatgcaattcacctaatgcccagggacctttttgtatagggtttagggcttaccctaaaacatgaaattactatttcatgcactcattacttgagattttgccgaagccaggagtttaatcatataaattagtttcattccaacttagttcccaactctagattagatagatggtttaattctatagcaaaacattagagttggctcatcctatagcttctatagtaatagttagccacaatcttgtaaatacccaattattttatgtaaagaaatttccattggagccttaatcaaatgtatgcgatgaagattcagattgttgaacctgtatcaatctactgatccaggggttgattgtcacgcccggaatttctatccaaaattccaaacgcttacatgtgcgttaaaccctcatccaggaatcagccgaggcacacaataacaaatgataatagagtactatcaaatatctaattaatgtgtgcaaaataaattattacagaggtggatagttcctctcaaagaataaagttctacgcagcggaaaaaaaacaaaagactaaacatctttggcgactccactccacaagcaactcgacccgaacaaagcctaatcctcctgatcatcaccttcattgaagcactcctcctctgaagaatgaaaattgcaagaatgagcatatgatatactcaacaagccacacagcaaatatgcaaatgcacaggataacaaaggatggcataattaagctcattcgcataaacagcatttaataaacatttgagagaatagtaaaacagttaagtaattaagcaatattaaataaacactatacaacacacccatgttgcataggcccaaccttatctgaacaaccaacccctaggtgtacaaatcaaacctccaaactaggaaatataccattccaaaccaggagtcaatttagttatcacagtattttcattaatactgagtaatatgagactaatcacgaaaaatattgttagacccacccataaccgctggcatggctattcgaatagttttactctgatcagagatgtaccactgtacccacaagacacaactctacaacatgacacaactccacaagacacaactccacaacatgtcacaacatgtcaccacaaaaaggaatgtgtagcaccggaatcaaaaagcacagttgcgggtatagagttagtaggaaacgtacccaaaaccacatcaggtgtattctgggcttctgcggctgcaacatgattaacacgagccttcggtgctggagcattggagttgttctgaacaggagcattcttcacacgccgaggcttgggacacttatcagcataatgtcctggatcaccacaattgaagcacacccctggcttgcttccctgttccttcctgacaggatgattctgagttggagctgctacaggacgagtgaccatattacgattatcgttgctgcgattaccagtgttgttgttgtagaactggcgttgagggcgagcaactgaagaggatcctccctgtgggtatggtgcagcttgaggtcccaaagcaatgtgcggcctctggctactaccctgttgtgccttgaaatgagcagccctacgctttttctgttccatcctattatacttgtcttcttggcgaatcgccttgtccatcaactgctggaaatcccagtaatccatagccatcaatgcataagacaactcatcattcaatccctctaaaaacttctcctgatgttcttcatcagtgcgacatcttctggggcataacgagctaagcaattaaagtcatggaggtactctgtgacagaacgggatccctggttgagtgctctgaactctctcttcttaagggccacaacacctgatggtatgtgtgtcttcttgaaagcagcagcaaactcccgccaagtgataggctgtccctcggctctgtttagacgaaactggtcccaccacttagcagcaggaccatgcaactgatgtgaagcaaaggaaaccttctcctgctcagtgcactgaatcaaatctaacttcttttccacagcatgcagccaatcacctgcctctactaggttagtggtgcttgagaaggtaggtggtctcacacgtagaaaatctgccaacttgttctacggaggtggtggttgattgttgttatttgcctgttggttctgcgcttgctgcactaacagattaatcaactcggtttgctgggccaaaacttgggcaagtgtgggatctccttcattgtgaccatttccacttccacttccacttccagtgcgggtgttcaccatctgaagaaaagcatgggcaaaaggaaagaacgacagagagatacccttagaacggagaactttaattaatttaaattctatattgctcttaactgtgtatgattacatttaaattgaattaacactatctcaccagctaacttactctctgacaagcaaaagaactaaactcatgtagttacatcccaccattgatgtaagcaacatgctaaacccacacacggacaagcaatcttaagctagcaaagtaacacagcgaactacagcaacggtctaactagacaactactctcgccttgcgtcagaatgaagagatggatcttcctcctctggagtagctggctctctttcttctaggtcttcctcttcttcctcatcacttaagacatggatgacaggtttagcatgatcaggcacagcgtctcccaccacaccagtcttcgaagctaactggagacgaggtggtggacgggttctcttccttgcggtgaggcgtagcttgggtgctggcggtggtgcttctcccttaagctcagctagttccttctgcagacggtacaccttgctctccaacttacaaatcctgccacggttccagttttccctatcatgagctgctttctcccgctccacgcctactgcatccatggcgctaagcatatacacggcgtgcatcacagtggcactaccttcaccttcgggacagttgtaagttccatagtcttgaccatgaggcttgtgtgggtgatactggaaagctgatgactctaactcctcatcaaagcgatgacgtagctctccaatggccaccaaggctgcttcctgacaagcatggctgtactttcttcccccagcttcaaactttatcgacggaaggtcttcacgatcactagtcaacgtcacgcgaacacgacacttctcctcattggggtcatagggaatctggcaatactcgggggcaacctcgtaacctacttcaaatgccatcattctcagctccctgacgaatcctagcacctcgatcaagtttttcggcggatggggcggcatataaaggaacattgaaaggaaggaattaatgcatatttttaagttagctgcacaaactagacttaattaaattggacccaaagaaaaagaaaataaaagaaaaggagcaaacatgactcaatttttttttctttttggaacataaatcaaccttgaacagagacaaataacttttgacaaatgaataaattaaaactaaaatatttaggatctaccaggagcacggtacagagtcaccattaacagggatgagtagtactgatgccatcttgattgaatcgataccataatagatgtacagtgccgactaaccaatgaaattcagaaaattatactatttaataccctaaacagtaaagttctttttctttcaaaataaaagaacaaatttctgttttgctaaattagaatttaataaattttgtacataaccttgcatgtggtgccaacttaattaatttataagagaatagagaagagcagttctattttccaaaataatttgaaggaaacttaaggtttaccatttggcttgtcctaaggtcaaggtggctctgataccaacttgtcacgcccggaatttctatccaaaattccaaacgcttacatgtgcgtcaaaccctcgtccaggaatcatccgaggcacacaataacaaattgataatagagtactatcaaataattaattaatatgcgcaaaataaattattacagaggtggatagttcctctcaaagaataaagttctacgcagcggaaaaaaaacaaaagactaaacatctttggcgactccactccacaagcaactcgacccgaacaaagcctaatcctcctgatcatcaccttcactgaagcactcctcctctgaagaatgaaaaatggcagaatgagcatatgatatactcgacaagccacacagcaaatatgcaaatgcacagaataacaaaggatggcataattaagctcattggcataaaaagcatttaataaacatttgaaagagaatagtaaaacagttatgtaattaagcaatattaaataaacactatacaacacacccatgttgcataggcccaaccttaatttgaccaaccaacccctaggtgtacaaatcaaacctccaaactaggaaatataccattccaaaccaagagtcaatttagttatcacagtattttcattaatactgagtaatgtgagactaatcacgaaaaacattgttagacccacccataaccgcgggcacggctattcgaatagttttactctgatcagatatgtaccactgtacccacaagacacaactccacaacatgtcagcatgcgcctcagtaccaccacggtaccttggaaaggaactatgacaatacctctcacacaacacaactcaccacattgcaccgttcctgatcataatctccccctcataaccaggggcaatggactccctcgcgacccccacggacttctcgccgcttcacagtctggcaccccgtaatgaatcatgctatacaaaaggtaaagccgttgcccacgctggcttgtggttggcacggtaaatgtttcacaacagtagctcgtgaaacggtccttaattgttatgagcacgaccatcaaaaccatgtactcacaacccactttaatcaggtttatgtatcaattaattatcataacacgattaaccatcgtgagctaccactaaatataaccataagtaatatccttatatgattaaccccattaatgagctaatgtttctaagcatggctaagcaattatacctatatagcacctagctaaaccaaaccaatatataaggtccaagctattcaatttatta

SEQ ID NO: 82828 - DNA, 4552 bp, Oryza sativa
tattgttctttaattaattcaaggccaaaaatccgacaatcaagttgggacaagaaagtatagcgcctagacaaagcatctgcaatcgcattatctttccctttcttgtgtttgataacataaggaaaagattcaatgaattcaacccattttgcatgtctacgattcaaattattttgagagcgaagatatttaagcgattcgtgatcggagtgaataacaatttttttaggccacaaataatgacgccacgtctctaaggaacgtacaagagcatacaattccttatcatacgtggaataattcaaaacatgtcggatcccaaaactaatgatttggaaaccgacatgtttaactgtatcaagccctggatcagtagattgatataggttcaacaatctggatcttcattgcatacatttagtcaagactccaaaggagatatctttatataaaataataggacatttacaagtttgtggctaactattacagcagaagctatacgatgactcaactctgccgttttactatagaattaaaccatctaactatgctagacttgaagattaggtttaaagggaactaacttatgtgattgaactcccagcatcaacaagaactccaaatagactctgaaaaagaggggttgaagtaagggtgagtacaacgtactcagcaagctattatattattcaacaatgaatgcatgagaggtaatatccgtgtagagctaggtttacttgcagaaggctgagaataaagagggagaaagcctgcaacgtatttgatgcaatagtatttaataaaatctggaattgagtttctaaccaaagtaccatatgagtcccgatcctcaaatccgtcagttcggctattcgaatagattcaaggatattcatactgcagtagatgtacgctttacccgcagtccatgacttgccactaatcattagcttagtcatggcccattattaggttattaacaattgtggcacctgttccatgaactctagtccccatgcgctatgactgtaacgttatcagcagcgagaggagttctggcattcccacgtcatctcaaccaggttttcataaatttacacacacatcgcgcgataatcaagatatttacctgcgcctcggtaaatatcacatttgcccttcgcggcatatatttgcctccttcgcgaggacttacataagaaccactgtacagaggtaccacattgttaattaacataatatctaggtctgtccccattgtagaagctgcggtcgtactcgttcgtttgacataagtacttggtaaacttatatcgaccgagacagtactagccacccggaaatcaaccaaatcttgcgtactgtcccaatctaagttcattatattttatgcaatctaacttggcagggctaagcaaaagctagcatatctggtttgctatatgtttaggttatgcattgtaaatcatgaatggctaatgcatgtgtaacatacccgaaattttaggacttaaaatttcttgtcaaaatagttagaggttaatttctccaattttgagagccaaaaatttctgttttaatttaggtgatgaccaacttaaaccattgcatgattaaaatttgagaacaaaataaaaccttttcattcccaacattagactagaaatatcatcaagcatacatgtacataatgcatgcctaggcttgagttctttgtgcatttggagttttggtcttgcattccataataggtcccatgagcataatctaaaagaattatttcactaaacaaacctatagttaatcttgggtgataacatgtggacttaatattaaactcaaatatcatcttctcagtctaaaagaaatttaatgtaatccctataataatattagatgcaattatgaagtgggaatacatatacaaacaaaggtcatcctaattctctaaaatattttgtgcaagataaaatcatggaaaaatttatgtgtacagtgattagcacaaacttatcctctgtaattttggtaacatgttaacactcaagttgatatctcaaattaatcagttaaagcagacaactaaaagaaatcaaattaaatttaatcggctaaaaccatatttcatccaaaagtacatttaactgcacataagtgaacatggaaaataatttattcaaatactagattagttatcatgaataaatgtaatttttctagaattttcttctctgtttaagcctcctaaaaattcaatctagctttctaatagcccatctttgtttaatttctgtgagcagtccacccattatttttgagtgcaaccaaataaaatggaatctaggtgtaatcatctacctccagtaaaatcaacactagataatttggtccacacattaagttatgaagctacaaagttagaggagaaaataattccgaaaaaaatgatataaaactcaagtttacccagaatcttacccaaccctctcaccctagcctagtttgccacgacttggtcccacctggcagcctctccagctcgcccttcctctgtcccacatcctcagccgaccaagaaacacagagagggagagatcgagagccgaccgagtcctggacgcgtcgacgcgtggtgacgacgtgtcgacgccttcaagtcactgagtcatgcctccatctcctctagaccgagtcgcccaactccacacatcactttgaagctgaagaagccgagggagaggtcctcagcctctccgtcatcctcaacctcgccgccggtcgtagtgacgacgaccttcgccatctccgtttgagtcaaggtcacctccatctctttcgcgttcccatctctccacacaatgccgagcatttcctcttttgacctaaacccctctcgtgcagtgcatcgccgggaacgcaagccacgtcgacaacgccctggagcacgcaccggagcgccgccgcttcaaccatcgtcgtcgtcgtccggccattctcattcacctcagagaaagctgctgcgccattgtcattgcctcaacctcctcttcaaaacgcctcaagaaccccagccggaaacatcaagaacacggagaacacatccttttcttcaccggcgccaatctaggatcgcctccgccgtcatcgtcgtttaccgctgcctcggtgagccattgttcgattccttgcgcatacaccatctccttgacctcacaaccctcgtgcatgcttgcttgaagcagctcattgtcccgttcgagccgtcgtcgttcacccgaggaggagcgccgtcgccgagccgttccacaagtcaccgctgccgccaagacctcgacaaccctagctcgacccacggtgagcatcctgaagtctagaagactacatgcatgcatccttttcgttcgtaatcgacttccatgcacacatgcactttcaccccaaaaccaccgccgctcacactcgccatcggcgctactccgatgtcctctaaccaggaaaactagaggaatggaatcgcgagagctttctcttcattttatcttttgacctcaacctcaaacgagccaccgtttgccgccggcgagctccagatcgagctcagccatggctagctctgctctgcctagagcagagggatgacttccgtgaattagattaagtgcagggatctgtttacaattgtagaaacacactgacatatgggcctaggactgcgggttgattcctagaaacctcaagggcctttgtgcatattggtccctcacagccatgtggacccatcctttaaaatctgaagaataattaggaaaatgcccaaacaaatatgtttagcagaaaaatgcacaaagttgtaaaatctatataaaatcaaatatagctcattttgaagtgattccagtttctgtagattcttgaagttatgaactttattccaggaatataaaacttgacactcactgtacaaataatgtctctaagatttatctaagataagtcatgcataaaacatgtacaaacttataaaatacatagaaaattcatttcaactcattttgaaacaaaatcaaattctacagattcatcattcatcatcatacagtctctgattaagtgaaataaaagtaattacttactttgcatcaaaagcctctaaaactattatctttaaaatgactagttttagataagcaaaactttagaaattcatgtagaacccaatttagcttcaatttgaataaacttaagttatgtaggatcactaacacatgtatttccaagttatgaaataatattatatacttactgtgtagtaaaagtctctaaatattcatataaggatttactaacatagagcagcctttaatttgtaaaacttgtagaaaattcatttttagtccaaatgaaatgaacaaagtttctatagaaccagcaaatagttagcttcaacatagtaaaataaaatttggcaccttttgtagagaacatagatcaaaaccttaacttagtgaaataagaatttaaacacatagtgttgtttaagtaatac

SEQ ID NO: 82829 - DNA, 8264 bp, Oryza sativa
cgaaagtgtcgtacgccgctcttgtgggatcaaaccggtgagcgtcaagtatttgggacagacatattgcgagaggcagaagaaaaagtgaagattatccaagaaaggttgcgcgttgctcagtcacgtcagaagagctatgccgacaatcgtcgcagagatttgactttcgaaggagattatgtgtaccttcgggttacgccgttacgaggtgttcatcgtttccagaccaaagggaaattggcaccgcgtttcgtgggaccttttaagatcgtaagtcgaagaggtgaagtagcttatcagctagagttgcctccgtcaatggcgggaatacacgacgtgttccacgtgtcacagttgaagaaatgtttgcgtgtacctacggaggaagcagatccggaacatatagagcttcaagaagatttaacctatgttgagaagccagtcagaatcttggaagtaagtgagaggaataccaggaatcgcgttatacggttctgtaaggttcagtggagcaatcattcagaagaagaagccacttgggagcgagaagatgaattaaagtcagctcaccctcatctcttcgccggttcttctgaatctcgaggacgagattcccaagttaaggggggcatatatgtcacgccctaaaaattgcctaatttaaaaatacattgtttaagtcatttttagaaattaaattaaaagcctacaagctaaacccaaattatctaggaaaattttcaacataaaaatgagctagataaaattttattaaatactttgcttattcctctatttttaagaattttctgggaattatttgagcaagggaagtatttttaataactgaaacaacatttcacgatttattttaattgaaaaagttctaaaacccctcctttaagttgttgggccatttttgccccaacatttcttcttcccgcgctgccaagccggcccaaagccggccgagctggcccaccagcccaccgagccgccagcccctctcccctcacatggaggctgacaggtgggacccacctgtcggtggtgtctcccacctccagccggccggctgtgcaagccgagcccgagccgagcacgagcatcgccgtgccacctccaatcccaccccaaaccggccccgattcttccggatttttgaggggtttttatcctctcattctcctctatctatccccccaaaaatcggagcaaatcgttgagtattttatcagaatcgaactcgttttcgagtttatctccaaaaccgagtttttgatttcccaagtcgatttcttgcgggaggagtccgatctcttcaatccaaggctataaataggaccccctagtccttctctttcgtttgccccaactcccgtcctctcccgtgcctcctagccgccgcgccgccgccgctaagcttgccgccgccgccggccatctccggcgccgccgcccagccgttgccgccgtcgccgccgcttgccgccaccgcctttaggtgcgtgggagcgaggagaagctcggccgcctcttccccgcagccgccggccgccgtagcccgccgcccccgtgcaagccgagccgccgccgccgccccttcgtcgccggccgccgtcgtgcgtcgttcggcgtgtaggtgagcaccgtcgggttcgtctcgtcgccctctacgtgtccatgtgctccaaattcgcagccgactgctctagctccggcgaggttgccatcctagccggccaccattgatgatgtcatcatgacatcatcggtttttctttttcccgattttctaatagattaaatcttcggaaaatcataactaaataaccgtagatccgtttcaggtggttcaagttgctaaatttttctaaaatcaagatctacatgttaaaaatatccacatgtactgtttatgcttgtttttgtactgttttgttgatttttgtttaattgctttagtttccgacgtttcggaggagagcgtttccgttgaggatggttccgaagcgtttgcggaagcccaaggcaagtcgcacagatcccaagcaaccctttgagcatgttgaacccgtttaaagctattattttatttcaactatgcattgttttcgaatgtcatcgggtggtgaaccttttccaattaattaatggcctacgatgactttattttcctatgggttataatttgattagcatgaaccttatatattggattggttcagctaaatgctatatgtaagtttgcttagccatgcttagaaacattagctaactaaaggggttaaatatagattataatatactatattattattattaattatggttatatttaatggtagctcacgatggttaatcgtgtgaggttaattaatggataattaaaacttggttaaggtgggttgtgagcatatggttttgatggttgtgctcatgacaattaaggaccggtttgcgagctactgttgtgaaacatttaccgtgccaaccacaagccagcgtgggcaacggctttatcttttgtatagcatgattcattatagtgtgacagactgtgaaacggcgagaagtccatgggggtcgctggggagtccattgcctctggttttgagggggagattatgatccaggaacggtgcactgtggtgagttgtgttgtgcgaggggtaatgtcacagttcctttccgaggtaccgtggtggtactaaggcgcatggtaacatgttgtgggattgtgtcttgtgggtacatgggtacacctctgatcagagtttaatctattcgaatagccgtacccgcggttatgggtgagttgagcaatgtttttcgtgattagtctcacattattcattactggtaattgtgttaattaatgtgattcctggtttggaggtttaatttgttcaaccggggttggttgttcaaatgaggttgggcctatgcaacacgggtgtgttctatggtgtttatttaatattgattaattatacaactgttttactattctcttaagtatttattaaatgatgtttatgcaaatgaggtatattatgccatcctttgttattctgtgcacttgcatatttgctgtgtgacttgttgagtatgtcatatgctcattcttacaatattcaatcatcagaagaggagtgcttcagtgaaggtgatgatctggaggattgagcttcttcctggttatgatgcctgtggagtggagtcgccatagctgttccgtagtttgctttagttttttttctgctgcgtagaatgttattctttgagaggaactatccacctctgtaatatttttttatttgcgaatattaaatagttgattatttgtactctattatcaatttgttattgtgtgcctcggctgattcctggacgagggtttaacacacatgtaagcgtttggaattttggatagaaattccgggcgtgacaagttggtatcagagccaccttgaccttaggacaagccaaatggtaaacctcaagtagccttcaaaatattttgggaaattagaactgctcttctctattctcttacaaattaattaagttggcagcacatgcaaggttatgcacaaaatttatttaacttaattccttttcttttgaaagcaaaacgttgttcttctcaaaatgtttcttatttcgctttattaaacttcattgattagtcggcactgtacatttattatggtatcgattcaatcatgttagcacaagtactactcatcccttttaatgatgatactgtaccatgcttatagtaggtcctaaatattctggttttattttatttatttgtcaaaaattatttgtccctgtttaaaaagttaaattctaaaaatatatatataatagcttagtatgtgtcttttcttttatttttcttcctctttggtcaaatcagttaagtctagatggtgcagctaacttaaaaatatgcattaattcctcccttctatgtttctttagatgccgccccattcaccgagaaatttgatcaaggtgttaggattcgtcagggagctgaggttgatggcttttgaggtaggctatgaagttgctcctgagtatcgccggatttcccatgaccccaacgaggagaagtgtcgtgttcgtgtgacgttggctagtgatcgtgaagactttccgtcccttaagttcgaagctggaggaagatcgtatagccatgcttgccaggaagcagctttggtggccattggagatttgcgtcaacgcttttaagaagagttggattcatcagctttccagtatcatcctcacaagcctcatggtcaagattatggaacttacacctatcctgatggtgaggagagtgccactctgatgcaggcggtgcatatgcttagttctatgtatgcagtaagtgtggagcgagacaaagccgctcatgacagggaaaactggaatcgaggcaagatttgcaagttggagagtaaggtgtaccgtctacagaaggaattagctgagcttaaaggagagacgccgccgccaacacccaagcttcacctcaccgcaaggaagagaacctgtccaccacctcgtctccagttagcttcgaagcttcgcgtgatgggagatgctgtgccagatcgtgctgaacctgtcatccacgtcttaagtgatgaggaagaagaggaatacccagaagaaagagtgccagctactccagaggaagaagatccatcgcttcgttccgacgcaaggcgggattagtcgcttagttagatcgttgccgtagttcgctgtgttagattgcttgtttaagtttgcttgtgagtgtgtgggttttagttgttgcttacatcattggtgggatgtaacagcatgagtctagttcttttgcttgtcagagtgtaagatagttggtgagatagtgttaatgcaatttaaatgtaatcatacacagttaagagcaatatagaatttaaattaattaaataactccgttctaagggtgtctctctgtcgttctttcctgtgtttgtgcttatcttcagatggtgaacacgcgcactggaagtggaagtggagctgctaacaatggaggagattccacgctagctcagattttggcccaacaaacacaactgatcaatctgttagtgcagcaggcacagaatcagcaggcaaacaaccagaaccagaatcaacccccacctccccaaaacaagttggcagatttcttacgtgtgagaccccctaccttctcaagcaccaccaatccagtagaagcaggagattggttgcatgcggtggagaagaagttggatttgatccagtgtactgagcaggagagtttcttttgcttcgcatcagctgcatggtcccgctgctgaatggtgggatcactttcgccaagccagggctgaaggagaacctatcacttggcaggaattcacggccgctttcaagaacacgcacataatgacaggtgttgtagctctgaagaagagagaatttagagcgctcaaccagggatctcgttcggtcactgagtacctccatgatttcaatcgtttagctcgctatgctccaaaatatgttcgcaccgatgaagaacgtcaggagaagtttttggagggactgaatgatgagttgtcttatgctttgatgtctacggatttccgggatttccagcagttagtggacaaggctattcgtcaggaagacaagtacaatcgaatagagcagaagaagcgcagggctgcccaatttaaggctcaacagggcagtaaccagaggtcgcgtctcgttacgggacctcaagctacatcataccctcaaggaggatcttcgtcagttgctcgccctcaacgccagttctacaacaacaatactggtaatcgtggcaatgacaaccgcaacgtggtcgctcgtcctgcagcaactccagctaagaaccagcctgtcaggaaggaacagggaagcaagccaggggtgtgcttcaattgtggtgatccagggcactatgctgataagtgtcctaagcctcggcgtgtgaagaacgctccagccccgaacaactctaatactccagcaccgaaggcacgtgttaatcatgttgtagcggcagaagctcagaatgcaccagatgtggttttgggtacgtttcctgttaattctatacccgcatctgtgctttttgattccggtgctacacattcctttttgtctaaaagttttgcgagcaatcatgggatggaagttattagtcttgggagacctttactagttaataccccaggcaatcaagtatcttcgacacagtattgcccttccgctactatagaaatagaagaagttcctttcccatcctctgctggaatccaaagatctagatgttatcttagggatggattggttatctcgtcacagaggagttatagattgtgccaaccgaaaggtgaccttaacctgtagcgatggggaaaccgtttctttctttgtgtcctctcctaaatctcatggtgtgaccttaaaccaagtcgctctacaagaaatcccagtagtacaagactactcagatgtgtttcccgaggatttgccaggtatgccacctaagagagacatagagttccggatagacttggtccctggaaccaaccctatccataagagaccttacagaatggcagctaatgagttagctgagataaagaggcaggtggatgatttgcttcagaaaggatatatcaggcccagtacttcgccgtggggagcaccagtcatctttgtggagaagaaagatcatactcagagagtgtgtgtggattatcgagcgttgaatgaggttactatcaagaataagtaccctctacccagaattgatgacttgtttgatcaactggaaggtgctacagttttctccaagatagatctccgttccggataccatcaacttcgaatccgtgaggaagatatatcaaagaccgcctttacaacccggtatggtttgttcgaatgtaccgttatgtcatttggactcactaatgcccggcctttttcatgaatctgatgaacaaggtgtttatggaatatctggataagtttgtcgtggtgtttattgatgacattcttatttactccaagacaaaagaagaacatgaagagcatcttcgtctagctttagagaaactacgtgagcatcagctctatgccaagttcagtaaatgtgaattttggttgtctgaagtgaagtttcttggtcatgtcatctcatccggaggagtggcagtagatccaagcaatgtggagtcagtgttaaattggaagcaacccaagacggtttcagaaattcgtagtttccttggacttgcggggtactaccgcaggtttattgagaacttctcaaagatcgccagaccaatgactcgtctgcttcagaaggatgtgaagtataagtggacagaagattgcgagcaaagtttccaagaactgaagaaaaggctagtgactgcgcctgtgttaattctgcctgattcaaggaaaggttttcatgtgtattgtgatgcatcccgactcggtttgggttgtgttttgatgcaagaaggaatggtggttgcctatgcatctaagcaattacgtcctcatgagaataactacccgacgcatgacctagagttggcagctgtagtgcatgcattgaagatttggcgtcattatcttttcggtaaccgtacagagatgtatacggatcataaaagtttgaagtacattttcactcaacctgatttgaacatgcgtcagtgaagatggttagagttgattaaagattatgatatggaaatccattatcacccgggtaaagcaaatgttgtagccgatgccctcagcaggaaaagctattgtaatatgtcagaaggtcgacatctaccttgggagttatgccaagaatttgaaaagctgaatttggggatagtcagcaaaggttttgtggctgctttagaagctcaacctaccttgtttgatcaagttagagaagctcaagggaatgatcctgacatccaagaaatcaaaaagaacatgagaagaggaaaagccatcggttatgtagaagatgagcaaggaactgtgtggttaggagaaagaatttgggtacctgataacaaggagttgaaggataccatcgtgaaagaagctcatgaaactttgtattccattcaccctagaagcactaagatgtaccaagacctaaagcaacaattctggtgggctag

SEQ ID NO: 82830 - DNA, 20244 bp, Oryza sativa
aatgaccgtccaaattaagcaggctagtatacctgaatgcatctgactgtcggtcatggtataatactgccatttcttattgtcggtagtagtctaagtttgttttgaacattctcaaattttagaaaccaaatttgagtactggagcatataaatgcataacaagagaaaacatgtagtaatagcttgcgtgaaacgatgggaacaaaaggcaactggccaaggcctacttctttttttcccaaatgcaattttcgaagttttgtatggagagattaagggtttgttcattaaaaaaacttaccgtaataccaaattttagtgaggtaatgtaaaagttgggtggtatatggtttaatatatttccaatattaatagaaatttcgtgagtggaaagtttcactaaatttttactcacaaaattttggtacgattgttttggtaatagtatgtttagcttgttacgttgccaaatgtcggtgatatcaaatttaagaagggttgaaaataacaagagtaagcccttaaaaagataggttggttgaacaagaaatgattgtaattggctgagacgagaaaataggtaacgaaattaaatggatgatgagtaggaaaagaagttatttttcttgacaaattttaaatactaatttggatagtgaggaggggagggagtagcaaacaaaggacctgctatactaatatgagatgtccaagaaaacataagaagttttacatggcataactataaaaaaacataagaaaataaatggaagattattgtaattcgttgagatgagaaagcatgtggagaaattaaattattgttattatcattaattgaaaagtgggaggatatccatatattttaggacaaaattaaatggttaaagtgctatattttagaacaaatagtagaaattaccatgttgataaaaaaatagatagttaaaaaatataactgtataaaaaacataagtaaaaaagttgtatatgtttttcccatcatgctttttgaagtccattgtacactgtcgtgtatttggggacaaaacacaaaatgcaagtaaagaacataaaatagtatttacatatcaaattcaattatactttagaatctattttatatgaaatgcaattacatctatgaaacacatgagctaagaactgtatgtcaaattcaattattcttaaatctaattttgtgcaaaattgcgcgaaaaatccaatagttagtttatgtcgtacaacgaatcatcagtttgctcggagtaatcatccccttggaagccggatttgaattcgcggtggcaaagctcaaccatctccttatcggacgcaaaggcgccgtgcgcgcgagtggagctgcatgccgggggcagagccgattcatgtgccggccaaatagttttagcgcgcgtcgcggcgatcggggggcaccgccttgttcaaaaccggtggactcgccctgcgccgtggccggccacgcttgggcgcgccgcgcgcggggtggtcgcgtcgcgtcgcgtgcgagtgaagccgcgcgcggccgcgcgggcatggagatccgcgatctcgccaaggaggggaccgaagcgaaacgtacgaagcggtggtgcgtgcgtgcgcggagtcctccagcctgcaggccggggtttgcgggcgtgcggatgcatcaccgcgcacgctgtgggggtgtagggtgttggccacacgcacacggcgacgaggcgccgttttggctcggttcggtgcgctgctggatcgcgagaattacataattgggcaggcggccgtagtgctttattggattcccgggggcaatcagggtttaggcgtttagtatgggttgcttgctgtggttagcgtgcttgggcttttgtacagcttgtatcattattctacgtaccgaatacgggacggcgacaaggtccgttgcaaagatttggtagcaggtggtgtacaatagcatgttacattatcttgcgaatttgcgatcgattggttgccctttcgaacgtatttgttgataacagaatacaggcggcgtagccttagttttcaattgtttgtttgttggcttacaacccacagttaaagttcaaatatttaaacttaaattttaagttgaattatgagatttttttatcgtaatttatattctagtcatgcattaacttatatactattaatgatatttttttcttcgacttatgaatattagcccaccaatcttttatctttatatttaatgaatatcggcacttaggcgcgcccattttattgaatggagcataagaaaaaaaaactatatgagagcaatttatggggaaaagaaaaaggaaactaaggtatgatctatgcaagatgtttcgttcttgccagtgcctatgttttggtctcctcttttattttcttttattttcaccgtaagagatagagtcgtaagttatgtgtgttcgaacgttaatttctctcctttcatatctcccagacctcccatgttgatattagcccacatcgatcgtgtccttattttcagtcaagaaaaaaaatgacaggggtctaattttggcaaaatatccaaggggctgagaatggcatgttctgttattattctatttttttcatcgaaaaggaggagcaactggccaaatctacatggttggattcgttcattagcaattcagtggtgctagtcagttaagtaaatgttgaatatataaacatatattgatttaatttagtctaaataaaacatagcattgcacatatctatacctaattaaaaataaggcttccggtattattttagtctatccgtctttttttattgtcaccgtttttcattttttttccattccactttttttacgtcacggttttttcgcacgcggtaagaattcagtttttttatccacctgttttttcgtcaccaggctgaaccctagcgccaccgccacgtttatgcacgctggcgagcgggacgaaatagactattagcgacgacgcagtacatagaaagaggcaaaccctaaattgatttcgtgtgtattgcgagaaggaggctgctcgatttatatagagatattagtacatgtgatcaggatgcctgcacgatcttcatgtcgcgtaaccgaaccggataagtcatgcataacttatccggactccacgccgctccacgcacgatctccacactgcgtaaccgaaccagataagtcgcacggaacttatccagactccacgcacagattattcggtgtgtttccaaaaacaaagccgaattttgcaacaaaataaaactgcaaaaagaagccacatctgcgcaagggtggggaaccaattttggcagaatattcacgcgcatgtcgcatacgcgtcgcttggcctggcggaacgagcgagcacatgcgtgtttctcttgttttctccaccacacatatctcaagtggttaagaaagtatcatttcttataggggtctccctctcttaagagattttatgattttaaaaaattaaacttcaaataggttaagatccatctatccaacagtaaaaatactctagaacgggtggtgaatggacagatcacgcatgggcaaatgcatgtagccatttacttttgggtaatttgaaaccatgccattataattttgtaaagtttaagatataccatcggtatctcaatgacatgtaggacccacatgagtcaatgacatgtgggtcaggatgccatatcttaaattttgcaaaattataatggcatggtttcaattttccctccatcattattttctcaagtttaaagtgacatggagagtcgacacgctgaagtccttttctgctgtggttgctctgcatctgatctctgagatttggggtctgttcactttgatattattttcaaccttaccaaattttggtaaagttgccaaaaaaaatgactacatttagtttgctgtcaaaatttggtaactatataagaaatcctgctaaaattttagcaagctgccaaaattttggcaactatactaaaattttggtaatgccaaaatttgataaggttttttttggcataaaagtaaacaggcccttggactgggatgccgtccagaaacttccccaacagttcaagagctcgtcactatgatagcttgattttgattgtgatcaatcaaattcaaatcaggaagagtatattgtagtacgagcgtagagtggcggaggatggaaaaaaaataaggtgtggcagcaacaacacagtacaaacaatgtcatactactaatcaaaactgtatagatttgcaatgcgctgatctagggtattgtgcacattagttgaatgctactcctacattgtaattccatcatttagttgctgaaatatagagtatctacgtgacaataaatagacacgggccaggatgtctaataagagcacccgcaatagtaaagtaaggtgctctctataaaacatatacaactcagcaatagactagattaatagtaaaccacctcaatagtatgtctacaggggtatctatagctctctaatacattgcctcgtttttctctatagactatctccaggttagtagatagctttgctctctctcttcatttaatatcttcgaagtagaaaaatatactgacatagatctcttgtagagagtctatagataaccattgtgggtgtcctaaaagatactatttaatagtaggtgcatcggtaaaaacacagtgattagtatattcattagtgattagacgttaattgtacatatgctcactgacaaaatctaaccataccggaagctccgccgcttagtagaattctgaaattgtccagtaaaaggtaccagtcctgggtccaataacgataagtcgatacaatacgacgatgcctagtgctcccgaaatcataattagatgcaacctggtagctttgctttttaaaattcaacaattagctcaaaacaaattccaggaccatcggacaaacaacaaaatccaccataggtccatagtcgtactagtaaagattctggagcagtgacatcacaaccaaatgctgggatagcgatcttttcctctccccttcctgcttccgcgtttatctggaaatgagaccatttgtagcctgtaccgtgacaattccagatggaattagctgatcgaccatatatccacttcattagctccctcgagggtcataaccacgtacaaggtcaaatatgcagcaaacttagctgcttattagacaagcctgggaggtgaggcttgttactacagaaactaaagggatcatccgcagcaagtgctatttctggcgccaataaaatttttggcccccattgccagtgtcgcacgagcatggagccccccctaccaacctaaaggacactcctctgctccttctgatcgcattccattttcgtcagaatagcagggaaacggcacaccataagtacggttcgtacttgattatataccataataagctgtacattgagtcctcctgctcatcagggctggttcggttcaggtgcacgggcgatcatcagtagctccatagattgacctcgcagtcgtagtcctcctcggcccacgtcgattgccctgccaatggcggcggctcgatgagcattccctgtgccatgtcgaggtacccctgcatttcgaattccagtccgtccatcgggtagcaagggaagtcggcaaagagctccgcgctcgccgcggttgcctgcgcagcgacagcggccgccgcctcggcagccgcattgtgctgcccgggcgccgggcggaacagctcggcggcctcgaccgcggcgcggcgtatctcctcgtgcccggcccccagcggcggcacgcggagcctgcgcggcgagtcggcgaagttgaggcaggcggcgcggccgcgcagcgccatcgccgcgacgtcgtgcgcgcgcgccgccatctcggcggtctcgaaggtgccgagccagatcctctgcttgccgtgcggctcgcgcacctcgcagacccacctcccggggttcctgctgcgcacgcccttgtacaccgggtgcctcgtctccttgaacttggtcctccccgcccgccgcttgggcggcgccgacgacaccgtcatgtacgagtcctcgtccccgtcgccgcccaccggcgacggcgtccccgacgaggagtacccactgccgtagtacgcccactccatcgatggatcagttcactcgacaaggatttgaaattatccgatttggtcttgatttgggaggaaaggaaaacggaccggggcggcggctttatatagttatgcacttgacgggtgggggatgctgcgagcgcgagagcgtgcgcgtccactgctgctacgcggggtggcacagtaggtgccagccagattgaagggcgatgggcgggagccgggtccgcgcgcgggagggggggtttgggctctcgctctgcggttggttgggtgagtgggttcggttggctgtcggaccagctggaggttgctcggacgcgatggggacgcgcgcgacgcgcaggcatggggcgctctttccctctcctgcggggagcggactctgcacggtgggcttgggctcgtgcttctctgatgcggagtttactgggggttgttactctggttttggccgtttggggctttgtggtgacggggacgtaagctgaaagaagccggatcgagagggatcgtgattcattgctcggttgatgcggacgcgtgtgagttggagagcgcgtgattcgttgtcggagccgtggtttatggatggatggggttgcacttgtggggttgatgacgatgctgatgccttccatcgttccctttaatgcacagggaaacatacatacgagcttcatgtgcacactccgtacacaccaattagtaaatgtcacaaaaaatctataaaaattagacatttactcgtaatagtattacatatatatgaaaagtctcgtattcaaatttattgtattttaaccgtaaaaaaaatcagacagttttaagggtaaaaatttgtcaaaaaattgtcttttttattacagctaaaatatattgaagataagatttcacacgtatgtgtaatactattaaaaatatgtctctaattttttctaaaattttctgtgatatttgctagctggtatatacgggaaacttatgtgtatagaatatattcccaatgcacatatgctcatctgaacgtggtaagcttatgtttattttcacgcacaagttcatcctaatacaacacaggaaaccccatgtaggcgtaaatgacttgcacataaagaaagacaactctcacagtttggcgaactagcatatactactaatcggtagaattaaagtttaaatgcacatatcatataataatattttttttgctaatatgaaattttaacaattattaaagacaaataaaaatgcaccgtgacgtttagcacgcgcatactactagtactactaatcgttagaattctgatgcatgtttcatcactccacagtttcaaaggacgctttgatacagaaaaggtacaaagagcagcatgcactaatcgaattctgatgcaatgtttcatcgctccactgtttcaaggacgcttgatacagagagggtacaaagagcgtcatgcgctttgttgctcgagccgtataacaacgggccccactttagtactcctactatggtggacttggtcagctggtctgatgcgccacctgccaatcgacggataccgactgggatacggctgcattatctagcagccagtcctttttgccgctaaggggaatagaccgttggtttggcagttagtacttcgcatctcgcaagctggtttctcgcggtattctggatgggctcttgccgtattctggacgggctcgcggtattctggtctggatgggttgcgcgcatgcgcgctgcgtcgctgccaatggatgggacccgtccgtataaaacgcagcgtttgccaccattgttgctggcatatcttcgatttggactttttaagtccaagaggattttctccacgagaactgaaggctgaccagctgaaaaacagagaatactcctacttggctactacactcctataggtcaaaactacccgtgcttgaaattctagaagccctttgtagaattctaagcttctactaacttctagtagatgattgacatagaaatgtttccagtactagatgattgacatagaaatgtcaagctctcactttctaacagtgtcctgactctgcagctgcttcaatgctgtcatttagctataacaacaaatgttactggtactcttatagcatttagtaccacttatatgcatgtcagtacgctacatcaggatgttcttcttgatgggtcatatttttttaccggttttttatacatgaaaaggaaactttgcatggacaatcttttttggttggaacattttttttatacatgaaaaggaaacttcttaagggattggaaggggaggaagaagaacagccatgattctatagtagtctgaggatcaacaaaattatactcatatcctctacgttttgcagttcatagaagttcctaagtactctattcgtatgaggaagcatcaatacgtaggatctggagaatgtgttatcccctccgatttttaatatatggcacctttacctttttatatatatatttgactatttatcttattaaaaacaacatgattgtcatttattttgttgtgcaattagatagataagagatggggaattttcgaactgtgttgaaccttatttcttgccaacaactcataaatggagccagtaacgccattgaatctgcatggcaaatgatatttctcgttcatcactaatactaatttcacaaatattttcactaatcaacaatgggtatgaaactggtggagctagggcggccgccttaccaggccggaatctagtttcgccgctgactcatctcccacggctaggcctagacccttgcctcctgcccttctccaaaaaaaaaagttatctcatgcacatgagtatattatattaagaggtatttttaaaagtttgtaaagaaaaaaatataaggtcaattttttaatggaaaactcattgaacgaagagggagaaaaatattatccaacaaaaaacaagtgagctatatcaacatattgatatttggatgttgggttatgtataaccatataaagtgtgaggctctagctaactttgtcctataaatatatgtggagatctgatagaataataataactaagggattttactctatgcactccagaaaaagaaaacaaaagctcccatacacgaactcgtggattgtatacgtgacaaagcttgtatatggtgtgaggcactaggtcgacccattgtatggtgggccacatcagaggttacatggtaatctcagtgtgtaaatacttttcatgtacctttagtctcaggtttgttggggtcatgaatccgctagtgattgtacacagcataacaaaggtatgcacaattatgtctacaaggaactaatacaaatactacatctacatgctttttttctttaaaacaatagttgacatagaattcattgtacaaatagtactagaatgtcatagggctcatccttagtattttgtaagatctagtgcatgtcatcggatggaatctactgacagtgcgtggaccaagagacaacatcaaaagaaacttggttggaatatattacataaagcagttcaattattataggagttttttttttctttccgataaggacatacacgaacacatgcacaacactgctacacatacaacactatattgaagcacccacaaatacactcttaaccgtagtaaaaagacaaaaataagtggcacatctatgatttcactatttacgagttttgggagccctcacaatagtgctaattttcgcttggccggccaaattgcaggattacacgctctccaacaatcccaaaagagaacgattgccgggttggtcagggactaattgtcgatcttaacccttaaaccttgggagctaacatagagggcaacatatcctatgcacacaggcccttacgtgtacacacgtgcacaccaactaaaaaatatcaccaaaaaatctagaaaaaatcatacacatactttcaattgtattacacctagggttaaaatcttaacgtcaaattcattatattttagccgtaacaaaaaaaaactgatagttttaaggttgcaattttgtcagaattttattttttttgttattctctatgtagaatgaatttaaagatgcgactttgcacgtagatgtaatactattgaaagtacatgtatgaatttttctagaattttttgtgataatttttagttggtgtacatggtgtgtatacgcgagggcctgtgtgcataggatacgctcccaacgtagagatgcccagattcaagttagcgtggcgacaaactcacggcggggcacgaaccgtacggcggcccatacgtccgtgacggcatgattcccatccctatccccacctcgctcgcggcgcggcccaccagcgccgtcgtgcccctcgtccgcgtcgcggtgcggcggtgcaggcgagatccgcttcgctcagctccctgcccgaccgcgccacggcccgtaggccccccgcgcgcgcaccgcgcccaaatcgatcgatccccgcgtcgtatgctgttgctctgctccgctcaggttgggacgttgggtaggggggatggcgtcgtggaccactcgtcctgtcatccatgcgcgcccaggctgcggctgtaccgcctgtgtacccgccgagccccgtatgcagacaccgggctgcaaaaggtgtgggtgtgctttgtccttttgtcagccactcagccttgcactcgtgttttatcgttctcccctccggctgtgtacggatcgcgtggacacgtgttgctccaggagagctatgcacactgttcagctattggccctggttgtgggcgtaattttgtactttttcaccccttttttgacttaaaaaaaccctaacggaatggtatttgttttgccctttcatatatatatatatattgggtgtgggtaaaatctgtgagactcaacttacccgtattatatatacatcttctgctgatgatttgtgaacctaaagctgttggtgatttgatgcggctgctgccgccaccgtcacaaccaccaaaatactcaatagtaagaatagacttgggctgtgtttagttcagcgcaaagtttagattttggttgaaattggagatgatgtgactgaaaaattgtgtgtgaatgacaggttgatgtgatggaaaaggactgaagtttgggtccaaactttagatctaaacatggccttggtaaaacacacaggtacacagtgaggggttatagattttcaactgctactgatctgataggataccagaaatattgacaagttcaggtatctttcctttttcacatctcaacacatacacataccaggactgaaaaataaactcatttactaaagtatttaatatggcaaaccgacgaagccatccatgtgttggaagcaagtactatcatatgtttttaatgaaagtaatcatctggttaatcatttgcaaaagatcgaatcttgttagatcaggtagtatcgagctaattaaccaccccaagtcgttggtcttttcatttttttcaacgaccaagatcacttacccaaaggccagagtccacacatcggtcatatctacacacactacttcactttttttttagaattactacttcacttcatttcactataagcaatgagcctatgagtgtttagaaaagggtaaggtgtggagcgatgcactgcgcgcacatcttacagttaatccacccccaaattcttatttcacacatgcagtacaagcatacacaaccacaatatatacagtactcctcatggttactcggcatttcaggaaattaaagtattatttttccttttgcagtactgtttatatatgtactgcactggccgatgtgaattgattaatatttcagctagtgagtccccagccaggtgaaacgggagacctataacttccctttaagccggcttcatcaagccaaaacaccacagagagaagccaagagcccgggaaaaaaagagaggagaaacaagctagaacagataggtagacatgcattagcagcagattaggcaatcagctgctgagctaacaccacatccagcatgcatgactggagagcaaaaaagggactccataccagtttcagtttgtagtttgtacctcctcgtctctccacatcattccagcatcatatgcaagcttatcatatcaaatacttagtggtactgtagctataacgagcggcagtgttttggtttcatctccatgcatgcatcaagagtagtagttaattaattattaccgtcatcgatctcagttcatcgccagccgttaccatgcatggagggattgttatctatgggtcacggtagctccagaggctgcccccggcctccgacgggtccggcgaatcgtcggaggagctggggctgagcctcggggggctcatcatcatcccggcggccatgttccgcaggaactgcggcgtctcgaagagggcctcctcgtccaagaaatactggtggctcccggcgccggcgccgctgctgccttcctgctgcgcgccgccgctgcccgccgtggtgcgcgcggcggcactgctcccgccgcgctgctggtgcgctgatccagaggcggcaggggcaatgccgccgccggcacggtcgtgctgcagcgaggcggccgcggcggcagccgctgcgcggatgtcgtccgctgagctggacgcgggtggcgcggtgcgcgaggcggccagatcggggaagttgagcgccgcgtcgggcccacgcagcgcgcgcgccgccacgtcgtaggcgacggcggccatctcggccgtcgggaacgtgccgagccagatgcggcgagccttccgcggctcccggatctccgacacccacttgccgctccggctcctgatccctcggtagaaggggtgcttccccgacgaccgcggcggcggcggcccgtggtcagacatttgatcgatcggcttcagctagggcagcagctagcaagctaggcgcacctatatagttgacgacgacatgcctatctagctatagctagctagctagctagctagtatcatcagctcgatctgagcgcacgtgtgttcgatcgtggcagctgtgggttgagcgcgtgccgagaaacacacgagcaacgcggctatataaggaggcggcggcggcggcgagatcagagcgcgggagagaagcgtgaggaaagccatggcggtcgcttgcgatgagctggtgctcccgaagcgaacaagcaaataacaccacagccacagccccgcgcgcgttattttcaggcgggtgtgtggggattagaaaagtcgcgttgccttcgaccttactaatcacccaagaagggggctgtggcctttccgcggttgaacatggatttaaactgttccatttcaggctccataaattaattgatggccccaatatatttacccctgacctaaaattgcacatgcaaagtgtcgtgagtaatttggttattgataaagtcctactgcctccatcccaaaatatagcaacttttgattatgaatctgggcacatagttgtccagatttatagctaaaaatgggaacggaggaagtaaattggtccacaaattaatttggcttgcttgtgctgctgtgcaggtgcataattttttttatttcaagagacgttttttcccctgaaaagaaatgtgtctatctctattgtatgaattatggtcctaggttgagatggggggtgagaggagcgaggacagaggggaaagaaaggggagattgttgggcttagaaggatggttgtgggaggcggtgaccctacggttgacggtgaggcgccgacagcggcgccagagccacagggatggaggagggcggtgagcaggcggggtaaagcaaggttatggtttagacgccgtggcggattcttcgaccagtggcagagccaaggcccggccagtacaagcatgcgcccgagcttagtcatacagcaagacataagcacatgcttaattactcgatctattggttccaatgcaagccaaaacatccaactaggcactagcaagcaaggcacacattacttggttgtggcacgaggaaaagctactgagacaaccaacaatcatcttcttttttcaaatataatactactactcataaatcttgtttgcaattgtggtatataatgtcacaccccaatccggcaccgccgtacaacggcatctgatatgagcgtgtcgtaggaaaaacagcgcgagccgcttcctacgaaaccgcgatctcagtaccagtcccaggatgtagcgctggtacccgcggtgataaatatgaatcattgcaatccttaaaataaatagaggacttatttaccttaacttaggttgcagctcagacagcccgagaatgcaaccgacgacacggacgaggcaaacaccaacaacagcggcagcagcggaaccaacggtctaacacccaacaccataggcaacaacagggaactaggacgaaatcctaatctttacttcacttcaacttcatcttcagagctggcagaactatatatttatatagagcaagggtgagtacaggagtactcagcaagccatgggaacttaggtggttaatgcaagcttcaaagataaggctgttattttgcaatcggttttgtttgcaagcattttaataatctaagtgtgtgctctccgcgaccagagcgagacaagtctcagctcggtcgggaggtgactagtgaccaaaattttatcaagatttacacaactcccagagttggttccaaggctggtttcccaaaccaaaccaatttttttttccaaacatcccgataatagtggtccccaaacgaccattcacttctagggactcccagtcccgctgtcacccggacagccaaatgctttccaagcatcaggtttcctgaaccttaacacattttcacaaagctgggtaaaacaaaaactacgctaaggaatcacctcacatccgcccatgaccgtgggcacggctgttcgaacagtttgttaacctctgcagagggggtacactttacccacacgacattactaacccggatcactcagcccgtgcagaacggccacatctggagaccttaaggctttcatgacaaggcatttcgaaggccgacacaaggttgccatatgccgacgagaggggtcccagaccaacaacaggttagatcccagaccatactgtgccaggaagcccgggggttctccccaacaccaccctgttgaatccacatgtctctcggcatcaaggctcccccgcttagcaatttactcagccaggggtgtcccattccacccgtgtggtcgcactattgtatgctcggatgtaattccgaaggaatcggtccttaaatgctaccacacaagcattccgcctaggaatggccttgtgtcgcgagttttatttttaaaactcattttctttcacaaggcactgactcaggcgtcgggttttccaatccttttgtaaaccaagttttacccaagaagttactcaaattttaagtttgaaggcgaccgtcgatactcgcacagagtgcacgaatatcgaggcgcaactagatggttacaagggaacatgatataacaattacaatggaaggatcaaatgcaacaagttaggtagacttgccaatctgcctcgcagacggggcaagcagattaagtgcaatcctatcaatgcataatatttttcaagcaatataattaagttcaaatataggctcaagatgttcaaaggtggcttgccttgctcagggtcttcacgaagcttcacaaatcttcgagaattccacttgaagaaaaatatccggtaaccgcaactaggcgcaaacaatcaaaaacctaaacaaagaccaaataaaatatcctatttaggctaattaatagtgccattaaatagatctcaattttacggaattactggaagtggaacgaaggcgatcggagctacggatcgagggatatgaattttggaggtctaaatggattttctggacaaggaaatgttttatcggaatttatggaaataatattctcaagaatattattgacagtcagtgaccaaggaaaatgattcaaggaattttggaataaggaattgatttctgaaagaaggaaaaaggatttattgaatttatagaaaagagaaatatttgtggaatattggaaaagatattctcaagaatatctttgactcattgacaagtggggccaacaagaagtgagagagagagagagcatagatgggctgcggtccatggtggcggatgtggtaggagggaggacgagggagcaaggttagacttcgttccacgacagctggtttggaagagggaggcaatatagactttgttccaaggatcgaggagagaggtgaggcccatcggctggcgagagagagcgagagagtagatgggccggctcgggttgggcggcccatggccgggcgggcgaggccgagccgagccaggcctgcgcacgcgggcggcgctgactggtcgctacttgacctggtcaagcggggccggcgggccagggtagcggccacgttggcacaggagagagagagagagagaggggaggagccgggccggagatcagacggctcacggcgcgcggcggaatccggcgagcggcggcaaaccgaagtggggggacggcgccgggggtaagaggaggaggagtggatcctttccaccggcgcggattagggcgccggggtcggaggagggccggcgacggcgtccggcggcggctgtgagagcggcacggcgcgggcgaggagggcgaagctagcggcagcggcggcgcttcagggaggtccgagggggggcacagggatggcggcggcgccgggaatcaaggagaggaggaaggccgatggccggggaggcacggtggaagtggccggtcacggcgcacggccgagcgcggcgaaacagaggaatggaacgcggcgggctatgtcgagcagcggcgggcgcgatgcggcgagagggggagaagaagggcggtgtcttcagtgctatttcgggcaaggacggggaagaagcagacgggaagctcaccgacgggagggaacgacgtcggcggcgatggttcgatgatgagaaggacgggaagccggcgggaagggcggccgggctccgcggaggatggtgttcgcgacggcgaacgcgactcgacggggcagcactgcgtcagccgagtggtggcgcctggcggcgaactttacgccgaggcgagcgcgccggggaggagatggaggcatgcggggatggaaggactgggtggcggcgtggcgttcttggtcgtggcggggcagccggcgacgaggaggcgacgacacttcatttccaggagcacgggaccaaatggatagataggggggcgcgggggttgggcttttataggaagatggtgctcggctggcgctcaaaggcggtgcggcggtttcgtgggcggcgtgaaatggcggatggcgcggatgcattgggcggtggatcgggcggtgcgaattgaacgcggggcgcgggagcaactgcgtggcgtggtcaaggtggggcagcaaggtgcagatgcggcgtcagcggctctgcctccgagcacaagcggccaaggagtggaggcggggcgccgttgcccggaagggaaaaagagaagggagcggtggaaaggagggctcgccccttccgtttttgggaggagagggggcgggagcacgagctgtgcctcgcggctttggacgcacgcggcgtggggcgcagggcccgagaggatgatgccggcgacgactgcaaaaaggacggggactgtttggaggcgagcacggacacgcggtggttgtcggagcaggcgacgaccgagggtggcgatgtgtcacacccagaaattcccgaatagaattccaagcagaatgtgcattaaaatccccgtccaggaccggccggggtacacaaacgacaatgttgacattcagatccacgtcttacaaatatcataaaagtcttacataaatgcagcggaaaaacgaaagacaacaggagctaagccttgactagaactgcagcgggaacaccactccacagacatcctcgacggcacggacgaagcctactcctcggagaaacctccatctaacacacactcgtactctggggttgggaaaaatagagcaagactgagtattacccactgtactcagcaagtcataccggaataggggtatgatgcagggaattatcaaaggagagttagagtggttcatttgcataaagcgggcatttataaacagaagttgaaagaattaaacagttgcaataattaattaatattgatcatccgctgtccaacgctatcccacgttgcaacaggcccaaccatccacctatactatccaatttcattagactaaactagggtaagactaatcacggtgaatctggttgaccgcccataaccgcgggcacggctattcgaatagttttactctgattagaggtgtacaactgtacccacaagacacagccccacgacacgtttccgtgcgccgacatgccaccacgacataccggaaagaggctgtgacaggacccttcgcataaccccctctaaccaagcacaccacacctcatatttcacccccactcctcgcaaggcaacgggcagtcccctctcgtgcctaggtgaatccggaagcgacagaggccgtcgcagggcccgccccgctccatcacgcccacccttgcctggatgcgtcagctagaggaaagctacactacaagcccagccgttgcccacgctggcttgtggtaagtacgataagttcttccagggcatcccgcgaaccggtccttaaatgccatgggtgcgaccagcaaaaccatgcacccacagcccaccatgtgattcattttaattaaccaacaccaaaacggtggtactaaaccaaccttaccaattgaacctaaaggctatattttagtgagctttccccaatgtgtgctagtggaactaagcatggctaagcaattcctagtccaaaatctattcatgttataacccaagctaacaaaggagcatggcatcaaaaatggcatggctgtaacaataggtaaacaccccatagtaacattataaaacaatgcaatatttgaagaaaacaatagagcattttcaatataggatcaacatgttcaagtgacaagcatgacttgccttgctctgctgctggagaaacctcggcgactatctcgaagtacaccggagcgtcggaagaaccggaatctagcgacatacaaggcaaacattgcaaaacaggctacaagactactgaaacagggaacaaaaccagttttaatggattctacacatttttcatgatttactgacttgaatgggcttaaacggagctcggatgaattagttatgaattttagaagattcactgtgtttattactataaaagaaaaaccttaatgaattattgcgcaataaagccttctagggctgacgtcagcacgggatggggcggcgccgacacgcgggccccactggccagcggctcgggagagggaggaaaggggcgccggcacgcgggcccactcggcagtggctcggtgggggggggagggcgtggaccaggaccacgcgggtggtccaccgccgatccacgggaccgacgaaccagatcgccctcggggccgatcggacgggcggcggcgacctggctcggctcaagaccagccaagcggccacggcgacggcgacggcgcgcgcacacgcgttgccggcgaaggcaaccggtggcggaggcggcggcgcaaaggcggcgccgacgggcggtggtgctaaagcgacggctaacgggcggcggcgctaaagcggcggcaaggagggagagggaggggaatagaggggagagggcgcctcaccgagggtggccggcgcggaggaagacgacggtgaa

SEQ ID NO: 82831 - DNA, 1569 bp, Oryza sativa
ttttaattggttaaaattatttctagggctctgaaaattccactaaaaatcctgttagtgaatttcgacatgtagaactcaaaaaaaattccacatgtcagattcgattattatttgtattactttcttagggttttctcttgatttgcaccggtatttccttagggtcatttatgaattaaattttaggcttgagaggagaacttcggggtgtgacacgatgacgtctcccagacggtcggccacgcgcgcgagcgcgcgggaaacggcgggcggattcaaacggcggcgagcggtttgggcgcggcgagggagagcgagagagaacgtccgagagagggaagggagagagacagcgctctctctctcggtggtcacgtgcggcgcacgtggagatggagggagctgaggagagatgggccagcggcaggtttcggcccaaatcatcacgagggagataaaatagactttttcaggaacttccttttaaggaatttgaggggcatttgagttgggattcgaattcaaattgaacatttgaactcaacataaaatgaaggagccaaggtggggctttaaagcgggaattttggtatttttgggatagatttatatttggcggcacgaaggattatttcagaggatttcaaaaagggaagatcattattcaaaaatggaacaagggagatagcggtagaatgccatggatagatagatagacagaaaggtaagttgataggtagagggacggatagacagatggattgacagatggatagataaacagatagataggtatagtagatagatagatggatcgatcgatagatagatagatcgagactcagagagagatgggatggaagagaaggaagaggtggaccagaaaaaggaagaaggaatccaacctatgagggaggttaaatagactttcacagagagatttaattgggaggttttagggttggaatctggattcgaatttcgaggttgatactcggtctcaggagaataggaaggagtcaaggaagggaacaatattcggagacgagtcaaagggagatggataatttagagagaaagagagtgtaacttgggagcttgagtttgactactcaacgagatatgtgggtaaggattttggagagaagtctgaatagaagggttcggacttcgagattatttcagaacggaaatcattttggggagaactcaaggcgaaagggattgaatcttggggtttagagttcaagggtggaagtgatctcgatttgcatattcagacttgggtcagaagttcgagaaataaaacaagggtagattgacgaaccgataaagagagaaagatagatgaatcaaaacctgagaggttgaattcgaatttgagaatcggtttgaaggaaccaaggagagagtttatgacgcgaaggtgaatccctggacggagttagggttcgggcattctacaaagttcacggatggggttctatgacgggattcccaatagaaggaatcgagcttcgggactatattgggatggaaattttgaggagacgatctttgataaca

SEQ ID NO: 82832 - DNA, 1921 bp, Oryza sativa
gacggattaacttatttaggaccgacttaaaaaccaatatcgaaaaaataaatggcaacaaaaaagacatcaaagtcaactacaaaaaccaaaaattaggactcaaattttagctgtgggggataacctaaagaacaaacggtgcagttgaatatattggtcaagcgtaacaaagcccctaaaatgtcaatataaattactacggtaagaggtgaagttagcatagctatctggtgaggctcttgtggtggaacctatattcgcctaggtgcaaattttatatttgatacaaatgcttgtagttatggttaattttcagtggtaaacgtgtataaccgtcaacagcaagaggcatacgttgaattcatcaatctcaaaaatataccaaacttgctaccttgtggcgccgatgagttttagcgtcgggtaggcagcctcattgtcgcttgtagctgcagcctgtaacctttgaaacttgtaactctcttctcaaatcttaataaactttggctgtcattcgcaagcccgacaagaaaagacaaataactatatataatgtgtatatgtcgcctacattatatatattatgtttgaaaaacatatataaacaaatacgtgcgggtctctctctatatatatatatatagagctaagattacgtgattataagtgcttatataggtcatgatttctcaagccagccgccagctggcaagcgcaagtgcagttgcaagacatagatcccataagcgtgccggctgcaagacagaagtgcacttgcgctatcctttttttttttcctttttttttgctagcccggctctcccatccgagccctaactcacagaatctcacagtggaccgagacagggtccgatttattggacgtgtgggtcctcctccccgtggcgtaccacgggaccaggctgtggtttggctggggatggtttcggccggggcagtgtcgcggtcgcgttcgtacgacgcgtgggggaggcggccgtcgctctcgaatgctcgatgatcgggtatctattgctgcgctacaaatgctccacttatttagtgcggcgtacgattggatacgatgcgatacgagtaccgtttggcgtttgttgctcccggcgttttcttgttaaaaaagtaccgtctgtaagctccggccccctcgtattaaatatgttgggcgtaattttgtttcttgttttcaaataataaacttgacagtagttgttgatttaagtactatacgagcgggggtgtgacatgtaccatgatacgacaatgtatcggcatagcaatgatactgaggagatgatattctgcgctttgctagggatatatgttattttatttgtcccaaattctcaatatgctggtctttctaggattaatgagctacttctctcatgcaaaaaagccaacctagtattggtgtccagattcgttggattaggaaacatcctatccaatactagattggcttttttttgggacgaagtgagtaaattagttggaggtgaaaattactaaattgctccaagttattactcatactagttgcatgtgatcatttttgcatgtgatcatttcaactagggaattagcacaaatggcaccgtcaccacgcaagccacacaagaaatattttaagcataaaataaaatgtcaagcaatctgggacggagggagtaattgtgttgcagaaatgatcgctggatacgtttggattgaaatatcatgaaaataatgataatgatttagcatatgtatattgagttatagaattaagtaaatagtatatgtaactactataattgcatcttcagttttagatattaatctagcatgtttgtatattacactttaggagtactactaaaatactattcttgcatctcgtcgagctgttctctgacag

SEQ ID NO: 82833 - DNA, 1084 bp, Oryza sativa
tacccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaac

SEQ ID NO: 82834 - DNA, 707 bp, Oryza sativa
aatggcgaggaggcgaatgcgagaggaagaaagggagggggggaggcttgggtttataggaggcggaaaggtcggtttgggagagaggaaccgacattgggcggtcaagccggcgagctggcgctccggctagcggccaaaacgacgacaggaggtgacgccggcgagaggggaaaaagggggaaaaaggggaaaatgagggagagaaagggggctcgccccttgcctctttgggaaaaggcggagggagcgggggcgacgcggcagggggaggaggggcgctgcctccgtcccttggcggcttgcgcgcggagtggcgggggccgggcgatgacgacggcgatgacggcgggcagattggagcggagcggcgacacgggcgacaggcgcggcaggcgctgacgacggcggcgatcaggcggtcggccaccacggcacgcgcgcgcggcctgcaacgggcggcgtccgcgcgggcgcgctcatgcgaacacggcgcgcgggaagcggcaacgagggaccggagagggaggacttggctcggcgcgggcggcttacgcgcacgcgcgcgggcagagcggaggggcgcagggcgcggctctcgcgctcgcgcgcggcgcgcgagggtggggcgctcggcgcggcgacgcgcgctcgcgcgcgcggcgcggggcggagcggagggagagagggggggagcgggggagatg

SEQ ID NO: 82835 - DNA, 6859 bp, Oryza sativa
aaagctattgtttctattcaactattgcatttattttcgaatgtcattgggtggaattaacctattatttgttatggcccttttgttcttgattactttattctttgataccttgggttaatgtaatttgactagttgagctttatatgatggttcagctagatgttaggcataattgcttagccatgcttagaaacattagcacactactgggataacttatgcttcactattatttaatgatggtttaataatagctcatgatggttaatcatgattggtttattaattaatttgccaactaaaacttgataatggtgggttgtgagcacatggttttgatggtcgtgctcatgacaattatggaccggttcacgagtttcggttgtgaaacatttaccgtgccaaccacaagccagcgtgggcaacggctttactttctgtatagtatggttcattgtagagcaccagactgtgaagtggcggagataagcccacgggggtcatcttcggccattaattaattgggaaaggttcaccacccgatgatattcgaaaataatacatagttgaaataaaaataatagctttaaacgggttcaacatgctcaaagggttgtttgggatctgtatgacttgccttgggcttccacaaatgtttcggaaccttactcaacggaaacactctatccggaacgtcggaaactaaagcaattaaacaaaaattaacaaaacagtacaaaaacaagcataaacagtacatgtgaatatttttaacatgtagatctcaattttagaaaaatttagcacttgaaccacctgaaacggatctacggttatttagttatgattttccgaagatttaatctattagaaaaaaaactggaaaaagggaaaaccgatgatgacgtcatgatgacatcatcaatggccggcccgggttggcgacctcgccggagatagggcggtcggccggaactttggaggacacgtacacgtggagaacgacgaaacgaacccaacggtactcaccctcgagccaaacgacgaacgacgagggccggcgacgaaggggcggcggcggcggctcggcttgcacggggcggcggagctccggtgaccggcgacggaaaaggaagggtggccgagcttcccctcaccacggcgcacccaacggtggtgacggcgaccggcgacgacgatggagacggcggcgcggcggcaccggagatggccggcggcggcggcttgctaggcggcggtggcgacggagctacggagcacgggaaggcttgggaaaaggggcaaacgaaagaggggaactagggggtcctatttatagccttggattgaagagatcggactcctcccgcaagaaatcgactcgggaaatcaaaaactcggttttagagataaactcgaaaacgagttcgattcggataaaatacccaacgatttgctccgatttttgagggtaaagatagaggaagatgtggggataaaaacccctcaattaatcggactcgagggcgaccggaagaggcgaaattggcggagagaggcggcagctcgggctcggctaggcggccggccggctggaggttagggatgaccccgacatgtgggccccacatgtcggtggctaaaggaggagggggcggggcggctcggctgggccgacttgggccggcttggccacgcgcgggaagagaagagttgggccggaaacggcccaacaactttagggaggggttttggaactttttaattaaaataatttgttaaatgttgttccaattattaaaaaaaaacttcctttgctcaaacaattcccagaaaaatctagaaaatagaggaacaagcaaagtatttaataaaattttatctagaccatttttatgttgaaaattttcctagattattagagtttaacttgtaggcttttaaaataaattctaataattccaattaaacaacaatttatatatttaggatttttagggcgtgacaaacctaccccccttaaacggaatctcgtcctcgagattcggaagaactggcgaacagatgaggatgagctgacttcaattcatcttctcgctcccaagtggcttcttcttctgaatgattgctccactgaattcttctgaataatccacgcacattctctgagtatgatctttcttctccacaaagatgactggtgctccccatggcgaagtactgggtctgatgtatcctttctgaagaaaatcacccacctgtctcttcacctcagctaactcattagctgccattctgtatggtctcttatggatagggttggttccaggtaccaagtatatccgaaactctatgtctctcttaggtggcatacctggcaaatcctcgggaaacacgtctgggtagtcttgtactatggggatctcttgtagagcaacttggtttaagatcacaccatgatatttaggagaggacacaaagaaagaaacggtttccccattgctactggttaaagtcaccttacggttggcacaatctataactcctctgtgacgagataaccagtccatccctaagataacatctagatctttggattctagcaagataagtgaggatgggaaaggaacttcttctatttctatagtagcggaaggacaatactgtgtcgaagatacttgattgcctggggtattaactagtaaaggtctcccaagactaataacttccatctcatgattgctcgcaaaacttttagacaaaaaggaatgtgtagcaccggaatcaaaaagcacagatgcgggtatagagttaacaggaaacgtacccaaaaccacatctggtgcattctgagcttctgctgctgcaacatgattaacacgtgccttcggtgctggagcattggagttgttcggggctggagcgttcttcacgcgccgaggcttaagacacttatcagcataatgtcctggatcaccacaattgaagcacacccctggcttgcttccctgttccttcctgacgggctggttctgagctggagttgctgcaggacgagcaaccatgttgcggttgtcattgccacgattaccagtattgttgttgtagaactggcgttgggggcggacaactgatgaagatcctccttgagggtacgatggagcttgaggttccgtaacgagacgcggcctctggttactgccctgttgtgccttgaattgggcagccctgcgcttcttctgctccatccggttatacttgtcttcctgacgaatcgccttgtccaccaactgctggaaatcccggaaatccgtagacatcaaggcataagacaactcatcattcagtccctccaagaacttctcctaacgctcttcatcggtgcgaacatcttccggagcataacgagctaaacggttgaaatcatggaggtactcggtgaccgaacgagatccctggttgagtgctctgaattctctcttctttagagctacaacacccgttggtatgtgtgtcttcttgaaagcggccgtgaattcctgccaagtaataggctctccttcagccctgccttggcgaaaatgatcccaccattcagcagcaggaccatgcaattgatgcgaagcaaaagaaactttctcctgctcagtacactggatcaaatccaacttcttctccaccgcatgcagccaatctcctgcttctactggattggtggtgcttgaaaaaggtagggggtctcacacgtaagaaatctgccagcttgttttggggaggtgggggtggattctggttctgattgtttgcctgctgattctgtgcctgctgcactaacagattgatcagttgtgtttgttgggccagaatctgagctagcgtgggatctcctccattgttagcagctccacttccacttccacttccacttccagttcgcgtgttcaccatctgacgataagcagagacaacaggaaagaacgacaaagagacacccttagaacggagttatttaattaatttaaattctatattgctcttaactgtgtatgattacatttaaattgcattaacactatctcaccaactatcttacactctgacaagcaaaagagctagactcatgctgttacatcccaccaatgatgtaagcaacaactaaaacccacacactcacaagcaaacttaaacaagcaatctaacacagcgaactacggcaacgatctaactaagcgactaatcccgccttgcgtcggaacgaagcgatggatcttcttcctctggagtagctggctctctttcttcagggtcttcctcttcctcctcatcacttacgatgtcgatgacaagttcagcacgatcgggcacaacttcacccatcacgcgaatctttgaagctaactggagacgaggtggcggacaggttctctttcttgcggtgaggagaagcttgggtgttggcagcggcgtttctcctttaagttcagctaattccttctgtagatggtacaccttgctctccaacttgcaaatcttgcctcgattccaattttccctgtcatgagctgctttgtctcgctccacacttactgcatccatagcactaagcatatgcaccgcatgcatcagagtggcactctcttcaccatcaggacaggtataggttccatagtcttgaccacgaggcttgtgaggatgatactggaaagctgatgaatccaactcttcttcaaagcgttgacgcaactctccaatggccaccaaagctgcttcttgacaagcatggttgtacgatcttcctctagtttcgaacttaatggacggaaggtcttcacgatcactagccaacgtcacacgaacacgacacttctcctcgttggggtcatgggaaatccggcgatactcaggagcaacttcatagcctacctcaaaagccatcaacctcagctccctgacgaatcctaacaccttgatcaaatttctcggtgaatggggcggcatctaaagaaacatagaagagaggaattaatgcatttttttttaagttagctgcaccatctagacttaactgatttgaccaaagaggaagaaaaataaaagaaaagacacatacttaagctattatacatatatttttagaatttaactttttggacagagacaaataatttttttttgacaaataactaaaataaaactaaaatacttatgatctattatatgcacggtacagtgtcaccataagaaggatgagtagtactagtgctatcatgattgtatcgataccataatagatgtacagtgccgactaatcaatgaagtttactaaggcggaataggaaacattttgagaagaacaatttttttttcttttaaaagaaaagaaaatgaattaatttaattttgtgcataaccttgcatgtgctgccaacttaattaatttataagagaatagagaagagcagttctatttttttcaaaatattttgaaggctacttaaggtttaccatttggcttatcctaaggtcaaggtggctctgataccaacttgtcacgcccggaatttctatccaaaattccaaacgcttacatgtgtgttaaaccctcgtccaggaatcaaccgaggcacacaataacaaaattgataatagagtacaaataattaactatttaatattcgcaaataataaattgctacagaggtagatagttcctctcaaaaaaataaccttctacgcagcggaaaaaaactaactataacaaactacggaacagctatggcgactccactccacaggcatcttaaccagaacaagctcaatccttcagatcatcaccttcgctgaaatactcctcttctgatgattgaatattgcaagaatgagcatatgacatactcaacaagccacacagcaaatatgcaagtgcacaggataacaaaggatggcataatatagtttcatttgcaaaaacagcatttagcaaacatttgagaatttaataaaacagttaagtaataaacaatattaatccaacgctatacaacataccctgttgtataggcccaaccattcagaacaaccatcccgggtgcacagttctatctccaaaccaggaatataccattccaaaccaggagctaatcaaattattaccaattaaagcatcatttactatggtgagaaaggtgagactaatcacgaaaaacattgctcaactcacccataaccgcgggtacggctattcgaatagattaaactctgatcagaggtgtaccactgtacccacaagacacaaccccacatcatgtcaccatgtgcctcaataccaccacggtacctcggaaaggagttgtgacaataccccttgcacaacataatccattacagcgcacctttcctggatcataatcacccccttataaacaaggcatggactacccagcgacccccgtggacttctcgccacttcacagtctggcgcactatattgaatcatgctatacaaaagataaagccgttgcccacgctagcttgtggttggcacgataaatgtttcacaacagtagctcgcgaaccggtccttaattgtcatgagcacaaccatcaaaaccatatgctcacaacccaccttaaccaggttttaattatcaattaattaacatcacacgattaaccatcgtgagctaccatttaatgtaaccataattaaaataataaagtaacatagtttataattaatccctttagttagctaatgtttctaagcatggctaagcaaacctacataaagcatttagctgaaccaatccaacatataaggttcatgctaatcaaattataacccataggaaaataa

SEQ ID NO: 82836 - DNA, 11303 bp, Oryza sativa
actctttgaaatataaccataagtgcgttttttttttttttccccccccccctttttttttttttaaaaaaaaaaaaatttttttggaaaattttttttttaaaaaaaaaccccccccccccccccccaaatttttttttaaaaatttttttgaaaaggggccctttaaaattgtgggggtttttttttctttaaaaggccattgggcctaattcaattttatcccttatatagctacctagctaacctaactctatatataaggtccaggctattcgctttattacccatagacagttaaagtcattgtcggccattaattaactgggaaaggctcaccacccgacgacattcgaaaataatgcataagttgaaataaaacattagctttaaacaggttcaacatgctcaaagggttgtttcagatctgtgtgacttgccttgaacttattcaaacacttctgaaccttcctcaacgtaaacgctctcctccggaatatcggaaactaaagcaaataaacaaaatcaacaaaacagtaaaaaaacaagcataaatagtacatgtggatatttttaacaaagtagatcttgattttagatgaatttagcaacttgaaccactcgaatccgagttacgatgatttagttatgaatttccgaagtttaatcgattttcaacgaatagaaaaaactaataaaaaggatttatgacgtcatcgatgacatcatcgccggccatggtacggctccacgcgaccaccggcgatagagagctcggttgggctatccggggacacctacgagaagaggacgacgacgcgaactcatcggtgcaagaaactacgacggacgacgatgtacggcgaccggcgatgaggacgaacggcagcgcggctcgggtcgacgacggcggcggcattccagcggcttgcgacgacggcgaaggggtggccgaggtactcctccaccgtgcgaacccggcggcggcgacgctagcggcggtgtggcgcgactggatagtcgccggcgacggcggtggcttgagctacgcggcggcagcgctacgagcaacggcgggactcgggacttggggcaaatggaagaggacgactaggggatgctttatataggcttggattagagagatcggactccaaccgagaggaatcgagctgggaaaaactagggttagttttttttaccaggaaaactgccagggctttgcccaacagtgtaattttataaataaagaaaatatttacaaggttacaaatattacatgcggttcacacagagatactataaggtttgtacccaattaaaaacagtttgctttaaaggttcattcattatgcacatatgcagaagaacttctttgacgaaaagagatctccatgcctgaaaagagggttggatgttctgaaatatgaagccatttctttgtttccagatgtgccaagctgccaaaaagaaaatttccaggaaacccttgtgagcaaatttgattcttgctagagagatcatttggaaaaactccaaattgttattccactcaattcctaggtattgccaacacctgatgctgaaagggcataaaaagaagaggtgcagtcttgtctctctgcagttcgcattgcacaaaacacatgtgagatcatcttctttggtacaatgtcttctatccagcatatctcttgtattaagtctatcacagaacattagccaggcaaagaccttgatcttcatgacacattttgttttccatagccaaatcatgtgtctggggggttgcaatgcagaataatttcttagcagtgtacttatctgagccccagataaaattccaagcatcccccatccctgattgtaagttcaaggtgtccagaaccccctgaagttgcaagaattctgaataagcctcatccgagagggatagagcaaaagaatcttctaggggtagctggtagacatggccttgactgaatcagacttatacaaagtcacagcaaagagattggggtagctggtgcacttaaaatcatcattccatagatcattccagaaaagggcagttcttcctgtcctgatttcacattttgctatccccctgaatatgtctgcaagagttgtgatgtccctccaccaaaaagaacccttattcatcgtcaggtgtggaactttagaaacatagtatgattgtgagattaatttcacccatggtaaatcagcaccattatagaacttgatcatatgctttaggagaagggctgtgttttgaactctcagattgatcactcctaagcctcctttctccttaggcatgcacaccctatcccaggacgctagagatttccttgtcgaagaagggttattacctctccacaggcaattcttacgagctgtgtcaatgaccttgatgactgtaactggtagctgtagtgaggacatgtaataggttgggatagaggacaggactgagttgatcaaagttaatcttcctccttgcggtaaaaaaattgagcttgccgtcagcctcctttcaaccctgtctaccaatgtagcaaatcaaccactctaggcctggtggttcctaaaggtagccccaaataagtgaatggaagagaaccgatcttatatcccaagacgccagataataagatagctttgtcttgagacatattaagtggatacaggcttgatttattatagtttaccttgaggcctgtggattgagcaaacatatttaaaatagccttgaaacagaagacttctttctgagatacttttaacaagatcaaagtgtcatcagcatactgaatgattgggaaaccatcctcactgctttcattaattggttttgacaaaagtccttgatgaaaagctttattgattattctttgcaacagctctgcccccaagacaaaaagcagaggtgagagaggatccccctgtctgactcctcttctgcatttgaaagtattccctggcaccccatttaataacacagcagtagaagcagtagagaaaaccatctgtacccactcaatccattttggagaaaaacccatatgttgcataactgagaaaattgcagaatgctcaatacattggtgaatatattcaaaagaccaggtaagacaatcctgtatggtttttcctttgatgaaaccatattggttatcactcaccagtgtaagaattaccccttgaagtctatcagctagcaatttagttaagattttaagactgatacccgtaagggaaataggtctgaaatcattaacagtctctggggaggttttctttgggaccagggttatgaaggaggtattaaggatttccaaatcaacatttccgtcagtcgataatagtcctgagctatgataggccaacactttttcatgaaaaatccattgaaaccatctggccctggtgctttgtcagctggaataatagagatgagactatctacttcttgagttgaaaacatgtcaaccaagctactcaagtctatatgtctgccaaaaagggagtccaagtcaaaagccatctgtggggaattagatacactcaacctattctgaaagctgcgatgaaacaatgaagccttctgctcatggagatgtagaatctgtccatcatgatcaagcacctatgagatagtgtttattcttaacctttctatggctattgactgaaagaattttgtattttcctcccccaacatcatccatctactagtacacctctttttccaatagatcttcctgaattccaatagtttcaaaatctataccttaactatttctctgaaattccactcatagactgatagcattctgttttcttcaactaagtcaagaaagtccactactttgttccaattttttagcaatcccatcaactttgacagattcttactccaggcaaggagctttttcctaagcactttcaatttgaaagaaatgcaaactagggttagtttggagagataaactcaaaacgaattcgatttggttgatccgggcaaaattgatctccgaaactctaggggaaaaggaggagatgatttcccctcaagcaatcggactcgggggcgaccggttgaggaggaatcggaggagaggctgcggcgctcgggctcagctcggcccggccggaggtaggggatgaccccgacatgagggccccatatgtcgacggctagaggagaggaggggcggctcagcttggattgggccggcgtgggccgcacggctacgcgcgagggagagtgatgttgggccggaaacggcccaacgggctaggggaggattttaaagactttttcaattaaaataattcgtgaaatgatgtttcatttattaaaaatacttcccttgctcaaataattcccagaaaaatctagaaaatagataaacaagcaaagtatttaataaaattttatctagctcaattttatgttgaaatttttcctagattattagagtttaacttgtaggttttaaaataatttctaaaaatgcattgaaaactgaattattaaattaggctattttcagggcgtgacattgatatagtttaaacatgtatgttaccgaatctttaattttaggacccgacaaggtgtgtgggtgggggcccctgcgatttgggagcctagagcggctgtaccgctcccccccccacaccaagcttgccctgactacatgggccttgaaaggccacatggcatcttatgacgatttctgggcttgatggcgacgaaaatggacgtcatagactctatgacgacagaaggatcgtcactagattagtaacaaaaagataagctttctttatagaacgccattagagacgcatgataggtaacgaatgatattcgtcacacgaatgtcatagatttcacaacatggtgaatcatctatatatgggcctatttgtcgtctaaatacctgcaaacaaccttggtgaatcatctctttgatcgtaaattatattttcaaagagacaaagaaagagagagagagggagttaaagtccaatcttgtcacaccctgaaaatcccaaatatataaattgttgtttaattagaattattagaaataattttaaaagcctagaagagaagatctaattttaaataaaaaattccaatataaaagtgggccagataaaattttattaaatacttctcttgattctatagttcctagatttttcagggatttatttgagccaaggaactatttttaataaatggaattgcatttcatgaataatttaaattgaaaaagttttaaaaatcctccttttggctttgggccgaaagttggcccaaaaccctttctctctctccctcagcccagtcggcccagtcagcccgcagccacccgcgcgcgcgccctcgcccgctgacaggtggggcccacctgtcaggcttcccgagccgcgccgccgtctccttccaaattcgatcgcgtctttccttctccggtcgaatcaatagaggggaaatgatctccgggacctcctctaccttttctcttttggaatcatcgtctaattttgtttggaaagcgccagattcgatctcgaatcggattcctctctctctcccgccgaaccctaatttttccatcgccgtcgccggcagccatgggcctccaccgccgcccctagcccctttataagaacccccgagacctcctctccacgctgccaccctcgccttagctcgcgccgcctgtagcgccgcctccgcgttcaaccgtgcgccgccgtcgccgccgcgagttcagccgagcaccgccgtcgctccagtcgtcgtcgtcgctcgggaaggacaccgtcgggatcaccaggtcatcgccgaggatcgccggaagaccgccgtcgtcgtcaagccgaccgtcgccgccgcttcttcctcgtcgtcgtcgtcgtccggtcgccgtccgccgccgttcgtgcctcggtaaggatcgccgcgtcacccgctacgtgtagatgtcctccgtttgcgccgccgcgccgtcgttcgccggtgagcatccgtgtccgagccgccgccggtgatgacatcaccgctgatgtcagcgctgacgctagcggtggaccgccggtagatcgataagatctcggccgttcgttttggatagaatatatctcggccgttcgtttccgtagaccgccgccgtgcacccggtccatcgatgcacccgagccgctgacgcaataatccctttttccttttcaaaaataattcattattgcgtcataattcaattaaaatctatataaatgatttaatccgatttaaactttgaaaattcataactaattcatcttagctcggatttagttggttcaagtctctaattttttctaaaattgagatctacgtgttaaaaatatccgcatgtactgttcatgcttgtttatgtgctgttttggtgattttgctcttttctctttagattccgacgttcccggagagtccgaatttgcaggagaagactttgaagagttccaaggccagcaaggcaagtcacacagatcccaaacaaccctttgagcatgttgatcccgtttaaagctattgtttctattcaactatctacctctgtaatgacattatattcacttattaattagagttataattgtactctattatcaatttgttattgtgtgcctcagttgattcctggacgagggtttacacacatgtaagcgtttggaattttggataaaaattccgggcgtgacaagttggtatcagagccacctagaccctaggttatgccaaatggttaccgatagaagccctctaaaaatattggaaaagtagaactgttctcctctctttctcttttaattaaaccaaactaatggcacatgcagtttatagtctcttttaatggttctcattcaaaatttatttatgattcctgtgttgttagtactgtacatctattactgtactaatggcccatttaccagcaaaagtttcacaacattgatttatttaatcttgctgcaatgaaataagcttagcatgttgattttataactttcttttattttatttcttttgaaactcgttattaaaaagtgcaaaatttctaatcatgttttcaactgtttcaacttatcttgcaagattggtttactttatttatttaccttttactttgattttctaactttaatttaatccaaaaacttgtgctattaattggataaatgtcttaactctgtcctttcacttgtctttagatgccgcgctacaagcctgagtacttgtttggcactaagggatttgtccaggagttgcgtacgatgtcctttgccataggatttgggactgctcctttgtatgcccagattcctcatgatcgtgatgaagagaagtgccgtgtcaaagtcaccttgaacagtaatcgtgaagatatcccatcggtgatgttcgaggctggttggggaagctacattcatgcttgtcaggaggtggcaaggatcaccataggagagctccgcgaaagctacaatgatcggttggccaacactaagtatcgctaccatcctcgccaaccccagggaagcgatcgtggcagctaccttgaacctgcagggattgagaatgatgctaccacaaggcatttggttgagatgctgtgggccatggatgagacccgcgctgagattgtgatagcagctcaagatcgtgaagacaggaatcgcggcaagatctgcaagctggaggacaaggtggatcatttggagaaggaactagccgcattgacgggagaagcaccaccgaaaaaggccagggtttgtcttaccgcaaggaagagagctctattcgttcctcgctaccagttggcgccaaaggttcgtgtggtggaaaaagaagctaccccagccccagcggatcctccggtcgtcaacgtaagtgatgatgatgaagaagaatccaagcgcacccatttaaaggtcgagtggggagctactcaagatgatggggacgcgccgaacgagccttcaatcaactccgatgcccggaagacctagaacgccttgtcaagccgttgccttagatcgttgtgttagtttgcttgtttaagtttggttgtgtgtgtgggtcttgcatgtgatttacatcattggtgggatgtaaatgcatgcgtttgtttgctttcgagtgattaggtagttggtgagttaagtggtgtgagagtcttcagttttgtaataatgaaactcagttaagatcaataaaagtcaagctagtaaaaaaaaattaatttcctgtcctaagtagttttttcccctgtttctctttttgtgctcctgtctatgccagatggtgaatactcgcagcactgggaatggccccaacaacaacaacaacaacaatggagagaatcccacgcttgcccaagtcctggctcaataggcacagcttatgaatatgatgatgcagcaactccagaaccagcagaaccagggaaataaccatgcacctccccagaacaagctagcagaatttcttcgtgtgaggccgcccactttttctagcactaccaatcctgttgaagctggtgattggctgcacgccatagagaagaagttggacctgcttcagtgcactgatcaagagaaagtctcctttgcttcacatcagctgcatggccctgcctctgagtggtgggatcacttccgtctcaacaggactactgctaaacctatctcttggctagagttcaccgctgcttttcggaagacgcacaaaccatcgggagtggtgtctcttaagaagaaggagttcagagagctcactcagggatctcgctctgtcaccgaatacttgcatgagtttaatcgccgggctcgctatgctccggaagatgtatgcactgatgaagagcgtcaagagaagtttctggaaggactgaatgatgagctttcttacccattaatgactggggattatcatgatttccagaagttggtgggtaaggctattcgccaggaggacaagtacaaccgtatggagcagaagaaacgcaggattgctcacttcaaagctcagcaggggaatagtcagaggccgcgtcttgcttagggacctcagtcagtacccagggaggttcttcgtctgttgttcgtccgcagcgtcagttcttcaacaacaatgctggcaacaacaaccgcaatcaagctccacgtccggtggcaactccgacacagcatcagcttgccaagagggagcaagggaacaagctcggagtgtgcttcaactgtggtgaaccaggacattattctgactagtgtccgaagccccgccgcgtgaaggttgtccctgcccagaacaactcctccgcaccagcgacaaaggctcgtgtcaaccatgttgctactgcagaagcccaaggtgctccagatgtgattttgggtacattccctgttaattcagttcctgcaacagtgcttttcgattctggtgctacacattcctttttatctatgagttttgcaggaaatcatgggatggaagtagaagatcttagacgtcctttgatggttagtactccgagtaaccaagcactctcatcgcaacgtagcccctctgtcagaatagagattcaaggagtaccatttctggccaaccttattctgttagaatccaaagaccttgatgtcatcctagggatggactggttagccagatataaaggtgtgatagactgtgccaatagaaaagtaactctcaccagcaatgacggtgaagttgtaactgttcatgcattgtcctctgaacctctaaggtcaagtctgaaccaaataacgttggaagagattcccatagtacgggagtacccggatgatttacctggtatgccgcctaaaagagatatagaattcagaatagatctggtaccaggaacaactctgatccataagagaccttatagaatggcagccaatgaattaacagaagtcaagaggcaagtagatgatttgctttagaaaggatacatcagaccaagttcgtctccatggggagctccagtcatctttgtggaaaagaaggaccatacccagaggatgtgtgtggattatcgtgcactaaatgatgtgaccatcaagaataagtacccgctgcccagaattgatgatttgtttgatcaacttaaaggtgccaccgttttctccaagatcaatcttcgatcagggtatcaccagttaaggattaaaaaggaagatatacctaagaaggcttttaccactcggtatgggttatttgaatgtactgttatgtcttttggacttactagtgctcccgctttcttcatgaacttgatgaataaggtgtttatggaatacctagacaagttcgtgctggtctttattgatgacattcttatctactcctgaaccaaagaagagcatgaagaacatcttcgccttgcactagagaagctacgagaacatcaattgtatgccaagtttagcaaatgtgagttttggttgtctgaagtaaagttccttggtcacgtcatctcagccggaggagttgccgttgatcctagcaatgtggaatccgtaaccaactggaaacaaccaaagacagtttcagagattcgcagtttcctgggtctcgcaggttattaccggaggtttatagaaaatttctccaagattgctaagcccatgacacgactgcttcagaaagacatgaagtgcaagtggtcagaagagtgcgagcagagttttcaagagttgaaaagtcacctaatatcagcacccattttgattttgcctgatctaaagaagggtttctaagtgtattgcgatgcatctaagcttgggttaggttgtgttctgatgcaagatgggaaggtggttgcctatgcatctcgtcagttacgtccgcatgagaagaactaccctactcatgatcttgagttagctgcagtggtacatgcgttgaagatttggcgtcattatcttttcggtactcgtatagaggtgtacaaggatcacaagaatttgaagtatatctttacccagccggatctaaacatgagacaacggagatggttggaactgattaaggattatgacatgggaattcattatcaccccagaaaggctaatgttgtagcagatgctctcagcaggaaaggctactgcaatgctacggaaggacgacagttgccatgggaaatatgcaaggaatttgaatgattgaatctgggaattgtcagtagaggtttcgttgcagccttaaaagc

SEQ ID NO: 82837 - DNA, 6045 bp, Oryza sativa
atttttccgtgtcgtcctctttaatggaccgcttgcgaaaatgagccgattttcccagaagcaacgagataccgcccgcacggaatctaaaagatccctatccaggaaaatcgtttctgtagtagtgattcatgaagttccttctctacttgatcgatccattttctttgtttcttttttggcatagattgaacacttggtggtgcgctcgtcggcgttcctggtgtctagagcaccaccatcgccccactttgtcattcccgtcaactcgaatcatctccggttgtaccattgcgccactgacattgcctaggtcccaggagaacgacgcccacatatgatctagccaatacgccgccacgaacgccgtcggtcgccgttgctctcctactgcctctgcttctcttgctgccgagtcaccgacatgtgggcccagctgtttagctacttcattaggtgctaaggactttaattaggttctttttgtaaaattgctttgtttgccatgtgggcttttggacctaaatgcaattcacctaatgcccagggacctttttgtatagggtttagggcttaccctaaaacatgaaattactatttcatgcatttattacttgatataatagcttgatgagtatattgttatcacccttgctttaaccccctcttttaaatcaatttggagtttttgccgaagccaggagtttaatcatataaattagtttcattccaacttagttcccaggtatagattagatagatggtttaattctatagcaaaacattagagttggcttatcctatagcttctacagtaatagttagccacaatcttgtgaataccctattattttatgtaaagaaatttccattggagccttaatcaaatgtatgcgatgaagattcagattgttgaacctgtatcaatctactgatccaggggttgatacagtttaaaaatgtcggttacccaatctttaattttaggacccgacaaggtgtgtgggtggggccccctgtgatttgccagcctagagcgggcgtaccgctcgcgccccctccccccagagccggccctgactacatgggccttaaaaggccaaatggcatcttatgacgatttctgggcttgatggcgacgaaaatggacgccatagactctatgacgacagaaagatcgtcactagattaatgacaaaaagataagctttctttatagaacgccattagagtcgcatgataggtgacgaatcatattcgtcacacgaatgtcacagatttcattgcatgacttaaaattcaatttttatgacgtaaatgagcatcacctatcataagattcttggctatttgagaggcagtttgcagacatacagcacacagtttcataccgtgtgcgtgcctagttggcaactggatcctagtagatgcaaattttgaaacattcaacccaacccaatccttcttctcttaatcttctcttcctacacttgtgtttgtgtgtgtgtgtctaagaggctagtagtagagtagctagcctaaaattttttgcacgttgcagctactaactgtgctgctggcttgtcgtcctctgcttcaacattaaagagaaagctaatagatcggtgattcactttggtttctttgatgctatccagccacgtcaccatgtatgcgaattttgtggatggagtcagaggctctgcatgcacggagctgatttaattaattaacttgttgccagctagtacctaattaagcatgtgtgttaatttattattaattactttgctagtgttaatttatccttagtttttttattccaaactactagcatgcatgcctttgtcagagagagaaaccgatggaatatcctcgtttcaaaagtccatgcataatgtgcatgctgtgtggattcgtgctgtattttcctgggtagataagaccaaaaaatcccacttaccaactaggttttttaaaagtctggtacatcgtgaaccatactgcttcacgtggtcggaactatatacgttaagatcaaatgtgctcaacgtggtctggcacatcatggaccatgctgtttcatgtggtcggatctagatgcattaggaataatccttttcgtagtagtgaaactaaagaacttcacttgcgaactacttcctccgttttacaatgtaagtctttctagcatttctcacattcatattgtttctaatgaatctagatagatatatatgtttaaattcattagcatcaatatgaatatgggaaatgctagaatgacttacattgtcaaacggagggagtagtttttgtagagactgaacaaagatgaaactttttggaaaggtgctcctgatgaccaagttcaattcaccaactgaaatcgcacactggatttacatgaaaaatgcgagatagacaaaaatgatttctttcggttttaaattaatactcccggccatttgggaggagcaatatgtacatatgcattcatcacacttcaggttttttgtcttttttttccttggagttgtaagaatgctcataattagggcatgcaagttgatccattgatatattcgcaatatttgacgatttttttttcattttaaaaattgttgacgatattagcttaattttggtatggaaaatatcggttaatttatctccaatttttatcaagagagaaaatgaaccatgagagttgaggtgcgaattaaccacaagcaaatattcattttaatttgtggtatatatatatacacgagcatgcatgtaaagatggaaatatgtgaaaaatacaatggtgctagtagatttgtctaaaacacttccataatactatgatcaggacactcgataaggacaaagttaaattttagggattgtgtcattatcaaaattatcaatgaataattggccagagggccgggattagcatgggtctactactgtcctgccatttcattaattaattagattaagtccccgattgcttgcatccctaattggcctacgagaaccgacaaaaatcgcaagatgggaggattgtggtaggttatcttctccaactgtgcctctcaagtggccataacatattagccagaaggataaataatcatcaatctgccttcacagttttgatcatctcatgagacatatatataaaccacccattagcaagagtctcctaggtgaattaattaactatactgatacacatatacttaattggtataagaaaattagtggtagttaattagtataaaagcatcaatcaaatggagactattagctagctaggagaccgggcaatttttgcaaagcattgatcttgactaggaatcgtgcacgtacaaggcacgtataaaaaaaataagtataaaatgtaaactacatataaaaattaggaagtgtgataaaatgtcataactgcataatttaccaacgtaacagccaaaaaaattaaaattatctcagtgcaccaataacataaacaaaccaaactttggtagatatatattaaaaaattgaggcacatcacagattgaaattagtcaacaagttcagggaatgaactcagaaatgaaccggtaccacctagaatattaagttcaggtacatccccggataagatcagaaaatactatagcaaatgttccaaattttgtttctgaattctccttaatccacatgaattgtccttaatacaatccaggataagatcagaaaacaagacctctcttacaagcaataacgcatatattatttgtcaagacaaagccaagtgcataatccacatcaggttatcctctagatgatactccagccatgctccctggtcctccaaaaacaaccaggttcaatagtccaatgcataatgtaaataacagggccggcagaagaatctgaacatggtaatcttaaagcgaccttatataatctccacaaataatattggaaattatttgaaatactatcaagtgacaggagcaaggttacaacattattagcaagtgacaggtgcaagactaaaacattagatcagtgaacctgaagtaagacaaacaattgttgattaaaaataaataacacttgttgacaaacacaaaatggcattttattcttgcacgaagaccatgtctaagccttgatatatgcattatgccttcatgatctttaaagtcaatagatacctgcataaagcatcaactaagaaaatacattgtttttgttccaaaaaaactgataaataacaaaaatggcatgataaaaggaacaccttaatggatacttttgttaaaaaagatagtgaaattcttgattattcaacgccggatcgaatcatgtccaatggtcattggaattttgtctatccttctattcttcaaaataattcagatttgttagccaaaatgcgaagaaataggtttgccattccattacagtatcatcaagaacaagcgaaagaaccaatatcctgttttgggatttcgattgaaataccctttatgggtgttttacgtagaaatactatagttgcttattttgacaacccacgatacaaaaagagataaaaaggttttgagaattgttaaatttagatataggaccacataagcaacacaattaatttaaatacagaacatatggacatacttctctctttgctgccctgtgtttgtagatggttcaactatcaacataggatgctcctcagcataaaagctaataaagcaaaaaaattcagtagttgcatctccatgccatacaaaggaaatcctactatttaatcaactttatccggttgtacacataagaagggatttcactatcagtatatttgaagagcataaataaatatgtaaggtgaaaagatggtgggcataaagcagtaaccatgctgacatccaaaagattccatagaggcatagaagattaactttgttgctgattctaaagaaactatgttaaagatagagtttggttcatcccaaacttccccagaaacaagttaggcacgttcggccttttgcggcaacgggcaagtgtttggccaaccacataagcagtgtgccaaacctggttactccagtgcctctcatgtcatagatttatttttcagacaagttttgccacaagtgtggccagctttttgggcgtgcacttttggcacaaaattactcagatctgcatcaaatagataaagcaactcacctgaaagcatgattccatatattgtcaacaatatcccaatcaataaatgttccatctttcattggtgaaatcacctattgggcatggaagaaaatcagtgataaacaatagttaacaaaatcatgagcatcaatattgatattttagaatgttgataaactaacctccatatgatccctcctaaatagaataaaaacaccttttagtacatacactacaatagagtattatcacaggccaaatataaattgtctccaggtaaaataaaggtagcaagcaaagcaaaattcagacaaaaaataatagtacatgttattgcagaaatttgtagtgtagagcttcgttgattatccattgaaagtattcagaaagcacggctatgttgtggaccactattatggtagagaactgcaaatgcaagacactcttatgcatcagttcagaatcctcttatgccatggacgcccatcgtagacagccagagccagccagcaacccactcagccatggacgccatggacaaagcaatcaaagcaaccataaaaccaagaaaagaaaaatcaccggttgccgaggagagcctggaggtggacgatgagcttctcctcctgctcagtgaagttcccccgcttgatccccggctggaggtagttcgtccaccggagcgggcagctcttgctgcaacgcatcacccctgcacacacgcacagatcaaacatgcaaaaatctcagatctcgcaacccaacgcagatcgatcgatcaagaacacacaagaacacgtaccggtgttggtcggcacggcacgccagttgccggcgccg

SEQ ID NO: 82838 - DNA, 14462 bp, Oryza sativa
  unsure (1)..(14462): unsure at all n locations
ggatgcatcgtagtacacttggaaacccttctttggatcaggcaaaatcaaaatgggagctgatattaagtgacttttcaactcttgaaaactctgctcacattcttctaaccgcttgtacttcacatccttctgaagcagtcgtgtcatgggcttggcaatcttggaaaaattctctatgaacctccggtaatatcctgcgagacctaggaaactgcgaatctctgtaactgtcttcggttgtttcgagttggttacagattccatattactaggatcaacggcaactcctcctgctgagatgacgtgaccaaggaactttacttcagacaaccagaattcacatttgctaaacttggcatacaactgatgttctcgcagcttctctaatgcaagacgaagatgttcttcatgctcttctttagtttaagaatatatgagaatgtcatcaataaagacaaccacgaacttatccaggtattccatgaacaccttgttcatcaagttcatgaagaaagcaggggcattggtaagtccaaaagacataactgtacattcaaatagcccataccgagtagtaaaagctgtcttaggtatatcttcctccttaatccttaactggtgataccctgatcgaagatctatcttggagaaaacggtggcacctttaagttgatcaaacaaatcatcaatactaggcagtggatacttattcttgatagtcacatcgttaagtgcacgatagtccacacacatcctctgggtatggtctttcttttctacaaagataacaggagctccccatggagatgaactcggtctgatgtatcctttctgaagcaaatcatctacttgcctcttgacttctgccaattcgttggctgccattctatatggtcgcttatggatcggagttgttcctggcaccagatctattctgaactctatatcccttttaggcggcataccaggtaaatcatcagggaacacatcagggtactcccggtctataggaatctcttccaaagttatttggtttagacttgaccttcgaggttcagagggcaatgcatgaacagttacaacttgaccatcattgctggtgagagttacttttctattggcacaatctatcacacctttatatctggctagccagtccatccctaggatgacatcaagatctttagattctaacagaataaggttggccaggaaaggtacacctcggatctctattctgacagaggggctacgttgtgaggagagtgcttggttactcggagtactaaccatcaaaggacgtctaagctcctctacctccatcccatgattttccgcaaaactcatagataaaaacgaatgtgtagcaccagaatcgaaaagcactgttgcaggaactgagttaacagggaacgtacccaaaatcacatctggagcaccttgagcttctgcagcagcaacatggttgacacgagccttggctgctggtgcggaggagttgttctgggcagggacgaccttcgcgcggcagggcttcggacacttgtcagcataatgtcctgggtctccacagttgaagcacacaccgggcttgctgccttgctccctcttggcaggctattgctgcgacggagttgccaccggacatggagctggcttgcggttgttgttgcccgcgttgttgttaaagaattgtcgctgcggacgaacaacagacgaagaacctccctgtggcatggacaggggtcccgaagcaatacgcggcctctgactatttccctgctgtgccttgaagtgagcaatccggtgtttcttctgctccatgcgattataattgtcctcctgacgaatagccttatccactaacttctggaaatcgtgataatctccagtcatgagtgggtaagaaagctcatcattaagtccttccaagaacttctcctggcgctcctcatcggtgcgcacatcctctggagcataacgagccagatgattaaactcgtgcagatactccgtgactgtgcgagaaccctgtgtgagcgacctgaactccttcttcttgagggacaccactcccgatggtatatgcgtcttgcgcaaagcagcggtgaactcaagccaagagataggttcagcagtagtcctgttaaggcaggagtgatcccaccattccgaagcagggccatgcagctggtgtgacgcaaaagagaccttctcctggtctctgcactggagcagatccaacttcttctctatggcgtgcaaccaatcactagcttcgacaggattagtggtgctagagaaaacaggtggcctcacgcgaagaaactctgcaagcttgttctgaggaggcgcatgattgttcccttggttctgctggttttgaagttgctgcatcatcagattcatcaactgtgtctgttgggccaggacttgagcgagcgtgggattctccgcattgttgttattgttgttgttgttggggccattcccgttgctgcgagtgagcaccatctgacatagacaggagcacaagaagagaaacaggggaaaactacttaggatagggaattaaattaattaacttaacttttattgatcttaactgagtttcattattacaaagctgaagactctcacaccacctaactcaccaacttcctaacactcgaaagcaaacaaagacatgcatttacatcccaccaatgatgtaaacacatgcaggacccacacacacaaccaaacttaagcaagcaaactaacacaacgatctaaggcaatgacttagcacaacggtctaggtcttccgggcatcggagttgattgaaggctcgttcggcacgtccccatcatcttgagttggtccccactcgatcttggaatgggtgcgcttggattcctcttcatcatcatcacttacattgacgaccggaggatccgctggggctagggtagcttctttttccaccacacgaacctttggtgccaactggtagcgagggacgaatagagctctcttccttgcggtaagacgaaccctggccttctgcggtggtgcttctcccttcaatgctgctagctctttctccaaacgatccagcttgtcttctagcttgcagatctttccccgattctggtcttcacgatcttgagcggctatcacgatctcagcgcgggtttcatccatagcccatagcatctcaaccaagtgccttgtggtagcatcattctcgatcccagccggttcaaggtagctgccatgatcacttccctggggttgacgaggatggtagcgatactcggtgtcggccaaccgatcattgtagctttcacggagctctcctatggcgatccttgctacctcctgacaagcatggatgtagcttcctcctccagcctcgaacatcactgatggaatatcttcacgattgctgttcaaggtaactttgacccggcacttctcttcatcacggtcatgagggatctgggcatacaaaggggcaatcccaaatcctatgaggaaggacatcgtacgcaactcttggacaaaaccttcagtaccgaacaaatactcaggcttgtagcgcggcatctaagacaagtgacaggagggagttaagtcaattatccaattaatagcacaagtttttgggttagcttgaataaaatttgaaaagtaaaatggtaaataaagtaaaccaagcttgcatgataagatgaaacagttagaatcatgctcacaaattttgcacttttgaataacaagtttcaaaggaaataaaataaaagagggttataaaatcattatactaagcttagcttattgtagcaaaattaaataaagcagagttataaatcttttgatggtaagtgggccattagcacggtaatagatgtacagtactaacaacataggaataataaataaattttaaatgaaaacagctaaagaagtcataaactgcatgtgctattagtttggtttaattaaaagagaaaaagaggagaatagttctacttttccaatatttttagagggcttctataggtaaccatttggcataacctagggtcaaggaggctctgcaaccaatttgtcacacccggaatttctatccaaaattccaaacgcttacatgtgtataaaccctcgtccaggaatcagccgaggcacacaataacaaattgataatagagtataattattactctaatgaatattcgaataaaatgtcgttatagaggtagatagttcctctcaatcaatatagttctaagcagcggaaaataaaagaaacagcgcaggcgactcctctccataggcagcttgaccagggctacgcctaatcatccacaccatcagcatcgctgtaaaactcctcctctgatgaatgattgcaaggtgagtatatgacatactcagcaagccacgcagcaaatatgcaagtgcacaggataacaaaggatggcatagtataggctcatttgcataaacaacatttaataaatatttcagaatttaatgaaaaagtaaactattaattaaacagtattaatcgaacgctatacaacataccctgttgcataggcccaaccattcccggctgcacagtgctatctccaaactaggaattaaccattccaaaccaggagttaaacaagacattaacatcatcatttaatagagtgagaaatgtgagactaatcacgaaagacattgttagacccgcccataaccgcgggcacggctattcgaataatttaaactctggccagaggtgtaccactgtacccacaagacacaacctcaacatcatgtcaaccatgcgtcgcgatacttgacaagtacccgaattgagattgtgacaataccctctatataatacaattcaaagcagtgcaccgttcccggatcataatgacccccttataaacaaggtatggactccccagcgacccccgtgggcttatcaccgccacttcacagtctggtgctgtacaacgaaccatactatacagaaagtaaagccgttgcccacgctggcttgtggttggcacggtaaatgtttcacaaccaaaacttgtgaaccggtccttaattgtcatgaacacaaccatcaaaaccatatgatcacaacccaccattatcaagttttagttggtaaattaattaattaaccaatcatgggctattattaaaccatcattaaataatagtgaagcataagttatcccagtagtgtgctaatgtttctaagcatggctaagcaattatgcctaacatctagctgaacaatcatataaagctcaactagtcaaattacattaatccaaggtatcaaagaataaagtaatcaagaacaaaagggccataacaaacaataggttaattccacccaatgacattcgaaaataaatgcaatagttgaatagaaacaatagctttaaacgggatcaacatgctcaaagggttgtttgtgatctgtgtgtgacttgccttgctggccttggaaatcctcaaagtcttctcctgcaaaatcggactctcccggaacgtcggaatctaaagagaaaagaacaaaatctccaaaacagcacataaacaagcatgaacagtacatgtggatatttttaacatgtagatctcaattttagaaaaatttagagacttgaaccaactaaatccgagctaagatgaattagttatgtattttcaaagattaaatcgatttaaatcatttatgtagattttaattgaattatgacgcaataattaattatttttgaaaaggaaaagggaattattgcgtcagcgggtcgggtttacggtggaccgggtgcatggcggcggttcacgaaacggacggccgagatcgatccatccaaaatggacggccgagatccatcggtccacggctagaccacgagggacgacgacgatgacgtcagcgacgacgtcaccaccggcggcggctcgggcacgcatgctcgctggcgaacgacggcgcggcggcgcgaacggagggcaccgatacgatgcgggcatcgctgcgaactcaccggtgaccaaagcgacggcggacgagcaacggacgacgtcggcgacgaggaaaaggcggcggcgaccttcggcttgacaatggcgacggcgttccggcggtcaacggcgacggagaaggtgcggacagagacggcaacgagacggcgatcacgacggcggccttcccgagcggtgacgacgaccggagcgacggcggcgatggctgctcaaggtctcacgcggaggcggcgctacagacggcgacgggctaaggcgagagtggcgacgggtagaggggagctggggggtcaatttataggggctagggagcggcggtgaaggcccacggcgaccggcgacgggaaggaaagtttagggttcggaggagagagatcgatccgaatcgaactcaaatccggcgatttccaaagcgatttagacgatgtttccaaaagggaaaaggtagagtggatcacggggatcctttcccctcaatcaatttcaccggaaacggaaaggggcggccggatttggaatggcggcggcggcgcagctcggctagagtttcggcgagaggaagacgacaactaacaagtgggacccacctgtcagcggcggttgcacacgcgcgtgcgggcgggcgctcggcttgccccgacttgggccgagggagagagagagagagcggtttgggccgactttcggcccaaaaccaaaagggaattttaaaaacctttttccatttaaattattcattaaatgcaattccatttattaaaaatacttccttagctcaaataaatcccagaaaaatctaggaattatagaattaagcaaagtatttaatgaaattttatctggccccattttatattggaatttattaattaaaattagatcttctcttctaggcttttaaaataaattctaataattccaattaaacaacaatttataatttggagatttttagggtgtgacaactagttaagttataataacccaaggtatcaaggaatagagtaatcaagaacaaaagggctataacaaggcaataggttaattccacccaatgacattcgaaaataaatgcaatagttgaatagaaacaatagctttaaacgggatcaacatgctcaaagggttgtttgggatctgtgtgacttgccttgctagccttggaactcttcaaagtcttctcctgcaaattcggactctccaggaacgtcggactctaaagagaaaagagcaaaatcaccaaaacaacacataaacaagcctgaacagtacatgtggatatttttaacatgtagatctcaattttagaaaaatttagagacttgaaccaactaaatgcgagctaagatgaattagttatgaattttcatagattaaatcggattaaatcatttatatagattttaattgaattatgacgtaataatgaattatttttaaaaaggaaaaagggattattgcgtcagaggactcggctcacggtggaccgggtgcacggcggtggttcacggaaacgaacggccgagatcgatctatccaaaacggaccaagatctaacggtctacgaccggtctacggtggacggcgtcgatgatatcagcagtgacgtcatcaccgacggcggctcggcctcgcgtgctcgccggcgaacgacggcgcgacggcgcgaatgaagggcacctatgggttgcgggcgacacggcgaactcaccggtgaccaaagcagcggcggaaggtcaacggacggcgacggcgacgaggaagaagcggtggtcaccttcggctcgacgacgacggcggggctccggtgatctacagcgacgacggagaggcggacgaggtcgacgacgacttgacgatcacgacggcggctttcccgagcgacgacgacgaccagagcgacggcggcgcacggctggacgaacggcagcgacggcggcgctagactacacgacgctagggctctaccggcgacgagagacgtagccgagggtggtggtgggtagaggagacaccgggggtccttttatagcggctagggggcggcggcgaaggcccacggcgaccggcggcggcgatggaaagtctagggttcggggagagagacgaatccgattcgagttcgaatccacggatttccaaacgattttagccgatgattccaaaagagaaaaggtagaggggatctcggggatcatttcccctctataaatttcaccggatcgggaaagacgcgatcgaatttggaatggcagcggcacggctcggctagggttcggccgggcgacggcgcaaggaagacgacgagtctgacaggtgggtcccacctgtcagcgggcgagggcgcgcgcgcgcggacggcgctcagctgcgggccgacctgggcttggagagagagagaggtttgggccgactttcggcccaaagccaaaagaggatttaaaaaacctttttcactttaaattattcatgaaatgcaattctattgattaaaaatactttcttggctcaaataaatcccagaaaaatctaggaactatagaatcaagcaaagtatttaataaaattttatctggcccaattttatattgaaatttattatttaaaaatagatattctcttctaggcttttaaaatcaattctaataattccaattaaacaacaatttatatatttgggatttttagggtgtgacataggtgacgaatattcgtcacacgaacgttagatttcacaacatgacttaaaattcaattttcatgacgtaaattagcatcacctacactagtggagaaaccctttttcctcccggttcgtaacccccctttagtcccggttatccaaccgggactaccaatccgggactaaagatcgctatctttagtcccgggtgaaataacctggaccaaagatcgatctaccaatttttttcttatttgcatggccctattgctgcaaggtttagagtttatgttacaatacatatatatgctttatatatatatatatatatatatatatatatatatatatatatatatatatatatatatatatatatatatatatatatataggacggctctttcgtacactcaggtgtatgtacacccttttattaatggatgatccaattagcattcaaattagctatgaaaaaaattaataatattaatttccaaatgactgcatgcatgtggcatagctgcacaccggattgggtgcagatttgaacaagattgttggcatgcatttgctttcaaatttgataacttaccttagatatccccaccttttctagtatgcaactgtcgcgtcccaaaacgactctaaaatgcatcctcaaaattgtgcatagaataattaaaatccatgtgaaagcctccaacaattaaaatgtgcaaagttaaaagtcgaataaggcttggaggatttttgtatatttcctaaaagcctaaaatgcgtaaataaattttagtggaattttcagagcacaaataataattaagaagaaataaacaaagttaaaaaggttttataaaaagaaaaaccctaaaaagtctttttcccccttccccctcttgggccggctcggcccagctccctccctctctctcctctcccccgcggcccatccggccttcccccgcgcgcgcgccgctgacgggcgggcacgcccgccaccctcgctgacgggtggggcccacccgtcatcccctacctcgcgccgcacccgccgcctcgcccgtgccctagcgccgccgccgccgcggattccgccgcatcccgccgcccccgcgcgcaataaagagggggaaatcactccccgtgattccctctccctttccccccacttttccctctctctctccctcggattcgtttggaaacactcccgcaaacctcgccggcgccattgatggagcccgagatcgccgcgccggtttccttcccctccggccgttctctccccctcccaacactatataaacgctccccgtgcctccctccaccgtttccgccactcgccgctctctctccccgtcggaatcgagctcgcgccgtcactccctctctccgccgtcgccgccgagctccggtccgccgccgtcgtcgccccggaccctctcccgtttcggcgtcgcttttttcgggttcgccgcaacctcgccgacctcgtccacccctccgtttcgcccgccgaccgccggaacgccgtcgccctcgttgacccgagccgcgccgccgccttcctccgctccggtcgccgtcccgtcgtcaccgtcgacccggggtgagccgtggaccgccgtttcacttcccccttccctcccctttctcgggcgccgctccgccgcgccggtggtcgccggcggcgaccatcggggcgcgggcgcgtcgcctcccgtcggcttttccggcgaggccgccttcgggcgcgccccgcggctgccatgtggggcccggccgtcagccgcccgcgccctcgggtgcggctgacgcgtgggacccacggcgccgggcggcgtaatccgcgtgcacccggtccaccgtggaccgagaggctgccgcgtgggccccactcccgtggacccggtccgcgcgctcctcccctcagctgacttaataaatccgattttaaattaaaatttaaatgaagaaattcgcaaatatccatttaaagagcatataaacttcaaatggccataacttggccatttgaactcggaattggaccgttcaagtctctaatttttccttaagaagccaagaacccatttttgtgctttgtttctgtttgttatatggagtttagtagagtaaaagccgtttcttttccgttggtcgtgtagacgctgcagcttcggaagatccgctcttcgtggaagttgaagccggcgtttgggaaagcgagcaaggcaagtcacatcatctttgaacatattgaatcccagtttgtaaaattatgttgatttaaattattgcattatcgctttatttaaattcccgcgttatcactgttttatttagccatgcctatttacctttgttatgaccttattatcattgttattgttattatttccttgttcaccctagaataaacaaaaccccaactagtggacactctactcatggtatcactagtatgattttaggtagatgcttcgcttttaattaggtaacattaggcggttttacaactctagactttggggatattcatatcacgtggacactatggaatggtttggttatcgtggaattggcttcacaccgctccttccattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctagttataaacaaaagtacacggatggagatggaagaagtcgggggtcgatggacatctccagggcaaatgaaggctacacgagctgcggcccggtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctaatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgataaataacattgtatagtactagaatcgtgtttgcaaaatagccctgagcaactaatgtctttaaatgctgtttactgcaaccctaaccctttatagtataactcctttgtactcccttgcatttattctgcacttgtgggtgtgtcttgttgagtacggtggttgtactcagtcttgctcaatttttcccaaacccagaagaggagttcctagaggatgaaggcttcggtgtctagctcgtgcctgccgtcaagtgcctgtggtcgtcgcccttgtcttccgctgtttctcgtttgtctttttgtgtgctgggccttcgctgcccgtgtaataaattaactatttacgcttccgcttgttaaactctgaattgtatcaacttttggtgtaccttgcctcctgggacaaggattaatgcacgcacgtaaggaacgcccgttgggttatttccggtcgtgacagcaacagtatatactgttttttaagccgcagtatatatactctttgaagtgatgagcagtactatatactagttttttttattagcagtacgtaataaggagtaccttatatttttgttgtagcagtgaatagttctttttttaattagcagccgtatatacttactccagaactaacgagtatatatatactgattatgtctttttattggtacgcgcagtatatactactgcaacgagcgaatgagtatatactgttctttctcagaatgagtatatactgattttttttggaacgagtatatatactgacttttctcggagtggtatatacttatttcttctccaatcggtatgaacagctactcggagtggtatatacttatttcttctacaatcggtatgaactcattgaaggagtatatactgcttctttggtcagtgtatatatactacattcctcattgaaggagtatatactgcttcttttttttatcagtatatacatttgttattaattgagtatatattgtatgcactacttgtcctgtcagtatactgcatatactaattgtcatgtttggtcggtatactgcatcgtcctcgctaaaggaggttatactgccttttcgtttgatcggtaaatactacgtatactacttttttttcactcagtatataaataagtatgtaccagtatttcttagataagtcgtatatttgctatccatggaagctggatgcatatgcttttcagttgaatagaataattaatatgcttttcacgtgcaaattcagaagtctgcctgaatcactagcaaagtatcggctgttgcattatgaataaacctaaattaatgaaataccctagaagggcactgaattctgaatggacattaccagaccaaagaaaaagatcaacgcagactttcggaaactaagaacaaaacataacgggatcacccctcgatgtggctcatcgaagaatctctgcatccccacagacagatctcggttaacatcgatgggatcacgccgaccgcacgccagagagaggtggacaagaatgtgtcttcctggattaacaccgttagctaggaatcacgggttcgatgccgacgacgatgctgttgccgcacggccacacatgctggactgttctgtcatcagcaccatctacgtccacgatacatgcatctcgcatttgcatgcaccaaacaaattcgatctgcatgcatgcattatcgatttgcaacctagaaaaagcaaatcaagaaaatcgaaagaaggaaggacttgcctgcagcatagtcgatgttccagttccggacgacgctcagcgtcgtcttgatcgtagcatgggcctgcatcgatgccgtcgccgtacggccacactgacttgcccgaagatcaatggcgtcgttgtctggtcacagctcttcggccagccagtcgcctgcggatagtcatactgaaggcattggtaatggaagacgccggcgtagacatcagcagacgccgtgaccttcgaatagccgatgggtcgcgccgtcgtcgccttcgaatcgccgatcgcgataacctgcggatcgatctgtcgattctgtttacaaccacccacgagattttaatacgagctattcaaaagggttctggttagtacggaataattcagattatgaggatttttttcgtaactaaaaatcaaaacgggctcggtatatggatccgcttgctgacttgatcggtggtgttcgctgatggacggtggatggaaccgggagtacctactcctgggagtatagaatcattatatatgtatatatatatatatatatatatatatatatatatatatatatatatatatatatatatatatgtgtcctatatatatatatatgttgatgaactgctgtaccaactgatagtccatttcnccactca

SEQ ID NO: 82839 - DNA, 659 bp, Oryza sativa
cttcagaagatccgctcttcgtggaagttgaagccgacgtttgggaaagcgagcaaggcaagtcacatcatccttgaacatattgaatcccagtttataaaattattttgatttaaattattgcattatcgctttatttaaattcccgcgttatcactgttttatctagccatgcctatttacttttgttatgaccttattattgttattgttattatttccttgttcaccctagaataaacaaaaccccaactagtggacactctactcatggtaccactagtatgattttaggtagatgcttcgctggttaattaggcaacattatgtggttttacaactctagactttgggatattcatatcacctggacactatggaatggtttgattattgtggaattggattcacacctccccctctattcaaaaccctcaaaatggttttaggctgggctcggggtgcatggttttgatagtagcacctcggccatacaaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctaca

SEQ ID NO: 82840 - DNA, 5659 bp, Oryza sativa
aggggggattaattatgatatgattccagctcgggagcaggcatctgatttagggttggtgctgcagagaatccctgcctgatcgctcgccctgtgtatcgctgcatgggcgaatgggtgtgtgtgtgtgtgtgtgagagagagagagagagagagagagagagagagagagttgggatggatctgttgcccaactgccagcagctgcacccctgagccaggtccgtgtgtggcaccgccgattgctccccatacacgcagcaacaagggaagaacacctgacggattgcttggagccttggatacgtgggattgtctaatccattccgaatccaagacaatactctcccttcgtaaaaaagatcacacaccgtataaaaaatataaagattttttaagttgtatacggtaatggaagtcggttgtgactatatgaggaagcacagcagtaaataaaatctgagtagaagtattaatttgtaatatctgatctatcaaatttttttataattttgcatggagcaagattttaaatgtacagttagatatgatatacaacttagtgcttcaatttttacaaatacaattgtatttcatatttttaaaatatccttctgttttgaacaaattaaaaaatcacttgtattgtatgttgtgtacaatttatatagatcattagatttatttccactcctataatttggacccaccactattgtgtgtatctttctctctctctctcctttccttttcaattactaggatgaattttaggcctccatcatatggtcctagaaaagcagccaccatatcgcttctagaaacctagaaattgccacattagttattacaaaatagacaatatgtaccatttgaccatggtgcacctaaattataaatgggggagataaatcgatatattttacgcaaaatacaactatatttatggaaacataaacttatcaatatatatatatatatatatatatatatatatatatatatatatatatatatatatatatatatatatatatatatatataatacaatagtatctatagaaaagccatgagctatatatcaaatcgaattataatttaaaattctattgcgcgcaagatataattatattttttaaaacaattgtaagtacaataaatccaattctagttttatattctagctccccacaactttacgcaggaaatgcactagcttaaccatgaaaattagtacgtagttttaagggtttcaagggaaatttaaaaaggagcatgagtgatccaatataataaaagggttaaatatgggattattatttttcatatttatatgctgtttttcgacgaatccatataattaaagctggggtttgattggccacaaaagcttaaatattattctctccgccctaaaatataacaatttttagcacttaggatttgtcccaaatataacaacttttgcactaattaatattcccttcccaaccaatcacaaccttacaccattcatttttcccacctacatgcgcttctcaaccaatcaccaacatctttatattcaattctatctattttcttaataactgtgtccaactctaaaactccttatatcttgggacagtacattggtttatacataggtaacagagatgttagctgtcgagaccgagcgagcgcctaagcaaataaaagatgattttccggctcgacaaaaatgtcttgtgaatgagttcagtaacatcacaatgcttggtgttaatcggatgtaactttagtagaggcattaattagaaacgcgttgattgacaaatgaaaattgtttcaccaatgaggaacacatacgatggtcaaaagatgaacaacatcacagtcggtgctttaatttgcacaatctggacggcataacatgataagcaaaaaacctgactcatcaattaacttcacatctgatccctgaccgaaacaatgtcagatcgatgtaggtagagggacaccaaattaattaactagctagcatggccaaatattaaaggacatatatatatatatatatatatatgtgtgtgtgtgtgtgtgtgtgtgtgtgtgtgtgtgtgtgtgtgtgtgtgtgtatatatatatatatatatatatatatgtactttaatatttacaccgaacttctatttccaaccatgtcgactagatctggacgtacgacaatgaaaaaaaaagtcaagcgaatgtttgttaagctaacacgcgcagtacaaaaagaaaactctacttagattgaatccaagtttattttgtccggccgtgcgttagctttatttgacgtgccattgcttcatttcacataatgaaagcgactaataatataataagtaaggtgcgtacatgcttctattacccgtatggtcacaaaagtattagcattgtcactagaatgcacacctacaatttgattcaaccgggtaaacatcagagattctttttggtttagtagtggtgcataactctactctttagatttaaatcctactagctagtaatcacaattttatacacatgagtgtattaagagatgtactcgattgtgtacgtatacttgtcttccgagtaataaaaaataatttcatttgaaacatgaccaaattaaaatccaaagacaaataatgaaagcttaaaacattaaaaatccgatatattctctccgctcaaataattgtcgctttagctaactccttagttattcttttttttccaaaatacatacagtaggcgctcatataaatgcgcacgtactcacacatacccatccctataagtaccttcaaaaactaagccagtatattctgtaattcacaaagttactatatagatgttttgttgttaaagaatacattgtctaccactaaaaattaattaaccgaaatgcaaacacacgtgactagtaatttaaaaaaaatatacatatttcaaacatcgtggtttttatgtttttagattcacaatgataaatacatccctaatatatataattcacatgttgtttaactacgtgactttctaacgattaatgctcaaagttggaagcaaagctaaaaccataaataaactaaatcgaagaatgggaaatctagaaagaaggacaaatcttcttctccccaacaacgacgccacgcgtacaaacgttcgtgcaatcgtacggcctgacattcacacacgcatgcagcttgtaaccctgtcacatgtcggcagcgcaggcgactccgagcgaaactgcgagcggcggctgtggcgcagcgtggctctcccaccgctcacccgagactttgaaacggtatgcatgcacggtcggatgtggccgcagccgcgagctagcgagcgagcgatcgacgcgcgcgggcgccgtcaacctaaccggacacgacacgccgcgacgtcgatctccacttgcggggatccgtgcttggaacggttcaaggccttgcatttcaattccccgctcgccgcgaagcgacatgctgggacagcgagatgtcgggcggtggattggatggatccatatcgcgtcgagcgcgcgcggccggtcgaggtgacgtcgcggcgtcgttgctgggccggccgggcgcccgcggtcgcttgccccgcggcgaccggatcgaaccacgtacgctccacgctccaaggtgttcttgtcacgttttcgcgttttgattctatatgacaaccgattccgcgaactgtccggttgagattgattaccactttacaggcattttcaaccttttcaaaatttgatattgtcaaatttttgataagttagcaaacattatccagttttaatagaataggtaaaatacccaaatctgatgatatcaaattatctattcatgaccaatatttgatagtagactactatcatatactccttccatcctaaaaaagatttaattcttgggtttccgtgttcaacgtttgattgtctgtcttatatgaaattttttttatgattagtattttcattattgttagatgataaaacatgaataatactttatgcatgacttatcttttaaaatttttttaaagtttttttaaataagacgaacggtcaaaggttaaacatgaaaacccataaattgaggtttttttggatggatgaagtatttatcaattttaacaaataataatatggtttaaaataataccaatatgcagcaggtcctacatgctaactacccctagctccgtattaatcgctccatactttggcgatctttcaggatgatgctgatcagtacggagtattaatgccagttcagcccgatacacctcctctgtgtattttggcaatctgtattcagcttgaattctgtatgaacactaataaacgaggcaacaaacgactagtgcttcgaaacagacccccggacagagaactagcgcaactgctttgtgatgtatctcttgataaaccccttgttgagtcctggatatcctctgctccgatctttttgacttcaaacaaatgaatgactgtttccagaaaacaacttcgatgtacacatctcgacgcccttttcaatgccaaccagtaacctgtcatctacaataagatctccggtgttgactaggatatttaatttatcgccttgttttgcactgttcaatatttagttcaaaagatatacggtcagctccaaatccatttcccttcaatctttcgatactatcaagattatttacaaagactagcaaactatcgatcacaacataaatattttagtctaaagttcaaactatcgatcacaacttaaatattttagtctaaagtttttcaattattttttgagggcctcaagagcctgggcatgcaaatattttagttgtgctagtctaatcacaactcaaggttcccttgaaactagggggtcaataacgagtcagtttagcccgttgagttagttatcttaaggaactagcttagctcggcttgttaatgttaacgagctaaaagcctatctcgacttggtttgtgagctagctcacacacacacacacacacacacacatatatatatatatatatatatatatatatatatatatatatataaaatttgtttggtgcttcatggtgcccggacaccattgttgaaattgagtatatacctaattcaaatgagtataaaactttttcaattatttaggtattaacattaactactttactaactagttcaaagcaagtttgaactgaatttgaacttgtttttgttagattttgattctaagtatatagcatccatacatataattagttaggtatgtaatcatagattgtgaaataaagttaaatttgagttgttttgttgataggtataggtatgaatcgaattcttataactaggtatatactcaaaatttaaaaattttgaaaaatttgagtgattttctgcatttgaaaccatggtgcccgggcaccatagtgccccatatgagtgtatatacatatatatatatatgtatatatatatatatatatatatatatatatatatatatatatgtatatatatatatgtacatatatatatatatgtatatatatatatgtatatatatatatatatatatgtatatatatatgtatatgtgtatat

SEQ ID NO: 82841 - DNA, 2767 bp, Oryza sativa
acttctatgcaaacatctaccaaaatagttttcttcaaggcaaattgctgtgtgaaataacggtatgatcagatttgttttatttcatccaaactttaagagacatcaggatatagaggagattatcagataaatgagataatcaaatggaataaaagtccatagttactccacaaaattgagaatatcttttccacacaaggcttgccggttgcggctgttatatgctgtctgctggaagtacgtacgttttcaatgtggttgctttctgccggaattttttacttcagtatcagactatcctagtttggttccttgcttagaccaaacgcacgtaattaactagtcgtgggcactggattccatttattggtatccatccatttgtcaaaagcccttagatcatcagctgataaaaagtctagagcatcagattgtgtggtctcctttactctgcatccacatttgaagacacgcatgtcttgtttctgtagttcccaggcagcactaacaagttctgtcaacttagctacaaaattcatcgtctttttttatggtaacacgatgtctagaaggataacgacaacagcacaagctgacaagcacgctgcactgccaaatcttctcttcatcctttttggcaaatgattcacttagtacctgaaaagaggcccttttcgggggaaaacatcgattaagatctgaaaaagctgaaaggcattgattttgccttacctatcaaattttgtttgtgtttggagtctcaactgctgttttttttccattatttaataattataaaattcgttatcaataaggttttacttagtttggaggcttaattatagctttattatgttttaataattaaaaaattgaaaaaaaaactatttgatttcatgttcaagtctcagtttgctcccttcgattttaaataactatgagtgatactattcaccttcacgctttgattattcatttcttttaaaaataaataccttttcaaatatcacattgtcaaagtgtgttgcatcctattaatttctcacccttacctaaaatttaagagaaatcaaatttcaaagttgaaaaggcaaagtcaatattgacaattattttaaaatagagggagtagtattttttttcaatattgtagatatttaaaatcaataagtagtgatttgtactcgacatgaacactcatttttagattaatgtaaaaactaaattatccaaggtccaaacctacgcacccagggcagcaatgaatgaaatatatatgatgatggtgaatctcggtctaaaccgatatacaactagttgaaccccacgatttgctgtaaaatatgtggatgaatgtatgttatatattataaaaataatatatatatatatatatatatatagatatatatatatatatatatatatatatatatatatatatataatataaaaacattgtgaagataataatttgtcattacttgcatattgagttctaaaataaaataaaattgcgaatgatatgccacatttgcatgatatttaaaatactctagataataattgctagtttgtgatgatgggacacacttgcatgttgagttttaaagttagcgagcatcaactatatagatagtatagatgtggtgtattttttttcctatgctaggatgtgactggagatggacaaaacacaacgaatgaatgacataaaaaaatctttgacagaagcactatcaatctattaacttattaaagtaatagaaaaagaaatctccacttttgctctcacacctagaaaattttcatattaataagataaaaaataaaaaatagaatccatatggaaatacaacttaaaaataactaaaattcaaaattaaaaaactaaggaatattggaagaggatactagattccatatagccatacaatttagagataattgaaattataacttattaaagtaatagaaaaagcagctcatggcctagacattctcatattaataggataaaaagaaaaaaaatagagtctagatagaaatacaatttaaaaatagctgaaattcggaatttaaaagtaagaaatattgaaagaggagactagagtccatgtaagtatacaatttacagataaatgaaatttggaattaaaaaaattgaaagtagaggttagagtacatatagaaatacaataaagaaataacttaaaaaaatattgaaagaagataatagaatccatataggcatacaatttagagataattaaaattcgaaattaaaaaaataagaaaactaaagtagaggttagagtccatataaaaatacaatagcgaaataactaaaagttgaaactaaaaataagaaatactggaagaaaagtgtagagtccaactaggaatataatttagaaataaactgaaattcgaaattaaaaaataagtaatattaaaagaagagtcaagagtctatataagaatttataacttactgaaagtcaacaattttttaaaaataaaagtagagcttagagtctatatagaaatacaattaagaaagaattaaaaatcaaaattataagaaaagaagattaggagaagtgtctagggtatatattggaataccaaatttggtttggataaccggagttgcaacctagtattcgtctaaagaaaagcaactgtatcatttggtctaaagttgataaagacattttcaaataaataaataaatttgtacgtaaacttttatatttgcttt

SEQ ID NO: 82842 - DNA, 1518 bp, Oryza sativa
  unsure (1)..(1518): unsure at all n locations
agtatataactatttgattgataattgaccggagaataaacaagagagtcgtgaaaaatcatactatactttactgtatatattcttcttgtcgtactcccgtttcagcagctcagccccatgcaagcaaaacggaagcaaccagcaaccagtctttgattcgtgtcaaatccgataggtgcttcgagagcgacgaccgcgtgcggatcaggcggcctctggcatctgccatgtgaagcccccaccccctcctccaccatcaggggcgcccccggatgccttacggtgaaaaagcggcgaaagcgacggaccgcgttgttgggtttatctgcnnnnnnnnnnnnnnnnnnnnnnnntccggctaaagcgtgattcccctagcgttgtcagcggcgcggcggttggttacacggttacaactggctttgagccgtcgccaagtgtaataggcagggcagattattagtgatggcatgtgacggagcgtggggctcctcaccaggagaccgcgcaagcccccttttgccggttcggccgggggccctgggtgagattctaagctcctagtctgtggaaagttcgcgagaatggaaaaagcacaagacacgggcgatgtatacaggttcgggccgctgagaagcgtaataccctactcctgtgttctggtggatctgtgtatgaagaagctacaaagagctggagagccagagagctcttattctaaaaaccctcttctccttttttttttctcgtgggatctcctctccagatcatccccccttccagtctcctctcttaagtgggcaaggtcctccttttatatctcaaggggataccacatgcaccacttctccctctctctctttttgggtggaggcccatcctatctatagtaaaacttggcttgccttctcttggaagctgaaacactgcctgtttttgagtgtggccacgcgtcctcgttcgtctgacctcggggatcaccctgtcatctcttcataaatgggcggagatttgcaacggctgctgcccgagtgacccttctgatgggacggcccatacctacctccactccgccggaagcaggtgcaacgtgggaacacggttgtcttctggcgacataaccagtgtcagaccagtcacagaccggtcacctttgtccaccacgtgtcagtttagcaatctgcatgttcgcccttcttcatacaacgtcttgtttataatggttgggataaagcctggcatatatctgaccaggaccaacgtgccatctccaggagctagcacgctggctctggctccggctagggacgagtgcctagagactctcatcctgacgggacggggcgaggcgtgtgtcagatcgcctgttgcctcctaacccgcaatctgaccgatctgtgaccggtcacagaccggataaacgagcgtgccatactgcgctacatgtggcgtgacgcgctcgtccaaaccgcaataaatgtggttaggtgagccccgctatgctcacctacccca

SEQ ID NO: 82843 - DNA, 1407 bp, Oryza sativa
cagataaacccaacaacgcggtccgtcgctttcgccgctttttcaccgtaaggcatccgggggcgcccctgatggtggaggagggggtgggggcttcacatggcagatgccagaggccgcctgatccgcacgcggtcgtcgctctcgaagcacctatcggatttgacacgaatcaaagactggttgctggttgcttccgttttgcttgcatggggctgagctgctgaaacgggagtacgacaagaagaatatatacagtaaagtatagtatgatttttcacgactctcttgtttgattctccggtcaattatcaatcaaatagttatatacttttatggggattactgccaaattaaatcaacatttccaaaatttagcaataccaaatttttggtaagtggacagaattaccaaattttggtagaatgaaataaatatgttatgccaaaattttctatgcattactaatatttggtaacaaactaaatgcagctatatatttatcgattttaccaaacaatgataaagtatggtttaaaataacatcaatcttaataggccctatctctactattataaaaattaaatatgtttgccggtactttggtacattatccgtttatgagtcggattttaagtacgttcgttttttaaaatacatgtgcatatttaagtcggtttttaagttcgttcgttttttaaaataaagaagaaatcttataaggaatctcttttaaaaaaaaccctcatgctaatttgagacgatcagactcccaggcgcagctcatgatttttttttaaaaaaatacatccaaacgaattgacacagtgaatttcaccttaggtaaaccatataacaataataatattaaaataaccttcacccgttgcaacacacgtgtattttttctagtataaaagaaaaacgttgataacactgataaacaggaagtctaccatcttgtaaaatcctatatccaaagtcgattcacataggaaaaacaaaaacttcagtcatgagtacactaacaccattgtatccaaacttctggttttttaagttagtgaatcagtgggattacttatagatcgaacactaggtgataaaatatttgtaaagattgatttaggccttgtttagttccaaaagttttttccaaaaatatcacatcgaatttttgaacacatacatggagcattaaatatagataaaataaaaaactaattacacagtttgcatggaaatcgcgagacgaatcttttgagcctaattagttcatgattagctataagtgttacagtaactcacacgtggtaatgatagattaattaggcttaataaatttgtctcgcggtttccaagtgagttatgaaattagttttttcattcgtgtccgaaaacctct

SEQ ID NO: 82844 - DNA, 9811 bp, Oryza sativa
ggtggaggcgccgacggtgccgggggagagctgtcctccatccgcatcgccgccgcgaggagctgcgacctcgtagtccaggcatcggcgtcggtgctgccatcctctcccgcatcagctccagcccactgctgccgccgccgccgccgctccagcccacgctcgccgccggccgaaggggagagagagagagagagagagagagaaagagagaagggaggaagaggggaggaagaagaaagagagaagatgacatgtggggcccacatgtcagtgggccgcacaattttttatgttgtgaatgacaaacgggtcccacatatatgttttttaattcaaatgcaatctaagcgccatgtgaaccccacatactagatcaacactgctacgtcaatgaaaccgccctccaaaacagtcaagggagtcatattgcaccagtttcaatagttcgggttcgagatatctgtttttgcgatttagggttatggattagattcgggtcacttcagggagtcaaagtggacttattccatccagatttgtaagaacgtgattgcccatggcttttcgcccctcttcatctactacttgttaagctactgaaaactgaatgaacatggcaaatcatgttctgagatagataataatgtaagtgaaattgtgctgttaaaatatttctgttctgtgcaatgtgacaagatttgtatgaacatgattgcccaggccttttcacccctttccatccactacttggtaagctactgaaaactgaatgaacattgcaattcatgttccgggatagataataatgcaagtgaaattgtgctgttaaaatatgtctattctgtgcaaagtgacaactaagttatacaggtgttaaatccagtttcactcaggtagacactagcgaattaagtacaagtgaacatctaaatatttctccctctacttagtataacacctgctaagctagctggctaagtgtgcggcagtgtgcggcggcagcaagggaaagcaacatgattgtttattgagattaacagtactctgcatgcataaattggagtggatgaaaacttttatctcgcattacttgcgtaacacaagcctgaatctaaaacgaatccacttcggatcgcttcagtctggatgcagaaaccaaaacacagaatagtaagtggatcgcttcagtctggatgcagaaaccaaaacacagaatagttatagaaaccgtagcctcgtggttctgaagccagaaacaacggactttcagtcttgcgattgcattcagatgcacgccaatgaaatctatatgaagtgaactacattaattcagatcagaacggggacacgaaccttcgggctagtgaacatcaagcgaactgcgttgattcagatcagaatagggcacatgaacctttgaaacttcgtgatcggttctgaacccttcgtcccggaagcagctcgtgttcacaaaaggggtttttcccccgagatcggaagtactactgtgtcatgcaatcgtgggtgatccgctcgtcggccacacttcggccgaatcaagttgggccgtaggcatgaaagtgtagagacactttcgagttgggacggattagccggccggggtctaggtggttatcgagttgggcttgattagcccaccgtggggacgaatttttttcgtttttagatttttttttaatatttacagaaataatctatcgaccaaaaaaattacagaaatagcccctgccgccctaatggtgggcggcaagctgacgtggcagacggtgggtcgaccgcgccgtctgccgccgtcggccaaaattgcgattaggcccttgccgcccatacagagggtggcaaggggctaattgcaattttagccgcccataaagagcttgcggccaaaagatttttctatgttatgttaataataaataaagaagtatttattggtaaaacttgttaatattgttataaaaatgtattgaagttggttgttgcgcaatttcatatgttaagtgaggtattattttgtaccttattcgacgtattagtactcggataatttatataggcctatcgcagtctgggtcgtagaaacattatatggacttaaacaaggagaattatgtaacatgaagaaatagtagtacaatttgaacatgatacgactatttgcattgcggttacatagatgatattagattcgaattaggagggaggtagtgcaatagttgaacacaacgacgatgtagtaatgggacaaggaagcatgacagtagaaatttcaatatgccaagttgtccgataatagctaacccctacgtgaggatccctctcctctctcaaaccgcgctttagtaaccctgtattgctctggtagttcaagctgcacaacacggctaggtggagttagaacccttctggtgtctatccattctctgtattgacatctccttggtggttcctgggaggaaagaatagatgtaaagcaagcaaagttagtaaatgttgtgagaaaataaggattcatgtaatcaaaatattcttaccatgaaatcgtcgtcaagaatatttggataaacaaagaaccttcgacctaatgttgtaggatttatggaacgaagaacctgacaacgatcaccacacctgcatcttggacgggcttcccatggagggagtgccgtagttagcacccgccagtcgctctgttgttcacgacattgtcgttcataagccgcttttctctgtaagtattgctcagtactttcggatgcgaaataccagcgaccttcttgtaaacaagtggttaggtcgagaacgggattttctgtatcgacccactcgatgtatgcgcaagccgtagtgcgggtctgccgaatagagtagtgttacgaagaataaagcgattgcccatacggaatgaataagcatatgcagataataaaatacctcacggtcatagcacctaaaaaagcgccttcctcgaatattaggattcctcgaagccattagttggcatcgatcaccgcataggtagagaggacgctggcaccaaggtggtagtaggtatacacaaggatcgctacgccagtttggatcctcaacaccccggcgtctagccattgacgaaagccggtcggatttgtaatgaagcaagtggggaagagagtactgaatatgactgagttctgaaatattgtgaggcctcactcgttaaggcgacttatataggcgcaaaaaatcgagtgatacccctgacatgtgaacgtggtggggtatggtgggtacgcctgattggcgccgaaagatacatgcatgatcggcgccgaaagttacattggtcgtatgcgccaaatagcggtcacatataggatctatgaatattacctgaaattggcgtctgaatccggcagggcttcgccccttcttctcttctcctcccctctcttcttttttttttcactggaattgaggagagaagaatgagggctgggggctgggcagcaggccttttataggcagcgaggcctgccgcccggccagagggcggcaaggggccgcctgcaaaatacccggccccgactggcttttttgcattcgggccccttgccgccccaccagagggcggcaagggttttctgcaaaaaactctccctccgtcaccgcccgttcctcccctgtttgccacgtcagcttgccgctccagaggtgggcgacagggtctatttttgtaatttttttggccgatagattatttctgtaaatatttttttaataaaatctaaaaccgaaaaaaattcccgtggagacgatggttttgaccgaggcgtctgtgcttctgtggaggtagcaggtgggctgatgtcgtaggttcacgtgggcgcggggtgtccgcgtaatgtgccgtgcgtcgcgccgtcgctcgattcgcttgggctgctgtgctctgagtgctcccgcttgggcagggccgcggccatcggcaaaagtctactactaactacaccgtacaggcagcggaatgatttaagggataagggagggacctaagtgaaaaaaggcggcagtagcggtgaaaaaatggcgaccaaagtgcacgcccgccgcctctagcgccgaccgcctcccgttccccttccccactccgtcccggcagctacctccgctttccaccacgccggccgatccgcctccccaaccctatcgccggcaggcgcgccacgccaggttccgggctcggagacaccgcacgctccgcccgatgggcacccccgggccggagctcgccgctctcgcgattcgccgcagcggcggccgcctgttcgagcggtagggagggactcgtctccccgcctctccttgtcgtggactcgtggtagcgggggtgggaggagccagagaggctgggggcagggagggaggatgctggggtcgggcctgaatctcgtcagcgcggcgctcggcttcggcatgaccgccgcctttgtcgcgttcgtctgcgcgcggttcgtctgctgccgcgcccgccgcgcggacgctagcgcgtcacggccacacccctcgccggtggacttcgacgcggacttcccctcggatttcgatcgcccggtatgtggcaccttgttctccctcaataatagtcttccgctgcgattttagtccacaaactggagtagtaatttgctcgtgttaacggtatcactgctacctgcagtggcatggcacgtgcacaaaacgactggagtatatctgttttcattttctgtgttcatggacagtacttttctactttcaagcagaaatacttgtcatgtgtcatgctcaatttatgatggccttactgtgtagtaaatcaaatggggaataagtacaggcactagtagtacactagcctgctttaccttgggcgtgcaatgttgttaaagtggctttggattgcttactggggttccttaagagattcattaagaatttgagatgttaccgtctaatctttttaatcattttaatattgtttatggttttatgttccctgtacaaataacaattttatttaagcgactaaaggaggaaggcacatcaacacatgtatgctagacttgtttctgaatttctcttctttgttggtttaaattgggttattctctcttttaaaatgaaaaatgtgttagtcttttggatcatttcctatatatacaaaataagctgaaaaatatcaattcaataataatagtataatgtattttcactgaagttcgtatagcgccaactgcacaaagcatctttctttcagagttagtggtcttgtagtagttcctcttagctagtactactacatataaaacagtgcattgaatctatagtactatgttgagcgtttgagctcatatggaaattattagtgaatagatcaactgaatcaatagtcaacacgccctataaattcattttggacttgaaagtaaatgcaagatttttttttattgttcagatagagcattcccgcagtgggttggaaccattggctgttgctgcaattcctacaatgaagtataactgtgaagctttccattcggaagatgacacccagtaagtacaatcgtcaccatctgaagtaaatattattgaacttctttatagtgtggttcaatgcatataatctgcttctaacatgctattgttagaaaaactatggttattgaaaaatattagcacaatgagttaaaaggtttgttagactttgtggaattcatatccttgtggaaatgttggaatttagatgtgcttaatcgaagcatatttaatcaatatgtacaatgggtagagatattatagattatcaatcatacttcttgttgatgagataacataggacaacacacctgtagcttttatcagtttttttgcagtaccttgggccttcgccaccagtccagatttaataggaaccaatttggcagagttgagtcttatctcattacgttgtcaacctgggttcagtttagtcttacttcaagtaaactttctatcattatcatctctgcttgcagccatacctcttaaatttatgatgcatccataattttttttttttgtaatatataggatgttttgttgtaacaggtgctccatatgtttaagtgaatacaaggagaaggacattctaagaattgtacctatttgtcatcataactttcacctttactgcttagatgcatggttgctgaagcagactacttgcccaatatgccggatctcattgaaagaactgcctgatggaaaatcgaccgtatcctctgctcctaccatgtctcaaccccccaccctccctgagagttctgttaatccaacatctcatttcctcccagttcatcaagaacacagaagccaccaggatggcccagatatgccagaatctgtagaggtggttattgaaatccgacagtgactacggcggaatagtgcaagacaagaatttgcagtttaaattctttgtacgcccttcattgcattgtttgtcgcagtttcaaaatgtttgaagtcaaaattatatgtggtccctttgcaagttgtagactagagaagtcagtcatacaatccacattatcatatgttctttttaatatatgttgtatattgcaagctaagtaaaaataccgataagatctactgatataggagtagagcttatttactgttgagtccctaatttttttatgagtgaatttcagcagggacacctcttaccaaagttttactttcgactatttagggtcactttgaatcgccggattgagaaaagtaggaataggaaaaaagtaggattttgataggaatgtaagtgtaaaacagaggattgcaaaacgtaggaaaaacacaggaatgaccgtttgattgaaccgcagaaaaaatgcaggaattggatgagagaaatagactcaaaggaaagttaccaagagattgaaactcttgttaaatttccttcaaaatctctaaaggatgtccattccataggaatttcaaaagattggatatgattcaatcctttgttttaaagggctttatgggaaatatttctataggattaaaatcctctaaaatttcaatgtttttaggctgtgggatcagctgaccagatagctttttcgcaaacatgtttgcgagtctccatttttaaatgtaaatttattaaaaattatgaaaatgacccactaaaatatggataatggtatttgatcttatagaaaaaatttattgctctgccacttacgatctacatccaggttatactcctcatatttccgccaatgcatatatatcctctagctacctggatacagagatggcaatgggtctccgttcaccgtttccccacggtgaattcatctattaggtggcggggatggttaatatttatccttcatagggaatgaaatggtttcatacttatcaccatcggggatgacggggacgggacgacgcaccattcccccgtccccgtcccccgtggtgacctgactttgttgtagagaggaccaattctaaactttttagacgttctggcccataatattgaagcccaaataacatgtatatataaaaactaaccctagtcaaccagtcaaaactccaaatcctccactccttcagatcgagcactcggcagcggcggctccgttgcacgtgtgcaacgctactccgccagcggccagccaccaggtgcgccgccgctctagacggccaagccgtggacgcgccgccccagctgtcgtcgtcgcgtcccagttgttgacgtgccgccgggagccacggtagttgcgccgcccggtgcctgcagccgtcgacgcgggcgcgacgcttgccgtcctccgtccgctgccagcgccatgccgccctctgtcgccactcgctagcacgccgtccgccgccaacggcctccgtcgctgaagaaatcaactactgaagtgatgatttgtgttgagttgatttgttttgtttaaccggggacggggtaaccacggggataaattcaccgagtggtgatcggggctggagaaaatgtagccctgttgtggttgacgggggcggggacggtgaaattttatcactatgaggacggggacgcggatgtgacccctaacggtgaattccccgttgccatatctacctggatatagcagcggtgttaaagtagtagtaaaatgtatccaaacaaaactaaaaaggtcaagcataaagtgctcctcctgtgatcctgtctccaccggtgcatctatatccgtatttctccttatcaggtatcagaacaactttgaaaagaaagggtgcatccaactttgaaccaacttttattaccaaagtttcagtttaggcatcatttattcaccctttttattctaaactactacctccggcccaaaataagtgtagccgtggatattcgtgtccaacatttgaccattcgtcttatttgaaaattttattaaaaaaattagtcatacagaaaagtactattcatgttttatcatctaataacaacaaaaatactaataataaaaaattctaaataagacgaacggtcaaacgttaaacatgaataatgtaaaactacacttattttggaacggagggagtagctaattttatattgtatcactttgaaccacctcaactttcttatccatccacatctagctcattttctatcaagatatgaactatagacagttttagggcccctttgaatcaaaacatttagagaggaatttcatagggttgaaatcctatagggaatttttctatttggctctttgatttaaagaattgaattttccaaattctatacaattcctatgaaatgactcattgcatgtaagttttggaggaaatttagcaagaggtccaacctattggaaaaaaaaaatcctttgagtatatctctctcatctgattcctgtgtttttcctgcgactcagtcaaacgattatttctatgtttttcctgtgttttgcaatcatctgtttcacacttacattactgtcaaaatcatgtgtttttcttattcctccatttttgttttcattcctactattcaaaggacccttaggagtttattgtcgtgcaaaagccgatgtaattgaaattaccgagttaggccctgtttgattcagcttaggattatgataatctggattattaggagtaagctgaaacaaatagatagcgtattatgatagattattataatctataagccagattactataatctggtaatccactctaaaagtgctttttctactccctccatcccataatataagggattctgagtttttgtttgcactgtttgaccactcgtcttattcaaaaaattttagaattattatttatttttttgacttactttattattcaaagtactttaacacaacttgtcgttttttatatttgcataaattttttaaataagacgagtggtcaaagagtgcaagcaaaaactcaaaatcccttatattatgagacggagggagtagattattgggtgtaacagctaataatccagagaatcaaatagctaacagcttattatatatcggcttattataatccagatatagtaatctgatttaataatttaaattataataattttaagttgaaacaaacggggctttaaaatcaaggtgatgtaaagtgtaacgaagataaactaaacgatacttcattaataaaggacggatttacttgaaaataaactgtatccaaatcttccaacctttttttttgggatccaaacctc

SEQ ID NO: 82845 - DNA, 14346 bp, Oryza sativa
  unsure (1)..(14346): unsure at all n locations
cttctttaatgaagcctgccgctaacagcttggttaattcctccttgatcgcgtccttcctgtcttgcgcaaatcggcggagtcgttgtttgataggctgggcatcttctttgacatgtaaggagtgctcaatcacctctctaggaataccgggcatatcagatggtttccatgcaaagatatctttattgttctgaagaaaggtgatgagcgcgctttcctatttacaatctaactcggcgcctattacagcagttttagtagaatcagagggatctaggggaatctttttagtcttagcttcgctttctccgctttttgaagtcttggtagcgggcatttctccttcgctcgtcgtggctgcagccagtcggatatcctctcgggcagacgctatctcgcgggtttgggccatgtcgcaactctccttgtcgcatgtgacggcttgcttgatgtcgctccgtagggataggactcctcggggaccaggcatcttcatcatcatgtaagtgtagtgcgggacggccataaacttggctaacgccgggcgtccgagtatggcgtggtatgctgtctcgaaatcggcaacttcaaagctgatattctctgtgcggaagttttcccgagttccaaaagtgaccgggagggtgatctggccgagtggagttgcggataatcctggaattactccgtgaaaaggtgcattgctgggttttagctcggagcgaggaatctgcatatcatccaaggtcttggcgaagaggatattgagtgcactgccaccgtcgatgagggttctgcgaagcttgacattacggaccactgggtctagtaccagggggtaccgccccgggtggaccactcggtcaggatgatccgagcggtcaaacttgattgcaatctctgaccatcgaaggtactggggcgtgtcgggctgaacagcattgatctcccgttcggtcaacttttgcttccgtttagactcataagccaaggggccaccgaagatatggttgagctccttgcggtggtcttgaaatcctgccggggcgtcgccgtcgtccttcttcctcgacgtgctttgttcttcgtcggagttcttccgtgtagtcttggtgtattgatccgcgaattgcttgtagacgaaacaatctttggccacgtggttggagttaggatggtgcgggcattgggagttcatgatcttgtcgaacgtgttgacgcgcgagcgctgtcgagaagagtgactggcggttgcaacaagttccgcaggcttacgcttgcggtccttatgattgttacttccacctcctcccgtagccggcgtacccttatttggcttccaactaggacccgactgctttgatgcggtgacggcgtcttcagctttggcgtactcgttggctttttcaaacataagcttgactgtcctaggaggtttacgcccgaacttgccaaccaattcttcgtggcgaatccctttggtgaaagcggcgatgataacgtcgtcggtgatgtcggagatcttattacgttgttcagaaaatcgccggatgtaatctctgagggattctccggacttctgaataacgttgtagaggtcgtattgtgtgccgggacgctcgaaggtgccttggaagttggcgatgaagtggtcgcgtaattcggcccaagatccgattgtaccacggggtaatccatggagccaagatcgggcggaatccgctaaagccactggtagatagttcgccatggccttgctgtctcctcctgctgcgcggattgcaagaccgtagacggtaagccacgattctgggttagtggtaccgtcgtacttctctattccagtcggcttgaagccggctggccaatccactcgacgcagatcgtcggtgaaggctgctactccgtcaaggtcgtcgtcgtggcggtccggcgaatgatgatggcctcgagctgctcggcgctgtatgatcgtgtcgcgaagatcgacggggcggcgacgaggtggtgagcgaggccgttccactcggcgctccccatgatggtcgggaggtgagtgaacggaccgcccgtcgtgacccttgctcctgcgattggatcctgcgccggtgatgctgaggcttggatgacggtagtcatgagatcggaagtggggaactcggctgccagtcggcgtgtggacgctttcggagttaactgggaccgaagccgcaatcatggtcttcgtctggttcaagatgttgacgacgtgatcagattgattgagctcgttttccttgaggagggtgtcgaggagggtgatcgcggcaaccgcattctgctgaggggtgcggaaaaccggtgtcccttcaacatcttgttggccgatgagatcacgcgctcggcgccctgcttccaaagctcgctgtcgtcgatcttcagcctccttcgcggtccgctcacgctcctgctgctcacgccgtaaccgttcttgttcttgtgcttgacgctcctcctccagtcggagacgctcagcctcgcgacgtgcttcggtctcccgggcttggcgttgctcctccgtctcgttatcggccatgaagacgccgaagtagagaggggtgtagttgtcatctaggctttcgtcgaagtcgtcgagatccggttcgttgtagcgagagctaaactcgtcgtactccacgatgtctgtggggcgcgagtcgacggtgggagagctgtagtggccgtccaactgatccgtcgaaaccgtgccgagtggttggaggatgacgccgacttccctgaagctaggcgaaatcggcgttgaagccgacttccgcctaggcctacgggatgaagacgctgtcgtgatgggggcggccgccgaatcgtcggggagcttcattaggatcggtgggtaagccccatcatcttgatctggtgtcgttggggaagatgcgatttcgcccgagtggtttgaagccaactcgattgagatggtcttgaagtaactttcggccgcgtttgggagtccaaacgggaccgaaagccggttctctcccgactgggccgacaccgagtcaaggagagagatcttgccgaagttgttggtgacgaagtcgaggctgccgaaccgaaacgtctgcccgggtgggaagacgaggtcgtcgatgccggagacggaacccattgcactgatcggcgaaaagcttgacgctacccctacctggcgcgccaactgtcgaaactagatttcggcaatagtaaaagggggtggctatcaagctagaaaagtgtatgggtttggagacaaaggatttatacaggttcaggccttcttattcaagaagtaataccctactcctgtccggggatggatccgccgagtgtattattgattgtatgattgggagaaaatcaacctatgccccaagaggcacccggaccctccttatatatgggaaggagtccgtgttaaaaaagataatctatatccctaacggaatatgcagatacaggtaaaatacagtcgtaaccgactaagtctcaaggtgtttccttgatgtacaagttaagaaacgaacccgagatacaaataagatattctatatatattcggtatcctatatccagtccaaatatcctcgccgtgtagatatgggatatccataatctccacaggccttttgctctaatagtagattgaattgtttttgaaggaacagaaactattccgttacatattcataattataggaacagggagattagcttctgttgcatgcgtatacatatttatgttatgcagattagcttctaccatatttttagcctgttttttcatttgccggctagtatatatcttctgtcggccaggagcagaaaatcaattccaaaaagaacagaacatcagttagttaggagcagaaaatcaatttgaaaagagcataacatcaacaattgcatgtgctgcccgtttatatacaacatatcaccaaacagtgctcactttcaaacgaaattaataataaaaatattggtttgagagcagaacatattctgcctccttataagtagatcgagtttgttttgaaagaacagaaggtattcttctttcttcttgccaaagcttcctataagtaaacggactttgttttttgagcagaagatatatattctgctttcttgtttctagaaacagagataatttcaggtacaaaattcaaatctctttctgctccctttctaaccgatgttctgctcctttggtagtttctgctgattttcaagttttggatcaaggagcagaacttaccgatgatgagatttaattagacgaggagaagttgaatatgtactacttatctaagtacgtacacagcagaaactatacccagcagaaactcggttatgcagaatatgtactacttatctaagtacgtatagatgacatacagtatgttagtaatcaaccgacagaacatgtactgccatcaaaaacagatacggagaaaaaaattaggtggctgttctgctaatttttttaagttgatgttctgtcattctttttaattcatgctctgccattttttctgttggccggctaatatatatgttccaccggcacgagcagaagataatatgccaggacgagcgggtgcgaggaagaaactgcatccgagaagttggtttgcatgcagccgatgatttagcaactatctgaactaacaaactatttaattaaacaacacaggtattcatcgttattggatcctcgtcactccattaactgaatccgatccataataggagggagtaactactctcggtagtaggaaataggctatatatatatatatatattagaaaaactattctacacccggggtatagaatagctattctatacctccctcccaccaacccacctcctctccccccaagggcccaaaacccacctcccacctcggtcaaaggccagtcaaaggtctctcacgtcggtcaattctaggtcaaacccgtcggtgactttccccacgaccctctctcttcttagctctcgtctcggaatgacgtagtaacgtgttgttcatcgtgtagtaacatagtgttttacttgcagtaacaaaattaaaatttactcataatatacttatgatggatctacttttggtaagcaattttttttgaacatcatggtgcaaacggtttttaaaaatagtacatggtgtgagagatattacccttcaaagatttgtttttgaagatttaactctccacaagtagtaatactatatcaaaagttttactactgcctgttttgcgttactgcaatcacatcatgtcattactacaagatgtagtaacgattataattttcacgtaacatagtgtcttactgtaattacttgataacgttactgcaagactataagttttgcagcaataaagcgtctaactacattttttgagtagtgttactgcataaacacgtggtaacgtgtaattgtcgtgcagtaatacttttacttttgtgcagacttttgtgcagtgacaagtgtatgattagcatctgagacttttaacccatatatttttgtttcaattcctgaattactgcaattcaccacaatattacggtcaaaagtgcaataacgtcatatacatgcagtaacgttatattggagggaggaaaccaattttcttgagaagagggaggaaaaacggttcttgaggaggggagtacgtagatgctttttgaagtttaatcctccacatgcagtaacacgataacatcatggtggaaacggttttaaaaaataatacatatcttatgacatattgcttttcaaagattgacattttgaactttagccctccacatgcagtaacagaatgtgtaatttacagtaataggggtttatacatgcagtaacatggttttaccaaatgtataaaattattcaaaatactcctacatcaatcagaccttgctcaaagccacctacaaactttatctatggcccacctattcgaacttcatctcgtaaaaatgacatagtaacactgcatttatcatgcagtaacatatctacttggaagtggtaacatgcacctattatgtagtaacgcttctacttttgtgtagtaacaagtatatggttagcatgtgaggctttaactcatatatttttatttcaattcctagtttatgtagtaatactattcaagaaaatgcaagacactttgttactgcaaagcttattgtctttactagactcttatagtaacgttgtgatagaaatgtagtaacgtacagtagtaacaagtaatgctattgtattattacttgtggagagtcaaattctaaaaagaaaagcttttaagaacaatatctctgatgtcatgtatggttttttaaaattgtttgcaccatgatgctagaaaaaaaatgcttatcaaaagtacatccatcatgactatatttcaattatatttgagcgttgttactgcacgtaaaacacagtgttacgagacggtgaccgccgcgttactgcacagtttcgcgaaacgagagctaagaagaggtgggtggtgaggggagttagtaggtgggtttgactgagctttgaccggcgggagggagctttaaccggcgtttgaccgaggttggaggtggtttttgggccttagaatggagggggaggtgggtgtggcccttgagagcgaggtgtacaatagtcttaccctatatatattacatatatattacgcacatatatatatggaatacatatatatatatatatgcatatgtataaatacatatacatgcatgtatagtacaattcatttgctcactagctagctatgacttcgacgccggcgttatgtcaaaagaagaaagaccgacgttatgaattgtcgatccgtcgtagtagaattcaccctcgggattaaggacttcttcgttgatgaatctcatcagttgttcctgaacaactgtgatagaatctttgtgtgggagattgtccctgatgtgaatacactatcattcgaaaaataatgacatatgaatatatgaaattaataaacaacaaatcgatacgcaatgaaattttgaatggtttatatatacgtacatcgagctctcgtgtggtgtagatttgggttgataggaagtgggcatactcgcatacgtagtagccgcacaggttagttccctggtcatgctttgcacattacatgagaaaggacaagagatttaatatacacttacattaactgtaactagtaatcatatataattagcatatgcatgatttaaaattgttaaaaattctaattatcatatgtaaataccacatgcatgatttaaaaatgttaaaagttctaataatcatatataactagcatatgcaaaatttaaaattgttaaaaattctaataatcatatgtaaataccacatacatgatttaaaattgttaaaaattctaataatcatatgtaaataccacatgaatgatttaaaattcttaaaaattctaataatcatatataataagcatatgcaggagttaaaacttttaaaattctaattatcatatataactagcatatgcatgatttaaaattttaaaaattctaataatcatacataattaacatatgccgtacaacaattgatttatatggatattcaatacatccaaaatattttacatcgtgtacacaacaattacggcaatacatcggcggtgacggttgaccgcacgtacttcctcctcactattgttccttccttatgatcgctacgtgagtaaggggtgtcttcgtttgataggaggatgctagggtcaaccgtcaccgtgaaagggggttgcccatcaaactgatcataatcttcatcagtcttgtcctcaactccgatgatttttcttttgcctgggagaaccacgtggcacttcggctcatcaggccctttgcccttctttcctttgctagacatgtccttcacataaaaaacttgcgttacatcattggcaaggacaaaagattcgtccgagtatcgaaccttgttaaggtcaaccgttgtcatcccactgtcatcaatcgttacgcctccaccaatcagccaaactcattggcaccggaacagaggaaccttgagaggtccatagacaagttcccatatgtcctcgatggcaccgtaatacgtgtcagttgtaccatcgtgtcccatggcatcgatacgaacagcactgttctggttcgtgctctttatgtcttggtttctcgtgtagaatgtgtacccatttatctcatatccttggaatgttgctatcaagccagatggtcccctcgccaggtaggcaagttgttggctaatcgtctcgttacccatgagatgttgtcgcagccacacgggcaatgtatcaatgtgatgccgtgtaatccatgcatcagacttaccgatgtttctggcaggaactagagccaagtgctcctcgatgtaaggagccaccaatgaagattgttgcagaaccgtgaaatgggctttacggaataaattgttgtctaccgtcattgctgcgttccttccgagagtcccctttccccgtagtctcccttcatggcgtgattcaggcactctgattgggcgaaggtcttcgataaattctacgcagaattcaatgacctcctctgttccataccccttggcgatgcttgcctctggatgagcacggttacgaacatacttcttcaaaacgcccatgtacctctcgaaaggaaacatgttgtgtagttacacaggcccgagaataccgatctctttgacaaggtgacaaagcagatgcgtcattatattgaaaaatgaaggtggaaatattaactcaaagctgacaagacattgcaccacatcattttgaagggcttccaatctatccggatcgatgaccttctgtgaaattgcgttcatgaaagcacattgctttgttattgttgcccggacattgtctggaaggataccccgaattataactggtagcagttgtgtcatccacacgtgacagtcatgagactttaggtttgtgaacttcttctccttcgtgcttattattcgctttatattcgtgaaggacgtccaagaattcccaatagggtaactcccaaaatatatagttctttttccacatcgccgcgtgaccatcttcgctatcaataggctggctgccaggcccctttccaaacactactttaagatctttcaccatagcaaacactgtttttccactgcgatgtttaagcttcgtacggtggtccgccttatgttcaaagtgattgcctttcttccgtacagggtggtttgcagcaaggaatcgacgatgacccatgtacgcaaccttcctacagtgcttaagatacgtactttctgtttcatctatacagtgagtgcaagtcttggaccacttattagactgccccgataggttgctaggtgtaggccaatcgttgattgttacgaacagcagcgctcgtaggttaaactcctcatgtttgtcctcgtcccacacggggacactttctttcttccacaacagtttcagatcttcgaccagtggtgttaggtacacatcgatgtcgttaccaggttgcttggggccttgaataataatcggcatcattatgtacttcctcttcatgcatagccaggggggaggttgtagatacacatcataacgggccaagtgctatggccgctgctcatctctccaaaaggattaatgccatccgtacttaaaccaaaccgtatgtttcgtgcgtccttaccaaagtctttgaatgttctgtcgatgtttcgccactgcgaaccatcggcggggtgtgacacagtatcccgtcctgttgatgttcttcagcgtgccaatgcatcattctagcatttccccttgctcctgaactaacgccttagccgtggtattatagggaaataccacatcaccttagcaggaattctcttcttcgttggctgcccataaacttcacatggatcatctcgtctaatcttgtatcgtagtgctttacaaacagggcatgcttttagattttcgtactcctcaccgtgatataggatacaatcattcggacatgcgtgaatcttctgaacttctagtcctagagggcagactatcttcttagcctcatacgttgtctcgggtaatttgtttccctccggaagaatgttcttgacgagtttcaataaatcgccaaatgtcttgtcactaacatcattttttgccttccattgcatgaactccagagtggtatccaactttttgtgcccctgctcggaacctgggtacaacgacgttctgtggtcctctaacatacgcttcaatttatgggcctccttttcactttcacagtcctccttggcgtcctacaacatctgaccaagatcatcgcagcgtcgttattgtcagcatccctgtccacctcgcccgtttgatttccttcaaatccagcgtactgagcccagtccggaatgttctcgtcttccacttcatcttcttccatctcaaccccttgctcaccgtgggatgtccaacaattatagcttggcatgaaccccgactaaaacaagtggaaatgagtagtcctgcatacagaatactccttctagttcttacacttattgcatagacaacaaataaaacccttatgcttgttagcttcggccactctcaaaaaataatgcaccctgtcgataaactatttggaccaccggtcagcgtacatccattgccgatccacctacatgaaatgaaaaaaagtcatacataaataaatattcataaaataatgacagccatacaataatgatcaaacaattaaaaactctttcaatagtcatacaataatgacatatcattattcatacaataattataaaataatccaacaaacaattcttatttattatttttgaatttttaaactaatattaatgttgtacttcttttaattttcaatttagtttgttttctatttttcaagattaattttcattatattttaaactatgagaataaaacttttttaagtaaacaaacaaaattcctatatattcttcttccccacacaatttgtttctctcatcaacttacgacaaagttttggagacaaaaaatgtgtgaaacatagctccaaaagtaatataacaacaaaaaacattggaggatgaagttactaaccttttagatacctccgatttgtatataatcaccaaaaaaattcacaagaaattttggcatgacctcccctcttttttggagaaaatttgaagcttgctcgggctggaggaggaagaagacacatataaagagggagataattagtcccggatgatgttatcatccagggctaaaaatcgccgagatctttagtccccgggggcctgacaaggcctaacatctttagaaccgagactaaagatgatcttaccaactgggattaaagatcatatatgcccgctgtagccaccaaccgggactaaagatgatctttagtcccggtttttagtggaaccgggaatattgtgaatttcggctgaccgaccaaagatggtttctccaccagtgctatgataagatctcttgtagtgacggcttgtttggttattagagaggcagtttgagacatacggcatacagtttcatactgtgtgcgtgccaagttggcaattggatcctagtagcagcaaattttgaaacactcaacccaacccaatccttcttctcttaatcttctcttcctactcttgtgtttgtgtgtgtgtgtgtaagaggctagtagagttagctagcctaaatttttttgcacgttgcagctactagctgtgctgctggcttgtcgtcctctgcttgaactttaaagagagagctaatagatcggtgatccgcttgggtttctggtgatcatatgcaacatggactagctacttggatttgttcaaaggatctgcttcttggatgctgtctgggcacgtcgccatgcatgcgaattttgcggatggagtcaaaagctgcatgcacggagctgatttaattaagggcatgttcagattgtagtcaaaataaaccttaccaagtttttggcaatgccaaaattttggcaggatttcttatgtattaaccaaatttggcaacaactaaacgtagatatttttttggtaactttggcaaaaaatgatttggttgaaaatgacatcaaagtgaacaggccctaattaacttgttgacagctactccctccattccaaaatataaggcataaccacccttaactcaaagatcaagaaataattattatcatcttatagtttgaatcatgctaataaatataatgcatgcatccaataggattagataacatgagagtaaaggatttaaaaaagtaataacttaatgaagaagatgtcatagttaattgcatgcttgcatacatgccttatattatggaacatctaagaaaagtggttgtgccttatattatggaatagagggagtagtacctaattaagcatgtgtgttaatttattattaactagtaatctgcccgtgctaacgctgcggcgacatttagaaatacaaattaagatcgatggatatagctattatgttgttaattaaattgccacatgcataaaataacatagttattatcctggttcaaatggagtcattagtgacaacataccatggtaaaagcaaaagtaattaaactttggaacttggcaccttgaaccatcaaatccttgtctaccatgctgtctccctgtcaccccccccccccttaattctaaattaaatggatgagagaaagagattaatatagtttagtgtgatagtgccaacacatggaaaatttagagcttctagttctctccttctacatctctcttaaatgtcggaccaagttcttatggggcccactcatcatacaaccatagccaacacatcatctgctcttctctcatttaaatcttcttttatttctcaaaaggtgagagaaaggtttaaattgaatttccacccaaaatgccactctaccactccaagccttctaggaaacatctatatatgggcctatttgtcgtccaaatacctgcaaacaaccttggtgaatcatctctttatcctaaattatattttcaaagagagaaagaaagagagagagggagttaaagtccaatttacacccaaacttcaccatacctctcatcttctcataggaaacatctaaatggggccactagacagccactcatacttggttgagtgaagtacaagtgggatcacagcctcaaaccactgccaactcctttaaatcgtttctacccctcatgttgacaactagctctcactttccaccttcacttttaccattcactactacaaccaagatttttgtgtgagggctaaaacgatttttgcgagcgggtaggcggcccgcacgcacctaggggtctaggaaaatgatgatttttgcgtgcgggtggcgcacccccacgggaaaacaaaaatccgaaataacataattttttttaaaaaaaacgaaaccctagaatccggcggcgggcttccgcccgatagccatagtgccgcctgcctcccgccggcctccgcgccacccaccgtcggatccgcgctcccctccggctgcaacgccgccgacgcccctcccctccgccggatctagggagggaaggaaggggagaggaggggagctggatcccacgcggggagaaggcggctggctgccggatccatgcggggacgaccgccaccactggattcttgcgttgacggccaccaccgttggatccgtgtagggactaccaccgcccgccggatcccgcgccctccaccgcagccacatggaggaggccggcgcgctcctactcccaccaccgccgcgccgctgctgtcgccgcgtgccgccgctgctaccgccgtcgggaggagaggagaggagagtgcagagaggagaggagaggcgtgagacagagaagactgagaggagatgctctgcgtggaaattttaaagtggaaaaagggatagaggggaggggagaggagagaaagagggaaaattttaaagtgggtgagagaggaaagagggacttagtatttttgcatgcggctctcttaataggtccgcacgggaaaatcggctcattttcgcgtaaagtccataaaagaggaccgcacggaaaaatcgatttttcccagacgcaacgagttaccactcgtaaaaattatgtttgatacaagncggtacacgggtagtaccatncccgcagc

SEQ ID NO: 82846 - DNA, 34997 bp, Oryza sativa
  unsure (1)..(34997): unsure at all n locations
aatgtggggccaacatgtgggggtcatcccctacctcgggctggcagagccaagccaaacaaccgccgcttttcatctaattcctcatcaccgggtcgccccagagtccatttgcttaagggaaatcattctcctccttatcctctccctttcccatagagtttgggagatcaattttgcccgaataaacaaatcgaattcgttttgagtttatctctcctaactaaccctagtttttcccggctccattcctctcggttggagtccaatccgattttcccagaagcgacgagttgccgcctgcacggaatctaaaagggtccctgtactagtgattaatctaggcaactcgccactgtgaacctcatctatttctcacagtgttccactatgcaaaccaccaaaaactacctcggaatctccaagaacttccacttactcttttcacctgaaggagtttcatccatcgcacgtattctctggtgagcttcaccgcactccaaccatgggaacgtgaagttccttctctacctaatcaatccattttctttgttcctattttggcatagatcgaacagttggtgatatgctcgtcggcgttcccggtccattgcgccaccatcgcccgacttcgtcattcccgtcgactcgaaccatctccggccgagccattgcgccaccgacgtcgcctacgtcccaggagaaagacgcccaaaaatgatcaagccaatatgccgccgcgaacgccatcagtcgccgttgccctcctattgcctctgcttccctagccgccaagtcaccgacatgtgggccccggctatttagccacttcattaggcgtaaggactttcattagtagaaatttaaatcttgtaaggttctttttgtaaaattgctttgtatgccatgtgggcctatggacctaaacgcagttcacctaatgcccatggacctttttgtatagggtttagggtaagtcctaaaccctacttagagattactatttcatgcattcattacttgatataatagcttgatgagtatgttgtactcaccattgctttaaccctctctttgagaatcaatttggagtttttgctgaagccgtgagtttaaacatataaattagtttcattccaacttagttcccatgtatagattagatagatggtttaattctatagcaaaacattagagttggctcatcctatagcttctacagtaatagatagccacaatcttgtaaataccctattattttatgtaaagaaatcacctttggagccttgatcaaatgtatgcgatgaagattcagattgttgaacctgtatcaatctactgatccagggcttgatacagtttaaacatgtcggttactgaatctttaattttgggacctgacaaggtgtgtgggtgggggcctagagcggccatcccgctcccccctccccccctcgtcggccctgactacatgggccttaacaggccacatggcatcttatcatgatttctgggcttgatagtgacgaagatggacgtcatagactgtatgacgacagaaggatcatcacaatattaatgacgaaaagataagcattctttatagaacgccattagagacgcatgataggttgtcacgcccggaatttctatccaaaattccaaatgcttacatgtgtgtaaaccctcgtcctggaatcagccgaggcacacaataacaaattgataatagagcacaattattactctaattaataagcgaataaaatgtcattacagaggtagatagttcctctcaatcaataaagatctaagcagcggaaaataaaagaaacagcgcaggcgactcctctccacaggcaacttgaccaaggctacgcctaatcatccacactatcagcatcactgtagaactcctcctctgatgaatgattgcaaggtgagtatatgatatactcagcaagccacgcaacaattaagcaagtgcacaggataacaaaggatggcatagtatagtctcaattgcttaaatagcatgtaacaattatttcagaatttaataaaatagttaaataataattaaacaatattgatccaacgctatacaacataccctgttgcataggcccaaccattctgaacaaccagtcccgactgcacagttctatctccaaaccaggaattaaccattccaaaccaggagctatcaagttattaacagcatcatttagtatggtgagaggtgtgagactaatcacgaaagacattgttagacccgcccataaccgtgggcacggctattctaatagtttaaactctggccagaggtgtaccactgtacccacaaagacacaacctcaacatcatgtcaaccatgcgtcgcgatacttgacaagtacccgaatagagattgtgacaataccctctatataatacaattcaaagcagtgcaccgttcccggatcataatcacccccttataaacaaggtatggactccccagcgacccccgtgggcttatctccgccacttcatactctggtgctctactatgaaccatactatatagaaagtaaagccgttgcccacgctggcttgtggttgacacggtaaatgtttcacaaccgaaaatcgtgtgctcacaacccatcaaaaccatatgctcacaacccaccattatcaggttttagttggcaaattaattacttaaccaatcatgattaaccatcatgagctatcattaagccatcattaaataatagtgaagcataagttatcccaatagtgtgctaatgtttctaagcatggctaagcaattatgtctaatatctagctgaaccaatatataaagctcaactagttaagttataataacccaaggtatcaaggaatagagtaatcaagaacaaaagggctataacaaggcaataggttaattccacccaatgacattcgaaaataaatgcaatagttgaatagaaacaatagctttaaacgggatcaacatgctcaaagggttgtttgggatctgtgtgacttgccttgctagccttggaactcttcaaagtcttctcctgcaaattcggactctccaggaacgtcggactctaaagagaaaagagcaaaatcaccaaaacaacacataaacaagcctgaacagtacatgtggatatttttaacatgtagatctcaattttagaaaaatttagagacttgaaccaactaaatccgagctaagatgaattagttatgaattttcatagattaaatcggattaaatcatttatatagattttaattgaattatgacgcaataatgaattatttttgaaaaggaaaaagggattattgcgtcagcggactcggctcacggtggaccgggtgcacggcggtggttcacggaaacgaacggccgagatcgatctatccaaaacggaccaagatctaacggtctacgaccggtctacggtggacggcgtcgatgatatcagcagtgacgtcatcaccgacggcggctcggcctcgcgtgctcgccggcgaacgacggcgcgacggcgcgaatgaaggacacctacgggttgcgggcgacacggcgaactcaccggtgaccaaagcagcggcggaaggtcaacggacggcgacggcgacgaggaagaagcggtggtcaccttcagctcgacgacgacggcggggctccggcgatctacagcgacggcggagaggcggacgaggtcggcgacgatttgacgatcacaacggcggctttcccgagcgacgacgacgaccggaaggacggcggcgcacggctggacgaacggcggcgacggcggcgctagactacacgacgctagggctctaccggcgacaagagacttaggcgagggtggcggcgggtagaggagacaccgggggtccttttatagcggctagggggtggcggcgaaggtccacagcgaccggcggcagcgatggaaagtctagggttcggggagagagacgaatccgatttgagttcgaatccatggatttccgaacgattttagccgatgattccaaaagagaaaaggtagaggggatctcggggatcatttcccctctatcaatttcaccggatcgggaaagacacgatcgaatttggaagggcagcggcgcggctcggctagggttcggccgggcgacggcgcgaggaagacgacgagtctgacaggtgggtcccacctatcagcgggcgagggcgcgcgcgcagacggtgctcggctgcgggccgacctaggccgggagagagagaggggtttgggccgactttcggcccaaagccaaaagaggatttaaaaaacctttttcaatttaaattattcatgaaatgcaattccattgattaaaaatacttccttgcctcaaataaatcccagaaaaatctaggaactatagaattaagcgaagtatttaataaaattttatctggcccaattttatattgaaatttattatttaaaaatagatcttctcttctaggcttttaatatcaattctaataattccaattaaacaacaatttatatatttcggatttttagggtgtgacataggtgacgaatgatatttgtcacacgaacgttagatttcacaacatgacttaaaattcaattttcatgacgtaaattagcatcagctacactggtggagaaaccctttttcctcccggttcgtaacccccctttagtcccggttatccaaccgggactacgaatccgggactaaagatcgctatccttagtcctgggtgaaataacctggactaaagatcgatctaccaatttttttcttatttgcatggccctattgctgcatggtttagggtttatgttacaatacatatatatgcattatatatatctatatatatatatatatatatatatatctatatatatatatatatatatatgatggctctttcatacgcccaggtgtatgtacacccttttattaatggatgatccattagcattcaaattagctatgaaaaaaattaataatattaatttccaaatgactgcatgcatgtggcatagctgcacaccggattgggtgcagatttgaacaagattgttggcatgcatttgctttcaaatttgataacgtaccttagatatccccaccttttctagtatgcaacagtatatactgttttttaagccgcagtatatatactctttgaagtgatgagcagtactatatagtagttttttgtgtattagcagtacctaataaggagtaccttatatttttgttgtagcagtgaatacttctttttttaattagcagccgaatatacttactccagaactaatgagtatatatatactgattatgtctttttattggtacgtgcagtatatactactgcaacgagcgaatgagtacatactgttctttctcggaatgagtatatactgattttttttttggaacgagtatatatactgacttttctcggagtggtatatacttatttcttctccaatcggtatgaacagctactcggagtggtatatacttatttcttctacaatcggtatgaactgctctttggtcagtgtatatatactacattcctcattgaaggagtatatactgcttctttttttatcagtatatacatttgttattaattgagtatatactgtatgcactacttgttctgtcagtatactgcatatactaattgtcatgtttggtcggtatactgcatcgtcctcgctaaaggaggttatactgcctttttgtttgatcggtaaatactacgtatactactttttttcactcagtatataaataagtatgtaccagtatttcttagataagtcgtatatttgctatccatggaagctggatgcatatgcttttcagttgaatagaataattaatatgcttttcacgtgcaaattcagaagtatgcctgaatcactggcaaagtatcggctgttgcattatgaataaacctaaattaatgaaataccctagaagggcactgaattctgaatggacattaccagaccaaagaaaaagatcaacgcagactatcggaaactaagaacaaaacataacgggatcacccctcgatgtggctcatcgaagaatctctgcatccccgcagacatatctcggttaacatcgatgggatcacgccgaccgcacgccggagagaggtggacaagaatgtgtcttcctggattaacaccgttagctaggaatcacgggttcgatgccgacgacgatgctgttgccgcacggccacacatgctggactgttctgtcatcagcaccatctacgtccacgatacatgcatctcgcatttgcatgcaccaaacaaattcgatctgcatgcatgcattatcgatttgcaacctagaaaaagcaaatcaagaaaatcggaagaaggaaggacttgcctgcagcatagtcgatgttccagttccggacgacgctcagcgtcgtcttgatcgtagcatgggcctgcatcgatgccgtcgccgtacggccacactgacttgcccgaagatcaatggcgtcgttgtctggtcacagctcttcggccagccagtcgcctgcggatagtcatactgaaggcattggtaatggaagacgccggcgtagacatcagcagacgccgtgaccttcgaatagccgatgggtcgcgccgtcgtcgccttcgaatcgccgatcgcgataacctgcagatcgatctatcgattctgtttacaaccacccacgagattttaatacgagctattcaaaagggttctggttagtacggaataattcagattatgaggatttttttcgtaactagaaatcaaaacgggctcggtatatggatccgcttgctgatttgatcggtggtgttcgctgatggacggtggatggaaccgggagtacctactcctgggagtatagaatcattatatatatatatatatatattatatcctactaccgggagtagctactcctgcatcatctgctatacgtgctttcaagatttgtgcagctttctgctaattcgaatttgtcattagcgggttaattaacccgttaaaatatgccgatcgctattttcgtgggatacaaacttttgaatgcattatgcacgtcagatgtttgcattatctgcctgacggccgcatatatatatgatctgctcgtccacgcatgtatttcgcatctatagcatatcatcaaccacaactaaaatgaacagatgatgttctgctggcacactgcgtgtggtaattacgtactgtccaactatagccttgtgaacaagataattaaattgagcagaagatgttctgttctttctctctatatatacctattcaaagaataataaaaaaaggcagcacatattctgctacctttcatggatgggaagaagatattctttttgaatgaagcagaacatgcagttttctagtttctgctcccggttcacattctgcccattttctaggttctgcattttgaagttctggaggagcagaacgtatccatgctggtattcaattacacaatcagaacttgatatggggaccagaacaaaaatgttctgctcttgtttctgctggggccttgtcgaaactagatttcggcaatagtaaaagggggtggctatcaagctagaaaagtgtatgggtttggagacaaaggatttatacaggttcaggccttcttattcaagaagtaataccctactcctgtccggggatggatccgccgagtgtattattgattgtatgattgggagaaaatcaacctatgccccaagaggcacccggaccctccttatatatgggaaggagtccgtgttacaaaagataatctatatccctaacggaatatgcagatacaggtaaaatacagtcgtaaccgactaagtctcaaggtgtttccttgatgtacaagttaagaaacgaacccgagatacaaataagatattctatatatattcggtatcctatatccagtccaaatatcctcgccgtgtagatatgggatatccataatctccacagtagcccccgagacctttgcagtcaaccatcatagccttctcaaagataataatccgagtgcttcaaacttttcatgccaaggcctgccgagtagcgaagacgaagactgtaaagggcgaaaaaataaggaatatggtgcatcgaatagatgcacctaattaggtgtagcccccaactatgtgattagttaacaaactaaacatatagttgagaacaaaataatagcacaatcatgcatcatatgacagaagcatatgcggcgcctaaagaggcattctagccgactgctttttagtcataataaaaagaatccgagtggttaacactctaaaaggttcacgaatgaacacacttgacaggcatccgaataaaaaactctaaagattacccaccaaacattataaaaattatggtaatgaataagtctaatagcctaagctatgactatccatcataatgaaaacaggcatatgtggtgtaaaatccgagtaaataaactcataaaggatttaccaaccgcctaaggaaaaatgactataatatataatcagcctaagccataatattggtcaataaaaaatgcacacttacgtggcaaaaagcaacgatattgtatccaatcaattgcttaaaaacccaaacagcaccatgactatattaaaaagtcagcggggcagctatataaagctttactgtttgacaccttttaagatgcattgtaccaactcttaaaaagttgagtaactgcggtataaaaggattttaaggtattgagcacttgatcacgcgcactttggcctaagcgaaaagtgcctgagtccctaaaagaacgtgacaggccacacctgaaaattcgcattgtaataattccgaagaattatatgaccgcgtaaaaaaagattttatcagcattgggcaacactattgtgcgcataagttgccaaagcaaaaaatgcctaagtccctaaggagcacaatgggccacgctgttaaaagtattgggctgaggtactgttcaagcctaagcccattcgcacctccgatacccttaacaaaaaatcacgtgatccaagcgccacttcgtcttccccgccagaactctcgccattttccccacttcctgctacagtacagagctgcgccggcaaactagggttcaccattccactcgaatccaccttcgaaaagttcattaaaatccttcctgtgatccaccgcctcaattcctcacctctcccaagccatccctcgaatcaaatcagcgcattcaggtaaaatcgatggcgaaagagaaagaaagcttcgaaggccaatgggcaccatccgacgtgacggaggagaatctgaaggagatggtggcgcacggtgttctccctgccaaggagatcattgggtggcgaccagcgtgcggtgaggtttttccgtcccccgacacacatgaggttgtagttttttcccatttcttctatggcggcttcgctcttccgacctcaaaatttttccgcgggatattaaacttctatggaatcagcttgcatcacctaaacccaaattccatagtccatatcgccaatttcatccatgtttgtgaagccttcttaggaattaaaccccacttcgctctgttccgccgaatcttttttctcaagccccaaccgaacaagaataagccatgtgtagtcggaggggcaggatttcagttgaggggaaccctgagtcagaagtatttctctatgcccttcaagacctcaaacaaaggatggcatgcaaactggttttatattcagaaccctgagcctgctcttcccgagtactcttgtcttcctccggtgtaccaagatacttggaactctcttccgatcggagatgaagctgctcaagccttggagttgatggaccgcatgctaaaactcaaagaacaaggtttacaaggagagcagattactcggcatttcatcaaatgccgattggcaccaattaaagaaagatcccgcacagcattcgagtttgacggcaagcatgatcccaatcgtgaagaaccagactctctggactttaaaatcatgaaggagagaatgtataaaatcttctcaaatgctattgtcgtcagctactcacatcaactgccagttgtgccatataacgcattcaatccgcctccgcaggtatgtatctgaaatcttcaacctatgaccaaaatagtatcttgtcttcatgttgagttaactaaccatggaggcatcttattcaggaatatgtactgataaaatctgatcccccaatcactcagcgccggtctcctcgccagcacaccgttcagggaggtggaggaccaacaatcagaccagattcgcaacctcaaacctccaatccaactggacagacaggttctcgcaagagaaaactggtgccaaatgacgacgaaggcgacgagaaatctggggacaaaggctcgcctaataaactcccgaagcgtaccatgcccaggaaaaaactggctggccgtccaatgccaaagattagaacatcttctaggtataaacctcttggtaccattttatttcggcatgctcctctcatgaaaataatactgaatattgaaagaacattttgcaggaaaccatctgacatagacccaactggaaaagatcctgatccggctgccacagagccaaatttatccaaagatgctgagccgactgccgaaagccggccgattgccgaaagccagccgactgccgaaagccagccgactggtgcccatgcttcggatgacaaggcccatccgagtgaccagccgccgactggaaaccagtcggcagcaactgaaactgtaacaacccaagagcccccgactggaaaccagtcggatgtaagtctaaatcaagagattcctgaagctgaagcgcaggcgacaacttctcaaggaccaaaggctggtaatgactcgatgattgggtctccaaataaagaacaaggatcacctcacgctcagctaggaacatcctcaggtaactcatcttctcaagtgataccgatttaaataactccagtttatttgcctaatgtcttggaaatacatcaggaccaccgggcgatggcgaagaagaaattccccgcataaaggcggctgatgattctcgtcctcctatcttgctcaaatggtgggatgagaactcacaggttgccggcatcgtcataaaccgtcaaaaagaagatgaggaagtgtgccagctgaagaaggcgcttggagaaactactcgcattgtgaatgtaaatatttcaggcgactgcctttgatgactttgttttctttttagctgaactaaaccatgaaccatcatgcagagaatccatcttcgtaatgaagccaagaccgcaactttggagaagctggttcctcatttgggaactcttgaagcagttagggaccagctacacgaggccaaggagctcgccaaaaagacggaaaaagaattaagggagcaaattgctcagctccaggattcaaacttcgagctgagtggttcgtcaaaaggtaatcttctagacctgtcccattaatctatgctgtcataactatatcctcaaccatttggatttcgaacagcgcaagccaccaggatggttcaaatggagaaacaaattgaagccttgaaaaaagacaaagtagaactggctgcgcaaagggattcggccttgaaggaggttgaaggtactgccagctagcaatctggacgtctctcttttaaatgcagcagattcttatcataaatgtgttttgtagatcgtaaaatcaaatctcaagctcagtttgacgtcctggttagtaagatcaagaggcttgaaggagcaagagatgaagtcgccaatgtcgctataccactcgtccaagctatgttcctcaataacagtggtccgagtgcactcgacgcaaccgaaattttcgacaagctgagagttgctccggatgtatatttcaagaacatcaagaaagctggaagtatgggagctggcatggcattagcgatgaccaaatccttgtacccgaggattgaaattgacgccattgatggctttgcagacgggacaagcgaagaggctgctcttgatcttatcaacaatgctcaaaacgcggctgacaggattgcaagtgacgttgtagagcaattccgcaacaacgaccttcagccgagtaacaataactctgatgatgaaaggactgattctgactgagcataaatgtaacaaatggaggctcaatttgtacaatactggtgtatttatgctgtgcttgataactctagccaagtctttgatttcttaaaagcttttatcaagctctgttgagcctaaaacccaaagaagctattaaaaactttcagtcctcgcaaactaagtagaaaaatcgaacaaggcaatgaaaaaccaagtaggcaaattgaattgataaaaaatcacactctattattatgatgatagcccccgactgacaacttcgaggagaaaacttgatgttgacagtcaagacagggaagtacaatgataagcctaagcgtagaaacgacgaagatgttcaatgttccaagagttgtcgacgagagtaccgtcttcgcgcttgagtcgataggaacctggccgggtgacttcagagatgataaatggcccctcccatagaggagataacttgtgccgatcccgtgtagtttgaattttccgcaaaaccagatcgccgactaaaaaggcgcgggatcgaacattgcgattatgataacgtcgcagcccttgtaagtatcgagccgactgaatcaaagccgcttcgcggacttcttccaatcggtgcaagtcatccactcggtcctcttcgtagcgttcttcacggaaatttcgaaagcgcaaagactcgaattcaacttcactcggcaacattgcttctgccccataaacaaggaaaaaaggtgactggcctgtggcccgactgggtgtagttcgcaaagaccaaagtactgatgacagctgtttcacccatttgccggcataaggttttagccggtcaaaaacacgcactttaatcccttgaagtatcatgccattggctcgctccacctgtccattgctcatgggatgcgccactgaagcatagcaaatcttaattccaaagtcttcacaaaagtctttaaaaactccgcccgtgaattgtctgccattatcagtgatgatccgattgggcactccaaatctatgcacaatgttgatgaagaagtctcgagcgttatctgctgtgattgtgacaactggtttagcttcaatccacttggagaatttgtcgatggctacaaagaggtgcgtgtaaccaccgactgcctttttaaacgggccaaccatgtcgagcccccaaaccgcaaacggccaagacagtgggatggtctgcaacccttgagctggtagatgaatttgtctggcaaaaaattggcaaccttcgcacgtgcgcacaattttgtcggcgtcggacacggcagtaggccaaaagaaaccctgcaggtaagccttgccgacaatggtgcgtgcggcagcatggtttccgcatatcccagaatgtatgtcttttagcaattgtctcccttcctctaaagatacgcagcgttgcagaatccctgaagggcttttcttgtacaactcagcttcatgcataacataaagtttgctccgcctcgaaatccgctcggcctcatctttgtcttgggggagttcttgagaagtcaaaaatcgtatgaggggctctcgccagtcggcttcaaccataactacgtcatgaatgcccgcaacttgagtagtatctttgtgaggtaccgtcggcgtataaaggtgttcgacgaaaacatcagagggtgccgcctcgcgtttggatccaaagttggcaagtctgtcggcggcttcattattgtgtcgaagaacatgactgagctagagtccatcgaacttgtcttccaatttgcgtacctctggtcgatatgccatcatgttgtcgtcaaggcaggaccactctttcataacttggttgacgaccagctgtgaatcgcctcgaagtattagacgctttatccctagggaaattgcaattcgcagcacatgaaggagggcctcatactcggcgacgttgtgggacgccgaaaaatgtatccaaagcacatagcttaatctttctccagttggggaaatcaaaaccactcctgctccaatgcccgaaagtcgttttgacccgtcaaaatgcatggtccagtgctccatcttctccgcgggggtatcctcctggcactcggtccattcggcgacaaaatcagctaacacttgggacttgattgaaattcggggcttgaatgatatgtccaaagacatcaactccaaggcccacttagcaatacgtccgtttgcttcgcggttgtgcagtatatcaccgagtggaaatgatgtgaccaccgttaccgagtgaccttgaaagtagtgagacagcttcctggtagtaattagaataccatataacagcttctgaacctgagggtacctcgttttggagttggctaggacctcgctgacaaagtaagtcggtcgctggactttctggacatggccttcttcctcgcgctcaacgaccaagactgtgctcacaacctgggaggtggctgatacatacagcaacaacggctcctgcggatgtggtgaagctaagactggtggctcggtgaggagtttcttgaaatcttcgaaggccttctgtgcttcgggtccccactggaaatcatctgttttcttcagtagcttaaagaagggcatcccccgctcaccaagtcttgaaacaaatcggctgagcgccgccatgcatccagtcaacttctgaacatctttctgggtgcttggcggtttcatgttgaggatagcagtaactttctccgggttggcttggatgcccctatgagacaccataaaaccaagcagcttccctgacggtactccgaaggtgcacttttcagggtttaatttcatcctgaaagcgcgaatgctcgcgaaggtttcttctagatccgagatcaaatcatcctttttcttggtcttgacaactacatcatccacataggcttcaacgttgcggccgatctgcgttgagaagcatctctggatcatacgttgataagttgctcctgcgttttttagtccgaacggcatggtgacgtagcagtatgctccaaagggcgtgatgaatgaagtcttcaagcagtcggattccttcagtcggatctgatgataccccgagtagcagtccaaaaaactgagaagctcacagccggcggtcgagtcgactacctggtcaatgcgaggcaacccaaaaggatctttagggcaagatttgttgaggtcagtataatcaacacacatgcgccattgccccgttttcttccgtactagaaccgggtttgccagccagtcgggatgaaggacttctttaatgaagcctgccgctaacagcttggttaattcctccttgatcgcgtccttcctgtcttgcgcaaatcggcggagtcgttgtttgataggctgggcatcttctttgacatgtaaggagtgctcaatcacctctctaggaataccgggcatatcagatggtttccatgcaaagatatctttattgttctgaagaaaggtgatgagcgcgctttcctatttacaatctaactcggcgcctattacagcagttttagtagaatcagagggatctaggggaatctttttagtcttagcttcgctttctccgctttttgaagtcttggtagcgggcatttctccttcgctcgtcgtggctgcagccagtcggatatcctctcgggcagacgctatctcgcgggtttgggccatgtcgcaactctccttgtcgcatgtgacggcttgcttgatgtcgctccgtagggataggactcctcggggaccaggcatcttcatcatcatgtaagtgtagtgcgggacggccataaacttggctaacgccgggcgtccgagtatggcgtggtatgctgtctcgaaatcggcaacttcaaagctgatattctctgtgcggaagttttcccgagttccaaaagtgaccgggagggtgatctggccgagtggagttgcggataatcctggaattactccgtgaaaaggtgcattgctgggttttagctcggagcgaggaatctgcatatcatccaaggtcttggcgaagaggatattgagtgcactgccaccgtcgatgagggttctgcgaagcttgacattacggaccactgggtctagtaccagggggtaccgccccgggtggaccactcggtcaggatgatccgagcggtcaaacttgattgcaatctctgaccatcgaaggtactggggcgtgtcgggctgaacagcattgatctcccgttcggtcaacttttgcttccgtttagactcataagccaaggggccaccgaagatatggttgagctccttgcggtggtcttgaaatcctgccggggcgtcgccgtcgtccttcttcctcgacgtgctttgttcttcgtcggagttcttccgtgtagtcttggtgtattgatccgcgaattgcttgtagacgaaacaatctttggccacgtggttggagttaggatggtgcgggcattgggagttcatgatcttgtcgaacgtgttgacgcgcgagcgctgtcgagaagagtgactggcggttgcaacaagttccgcaggcttacgcttgcggtccttatgattgttacttccacctcctcccgtagccggcgtacccttatttggcttccaactaggacccgactgctttgatgcggtgacggcgtcttcagctttggcgtactcgttggctttttcaaacataagcttgactgtcctaggaggtttacgcccgaacttgccaaccaattcttcgtggcgaatccctttggtgaaagcggcgatgataacgtcgtcggtgatgtcggagatcttattacgttgttcagaaaatcgccggatgtaatctctgagggattctccggacttctgaataacgttgtagaggtcgtattgtgtgccgggacgctcgaaggtgccttggaagttggcgatgaagtggtcgcgtaattcggcccaagatccgattgtaccacggggtaatccatggagccaagatcgggcggaatccgctaaagccactggtagatagttcgccatggccttgctgtctcctcctgctgcgcggattgcaagaccgtagacggtaagccacgattctgggttagtggtaccgtcgtacttctctattccagtcggcttgaagccggctggccaatccactcgacgcagatcgtcggtgaaggctgctactccgtcaaggtcgtcgtcgtggcggtccggcgaatgatgatggcctcgagctgctcggcgctgtatgatcgtgtcgcgaagatcgacggggcggcgacgaggtggtgagcgaggccgttccactcggcgctccccatgatggtcgggaggtgagtgaacggaccgcccgtcgtgacccttgctcctgcgattggatcctgcgccggtgatgctgaggcttggatgacggtagtcatgagatcggaagtggggaactcggctgccagtcggcgtgtggacgctttcggagttaactgggaccgaagccgcaatcatggtcttcgtctggttcaagatgttgacgacgtgatcagattgattgagctcgttttccttgaggagggtgtcgaggagggtgatcgcggcaaccgcattctgctgaggggtgcggaaaaccggtgtcccttcaacatcttgttggccgatgagatcacgcgctcggcgccctgcttccaaagctcgctgtcgtcgatcttcagcctccttcgcggtccgctcacgctcctgctgctcacgccgtaaccgttcttgttcttgtgcttgacgctcctcctccagtcggagacgctcagcctcgcgacgtgcttcggtctcccgggcttggcgttgctcctccgtctcgttatcggccatgaagacgccgaagtagagaggggtgtagttgtcatctaggctttcgtcgaagtcgtcgagatccggttcgttgtagcgagagctaaactcgtcgtactccacgatgtctgtggggcgcgagtcgacggtgggagagctgtagtggccgtccaactgatccgtcgaaaccgtgccgagtggttggaggatgacgccgacttccctgaagctaggcgaaatcggcgttgaagccgacttccgcctaggcctacgggatgaagacgctgtcgtgatgggggcggccgccgaatcgtcggggagcttcattaggatcggtgggtaagccccatcatcttgatctggtgtcgttggggaagatgcgatttcgcccgagtggtttgaagccaactcgattgagatggtcttgaagtaactttcggccgcgtttgggagtccaaacgggaccgaaagccggttctctcccgactgggccgacaccgagtcaaggagagagatcttgccgaagttgttggtgacgaagtcgaggctgccgaaccgaaacgtctgcccgggtgggaagacgaggtcgtcgatgccggagacggaacccattgcactgatcggcgaaaagcttgacgctacccctacctggcgcgccaactgtcgaaactagatttcggcaatagtaaaagggggtggctatcaagctagaaaagtgtatgggtttggagacaaaggatttatacaggttcaggccttcttattcaagaagtaataccctactcctgtccggggatggatccgccgagtgtattattgattgtatgattgggagaaaatcaacctatgccccaagaggcacccggaccctccttatatatgggaaggagtccgtgttaaaaaagataatctatatccctaacggaatatgcagatacaggtaaaatacagtcgtaaccgactaagtctcaaggtgtttccttgatgtacaagttaagaaacgaacccgagatacaaataagatattctatatatattcggtatcctatatccagtccaaatatcctcgccgtgtagatatgggatatccataatctccacaggccttttgctctaatagtagattgaattgtttttgaaggaacagaaactattccgttacatattcataattataggaacagggagattagcttctgttgcatgcgtatacatatttatgttatgcagattagcttctaccatatttttagcctgttttttcatttgccggctagtatatatcttctgtcggccaggagcagaaaatcaattccaaaaagaacagaacatcagttagttaggagcagaaaatcaatttgaaaagagcataacatcaacaattgcatgtgctgcccgtttatatacaacatatcaccaaacagtgctcactttcaaacgaaattaataataaaaatattggtttgagagcagaacatattctgcctccttataagtagatcgagtttgttttgaaagaacagaaggtattcttctttcttcttgccaaagcttcctataagtaaacggactttgttttttgagcagaagatatatattctgctttcttgtttctagaaacagagataatttcaggtacaaaattcaaatctctttctgctccctttctaaccgatgttctgctcctttggtagtttctgctgattttcaagttttggatcaaggagcagaacttaccgatgatgagatttaattagacgaggagaagttgaatatgtactacttatctaagtacgtacacagcagaaactatacccagcagaaactcggttatgcagaatatgtactacttatctaagtacgtatagatgacatacagtatgttagtaatcaaccgacagaacatgtactgccatcaaaaacagatacggagaaaaaaattaggtggctgttctgctaatttttttaagttgatgttctgtcattctttttaattcatgctctgccattttttctgttggccggctaatatatatgttccaccggcacgagcagaagataatatgccaggacgagcgggtgcgaggaagaaactgcatccgagaagttggtttgcatgcagccgatgatttagcaactatctgaactaacaaactatttaattaaacaacacaggtattcatcgttattggatcctcgtcactccattaactgaatccgatccataataggagggagtaactactctcggtagtaggaaataggctatatatatatatatattagaaaaactattttacacccggggtatagaatagctattctatacctncctcccaccaacccaccttttctgcccccaagggcccaaaacccacctcccaccttggtcaaaggccagtcaaaggtcccctacgtcggtctattctagcccaaaccggtcggtgactttccccacgaccctctctcttcttagctctcgtctcggaatgacgtagtaacatgttgttcatcatgtagtaacacaatgttttacttacagtaacaaaattaaaattgactcataatatacttatgatggatctacttttggtaagcaattttttttgaacatcatggtgcaaacggtttttaaaaatagtacatggtgtgagagatattacccttcaaagatttgtttttgaagatttaactctccacaagtagtaatactatatcaaaagttttactactgcctgttttgcgttactgcaatcacatcatgtcattactacaagatgtagtaacgattataattttcacgtaacatagtgtcttactgtaattacttgataacgttactgcaagactataagttttgcagcaataaagcgtctaactacattttttgagtagtgttactgcataaacacgtggtaacgtgtaattgtcgtgcagtaatacttttacttttgtgcagacttttgtgcagtgacaagtgtatgattagcatctgagacttttaacccatatatttttgtttcaattcctgaattactgcaattcaccacaatattacggtcaaaagtgcaataacgtcatatacatgcagtaacgttatattggagggaggaaaccaattttcttgagaagagggaggaaaaacggttcttgaggaggggagtacgtagatgctttttgaagtttaatcctccacatgcagtaacacgataacatcatggtggaaacggttttaaaaaataatacatatcttatgacatattgcttttcaaagattgacattttgaactttagccctccacatgcagtaatagaatgtgtaatttacagtaataggggtttatacatgcagtaacatggttttaccaaatgtataaaattattcaaaacactcctacatcaatcagaccttgctcaaagccacctacaaacttacctatggcccacctattcgaacttcatctcgtaaaaatgacatagtaacactgcatttatcatgcagtaacatatctacttggaagtggtaacatgcacctattatgtagtaacgcttctacttttgtgtagtaacaagtatatggttagcatgtgaggctttaactcatatatttttatttcaattcctagtttatgtagtaatactattcaagaaaatgcaagacactttgttactgcaaagcttattgtctttactagactcttatggtaacgttgtgatagaaatgtagtaacgtacagtagtaacaagtaatgctattgtattattacttgtggagagtcaaattctaaaaagaaaagcttttaagaacaatatctctgatgtcatgtatggttttttaaaattgtttgcaccatgatgctagaaaaaaaatgcttatcaaaagtacatccatcatgactatattttaactatatttgagcgttgttactgcacgtaaaacacagtgttacgagacggtgaccgccgcgttactgcacagtttcgcgaaacgagagctaagaaaaggtgggtggtgaggggagttagtaggtgggtttgactgagctttgaccggcgggagggagctttaaccggcgtttgaccgaggttggaggtggtttttgggccttagaatggaggggaaggtgggtgtggcccttgagagcgaggtgtacaatagtcttaccctatatatattacatatatattacgcacatatatatatggaatacatatatatatatatatgcatatgtataaatacatatacatgcatgtatagtacaattcatttgctcactagctagctatgacttcgacgccggcgttatgtcaaaagaagaaagaccgacgttatgaattgtcgatccgtcgtagtagaattcaccctcgggattaaggacttcttcgttgatgaatctcatcagttgttcctgaacaactgtgatagaatctttgtgtgggagattgtccctgatgtgaatacactatcattcgaaaaataatgacatatgaatatatgaaattaataaacaacaaatcgatacgcaatgaaattttgaatggtttatatatacgtacatcgagctctcgtgtggtgtagatttgggttgataggaagtgggcatactcgcatacgtagtagccgcacaggttagttccctggtcatgctttgcacattacatgagaaaggacaagagatttaatatacacttacattaactgtaactagtaatcatatataattagcatatgcatgatttaaaattgttaaaaattctaattatcatatgtaaataccacatgcatgatttaaaaatgttaaaagttctaataatcatatataactagcatatgcaaaatttaaaattgttaaaaattctaataatcatatgtaaataccacatacatgatttaaaattgttaaaaattctaataatcatatgtaaataccacatgaatgatttaaaattcttaaaaattctaataatcatatataataagcatatgcaggagttaaaacttttaaaattctaattatcatatataactagcatatgcatgatttaaaattttaaaaattctaataatcatacataattaacatatgccgtacaacaattgatttatatggatattcaatacatccaaaatattttacatcgtgtacacaacaattacggcaatacatcggcggtgacggttgaccgcacgtacttcctcctcactattgttccttccttatgatcgctacgtgagtaaggggtgtcttcgtttgataggaggatgctagggtcaaccgtcaccgtgaaagggggttgcccatcaaactgatcataatcttcatcagtcttgtcctcaactccgatgatttttcttttgcctgggagaaccacgtggcacttcggctcatcaggccctttgcccttctttcctttgctagacatgtccttcacataaaaaacttgcgttacatcattggcaaggacaaaagattcgtccgagtatcgaaccttgttaaggtcaaccgttgtcatcccactgtcatcaatcgttacgcctccaccaatcagccaaactcattggcaccggaacagaggaaccttgagaggtccatagacaagttcccatatgtcctcgatggcaccgtaatacgtgtcagttgtaccatcgtgtcccatggcatcgatacgaacagcactgttctggttcgtgctctttatgtcttggtttctcgtgtagaatgtgtacccatttatctcatatccttggaatgttgctatcaagccagatggtcccctcgccaggtaggcaagttgttggctaatcgtctcgttacccatgagatgttgtcgcagccacacgggcaatgtatcaatgtgatgccgtgtaatccatgcatcagacttaccgatgtttctggcaggaactagagccaagtgctcctcgatgtaaggagccaccaatgaagattgttgcagaaccgtgaaatgggctttacggaataaattgttgtctaccgtcattgctgcgttccttccgagagtcccctttccccgtagtctcccttcatggcgtgattcaggcactctgattgggcgaaggtcttcgataaattctacgcagaattcaatgacctcctctgttccataccccttggcgatgcttgcctctggatgagcacggttacgaacatacttcttcaaaacgcccatgtacctctcgaaaggaaacatgttgtgtagttacacaggcccgagaataccgatctctttgacaaggtgacaaagcagatgcgtcattatattgaaaaatgaaggtggaaatattaactcaaagctgacaagacattgcaccacatcattttgaagggcttccaatctatccggatcgatgaccttctgtgaaattgcgttcatgaaagcacattgctttgttattgttgcccggacattgtctggaaggataccccgaattataactggtagcagttgtgtcatccacacgtgacagtcatgagactttaggtttgtgaacttcttctccttcgtgcttattattcgctttatattcgtgaaggacgtccaagaattcccaatagggtaactcccaaaatatatagttctttttccacatcgccgcgtgaccatcttcgctatcaataggctggctgccaggcccctttccaaacactactttaagatctttcaccatagcaaacactgtttttccactgcgatgtttaagcttcgtacggtggtccgccttatgttcaaagtgattgcctttcttccgtacagggtggtttgcagcaaggaatcgacgatgacccatgtacgcaaccttcctacagtgcttaagatacgtactttctgtttcatctatacagtgagtgcaagtcttggaccacttattagactgccccgataggttgctaggtgtaggccaatcgttgattgttacgaacagcagcgctcgtaggttaaactcctcatgtttgtcctcgtcccacacggggacactttctttcttccacaacagtttcagatcttcgaccagtggtcttaggtacacatcgatgtcgttaccaggttgcttggggccttgaataataatcagcatcattatgtacttcctcttcatgtatagccagggggaggttctagatacacatcgtaacgggccaagtgctatggccgctgctcatctctccaaaaggattaatgccatccgtacttaaaccaaaccgtatgttacgtgcgtccttaccaaagtctttaaatgttctgtcgatgtttcgccactgcgaaccatcagcggggtgtgacacagtatcccgtcctgttgatgttcctcagcgtgccaatgcatcaatctagcacttccccttgctcctgaaataacgccttagccgtagtattatagggaaataccacatcaccttaggaggaattctcttcttcgttagctgcctgtaaacttcacctggatcatctcgtctaatcttatatcgtagtgctttacaaacagggcatgcttctagattctcgtactcctcaccgtgatataggatacaatcattcggacatgcgtgaatcttctgaacttccagccctagagggcagactatcttcttagcctcgtttgttgtctcgggcaatttgtttccctccggaagaatgttcttgacgagtttcaataaatcgccaaatgccttgtcactaacattattttttgccttccattgcatgaactcgagagtggtatccaactttttgtgcccctgctcggaacctgggtacaacgacgttctgtggtcctctaacatacgcttcaatttatgggcctccttttcactttcacagtcctccttggcatcctacaacatctgaccaagatcatccgcagcgtcgttattattagcatccctgtccacctcgcccgtttgatttccttcaaatccagcgtattgagcccagtccggaatgttctcatcttccacttcatcttcttccatctcaaccccttgcttaccgtgggatgtccaacaattatagcttggcatgaaccccgactgaaacaagtggaaatgagtagtcctggatacagaatacttcttctagttcttacacttattgcatggacaaccaataaaacccttatgcttgttagcttcggccactctcaaaaaataatgcaccccgtcgataaactatttggaccaccggtcagcgtacatccattgccgatccacctacatgtaatgaaaaaaagtcatacataaataaatattcataaaataatgacagtcatacaataatgatcaaataattaaaaactctttcaatagtcatacaataatgacatatcattattcatacaataattataaaataatccaacaaacaattcttatttattatttttgaatttttaaactaatattaatgttgtacttcttttaattttcaatttagtttgttttctattttccatgattaattttcattatattttaaactatgagaataaaacttttttaagtaaacaaacaaaattcctatatattattcttccccacacaatttgtttctctcatcaacttacaacaaagttttggagacaaaaaatgtgtgaaacatagctccaaaagtaatataacaacaaaaaacattggaggatgaagttactaaccttttagatacctccgatttgtatataatcaccaaaaaaattcacaagaaattttggcatgacctcccctcttttttggagaaaatttgaagcttgctcgggctggaggaggaagaagacacatataaagagggagataattagtcccggatgatgttatcatccagggctaaaaatcgccgagatctttagtccccgggggcctgacaaggcctaacatctttagaaccgagactaaagatgatcttaccaactgggattaaagatcatatatgcccgctgtagccaccaaccgggactaaagatgatctttagtcccggtttttagtggaaccgggaatattgtgaatttcggctgaccgaccaaagatggtttctccaccagtgctatgataagatctcttgtagtgacggcttgtttggttattagagaggcagtttgagacatacggcatacagtttcatactgtgtgcgtgccaagttggcaattggatcctagtagcagcaaattttgaaacactcaacccaacccaatccttcttctcttaatcttctcttcctactcttgtgtttgtgtgtgtgtgtgtaagaggctagtagagttagctagcctaaatttttttgcacgttgcagctactagctgtgctgctggcttgtcgtcctctgcttgaactttaaagagagagctaatagatcggtgatccgcttgggtttctggtgatcatatgcaacatggactagctacttggatttgttcaaaggatctgcttcttggatgctgtctgggcacgtcgccatgcatgcgaattttgcggatggagtcaaaagctgcatgcacggagctgatttaattaagggcatgttcagattgtagtcaaaataaaccttaccaagtttttggcaatgccaaaattttggcaggatttcttatgtattaaccaaatttggcaacaactaaacgtagatatttttttggtaactttggcaaaaaatgatttggttgaaaatgacatcaaagtgaacaggccctaattaacttgttgacagctactccctccattccaaaatataaggcataaccacccttaactcaaagatcaagaaataattattatcatcttatagtttgaatcatgctaataaatataatgcatgcatccaataggattagataacatgagagtaaaggatttaaaaaagtaataacttaatgaagaagatgtcatagttaattgcatgcttgcatacatgccttatattatggaacatctaagaaaagtggttgtgccttatattatggaatagagggagtagtacctaattaagcatgtgtgttaatttattattaactagtaatctgcccgtgctaacgctgcggcgacatttagaaatacaaattaagatcgatggatatagctattatgttgttaattaaattgccacatgcataaaataacatagttattatcctggttcaaatggagtcattagtgacaacataccatggtaaaagcaaaagtaattaaactttggaacttggcaccttgaagcatcaaatccttgtctaccttgctgtctccctgtcaccccggccccacttaattctaaattaaatggatgagagaaagagattaatatagtttagtgtgatagtgccaacacatggaaaatttagagcttctagttctgtccttctacatctctcttaaatgtgggaccaagtccttatggggcccactaatcatacaaccatagccaacacatcatctgctcttctctcatttaaatcttcttttatttctcaaaaggtgagagaagggtttaaattgaatttccacccaaaatgccactctaccactccaagccttctaggaaacatctatatatgggcctatttgtcgtccaaatacctgcaaacaaccttggtgaatcatctctttatcctaaattatattttcaaagagagaaagagagagagggccaatttacacccaaacttcaccatacctctcatcttctcataggaaacatctacatggggccactagacagccactcatacttggttgagtgaagtacgagtgggatcacagcctcaaaccattgccaactcctttaaatcgtctctacccctcatgttgacaactagctctcactttccacctttacttttaccattcactactgcaaccaagatttttgtgtgagggctaaaacgatttttctgagcgggtaggcggcccgcacgcacctaggggtctgggaaaataatgatttttgcgtgcgggtggtgcacccccacgggaaaacaaaaatccgaaataacatatttttttttaaaaaaaatgaaaccctagaatctggcggtgggcttccgcccgacggccatagtgccgcctgcctcccgccggcctccccgccacccgccgtcggatccgcgctcccctccggccgcaacgccgccgtcgcccctcccctccgccggatctagggagggaaggaaggggagaggaggggagctggatcccacgtggggagaaggaggctggctaccggatccgtgcggggacggctgccaccgcaggattcttgcattgacggccaccgccgccggatccacgccctccaccgccgccacgtggaggaggccggcacgctcctactcccaccgccgccgcgccgctgctgtcgccgcgcgccgccgccgctgacgtcgtcggcgttcccggtgtccagagtgccaccatcgccccactttgccattccagtcgactcgaatcatctcctgctgtaccattgcgccactgacgtcgccttggtccctggagaacgacgcccacatatgatcaagccaatacgccgccacgaacgctgtcggtcgccgttgctctcctgctgcctctgcttctcttgccgccgagtcaccgacatgtgggcccggttgtttagccacttcattaggtgctaaggactttaattagtagaaattgaaatcttgtaatgttctttttgtaaaattgctttgtttgccatgtgggcttatggacctaaatgcaattcaactaatgcctagggacctttttgtatagggtttagggtttaccaactcgacccgaacaaagcctaatcctcctgatcatcaccttcactgaagcactcctcctctgaagaatgaatattgcaagaatgagcatatgacatactcaacaagccacacagcaaatatgcaagtgcacaggataacaaaggatggcataattaagctcatttgcataaacagcatttaataaacatttgagagaatagtaaaacagttaagtaattaagcaatattaaataaacactatacaacacacccattttgcataggcccaaccttatctgaacaaccaacccctgattgtacaaatcaaacctccaaaccaggaatataccattccaaaccaggagtcaatttagttatcacagtattttcattaatagtgagtaatgtgagactaatcacgaaaaatattgttagacccacccataaccgcgggcacggctattcgaatagttttacactgatcagagatgtaccactgtacccacaagacacaactccacaacatgtcaccatgcgcctcagtaccaccacggtaccttggaaaagaactgtgacaatacctctcacacaacacaactcaccacagtgcactgttccgggatcatagtctccccctcataaccagaggcaatggagtccccagcgacccccacggacttctcgctgcttcacagtctggcacccccgtaatgaatcatgctatacaaaaggtaaagccgttgctcacgctggcttgtcgttggcacggtaaatgtttcacaacagtagctcgtgaaccggtccttaattgttatgagcacgaccatcaaaacgatgtactcacaacccacctttcatcaggtttatgtatcaattaattatcataacacgattaaccatcgtaagctaccactaaatataaccataagtaatatcgtaatatgattaaccccattggtgagctaatgtttctaagcatggctaagcaattatacctatatagcacttagctgaaccaaaccaatacataaggtccaagctattcaatttattacccataggaaaataaagtcattgtcggccattaattaactgggaatggctcaccacccgacgacattcgaaaataatgcataagttgaaatgaaacattagctttaaacctgttcaacatgctaaaagcattgtttgggatctgtgtgacttgccttgagcttcttcaaacacttctgaaccttcctcaacgtaaacgctctcctccggaacatcggaaactaaagcaaataaacaaaatcaacaaaacagtacaaaaacaagcataaacagtacatgtggatatttttaacatgcagatcttgattttagatgaatttagcaacttgaaccactcgaatccgagttacgatgatttagttatgaatttccgaagtttaatcgatttgcaactaatagaaaaaactaataaaaaggatttatgacgtcatcgatgacatcatcgctggccatggcacggctccacgcgaccactggcgaagaggacacctacacgaagaggacgatgacacgaactcaccggtgcaagaaactacgccggacgacgacgtacggcgaccggctatgaggaccaacggcggcgcggctcgactcgacgacggcggcggcgttccagcggcttgcgacgacggcgaaggggcgaccgaggtactcctccaccgtgcgaacccggcggcagcgacggacagcgacgacggcgatgctagcggcggcgcggcgcgactggagagtcgccggcgactacggcggcttgagctacgcggcgatggcgctacgagcaacggcgggactcgggacttggggcaaacggaagaggacgattaggggatgctttatataggcttggattagagagattggactccaaccgagaggaatggagccgggaaaaactagggttagttaggagagataaactcaaaacgaattcgatttggtttatccgggcaaaattgatctccgaaactctaggggaaagggagaggataaggaggagatgatttcccctcaagcaatcggactcgggggcgaccggttgaggaggaatcggaggagaggcggcggtgctcgggctcggctcggcccagccggaggtaggggatgaccccgacatgtgggccccacatgtcggcggctagaggagaggagggacggctgggcttggattgggccggcgtggctgcacggccacgcgcgagggagagggatgttgcgccggaaacggcccaacggcctaggggaggattttaaagactttttcaattaaaataattcgtgaaatgatgtttcatttattaaaaatacttcccttgctcaaataattcccagaaaaatctagaaaaatagataaacaagcaaagtatttaataaaattttatctagctcaattttatgttgaaatttttcctagattattagagtttaacttgtaggtttttaaaataatttcaaaaaatgcattaaaaattgaattattaaattaggcgattttcagggcgtgacaaacctaccccccttaaacggaatctcgtcctcgagattcagaagaactggcaaaaagatgaggatgagctgacttcaattcatcctcccgctcccaagtggcttcttcttctgaatgattgctccactaaaacatacagaaccgtatgacgcgattctgggtgtttctctcactcacctccaaaattctgactggcttctcaacataagttaaatcttcttgaatctctaaacgctcaggatctgcttcctcggtaggtacactcaaacatttctttaactgcgacacatggaaaacgatcatgtattccctccattgacagaggcaactctagttgataagctacttcacttcttcgactcacaatcttaaaaggtcccacaaaacgcggtgccaatttctctttggtctgaaaacgatgaactccccgcagcggcgtaacccgtaggtatacataatccccttcttcgaaagtcaaatccctacaacgattgtctgcatagctcttctgacgtgactgagcaactcgcaacctttcttggataatcttcactttttcttctgcctctcgcaatacatctatcccaaaaacttgacgctcaccaatttgatcccaaaggagcggtgtacgacacttacgaccatacaatgctttgtatggagccatttgaagactagcttgataactgttgttatacgagaattcagcatacgacagattcttatcccaacttccaccgatatctagaacacaggctctcaacatgtctcctagaatttaatttactctttctgtctgaccgtcagtttgagggtgataggcagtactgaaattcaaacgagtacccatcccttcttgtaagttctgccaaaacttcgaagtaaactgactacctctgtctgacactattttcttgggaacgccatgtaaacatacaactcttgccatatatagctctgcgagcttatttcccgtgtaggttgttttgacgggtatgaaatgagcaactttagtacgcctgtcaaccactacccaaatagaatcatgtcctgccgacgttctgggtagaccggtgataaaatccattcctatttcctcccatttccactctggaatcttcaacggttgcagcagaccggctggcttctgatgctccgccttgactcattgacacacatcgcatagagccacatattctgctatctctcgtcgcatgctggcccaccagaattgttgcttcaggtcttgatacatcttagtgctcccgggatgaatggaatacaaagtttcatgggcttctttcatgatagtatcctttagctccttattatcgggcacgcaaattctttctcctagccacacagttccttgctcatcctctatataaccgatggctttacctcttctcatgttctttttgatttcttggatatcaggatcattcacttgagcctctctaacttgatcaaaaagagtaggctgagcttctaaagcggcaacaaaacctttgttgactattcccaagttcaacttttcaaattcctcgcataactcccaaggtaggtgtcgaccttctgacatattacagtagcttttcttgctgagagcatctgctacaacatttgctttacctagatgataatccttgatcaactctaaccaccgtcgttgacgcatgttcagatcaggttgagtgaaaatgtacttcaaacttttgtgatccatatacatctccgtacggttaccaaaaaggtaatgacgccaaatcttcaatgcatgaaccacagctgccaactctaggtcatgcgttggatagttattctcgtgggggcgtaactgtctaggcgcataggcaatcaccttcccatcttgcatcaaaacacaacccaaaccatgtctagaagcatcacaatacacctgaaaacctttccttggatcaggcaagactaacactggcgcagtcactagccttttcttcaattcttggaaactttgttcacactcttccgttcacttatacttcacatccttctaaagcagtcgagtcattggtctagcaatctttgagaagttctcaataaacctgcggtagtaccccgcaagaccaagaaaactacgaatctctaaaaccgtcttgggttgcttccaatttagcactgactccacattgcttggatccacggcaactcctccagctgagatgacatgaccaaggaacttcacttcgggcaaccaaaattcgcatttactaaacttggcgtagagctgatgctcatgtagtttctctaaagcaagacgaagatgctcttcatgctcttctttattcttggagtagataaggatatcatcaataaacaccatgacaaacttatccagatattccataaacactttgttcatcaagttcatgaaaaaggccggggcattagtgagtccaaacgacataacggtacactcgagcaaaccataccatgttgtaaaagcagtcttaggtatatcctcctcactgatgaggtncttgcagtaganggcgaatcactcaaggcct

SEQ ID NO: 82847 - DNA, 5507 bp, Oryza sativa
aggccgaagtcggcgatcttggcgcggaaggccgggtcgagcaggatgttgctggacttgacgtcgcggtgcatgatcggctgcgcgcactcgtggtgcatgtagctgagccccctcgccgcgtcgatggcgatgcagagccgcgtcggccactggagcggcgccgtcggcgcgccgccgtcgtcgcggcggtgcagccaccggtcgaggctgccgttctccatgtactcgtagacgagcagcttggtgtcgtcgccggagatgcagcagaggaggtcgatgatgttgatgtggcttacctccccgaggatcctcacctcggcgtcgaactccttgtcgctcttcgcgtccgacttggccgccgtccgccatagccgcttcaccgccaccaccatgccgtcgctgcccttgccgccgatgttgatgcggtacaccttgccggagccgccgctaccgatcacgttctcctcgtggagattgccgagcacgtcgcattcggagaagtgcagggtacggaacggcgtcatcttccacccggcgaggtcttgctgacgcttctggtgtcggatgatcagcaaccagatggcgacggcgccgatgaacacgacgccggtgagcaccgagaagacgatgatcaggttcgtcgacgatttgttgtggctttggtgggggcaagccggaaggttcatgttcgtgttcaccgtggcacagaggccatggttgccgaggaagctacgatcgtaggcgccgttttgcagcgtctccgggacctcgccggagagctggttagaagaaaggttgagaaagttgagatggagattgctgaaatcttgaggtatgtcgccggtgagcccgttgtcggagaggtcaagaatgtagaggcccatccacccgactgcggcagggatctcaccggaaatctggtttctgctaaggttgagggaggtcagacttgtcaatgatttgatagacggcggaatcgagccggataactggttgccggcgaggttcaactcggtgaggttggcaagcctagacatgtcagctggcagttcaccggagaactggttgttctccgccgtgaaactcttcagaccgacggcggtcgacgggagggcaccggagaagcgattgttctccatctcaatcctcgagatgttaaatgatatctcactgggtagagtgccggtgaagttgttgttgtaaatcatgacattggtgagcaactcgaatgaccatatcttcttgggaaagtccccaacaaagtggttgttgtatgccatgatgttgttgatggttttgcaatccccaaggttcgtcgggaacacgccggagaagctattgttgaacaccacaatgtcaaagagcttcttattgaagcaaagtgtatccggtagctcaccagagaggttgttgttggacacctcaaaattccccaattctgaatgttttccaagctccgcgggtaggggcccagagagcttgttattgaagagacggatgtcggtgaggtccggcatcataccaacaccagccgggatgggtccagtgagattgttgtagtacaaatatagtaatctcaacttcttcaagtttgcaatgtcctctggtattgatccagagaacttgttcatggacaggtcaagctcctgcaggttgagagctgtgatgttaggaccaatctcgccactcaaattgcttgcatagagatatagattctcgagcttctggtgcttcaatacccactcggggatttgtccctgcatcttattttgtgacaagtccaacaatgtgagctccatcaatgacgacagatcatcagggatggtcccagtaaggttcatccatgacagccacagcattttcagctttgtcagcttgccaaactcctttgggactggacccggctcgaatgggttggatgccaacgtcagcgtctcaagctccacaaggcctccaatggcggcacccgggtaattcccattgaatctattagtgtcaaggaccaatgacttgagcttcgagaaccttgcaatagccgacggcacatcgccggtgaaagcattgctggacaggttgaggtgttgcatccccaacgatagcctgtcaatgcggtccggaagtctgccggataattgattgttggataggtcaaggaactccaaagctgagcaaccgtagagcaccgtggggaaatcaccggtgagattgttgcaagagaggtctatgtaggtcagattcttgaggctacaaacggaggctgggattggtctggctatatggagacttggcaaggagaggccagtgacctgacctgtgctgctactgataacaccagtccagttgccggtgctgctccatgaactgagtggagctgggttgtcccaatcttgcttgattgctaggagtagtttttgctcgtcggcgctgggctgcgcagtcgatagagagaagagcaatagtagtagaaagaggatgaggatgttgtagacagccattttttgcgagtgtggtgtgttcttggatgttcagacatggcgtcggagtgatcttaagtagaaattaaggcagagagagaaccaccatcgaagtgcgtcactacctcaggtcaagtcttcggtatagcttccttagcaccaatcctctagtgattgaaagatgctctgatagagacatgtgagttgtcagttgagcactatgctatcctctttcatccaacttgaatgtatttaagattagaagcatgaaaaggatgatcaccttctggtgtagtacaagacaattacttggaatatgttccgtttgatatatatgcgattatatatcactatgatacggcactcgaaagcaaggacatgcagtgagaatggaattgccgtttcctagtcgaaatgttcttattctgttctgtcgaaagtttttttatgctttacatacatatgttgttctgtcttttcggcagaaatgggggggggggggggcgagattgtatctactaccgtctcttgtagctgaagaaactcgtgtgattctcgatcgcccatatctgaaactctgaataattggtgcaggttcagagagttcaggacttcaggtatattcgccgcactctgtttctgaattcagtttcgtttcgttgtgcactgtttcttttgccacgtacgtgtgtaaatcatggaattctcacaagatgttattaatcgggacaaaaactaagctctctccaatggagtggtgtcatcgatttttattgatattacgtatggagaagggaaggtatctcacgctcatgatggattttatgttctaacatcaataatttgccacagtagcatactactataaatccggtttttccaaatgtccaattgtggagattatgagtatcccatacccacacgatatggttttccgactgattataggggataacttatatctatggaatatgtaacggatcatgacttgggtattacgtttccctgtttattatggaatagcctaaagtcctggtttgataaaattataaagtagatttaggaaaccgataccgtattggttaaggtttctatcttgtaatcctgccccccatcctatataaggtgggcaggaggccctctagggggcatgagcacatatgatggtcagatctatactacacccggcggattcaaatccccaaacatgattagggtattacctctctaaatccttgtctccgcatccatccacttttaggtctcgtgcgctaccccttttattattgccgaattcatgtttcgacaccaatcctagtttttgcaggcggcaaagcgatcatcacgtaccaaatggtctgtaaaaattgatatcgccgccggagcccgccgcctagagagaggagaggggagaggaggagtaggagaggtcagaggagatagccgggcatagagagtgtgggtgatgggagagagagaggagtggagaataaataaaatagagtgagctatttttgcgtgcgggtgagttaagagccctgcatgtaaacataccttatttttgtgtgcggatattttaagtggtccgtctgaaaaatttgaattttgcgtatagatctcttaaagagccgtatgagaaaatgagggtcgatttttgcagacacggacactaatggtccatctataacctattggggtgttcgtctagaaaaatcattttttaagaagtggcaagcataacccccaatgcaaaaacttttaccagatttgtagataacacctatacgacaatctatcatttcgaaaaattccaacacaaaacagtaacaaacctttgtcttctctaaagaaaaacaaacacaaccctcttatgtgtttcaaaaattacggaacaaatcacacgacaatatctcctaaactctcaagatgacattctctcgttgtttagaagtcaactaaatagttatgaaaatttttttaaaaaaaattaacaagactgattattatgataaatcactctacaaatatacaagttaaaatttaacttctacaagttccaacagaaaaaacaaattaaactatgactagttaacgtatattcgtaattaatttttttattgcagaagttaaatttgaccatgtttatgaagtggtttatcatatattaatctatcttgttgaatttttttaaaaaaaatcataactaattgggtaacatgcaaacaccgagagaaaatcctgtcaagagtttaaaatagttttgcaatctctatcctttctatacgcaagctatctttgcgacgaatattagccatttagcattatcaaattttagtagggcagagaaccggaagttcgagatattcgcacgtctgcttcagctggttgtggacaaagaggtgactccgtgactccccgtcgtccgcttgtcctattgaagtattgatgatagagcttgatgactgatgagtgaacgacatcggctgaactcgcagaagaattctctaacgccgacgatccagtcataatcagtgcggaaacttgaagctttctgctcttataacccactgtcgatctggccatttgtacaaacgaagggacgggtgtgtaaagttttggcattgtcacatcaggtattatgtaggatgtcgcatgagatgtttgggcactaataaaaaaactactccctccgtattttaatgtatgacaccgttgactttataaccaagatttgaccactcgtcttattcataatttttatgcaaatataaaaatacttatgtcatgcttaaagaacatttaatgataaatcaagtcacaataaaataaattataattacataaatttttttaataagacgaaagatcaaacgtttgtcaaaaagtcaacggcgtcatacatataatatggagggagtaattacagaatccgccagtaaaccacgagacgaatttattaaggctaattaatctattattagtaaatgtttattgtagcactacattgtcaaatctagagcaattaggctt

SEQ ID NO: 82848 - DNA, 16444 bp, Oryza sativa
caaagatctgggcacgtacgcccgggacgagctcggaaaggcaaaatctgatcaaagccatccagcccagccagcgacgcccacatcttcgcggatcgttacatggcgacaacgagtggtggctggctcgcagccggcatacgcgccaaaaaagaggcgttatttttgcgcgcggtacacgacgcccctctgcgtccccgtcgcaccaggctaaagacagcttttactctgccgcgtgggcgtcgacgaaacatatgcgaaaataacacaccgcccctgcgtccgcttcgcgcgcgagcgaccacgggtttcgtcccccgccctccttcgtcctctcgcgctactacgagattatttctagaaaccaacaaggcgctgagctgattagtggttaactagcgtcgttttgctccggaaaagcaaactcgtggcctcgaccgcgttgctctccatggacatttgcctcggccacgggggccaggagcaaggcaacaaggaaaaagtacagcgtctcgcgacaaaaacggtgggaagcggaggttacttgtttttatttacgccgaatcggtgggccaataacagcttcccgccggccgggcgggctggctggctggctacaaatacaacaaggcctcgtggcagcataggcatgcatggtccatctcgacgcacacgcatgcaacaaaagaaaaaacgcaaccaccaccgcctcaccgaggcaggcaacaatgccaaaacttgtccagccttccagcagtacttcagtagcaccactccaaaatcaaatgcatgcatggctgcctggaccaatctcggccgttggctaggccaccatgctctccatgcccgttggtcaccaccggtcaagacaaacatactgttacttgcaatcttgcattctagcttgttgccgctggtactgatcatgcatggacccctcgcccaaaatagagaaaagaaacactcggtgcttctcaatcggttatataaaatatatgccaccacttgttcgccaaggtgcattttccatgtacgcctatggcttagctagccgatgcatggcgcacatactgcatgcgttcttggctactaaacccaacttgcaaagaaaaaaggcctagatttcctcactccgaacatggcgtgtcgctttgcacctatatccccgggtgaggcatccacatatacgcagatccattactattgatggtgtgtatctgaccccaaaagcagctagtaggttgggtgaggctacttgatttggagagcatcgaagcagaaatgattagatcgttgcctcatcgagtaagtctagaagcgaaaccacgcatctggtgaccagcgagggagtccccagttttccaaacacctggttttaaagcgtactagtcgtacatgcttctctggagatttctcacaacttgatcacacaacttcgcaagtgtgtggcagtttttaattgtcctgcatttagctggggcggcagatgcagagtaacctagctcgaagagtttacctttgcttattttgaaaagatcccaagaactattataattttactactagctaggtgtgtctaaaatagctttttaaagtgggcaaaacgaatatgactaatggcctttgccgaccaaaactcaatccccagtatatggattattgtttgacagatcgttttgcagtgtacaattaagtccactatttctttatttgacagatcttacttctatctttactattataaaaattaaagatatttttgccggtattttggtacgtcatccgtgtatgagtcggtttttaagttcgtttgcttttgaaaatacatatccatatttgagtcggtttttaagatcgtttacttttggatatgtttaaaaaaactcgcatgctaacttagatgattggattcctaactgtagctcatgattttcttaaaaatatatatatctaagcgaactcacacagtgaatttcatcttaactaaaccatataacaataataaaattaaaatagactccacccgttacaacgtacggatatttttttctagtataaacaggtttaagcaaaaccttgtatttatctgtcgagtcagcaaattcatcattttgatttcgcaaaaggttgttttctatgttcacaaaagtacagatgacatggcaaacaaattaaggctgcgttctttccgcaagtttcccaaccccttttcctcgttttccacgtgcacgcttttcaaactgctaaatggtgtgtttttttgcaaaaagtttctatacgaaagttgctttaaaaaaacaaattaatctatttttgaaaaaaaaattaactaatacttaattaatcacacgctaatggaccgctccgttttccgtgcggtggagttgggttcccaaccccaactatcaaacacagcctaaggatgagagtatgcaggaagcgaagacattgacattgctaatttatcaaattattttttatcatgtttattaaatagctgtgaagcaatgagataaggaacgctgctaataaaaccagttgactttgcacagtacttcttccgtcaaaaaatatagacatttttaagattgacacggatattaataaagtatatgagaatgattggagaaagtatgtggttggctgaacagagaaagtgcgtaaaaaagaatggttgtgattagttgagaggatgaagtaggtgaagaaatagctttattttgggacaagatactgttttagaaataactatattttgaacggaagtagtagcttgttagacacatttgttatacaaacagtatggagggtagacttcatttgtttgtatatatatatacgttgtcaacgcataaaagaaacttgagtgtgagttgaccagagggtccagaagtactatgtgggataggcgattgaactttgaagggggaataatataagattaacatctcgagagaatatcatctcgtttgttcatacactattcaaatagttaaaaaatgacaagatttatacaacattcatatacaatttcacaaaatcttatctaaactcaactcatatattcacatagggatttgtcaattttttaattatacattggatttgtctttgttttaattatttctcaaagtgtggatcaagttttaacttactgtgtttcatattataagactttctagtattgtccatattcatatagatgttaattaatctagacacatactggatatgtgtctagattaattaacatctatatgaatgtgagtaatgctagaaagtcttataatataaaacggaggaagtaatagatttagatttttggtgcagtgataaatgtcactggatttttccctaaaacattttgtgatcatttatgttgaatttgattgaaaaaagggatatccttgagagattaaaatcaattcctctatttaaggtgtcctagagctcaatgttcaaatcggagaagaaaatcagaaccatagaatatacctatttccctgacaagtttttaaaatttaagcgtaaagaatgagagtcaaacacaaataaaatgggctaacgaaatctcgcgcaggcactactattgccggccatagcgaaaaaaatatcacgcagggcggcattatcatgcatagcttaataagaaacgaaagaaaaaaacatatctgtacgaccatgtgattcctgtttttttttccctcatggcatatcttgatttggaattttgtcatagacttcagaaaaatgttttatcagtacagaatctggacgagttctcgtaaaactgaaatcaataccttagcaataagatttactactaactctgaccagtggtactaaataagataatcaatgccacttactgtagctataaaggagaaggtatgtaactgagtgcacccacaatagttatctataggctctttacaatagatccatgtcaacatattttcctacttggaagagattaaatgaagagagagagcaaagctatctactaacctggagaaagtctatagagaaaaacgaggcaatggattagagagctatagatacccatgtagacataccattgaagtggtttactattaatctagtctattactgagatgtaaatgttttatagatagcaacttactttaccattgcgggtgctctgaagccaaaaggtacttgtgccaacatgtttgtcttggataaactaaaatatgtccttcgaaaagaataaaacaaaacaatattaaaggtataagtacatcgtgtatgttttatatagtaaatctaaataagagctgttgttgaacgcgcaggtacacgaattagcgaaaaggaaatggagataatacgcatgggcggctctggcagatagatacagcagcaaggacaagaaaccaattcaagaagtgtcaaaagcaaagtgctgcgcctatgcgcgctatgagaggaaaaaaggccgggagcagagcactcctcgcctatataaagagaggctcaggcttcccatcccctcgcgcggctcagagcacacagctccaccaacctcacacggcctcaggcctcagcctccaaaggggagacaggagagaaagctaacgcttctctctctctctcggttaattgcctgtctgcgtgggagttacctccacacagcgccgtaaaagcttcgagcgaaaccccacgcacgtacgcaggcacgcacacgcgcgccggcgggcgggagaagaccagagtgttcttctgtttcagctatgacgacctgcgcggatgaccagacgggctgcgccttcttcgcccccttgctgtcctccaagggggcggaggtcgtcatcttggtggccggcgatgaggcggaggagcagcagccggcgccggtgctgacgagcaagccgccgggtcggctcgccaaggcggtgaacgaagcctggtccgtttctttgggcgtcgcgttcccggtgacgccgtccatgttcacctgctcggcacggggcgaggcgcggtccattcttggcctcgcattcccgatgatactgacgggtttgctgctctatctccggtcgatgatctcgatgctattccttggtcacctcggcgggctggccctcgccggcgggtccctcgccatcggattcgccaatattaccggctactctgtcctctccggcctcgccatgggcatggagccgatatgcggtcaggccttcggcgcgggcaattacgcgctcctgggcgtcaccatgcagcggacggtgctcctcctcatcgcggccgccatccccataggtggcctgtgggtgcagatgcggcctctcctcctcttctgtggccaggacgccgccatcgcggcggtcgccgagacctacattttcgcgtctctccctgacctcgtgctccaggcattcctccacccggtgaggatatacctcaggacgcaatccatcaacctgcccctcaccgtgtgcgccggcctggccattgccatccacctccccatcaactacgttctcgtagtcgtcctcggcctcggcgtaaaggcggtcgcattggcgtccgtgctggccaacttgaacctcgtgctcttcctcctcgcctacatcttcttgaaaggcgtccacaagcgcaccggcggtttccttctgtccgccgagagcttccgtggctggggcgagctcatcagcctcgcgctgccgagctgcgtgagcgtctgcctcgagtggtggtggtacgagatcatgatcctgctgtgcggcctgctgctgaacccgcaggcgacggtggcgtccatgggcatactgatccagaccacgtcgctcatatacatcttcccttcgtcgctcagcttcggcgtgtccacccgcgtgagcaacgagctaggcgcggggcagcccgaggaggcgagccgcgcagccacggtggggctcgtgctcggcttcgggttcggcgccttcgcctccgcgttcgcgttcctcgtgcgcaacgtgtgggcgagcatgttcacggccgacccggccatcgtcgcgctcaccgcgtccgtgctgcccatcctgggcttgtgcgagctcggcaactgcccgcagacgacggggtgcggggtgctgcgcggcagcgcgcggcccaaggacgccgcgagcatcaacctccgctccttctacctcgtcgggacgcccgtggcgctcgtcatggcattctggttccacttggacttcaggggcctctggttcggtctgctcgctgcgcaggccacctgcacggtgcgcatgctgctggtcatcggccggacggattgggcggccgaggccaagcggtccaagcagctcaccggagcgggcgccgccaacatggagagtgacgacagagttgccgcggacgagaagtcgcgcttacccgtcgatacggacgtggagcgatcgagcgatcacactgatcggtgttgaactgctgacagcaacagcgcgagccgcatgcgtattgtagtaatctagcctctctttttttctttttcttttttaccatttttatttcctccctctttccaaatttcggcgggggaggaatcagatgctgacagagcgacaattttgttctcggatgctaattagcaatgtaaagattatgctgattgtttattagtagcatagagttggagaatatgagataccaaggaaaaagattaattttgactcttttcacaatggaggagcaaactgttcacggcttcgctttctcttgctccgggtcggtgtctggtccagggaggccggccgcgtgacgactcggtcagcggcacgggccaaccagtggtagcaccgggtctcagctctaaagtcgcgtggcgcgtggctttggacaaaccgtcgggacccgccattttttagcctcgtagccgtcgggccgtcaagttgacactcgcggctttaacttctggtagccggtaccttttcggatacaactgtgctatggaaatcggactatcgcacgttcttgtaacaaagggccggctgacttgtaaagcacacctaattgctatcgattagaattctagaccatgattagctctggttttctttgcttttggggttaggacccgcatgcttgtgtattgagaaaattctgtaggataagcgtggaatagtccatcctataaattacaaaatgcaaacccatgtctcaaagagctgtaggataagcgtgaaatagtccatcctataaactacaaaatgcaaaacccatgtctcgaagagccctgctccggccggcatcgcgggcaagcgagccccacgttgaggcgtggttgggcttgagcgagcttcccgtgcgcgcggctcgcgcacaggcctggatccctgtgttctggctcagctcagcacccacgcgcgtgcgcgcgacggatggcgtttggcaccggcatcgccgcaccgcgcgttaaaaaacgacccgctcctccgctctcgctcgctcagccccaactcggccactcctttttttttttttggaaacctgccactccttggagttcctagaagatggcactgtttggaggcaccaaaaggcatcgtcaagctgtcaggcctgcttatatatgcactgctagtacggagtactataaactagtactcgtaataccgaacgtttggataaagtacagctcatcttcacaaagatgttggagttcggatcgaatgcccgagctgcacaatgcgctgcatagatcggagaccgaccgatgactagatgagcacctgttgtgccaacggataacatggttatgtgtctgttgtatgtgctccccgcccaatcacacctgctgctgacgtggaagggaatcgtactcatttggagtcaaaaccgttgtttacctccaccgatcgaagaatctgaggtggagtggcagcctggcttgctcaatcgaccaatgggactgtatacacgcttgaatgcttgatcctttgagagtcaatgattgttcccggtcgcttggattggatcattccaatttaaacaagttatgttccctggttcttgggcgagctcgagaggtgtctccaccgaagtagaaatcgcgtttactttcctacgcgatcagctcacggctcatcagtgatcgcaatacatgcatgatgcacacgtcccattgggctgagatcgcattttaattaggccccctttaaactgtgaccgatagtataggtcgcatggcaaaccgtttgaaagggcatgtacctattaaaggctaagttcctattaaaaaaagctacatatatccaaatggatatagaggccgggtaaaaaaatattcttctaaaaaaaagattcaaaacaaattttccaagagattaaaactcttgcttactttcctataaaatatctatagaattatccattccataggatttttaaaggaaatgatatgattcaatcatttgttttaaagggttttgtagaatttttcctatatgattgaaatcattcaaatttcctatgttttttcccttacaaatgagggttcttttgaaatacgagattgaaaaaaaggaggaattaaaataaagtaggattttgacatgaatataagtgtcaaacaaataattacaaaacatgcaaaaagtacaagaatgattgtttgagttgaccgaagaaaaaaatcacatgaagcggatgagagagagactcatagaaattttcaagagattgtgccctttgatcatatatactattcctatataattatctccattagctgttattctagctagccatatcatcttatttatttcagccattagatcactatcaaaatccaataaaaaatgttagatccccttttcctcttgtcctatgtcactgcatgtttgcatctgtttgaaacggtaagtaataagaacatccctaacttagaaactatcaactagtttctatagttgccatgtcatatagagactatgtataaaaactatatatcaatggacagtgtcttcaaattaaattctcatccaatcatctatcctctcttcttttatccacatatgccattgttttcattcttggttcttgtgtagagatgatttcttccatgagaaataatttattcatcattttacatctctcctcattaactctcttgccacgttagatttttgctcatgtgacaatttatttaatgctatagataccagatgatatggagggctgaggatggcctaaaaactaccatcaaagctctttttcgccaaattggccctaatcccattaattctctcataactatcctacaattaggataatcctcacacacaacggcatcctccttctcgagagctgatgtatgccatcatcccttcttaatcgatgctaattacatggtagtcatcgttcatttcctagagtactttagttttgccgattatctatagcatatatttgctttcatgaacaacacttgacagcaactcattgtacatatccactatacctgatatttgcaaggttaattatatcaatgacttttcggttagggatatgcttatgtgaaagtatgttcaaattttgattatttgaagtcgttctatattcatgtaacttttaagttaaactgagaaaacttctgcacattggattttttttaattttcccgcacataaatgtttatgtctagctacatacacatgtaaaagccaaacactttgtgacatactcctttcatcccataaaaaattaatctagtactagatgtgacatatcctagtcttacgaatctaaacatacctttatccagattcattgtgctagaatatgtcacatccagtattagattcgttttttttgggccggagggagtatgcattattttctttgaaattttcaaactagccattctcaaagagaacaatgatcatagtaataaaagaaacaattgtcatcgttctattcaacctccctattttacaccttcactaatgattcttatttttttagtgaaaatgttcgcaatgcgcgggggcataatctagtatgtacatgtttggccatcattatggtctttaaagaacactaatttctccaaattatctacacaatgctggattgaagtttactttttaaaaaatataattataggttatataaactctagtttctaattttctataaacataaatatgtttcgtacacactatattaatcaaactacattgttttaaatcaatacccaattaaaaaatacatctatttctcttttccttggtttaacatgggaatttttctagtcctagagcaaacactggttccttttatgcttctcctaataataagcaaattgccatgttttgcgatggataaaagaaaatatatcataatatgtcataaaaaatatagttttatcaaatatgttagcatcatgtgttttcttattcgaacattaagtattcacttgttttaaccaaatactggatcgctccataatattagaaaactatattcacgtcaatttgtataaactacaaaaaatctgccgccactagggcctcaaggagtttacaaataaaagctagataaaactataataaagttataaataaatgcatgaaaagttgtaatggcaatcgacactccaggcttatgcaaccacaattggattcccaccacaccaaacttgtagtttctgctaatatgttccacaatttgactctatataaacgaatttaagaaaaaaaaagatggaatacatttctatatcaatagacgttgttgtaaatgaacttattgttttttttaatgaaagctacatgtgaacttttccttttgaaatcgagatgacatgtttctaaaagagagatgacatgtttcctcaattaaggcacgtataatagcaattaatagcaggttcgtcttagggttgtcaatttgctgacacaaaagagaggggaacggaaagagaaatatcgatgttaagtttaccaatggcttaacattatcatatcttagcgtttataaaaaaatattactccatgggaatatgaaaaggaaaaaaaagtaataaaaattatctgatacattaattattatattctttaccgttgtaactgttgaaaaagatactagctagtctctaactgtgtgttggtcgtcattcctgtcttgctaaaattttctccatatgtactatttcatgtcttgacccaatctatatgctagcttatgaaccttctttaacaaccatattatagtcatcatgatttgttggtttattactgtataagcgacttacagacatggacgaaactcgcgatcgttgcttttcacacctcgtgtctatctcttaggaaattagttttttgcttctagttcaccgcaacctccgacgagttgctgcgtccatgtatatccatccattcgcaggtggagacatgcatgtcgacatctcttccgaatcatttaaagggaaatacaaatagaaaacacatgcctccgccgctaatcatataggagctgactatgcgtcctcgagataactcagcaccgttagtgcatgaatcctgacggaatggtaggtccgattttcctcatcaaatgcaggtcagcgtgtgatatatggcactatggagcacatgaacttaattatacgaattacgaccccctcctctgccgccgggttacgtccctgttgcgcgatttcaatttatttctctcgtacttggattgcgtgacttttcatgtacatgaacgggcggtcgaatgtccggcgccacggccggcctcgtaatttctgtcaatatcatggagctccatccaccgacttgtaaagcgacgccgatcgcaattgaccatcttccgtagatccactgcacggtaggatgcatgcataggcggcagagaccaagcaggagcagtcatagctagtttcagctgctcgtctcacataatttcaaccgaagaacacttgaagaaacagcttcctggtggaatgtcaagacaccgtgagcgtccccggccagtaggatcactcgcttccggcgaccggcttcagcttccgggacgtatcctccgaatacgacgccgcgagtctgcgacggaagatgaggcacgcatgccatgtgcgtggcagactggaacaagctaagtaaggcagatacactgatgcctaaaacacgaactgttatttattgtggtcaattcggccacggcaatctgggccggctggcgaccgatcgatagagtgagcgaacgccgattccagttacgtgcctaccttgccgcggccgtcatcgtcgcgttggtttcccctttgaacagggcaaagcagcggggaagggaaatcaagcacgtcgcctgcacctgcgggctgagagtgacggctcatgtggtcttttgcgcctgggagggagcgtgtctagtggcaggggagcacggggcaatccagcccaatcccatcgcatccatcccgggtgcacacggtgacacggctaggctaggcgcccgcggcgccgtgggtccagcggtcgctgccccgccagtagctagtggagtcgatagagggatcggatggctggttggctttgggctcgctgagcctcctcagcgagccccgcgcgcgcgtcgcaccggtggaaaagaaagtcgtgacggcgaccgcacgcgcgcgcgcgcgagggagacggggcgcagcgcgtggtcgtggttggtgcggtgcacgggagggacgcgtccgcgcgggcggcgggggcggcaggtgcgggtgggggcgcgcggtcatcagcggccgagccgcgggcgccgcagcgcgtggcggtcgtattccgcggcaaagctggactggtaaattggtcccttccgaggaaacattcagcgccgcctcgcccgctcgtagtagcttcgatttcgagcggagttggaagaatagctggaaccatctccaccttgcaaaatgccgaaccacatgattttcaccgtatgaaccagtcagcactcaaatctcgcagatatctaactccggacttgagcctgatcctaacgtaagacttgtcatgttgccatccgtttatctctgacaaagttagcgtttgtcactaatatctttctgattggtatgtcgtatgatgggtcgtttaatttttcgttccccaattgtctacccgttgtacgtacgtggctgactttgtactacaatatatcaaaagaattgctggcgtcgcataaccggatttatgccataatttaaggtttgaacccaggttttgtttacctcatttgccacgcctcgtcaactggcgacgggtacaggactacagcgcgaaaaaggaggtggggagatagcgttttctgttccctgattcctcatccatctgcagggcgcacgtttgccgggctgcagaatatcaatccctaggacaaaaagtacaacagaagttagacctgcaaagataagatattttatatacatataacaatgtatctagccactctacaatacgccaattagccgcctaaatttgtaatgtattacgacggataagcttatctttgtgaggaattatttggataatggttttttagtatagtagttcggataagctagtaaaactacatcggcaccttcatcctagtagtagattagaactgaggcctccattattactgcaatcgcggaatcagaatcttgatgaaagagagtaaagcaacaaaaagccatgctcaagaagatgatagatgtgttgactattgcttatgcgccccaacagtttataagtgcagattttagatgactggagcccgcaccaatttccatcctgatcggttttcttcactggcagttcatgttgatggtggagagtgctatagcagatagatatggtcttggtaatacacagtgatattgtttactggagtatatggtactctactgtcatccattgaggtggagcttggacaaaggtaaagagatactatcaccaatactcacattaattgttgagagcttggaatcaaagtaccactgatgcacttgcagagtattgaaacatatccaaagttgttcggtaaaggggccgttttccaaggactgccgattactttaaataatctcacaacatacccatttctctttataagaaaccatcactaccagcagaaacagagatatattaagataaatcacttcacttataaaccgtacatgtagcccttgctctagtctagatgctaaaaatatttatttggtactacatccgtcctaatataagtgcaattgtggttttcgtgtccaacgtatgactgtccgtcttatttgaaaaaattataaaaaaattaaaaaaaattagtcacacaaaacactattcatgttttatcatataataacaataaaaatactaatcataaatatttatcaaataagacggaatgtcacacgttggacacgaaaactcacaattacacttatattaggaaagaggtagcactttcatagtagtaagtggtaaaaggtatactactaattagtactcaaacaaaacatgcaaaccaaacaagccaaactggtggacgaaggccgtgtttagtttcaaagtttttctttaaactttcaattttttcatcacatcaaaactttcatacacacataaactttcaactttttcgtcacatcgatcgttccaatttaaccaaacttctaattttggcatgaactaaacacagctgaagaaagatgaaggtcttctttttttttttttacgttgcaaaatttgcaataagctactacaacagataatgaaaataagttccatttggacagaagaaaagaaacatgtttagaaattttaaaacaactgatcgtcagctcacatgtaaaaaaaagaagtctataatgaatttccaaaatgagcagcgatgttcctttgtctgctcaggagatcaattgtgtaccggatagctagccagtgacatagagccacctgatgtcttgctgagttcattcttgaattctttagatgctgacttctctacaaggtattttattatgagctgatctactttgccaatgtttattgaccaataataaatacccataaccagtcaatgtccattcatattatctaagaaaagtcaatatacatccacattattataggaaaatccagcgtgtacttcacgccgttgaccatttacatatataatgtccgattgagaaacatataaactgcaagtaagtcaaatagtaaattagaaatagttctgtggtctgattcctgaaagttgacaactccaatttcttattagttagttttggttgactaattgtatgaattataaaatgcaatcgtgtggcaaatggcatagttgtttcttttttcgctgttaaaacctctaggtgttctgccaccacttcaaagactgtcattcatgtaaaactttgctggccggtttgttagaaaaccaaaatttgtaatagttgacatgagtaatgctaattttcagaattttgcagtgttgaaataggtagacaccagtccgagaatctgtctatattaaaacaaaagaaggtcaacactctaaactagcccactatgacattccagcccacatgagtatacagcccagcacataccaacttagtacaaacttaaatttatccatggtccagattggaataagttcactttgactctattaaaagtgacccgaatctaatccgtgaccttaaaccgcaaaaccagatatcttaacctctaaactgttaaaaccagtgcaatttgactccctcggtagttttggatagcggttttgctgacgtggtgtctacgtggcattgttgacctggtccgccgttgacgtggtgcttaggtggcatgtggagttgtggacccattcgtcattcccacaaaataaaattttgtggggcccactgggggtctatcccttcctcctcccccgctctctctctccctcatcattgagccagggccagtgttggcggcggcagaggcggagtggcggcaataggtggagtggtggtggtggacgggcaaaggcgccggcgacgccgtgggaaaggagccagagctcgagggagtcgttggtgtccctctctctcccctttaccactctttctctctcccacttcggcggcagaggcggagtggcggtggcggacgtgagggtggaggcgccgacggcgccgggtgagaggaacaagagctcgagggagccatcgacgccccccttctctctcactctctctctctctctctctcttcggcagtggaggcagagtggtgacggcgaacgggagggtggaggcgccgacggtgctaggggagaggaacaagagctcgagggagccatcggcgtctctctctctctctctcttcctctttggcgccgggggcggagtggcgacggtagacgggagggtggaggtgccgacggcgcttggggagaggaacaagagctc

SEQ ID NO: 82849 - DNA, 1726 bp, Oryza sativa
attaacgttataatgcattttagttttaaggaatgtttaagataaatactttccaattttattatgatgtatggatcaagtagtatgatgcatgaacttcattggcggatctaggaggaaaaaaattaatgatggtttcgtggggttctcatagtggcggttctcgaatattttttttttttgaagaaacccatgcatgaagccaaaaatgtcaaatgtgagagaagtacgaaatggtcagtatctaacctgtggaaaatatggtcacattaccattagtttgagggcggacatacgttcagatgccatttgttgcccaaaagaatcatatctgtaaaaacaaaaatttgaacagatacattccgatttgcctatgaatgaataaaaacactaatggacatgagctaagggcgtttacagtgcattgagttggcattcggcctcagcgtttcccaataaatatttcgtgttacgttcgcttctgtcgcacctacttgaagtccccgtatttaactttgatcactcgttcttcagcctaatcctgggtaagtaacgtggggagagagagagcatcatcctgtggaagtcataaccccgcttcctccactcctcaaccgcatggggatcagatgtattatgaatggcataagaaaacttaatgtacttttatcattttccatactcctttcgaaagacttgtggcgatgatgccgccaacaccactgacgagtggggccatgagagcagtacaaatgtgagtcctcttgctttgtgtgttgcagtcattgctcttcctctccggaaagaggaaattgggtgcttctaatcgggttgcaaccctttaatgctatattgctttgcttctttctcacctctattcaagttaaaaaaccatgaaaatttaagtttcatttgtacatttaagttaattacactgcacaatttgttagtaatgagaatttcattgccacgtgaaaaagggtttatgtctcactttaagaactatactatgtcccttttctttttgtctttttaagataaagaatcccatttcaaccaaatagaagcaaccatttttttctcaacaaaaagactcgttttttttccttatatataaatcattgcaatacacgggtatttgaccagtaaaataaaatacaaggcaaagcaaggaactcatgcattccaccataaaatataccactttctccgtttcacaatgtaagccattctatcatttcccacatatatattgatgttaatgaatctacatagatatataatattaacgtgggaaatgctagaatgacttacattgtgaaacgtagggaacatctgaattggaaacatatggaaatgcaagcttgctaaaagaaatgacaaatttgttatatgtaaattagaacaatctgaaaattactgaaggtggcatccggtattcagatcacgcctcctttaccgaccaaccaaacaggcaccaagaacagggtgcactgaatgacggagtctgaaataattaagtagtgttctgcatttcttcctcgcatttcctgcactgcttacagcgcattcgccccccaaaatttacaacttctgttatacgatttaccgtgtaaaaacagcatcctgattcctagacaggtttgctgctgaacagttctagataggcactgagctgcgtggtagtaactgaagaaatgtacacaaaaatgtggtcagtccttga

SEQ ID NO: 82850 - DNA, 5483 bp, Oryza sativa
taaatgacactttaaccccctcattcacatatataagagaaaaaaaatcgaatgcaatgaatttttttatagataatgcatcgtaatttatgtagaacgaaaataattatgtacttgcaagtgtatacgatagacattgcttaagtttgatgtgcacatgttaaaataatgggaagtatttctgcaatgttatttattcatcttggttttctcttttctagtgtatagttatatacaaattattggcaaaaaggatattttctaacagaaatattgactagaaatagccatatggcatattaagtgggcctaagaatgattttaagccaaaacaaatacttataggacctacgtggacaaaatgaaacctgaaggacctaattgaccttcggtgaaacttgagggattaaattagctattcacccatttaaatatatatggattaattgtttagaagaaaagactaagatgatgagactcaatgagagaaagagaaaaaggtatataaatcaattatccaaaaacaaaactaagttgatatgattttataagataaaaaaaggaaatgatataatttggacgatatatcaaacatccaagagttagaaataattgagatgatatggcttaatgagagaatagagaaataatattacctatacttaataagatgaattttatagatatataagaggcctgtgtgtctaattgtctatttcttccaatctgaaaataagttcaatataggctgtgtttacttcagcgcaaagtttgaattttagttaaaattaaaggtgacgtgactgaaaagttgcgtgtatatgatagattgatgtgatgaaaaagaactgaagtttggatgtaaactttgatctaaacacagccatattcacgagtaatatcaaagcgcatcaacgatcactttttacgagataaattacaacagctcgatgtgtggtgctctgctatgacatgacgttgacgtactcgttagcgctgtactccctttgtataaaaaaaacttaattcttaagtgtgtgtacaatgtttgaccgtctgttctatatgaaatttttttatgattagtatttttattattgttagatagtaaaatatgaataatactttatacataacttatctttttaaatttttttaaataagacggacggtcaaacaataaaaacagaaacccagaaattaagtgtttttgagacggagggagtagaggtgtaggttgtccgggcaacgcttgattggtgctcggcgatggcggctggctggattggttatgtcccttccttccccttctagcagaacagaggagcttatgtggtggctgcaaggagtgagaaggcgtggcactgtggcagtggttaggagcgcttagctccgttttatcttaagttttgaagcaagcaagaaaagctttaatcccagccttttaagtatttccttttcgcttgtttgttatttatgtcagttatgagattaggaaagtatgtactcgtgtaatctttggttatgtatatccacttgtgaatgttgtatatgctaaattcctatctattatttaaaaatacagtaatatcagagcattttccacataaaaacagtccagccgttgtactctttggaactgaggatccaccggaaaaaagattccatttgatttcttaagaaccaaaagacatgtggccctagtctcaattaaagattagctttcgttgtcgaagaccttgaccacttactttgcagtctcgagtgtttggctctttcctacaaagatgtgcacatgttaagaccattagcccaagtcttcggtcatctatgagctctgagggcatatccaatctcttctttctataaagctaatacctattaaacacataaaacttaacatacaagtataatatttattagcactcctaaaacttacatgcaagcatgtcacatcaacccattaattaatcacacaaaacccaatatgtaagtatatattagttatatttacattttagtctgcttcagtcacttcctctcaaccaatcggaaactcttcctcctctcgcgtcacctttccccgggtgacttgggaggcgacgccgccgccgccttcctccttctccctcctcctcccccgcctcgccaccgcctgagcgggcactggcaaagccgtgcggccgcaaggacagcggcggcggggccttctctcaccctccacgcgctcggcggccaggggcgctcctcggagcggcggcggcggcggtgtccatatccgggccgggcgcggtcggatcttgcggaggggtctctggcggcggggagtgaacgtggcgacggcggcacctggtagtggacgtggcggtgcggggtttggcggcgacggcggcggaggcccccagatccgccccaactcggcctgatctggatggcgattgccgaatggcggtcagcagcagctggcggcggcggtgttgactgctgtggtggcggatggcgacgaagcagtggctgtgatggcggcggcagcggctagcgacggcggctagtgacggcggtagtggcagacaacggtcaacttgtggcgtccgcggctatggaggccgggggtagcggaggccggcacggcgcgaggtggcgcgaccagtggcggtggaggtcggcttagcacggtgaggcgtggccggcggtgccgtaggcctgttacgacacggcgaggtgctgctggtggtggaggaggcgggcacggtgcgacaaggaggagctgccggtgggtgcggtgcggtctacgacgcacgaaggctggccggcagggggcgctgatgcagtggttccacgtgccagcagaagtttgatggtggtggagcatcggagcgccagctgtggactcgcaggtggtgattggcgggtgaaaacccagcccagtctcgaccaggccggcaacgatgacgttcgacgcgtcattcccctcctgaggacgttatcgtgacgtctcatccctcaagtgtggatgccgagcgaaagccctgtctcggttctctttgagaccttgacggatggggcggcggtgttttccatcgcttctcttcttgaaaacgtcgtttagacatcccctagcggaaacccccaagcaattgatgcaagctcgctctagatttcatcctcttatggcggcgtcctagacactataagttggtcacatcagagggcctaaggggagaagtgtttcattcttctctctcaccctctctctctaacttctgaagacttggatagagcggggtttgtgttgattgtaagggttgggttttgggcgatctcggctgtgttttgttgttggcctagcggcggtcggtcatgcttagcggcggccggttcggtgctagccttctcctggacctgtgtgttggcgttgccggtgtgtgggtggtggtatactttttttcttttcctggttacgactttccagggttgtaatcttgtaattttttttctgctctatcaataaactttgcaccgtcttttgcgagttgttcaaaaaaaatttacattttatgtcattctaaaactaaacatacatatgctaaattatcaatctcaaatcattttcataatatttcaatccaaatcatttcatcatttttgcaatatctaacatatattctgcagcaaagcgtagagcatcatctagtttatctatatctacatatcctatatagttgtatccaatagctcaatatgtattgagccgcatcatttagaaagaaaagtcatttgatcattttcatacttaatcacaaattcacaatcattcatttagtagttactattcctcgttaattagtatataagtcaacattagtgattcaattagtgtagaatattatcgctataaagaagttaggccatcaccatatttaacaccattgcatacactggtggagaaaccctttgtagtcccggttcgtaccccccccttagtcccggtttccaaaccgggagtaccaatccgggactaaagatcgctatctttagtcccgggtgaaataaccgggagtaaagatcgatctttagtcccggttggtgttaccaaccgggactaaagatagagctgaccttttttttttttgcatgcccctgttgctgcatggtttatatatatatatatatatatatatatatatatatatatatatatatatatatatatataaaccatgcatatatatgttatgcaaatgcatttgtatatagatatatatatgaacaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgtaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctacaagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgacattgtctggaaggataccccttattacaactggtagcagttgtgtcatcaacacgtgacagtcatgagactttaggtttatgaacttcttctccttcgtgcttattattcgcttgatattcgtggagtatccagacggtacctttatgctctccaag

SEQ ID NO: 82851 - DNA, 18376 bp, Oryza sativa
ccgttagactcttttagaaataataattagcatacttcctctgttttatattataagactttctagcattgtctacattcatatagatgtttgctataaaagtcttataacctgatgaaacggagggagtagcttcaaggtgaaaaagattcgtttatgaaaagaaaaaaacaaatggagcagaccaaaaatttaatatttgtaaatatttttaaatgtttccactgaaatttaaacccaactgaaaaaaactttgccttttcagtttcttggtgaatcttttgtatgtgtttcatcaaattcgtaaaaaaaaactattttctatatttggggtcataattatgtccagtttgattttatcacaattctttttagattatgtttacaaagtagaaagcataagtacgtatgacatataagtcattttgaaaaaatctaacagtcaactaatagaatagatataaaggagataaaaaaaacgcaaggacatgtaaagataagataaaattcatgaatatagaagggattctttgagcaatttgtttctatattctttgtgcaagttccatttaaccatcattttcaccatagcatacatatgtgtctgtgctaatgatttaattattgttttgacgttgtaattaattaattaatatttaataggccggagcaatggtgacatgttgggagagaagatcaacataccacctgggccgctatgtgcaaagcgaccagacctctgcaagaactgctggtgttgtgaggtcagcgacgggcaatgctaccagagtctcgaggcctgccaggtcaactgcccattaccatcgccaccggccatttgatcagatctcgatcgatgcatcatatcgtttgtgtgataataagctgatcaatcaaccaataaagaaggcattaattaagtatcgtactctgttcgttttggaaataaaatgctgatgccatcaatggatgcatcatgcatgcatgaattaatgttctggaaaatatgtgataatcacatgtcgtgaaaacttgaaaacaaccttggataaaataaaaggacacctgatatttatccacgttatttagagtaaaaattttacttgcggatttaatcatgagtaaaaattttactattgatgacgtggataaatctcatacgttcatttttaaatccaacggtagctttcaggtttgtacgtgatatattttccttcttaataacgtttatagtgccagatatgggacaattgatcttttgtccatattttaaagtctaactataactatacacatttgaccctacatttttaactttgcttatttgatcttattttttttaaatcgaagttgttatttggccctattgtataggaatagatttagaagaaaataaaaaatgaatttagagagggaagaagacttaactgccccctgtgatttaccaaagcacatacgcgcggctagagttacatgggcgcggaggagaccaatctcatgagcacagagccaatctcggtcagcaaccaaattgttacacattctgatatgcaatacttatattattatagtctttagacttatctttgtcggctttagtttctgcttgttccttggatttacattcttcggaagtttcaataacggatccaccaatatctgatttagacagattattgtgtgctttggtgaagaattagtacttaactggcccccgcgtcatcctcccttacgggcgatacgggaggcagaaaccaccgccatcgtccgctccccctctttcctcctccgcctcgccgccgcccgagcggccgcaaggacggcggcggcagggcttcgtttctctcactcgccaacggtgggggaccgtgcgggatggtgaaggccgcccagatccgggccgtcgcagtcggatcttgcagggacacagccggcggcagggtagtgtgatgaggcggcggcggttggcagtggtggcggtggagtatgaaggtggtggcgatgaaggagaagagaggggatccgtcggcggcggggatgaagatggcggcgaggatggcgacagcgggcaggactcggtcacgccgaaagcggatccggccccctgaggacggatctggtgcagggcgaggttgcagcggtagcggcgcggcggagctgcggcgacggtgtcggtcgcaacggcgcagacttcgtggtgacggtgacggtggcaacggcgtggagcttgtggcgatggtggcggcagcggttggacggcggcgacagcacggtggctggtcgacggaaacggcggctgccggcggctgtggcaacggggtgcactcacggtggtgatagcggcgcggagctcgtggcgacggtcgcggctggacggcggcgagggggctacggctagtcggcggcgaggtgtccgttggcagcagcggctgcggtggtggtgaccgtatctacggttggaggaggcatggcagtctcggacagctaaccgggggtgtggcagacggccgcacctggccggcgtggtagcgattggaggggtcggaggccagcttggtgcagagaggcgcagccgatggcagtggaggccagtaaggcgcaagaggcgtggccggcggcgaggaggcccgcttggagcgagaggcgttaccgatggcgggaggccgaactggcgcgagaggcgcgtccggtggtggaggccggcgcagcacgatgaggtgcggccggcagtaaaggaggcaaccacggtgcgatatggagctgccgggggtgtggcgcggtcttgggtacacgaaggctggctggagggggcaccggtgcagtggtcccacatgtcagcagaggttgagtggtggtaaagcattggtgcgacaaccatggacttgcaggtgatgagcggcgggtgaaaacccagcccggcctttgccggaccgacaacaatggttcattccccctcctaagggcgttgtcgtgccgtctcatcccttaagggtgtttgccgggcgaaagcccagtcttgactcttttgagtccttgacggacggcggcagtggttttccatcgcttctctccttggagacatcgtttaggcatctccttgtcgaaaccactcgaacgattggtgcaagcacactctagatagagttaggctttgtgttggttgtaagggcgtttttgggcattttcgtctgtgttcctttgttggcctagcggcggtcggtcacgcttagcggcaaccggttcggtgctagtcttctctcggacctgtgtgttggtggtggtatattttttctctttttcctggttacgaccttctaggaatgtaatcttgtaatttttttttctgctttatcaatagaacttcgcatcgtctcgtgcgagtcgctcaaaaaaatatctactttagagaatcaggttcttaggccctgtttagtttgcgagacgaaaagttttggtgtgtcacatcggatatacgggaacacatttgaagtaataaacgtagactaattacaaaacatattacagattccgcttgtaaactgcatgacgaaattattaagcctaattaattcaccattagcaaatgtttattgtagcatcacattgtcaaatcatggagcaatgaggcttaaaagattcgtctcgcaatttatacgcaatctatgtaattagttttttatctatatttaataatccatgtatgcgtccaaacattcaatgtgatagagtgaaaagtttttgtttgggaactaaacagggccttattcatctgaaagcctgaaacttatgtcattatcagattgcaaatcataaaatggtactcacaccgtcccaaaatataagcatttttgaccttaaaacaatctttgagacgctactctgaccaataatatctataaaattaagtcgttttaaataaaaagatatatatattatgatattttgtttaatgataaatctagtagcatcaatttaaaatgatcttttttatttttttcactattaatggtcaaaattaaaattgtttgacttagcattattttaaaaatgcttatattttaggatgaagggagtagtattcttgaataccattatcaaatatcaattatttatgtggaaaaatatgtcgagctcaaactgtccttttgcattatcgatgaccttgaccaacatagccccagcacacacggtaaagactagagacggccagctgcaagtctgcactagcgtactgcatacgtactgaaattggtagcttctcactctccaagtcagtctcacaagtccacattaaacaagcatcaccactcgtaactagtaacaaaaaatgaccaatagtaccgataatcttttgttactactgctcctcttcttctccggctccagtgcggagcttgatgacggcggcgagctccaaacgcttctgaccatcaagcggcattggggtagacctgctgcattcagctcatgggaggtgagaagttctaattcttttggttactgtgattgggtaggagttgcttgtacagatggccaggttacgtccctctccttccagagcttccaaatagccaatccaatcccagcttctatttgtagccttaagaacctgaagtacttagacctctcttacaacaacctcaccggtgatttccccacagtgctctacaattgctcagctttgcaattccttgacctgtcaaacaatgaattgaccggaagccttcctagcaacatcgacaagttgtccttggggatgcagcacctcaacttgtcaagcaattattttattggtgatgttccctcggctattgccaggttcttgaagctcaagtcactggtccttgacactaacagctttaatgggagctatccaggtgcttccattggaggccttgtggagcttgagatactgacgttggcatccaacccgttcatgccgggtccaattccgaatgagtttagcaagcttacaaagctgacatatctgtggttatcctggatgaatctgactggtgacatccctgatgctctgtcagcattgaaggagctcatactattggatttgtcaaagaataagatgcaaggaaagatcccgaagtggatatggaagcttcagaagctcgagatgttgtacctctttgcaagcaatttcagtggcgagattggtccttacatctcaacactcaatatgcaggagcttgatctatccatgaacaagctcaccggatcaataccagaggacattgcgaacttgaagaacttgagactgctatacttgtactacaacaacctcactggatccattccaaaaggtgtcagtatgcttccaaaccttaccgacattcggctcttcaataataagctctccgggcccttaccccctgagcttgggaaatattcagaattgggaaattttgaggtgtccaacaacaacctgtctggtgagttgcctgatacgctctgcttcaacaaaaagctctacgaccttgtggtgttcaacaatagcttctccggcgtgttcccaatgaaccttggggactgcgacaccatcaacaacatcatggcatacaacaaccactttgtcggggacttccctgagaatatatggtcattcgcaaagctcatcaacatcatgatttacaacaacaacttcaccggcaatctaccgagtgagatatcattcaacatcactagaattgagatagggaacaatatgttctccggtgccctcccatccgccgccatcgccctgaagaacttcatggcggagaacaaccagttctctggagcactaccagatgacatgtcaaggttcgctaatctcaccgagctggaccttgctgggaataggttgtccggcttgattccaccatctatgcaatctttgacaaagctgacctccctcaaccttagcagcaaccagatttccggagagatccctgcagtacttgggttaatggatctaaacattcttgacctttcgaacaacaagctcactggtcacatacctcaggaattcaatgatctacatgtcaactttctcaacctctcatccaaccagctctccggtgaggtcccagcagcattgcaaacgctagcatacgaggacagcttcttggataaccctagtctctgttgtcaatcagaatccggcatgcacatcaggacatgtccctggagtcaaagcatgagccatgatcaccttgcactgagcataagagccatattggtcattcttccttgcattactcttgctagtgtcgccatcaccggatggcttctcctcctcaggcgcaagaaaggtccacaagatgtcacgtcgtggaagatgacacaattcagaacgatagatttcaccgagcatgacatcgtcagcaatatcagcgagtgcaatgtgattggtaggggtggctcagggaaagtgtaccgtatccaccttggcggcgacatcaaggcgggacgacatggcggtggctgtaccccaaggacggtggccgtgaagaggatcggcaacaccagcaagctggacacgaacctcgacaaggagtttgagtcggaggtgaggacgttgggtgacctccggcatagcaacatcgtcgacctgctctgctgcatctctagccaggagacgaagctgctcgtctacgagcacatggagaacgggagcctggatcaatggctgcaacgctacaagcgagccggcaaaagcgggccgttggactggccgacaagggtggccatcgccattgatgttgctagaggcctcagctacatgcatgaggattttgtgcagccggtcatccaccgcgatgtcaagtgtagcaacattcttctcgaccgcgagttcagggccaagatcgctgattttgggcttgctcgtatccttgccaagtctggtgagtcggaatcggcctccgccgtctgtggcacctttggctacattgctccaggtatctactatatttatataacttttatcatgctctctactgtagtagaaatgatttcaacttatatgtattttaagcgaagtcttcatatctttatcaccttaattaattattggaagtagaagcgatagggtatagttgaccaatttcggctaaaaaattcctactactatttctatttgtattagaacacttccagcaaagggtttattaaagtactcatttatttttgtcgcaatctacactagagggcacatagacaatatcataatgttccattataatctgtctgaatttgaggtgtgcatacatttggtgtattaatttgcttattgcagagtacgcatacaggtcaaaggtaagcgttaaggtggacgtatacagcttcggtgtggtgctgctagagctggccaccggccgagggccgcaagatggtggcacggagtctggcagctgcttggccaaatgggcatcgaagcggtacaacaatggtggcccggtcgccgacttggtcgacggcgagattcaggatccttcctacctggatgacatggtggccgtgttcgagctcggcgtggtttgcaccagtgaggagccggcgtcgaggcctccgatgagtgatgttctccaccggctcatgcagtttgatcatagcggaacacatagcgatggcgtagtagctaaaggcgtgtttgacatcgatgattcttcggattgtattgtttaatttggatattgagatgatcaaccatgggtcaaacagtcccagtacgagtgaattgtccgttcttctcaacaaaccaaagattttaagatgaactgactactctgtgtgcaattcaacaagatgcatggttgtgcaaacagttggattagcttgagtcatcgttagattcatactatgaccagtagaggacaccgtcaaagtgttttcgtataggatattaatcctgcctaggtctggccttccactttcactcaactccgaatcctctacaaatagagctgcaaatagaggaagaattaatgatcaggtgttgtggaagctcatagactaaagttgctttctctgtgtctacagcaaggtgagagatcaagcctgcgcaagctagctaatatggaagataagcgcactgtcaaatgtcaaattcttcatctggttggggaaaaaatgcctcatagccgataatctcctcaaaagaaattggccacatcaacggagttgccatctatgtgcttcagctcacaaagattgaagcatttgttcgtctcttgcgtttttatatatatatatatatatatatatatatatatataccaacagaatttggagtgttgaaagcctgggtgggtatatcccttttcaacttacacgacatgggtgagtggtggtggcggtgcttttcggatgaactacaggaaatccttcaacacgttcttcatgttggtctgctggtcgatttagaaaggagagaaatgccagcgtgtttgaggggtaccgtcttgcacgcttgggcagtcatttggtgaaacggttttgctatgtccctttgtgttagatttttgggctcctgtcttagatgaaaaaaaaaatccttagcagttacacttatacacttagttatagcgcacttacactctgttacaatgtacttacattttttagctacagtgcatctaaattagattttttttttcaacagtgttttttctctaaatttatgattttttggcatatttgtcttttttgttattttatttaaaatgggttgtatagattggttgaaatttctgtaagatttgaagctccaaatctatcaaaaaatcaataggttttcaaatccttggtgaaatcaaagatgaagtattactttcaaagagagcaagagttttcaaatccttttctaagtagctccggtaatgtaagtgttaagtttctctagtgattcatcactagcctcaacagtgttatgtcgatgtcaagtacttcgtcgtaagaaaacccttcctaaccttaatcaaaatggttgcccttcttcagccaacccatctaaaaacatatgactagggctgctgctctttccaattcattttttatgttttggacaacgacacgtcctccaaaacacatctttaattatattttttattgtgataagaaatttgccacagaaattatatagggataaacaaactaaaaaaatgtgtctttacaaacacttttctttgttaaattttctataggagattgggaaaatcctcaagtactccatccgtatgagcttttggaaattcaataggcccaacctctcgagctactctatttatcctccaccttatctcttggcgctaataggtgtttagtagcctctctagtcatattcaaaccaagcctctctagtcatattcaaaccacctgtcgtcgatttgatagtgcattggatttactactagttgattattaagggtggacttctttttctcacaagtataaaattaagtttaaggcgatttcaatttcgaattatcatagtcgtttcataactggttaggaaggatatgacacaaaatagttatactttaataacgtaatatttaactgaaacaaataaattcacaaggtaaatatagcataaatataggcacatataagattatatattctatcctctcctgtcattaatatgcgttatttttaataataacgtcatatgttaaaagaccggagagagtatatatatacaaagttcaagtattgctagaacctgttttatctaccttatccccagtaccccactcctcccctctctctctatatatatatatacaaccgcatatgctatgcaaaagcatccagcaatcagattatcatttacatattaaatatccaaagagtacgtaagggtagtagtaaaatctagcatggtgaagtgcggtaatggacatgtctatgcagtactaatgctgctgcttcttgggtgctttgctatccatgcacaatgtaagtgtttcaatttgtttgtttttcaacaaaatttgaaatcctattttgcctatactgattttaccctttcatatactaatcctttttttaaaaaaaattcttttgacaaataggctgtgccatggatgacatgttcggggagaaaattaatttgccaccgtcgctgccgtgcacacaaggatcgaacacagagaaatgcagagactgctggtgttgtatgctcgttgaaaacgatatctgctatccgtctttggacctttgcaaagcaagctgcggaaagataataaattgataagtgctaatgtactgtgatgagacaatttagcaacaactaattcggaataatatggagatgtatgttgtgttggaattcttgcatgctggtaatagttgctaattagtttttgtggttgaaatgctgctaaactagctaatcgtgtagtatagggctgttcattttgatgctattttcaaccttattaaattttggtaaagttataaaaaaaagtggctacatttagtttgctgtcaaattttgatacctatataagaaatcctgccaaattttggcaactatgccaaaattttggcctttttttggcatcaaatgatttgatgtgaaaaaaaataagataaaggaacatgtgaagcatggaagtttagccgccttgttgggcccaccgattatgggctgaactgcatgacatggggccgaatataggcctacgttatcgtggcctttgggacccatgagatgagtcgatcataatagttttgataattgttttggaacgaatgaattgttaattggaatgcacatgtaaaataataagggattaaaaatcataagaaaatacagaaatagtcgttcgattaggccgtgaacaaaatgcaggaatcaaataaaagagatatactcaaagtaaatattccaagaggttgaaattcttgctaacttttcgctagaatttctatagtactgtccattctgtaagaaatttaaaacaaaggatgtaattgaatattttattttaaagacctttacatgatttcttttatatgattaaaattatccaaattcatcttttcctaaagggggcctaaatattgttgccgtcatctgaataggatcactacgatagaaaaagggatcggtgccggatttcctaatcggcacctagcatgcagcacctttgaggatgactctaagatattggtttaggaaccgacacctttgagattctaggaataaaaaaagcaaaaaaagaaggcaaaattggttatatagcatcgaaagttcacgtttttggttttataacaccgaaaattactagttcactttaatagcatctaaagttcaccctgttcccatttttagcacttccgtcaattttccgtccgtcttgatcgttattgatccagccacacacatgatatgacatttctacccctcattgacatgcattatacttgtacttgtgaggggtagaaacgtcatatcgtatgtgtggctggatcaagacggacagaaaacgatcgagaattgacgaaagtgttaaaaatgggaacatggtgaactttgagtgctattaaagtgaaccggtaacttttggtgctataaaaccaaaaacgtgaactttcgatgctatataaccaattttgccaaaaaagaaagttggctcgatgcatcagcttgaattgagccaatgaatcgaggagctctctatcatcaatgagatcaatatcatccccatcaaccaaacacaattaaaatcatcactgaaatcaacatcatcccatcaaccaaactcaatcacaaaatcaacaaaattgcaaacacaagcacacgccgccgccactgccgtcgatacggccttcccccattgtcgattctgccaccctcgtcatcgcattgtcgatcgatctgcccccccgccctcacgcgcggcagcagatccggtacctatgagctgtcacctattaaggtttttgtagtagtggatgactatattttagcaatgcaaatttaaccagcgatagcagtacatgtagcaataaaagtgatgcatctataataagggaacatattttgtgcacacaaccttctcgtgcacagtccgtacacaccaactaatatatgtcaccaaaaaatctaaaaaaaattgtgcatattactttcaataatattacacctatgtgtaaaataatcttaacctcaaattcattatattttagaaaaaaaaatatctgacagttgtaagactataaattataattttgtcttttgctctctatatatgatgaatttaaagatgaaattttatatgtagttataaaatattgaaaatacatgtataaaaatgtttctagaatttttttgacatttgttagttggtgtcagctgaaactaatgccatttgttctagtacatgtacatgtgtgaattttacagcaagtaacactagtacgctagaccttgtgacaccagtggattgctttgggcgttggccagtaaaaaagttaattagtgacaacaggagcgcagcagcaggtcctgcttcaagctctccttccgcaagacggccaactggagttgtagcgttgagcagcatttgtaagattttgtttgttgttatacctgccaaaaatggccaattattgatctgatttcaatttaattagttccgttctaacctactcaccaagctgacaagccaattaggccctgtttctttcagctttggattattataatctagtttattgagtcagattactataagctagattgttataatctgtagtagaataagcggttagttgtttctttcctagattattagagcctagattattgggtttgccagtctaaagagggagtggggtggcatggtgggtaatttttcacccaataatctggaaaaagctaaactaaatgagcttatcagattataataagctacttcaataaattgtctgtttctttcagcttacttccaataatccggattataataatcccaagctaaaagaaacaggcctgagtagttggattgaagttaatcaaggttagttaagagcaggtaatcagggttagttaagcaaatggggctatgttaattaagcaaatgaggaggttatataggggtgggtagggcactggccaggcctccctggcttcgcccctagtttcaagttatttttttatggatataacaggttgcattagataaaatataaatacagtgacatccaaaatccttgtaatgttttaacagctgcagatgctcattttctagacaagtttatttttttaccatttttatatatcacagttttaagttatattttgatggctataacaggttggattaaacaaaatataaatgtagtgacattcaaaaccacaagcatagtgtctaatttttaaataaaaataaaacatgcaaatgttgtgtttggtttaccgattgaaataccaagtctgataactgtttcacaagattcgccaccacctctcttttctccggccagcatcgcactcacccttattttcctccgtcctttatggagaaatcgccgagcgttacgtaagacatgtggcagggagctaaaaggtcggattaggtaatccgcgttgtgacgctttcttgaatgaattaggaatctcatcagtgtctttcaatctcacgcaagttgtttaaattcttagctggcgcagctaattggtgatgcttttaaggtggatactgttatttttttttaagtttgtttttagcatggccaatttcgttgcaatcggccgttatcgcaatgggcaaaacccattttcccttgtgactgtaaaccaatctcttttacatttgacttactaacaatcttattacttggtagagtgctggcgaagttgttaatataaatcttgacagtggtgagcaactggttgccggcgaggttcaacatggtgaggttggcgagcctagacatgtcagttggcagttcaccggagaactggttgttctccgccgtgaaactcttcagaccgacggcggccgacgggagggcaccggacaagcgattgttccccatctcaatccttaagatgttaaatgatatctcactaggtagagtgccggtgaagttgttgtaaatcatgacattggtgagcaactcgaatgaccatatcttcttgggaaagtccccaacaaagtggttgttgtatgccatgatgttgttgatggttttgcaatccccaaggttcgtcgggaacacgccggagaagctattgttgaacaccacaatgtcaaagagcttcttattgaagcaaagtgtatccggcagctcaccagagaggttgttgttggacacctcaaaattccccaattctgaatgttttccagctccgcgggtaggggcccagagagcttgttattgaagagacggatgtcggtgaggtccggcatcataccaacaccagccgggatgggtccagtgagattgttgtagtacaaatatagtaatctcaacttcttcaagtttgcaatgtcctctggtattgatccagagaacttgttcatggacaggtcaagctcctgcaggttgagagctgtgatgttaggaccaatctcgccactcaaattgcttgcatagagatatagattctcgagcttctggtgcttcaatacccactcggggatttgtccctgcatcttattttgtgacaagtccaacaatgtgagctccatcaatgacgacagatcatcagggatggtcccagtaaggttcatccatgacagccacagcattttcagctttgtcagcttgccaaactcctttgggactggacccggctcgaatgggttggatgccaacgtcagcgtctcaagctccacaaggcctccaatggcggcacccgggtaattcccattgaatctattagtgtcaaggaccaatgacttgagcttcgagaaccttgcaatagccgacggcacatcgccggtgaaagcattgctggacaggttgaggtgttgcatccccaacgatagcctgtcaatgcggtccggaagtttgccggataattgattgttggataggtcaaggaactccaaagctgagcaaccgtagagcaccgtggggaaatcaccggtgagattgttgaaagagaggtctatgtaggttaggttcttgagtctacaaacggagggtgggtttggtctggctatatggaaacttggcaaggagaggccagtgacctgacctgtgatattgttgtagataacaccagtccagttgccggtgctgctccatgaactgagtggagctgggttgtcccaatcttgcttgattgctaggagtagtgtttgctcgtcggcgctgggctgcgccgccgattgggagttggagatggagaagatcaatagtagtagaaagaggatgaggatgctgtagacaaccatttttgcgagtgtggtgtgttcttggatgttacatggcgtccacttaaataaggttggcggagagaacgacaaaaaagtggtcactacctcactggtcaagtcttcggcgtggtagcttcaatcctccagtgagcgaaagtcgaaagataacctggtagaaacatgtgagttgtcggttgagcactatgctatcctctttggtccaacttgaatgtatttaagattagaagaatgaaaaagatgatcaccttctggtgtggtacaagacaattacttggaaggagggacatgaattgccttttcctagtcgaaatgttcttattctgttctatcgaaagtctttttatgctttacataatatgtgttctgtcacgagaacggggcttgcgcacgtctgtgtcagcaggttgtggacaaagaggtgacttcgcccgcttatcctattgacagggcttgatgactgatgagtgaacggtacggtatgggcccttcagcgattagtttgccccctctcccccctatactcctccctcttttcccccttccccctccccttcttgtctttctactacagtacaccacacaattttttttaaaaaaaacaaaagttagaaaaatttatgtatagaaatactatatatagaaaatttgaattcaaattcaaatttgaatcgggtatgtaaacttttgacttctaaactttgggtctataaactttagatgtatagaaatactatatatagaaaatatttgaattcaaattcaaatttaaatcgggtatgtaaacttttgacttataaactttaggtctataaactttaggtgtataaactttagatatatagaaatactatatatagaaaatatttgaattcaaattcaaatttgaatcagatataattcaaattcaaatttgaaacgggtatataaactttaggtctataaactttagatgtatagaaatactatataaaaaaatatttgaattcaaattcaaatttgaattggatatataaacttttgacttataaagttttggtctctaaactatagatgtgtaaacttgaggtgtataaactttaggtgcataaatttactaaaatatgaaaataatgtggtgccaaaaaaggaaacaggtggagggagggagggggaggtggggagcgaatctgatcgctaccccatccctagggcgatcgatcgccgaacagcattttcggaacggcatcggttgaactcgcagaagaattctctaacgccgacgatccagtcatagtaacagtggaaacttgaagcattctgctattataaattgggccggagggagtatttcagagggtattactgcaagtaaagtgaaaccatttattggatttcacaaattccatacacctaaaatccaataattaataccctcttgagaattattacatcatgccatgcctgtaaccaaattattgcgatttttttattgttattgtaattctaaaaatcgaacataactatcgttggaattcatttttcattttctagaagtcccgtcaaccgtcggcggctttgcaactatactcttatacacccccgcatgctgggtctcctttctattgttggaattcattttttattttctagaagtcccgtcaaccgttgacggctctataactatactcttatacacccgcccgctgcttctcctttttatcgccattgagattttaaaaattgaatatgattatcaatggggtttgtttttttttttcactttctagaagtccctgcaaccgccttacatgtttgcttcacgggctgcctgacgttcctccttttaatcatcattagaattatatttggtgttttattaataatttttatatctcgtactcctttataggcatgttacttaatttatctcgtcatgggttttaaatggactttcaataatctttatttttatcacaaattttagttatttataaattgtattcctaattgaaatcttatttttctttttctaatttcagaatttttttaaaaaaattatttaatatcgtattgtgttattttaatgtttttattttttattttcaatttcatttgtttcaaaattttattcctacttgaactctcttttagtttttctaattttagatattattttatttttattctaaattttaattaatctcgtattgggttcttatatggattcttctttcaatattgcttatttttaattccgaattttagctgattttaaattgtattcctacttaaactcttattttattttcttttgctaattttgaatttatttatttttattccgaattttaattaatctcgtattgggttcttatatgtactcttcttttaatatttcttatttttaatttcgaatttcagttatttttaaattgtattcctacttggactctcatttccttttctaattttggattttattttatttttatttcatttttgattaatctcgtattgggtacttatatgaaaacttatttcaatattctttatttttatttccgaatttcagctatttttaaattgtatttctacttgtactctccttttctttttaaattttggattttattttatttttatttcgaattttaattaatcttgtattgggatcttatatggactcttcttttaatatttcttatttttaatttcgaatttcaattatttttaaattgtattcctacttggactctcatttccttttctaattttagattttattttatttttatttcatttttgattaatctcgtattgggtacttatatggaaacttatttcaatattctttatttttaattccgaattttagctatttttaaattgtatttctacttggactctccttttcttttttaattttggattttattttatttttatttcgaattttaattaatcttgtattgggttcttat

SEQ ID NO: 82852 - DNA, 12121 bp, Oryza sativa
tccgccgtgcctatggccgccgccggcgaccataggggcgcgggcgcgtcgcctcccgtcggctgtgccggcgaggccgccttcgggcgcgccccgcggctgccatgtggggcccggccgtcagccgcccgcgccctcgggtgcggctgacgcgtgggacccacggcgccggccggcgtaagccgcgtgcacccggtccaccgtggaccgagaggctgccgcgtgggccccactcccgtggaaccggtccgcgcgctcctttctcccggctgacgcaataaatatgtttttaaattaaaatttaaatgaagaaattcgtaaatatccatttaaagagcatataaacttcaaatggccataacttggccatttgaactcggaattggaccgatcaagtctctaatttttccttaagaagccaagaacccatttttgtgctttgtttctgcttgttatatggagtttagtagagtaaaagccgtttcttttccgttgtcgtgtagacgctgcagcttcggaagatccgctcttcgtggaggttgaagccgacgtttgggaaagcgagcaaggcaagtcacatcatctttgaacatattgaatcccagtttgtaaaattatgttgatttaaacttattgcattatcgctttatttaaattcccgcgtcatcactgttttacttagccatgcctatttacctttgttatgacctaataataattgttattgttattattccctggttaaccctagaataaacaaaaccccaactagtgaacaatctactcatggtaccactagtatgattttaggtagatgcttcgctggttaattatgcaacattaggtggttttacaactctagactttgggaatattcatatcacctggacactatggaatggttggattattgtggaattggattcacacctccccctctattcaaaaccctcaaaatggttttaggctgggctcggggtgcatggttttgacagtagcacctcggccatataaggaccggtcatcgggcctctgttgcaaagcactaccgtacttccacatgtctagtgggtaaggcttagtttgtgtgtcgcgtcccaaaacgactctaaaatacatcctcaaaattatgcatagaataagtaaaatccatgtgaaagcctccaacaattaaaatgtgcaaagttaaaagtcaaataaggtttggaggatttttgtatatttcctaaaagcctaaaatgcgtaaataaattttagtggaattttcagagcacaaataataattattaagaaataaacaaagttaaaaaggttttataaaaagaaaaaccctaaaaagtccttttcccccccttcccctcttgggccggctcggcccacctccctccctctctctcctcttccccccgcggcccaatcggcctcctccccgcgcgcgtgccgctgacgggcgggcccgcccgccaccctcgctgacgggtagggcccacccgtcatcccctacctcccgccgctcccgccgcctcgcccgtgccctagcgccgccgccgccgcggattccgccgcatcccgccgcccccgcgtgcaataaagtgaggggaatcattccccgtgattccctctccctttccccccatttttccctctctctctcgcattcaaacgggcggatttgcccccgcaaatctcgccggcgccattgatggagcccgagagcgccgcgccggtttccttctcccccggccgccctctctcactcccaacactatataaacgctccccgtgcctccctccaccgtttccgccactcgccgctctctctctccgccggaatcaagctcgcgccgtcgctctctctctccgccgtcaccgccgagctccggtccgccgccgtcgtcgcctcggaccttctcccgcctcggcgtcgcctccttcggctccgccgcgtcctcgccgacctcgtccacccctccgtttcgcccgccgaccgccggaacgccgccgtccccgtcgacccgtgccgcgccgccgccttcttccgctccggtcgccgttcccgtcgtcgtcgtcgacccggggtgagccgtggaccgcccatttcgtttcccccttccctcccctctctcggccgccgctccgccgtgcctatggccgccgccggcgaccataggggcgcgggcgcgtcgcctcccgtcggctgtgccggcgaggccgccttcgggcgcgccccgcggctgccatgtggggcccggccgtcagccgcccgcgccctcgggtgcggctgacgcgtgggacccacggcgccggccggcgtaagccgcgtgcacccggtccaccgtggaccgagaggctgccgcgtgggccccactcccgtggaaccggtccgcgcgctcctctctcccggctgacgcaataaatatgtttttaaattaaaatttaaatgaagaaattcgtaaatatccatttaaagagcatataaacttcaaatggccataacttggccatttgaactcggaattggaccgttcaagtctctaatttttccttaagaagccaagaacccatttttgtgctttgtttctgcttgttatatggagtttagtagagtaaaagccgtttcttttccgttgtcgtgtagacgctgcagcttcggaagatccgctcttcgtggaggttgaagccgacgtttgggaaagcgagcaaggcaagtcacatcatctttgaacatattgaatcccagtttgtaaaattatgttgatttaacttattgcattatcgctttatttaaattcccgcgtcatcactgttttacttagccatgcctatttacctttgttatgaccttattattattgttattgttattatttccttgttcaccctagaataaacaaaaccccaactagtggacactctactcatggtatcactagtatgattttaggtagatgcttcgcttttaattaggtaacattaggcggttttacaactctagactttgggaatattcatatcacctggacaccatggaatggtttggttattgtggaattggcttcacaccgctccttctattcaaaatccccaaaaatggttttaggctgggctcggggtgcatggttttgacagtagcacctcggccatataaggaccggtcttcgggcctctgttgcaaagcactaccgtacttccacatgtctagtgggtaaggcttagtttgtggctcagtctagtcataaacaaaagtacacggatggagatggaagaagtcgggggtcgatggacatctctaggacaaatgaaggctacacgagctgcggcccggtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtctttcgtctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcataacaactaaaatgtggaatggttggcctgggttggcttgggacgagctgggacccagggtcgggtttccagttcggtctgaatcatcgtaggccttgggttaaggcaggttcgtgtgggttcacggccttatttaataatattgtatagctctaggagcgtatttacaaaatagctttcagcaactacgtgtcttttaatgctgtttactgcaaaccctaaccctttatattatgactcccttgtactcccttgcatttattctgcacttgtgggtgtgtcttgttgagtatggtggttgtactcagtcttgctcaatttttcccaaacccagaagaggagcccctgtatgatgaaggctttggtgtctagctcgtgcctgccgtcaagcgcctgtggtcgtcgccctagtcttccgctgttttccgttcgtctttgtgtgtgctgggccttcgccgcccatataataaattatctatttactcttccgcttgttaaactctgaactgtatcaacttttggtgtaccttgccttctgggacaaggaataatgcacgcacgtaaggaacgcccgttgggttatttccggtcgtgacattagggcacccacaatggttatctataggctctctacaagagatccatgtcagcatattttcctacttggaagagattaaatgaagagaaagagagcaaagctatctactaacctggaaatagtctatagagaaaaacgaggtaatggattagagagctatagatacccatgtagacataccattgaagtggtttactattaatctagtctattgctgagatgtacatgttttatagatagcatcttactttaccattgcgggtgctctaatagtaggaagtgggctatattattatccttgctctgagaatgtttttcaatcaacgtttgaccattcattttattcaaaattttccgttagctgcgccagcatccagcgcagaccggagaagccgacggcgagtatgagccttgctggcggcgaggtatccggcgccgtcctcctcacacaattgtgtagcgcagctgccatctgcgtggcgggatggttggtgccattgccggcagccggccaggtggcgaggtcgggaacatggaagcaatgctgctccatcgatttattcctcagatcagcagcatcgtcgcagcaaatgcgtcgacagatgagctgcaggttgatcagtgatcagcaaaagcagcaggaggaggaggacgtggtggtcgtcgatcgacgacaatctttgttgtcgctgcggccgcgaagacgtgatatcggctgaactgctgatgatcaagaacctgcagtgccggttggaggagaccatgctcggcatcatccgtcacgacaacatcgtcgtcctccggggttccatccagagtgacgacgacgacggcacggtccagctcgtgtacgaggacatggagaacggctgctgcctccacgaatggctgcacggcaaccgccgatcccagctggaggccggcgagaggcagcggcggcggcggctgagatggcgggcgcggcggtccatcgccgtcgacgtggccagagcaatctgctacctgcaccacgattgcaaaagccccatcatccaccgcgacatcaagccgaccaacattttgctcgacggcaacctcaaagccaagatagctggtttcggtcttgcacggatcaatgttgctgggctcaaccaaccgttactcaacgtagaaattcctagcgaggcctttgggtatactgctccaggtgaggtgatctttaatgcacgatcaattccgatattttttaaaaaaaaacagaaatagattctactttatcataaacataattaaaggcaccatgattaaatcattatttaggtctggtacaactcaaaatccaaggtttcttatagctaaatattcatagctacataaatttgttgatttagtccatgcatgattacgttgataacattagataaatcgttttatttttattttagataaaatttgtaattttaaaccactataatttactatggatttgggatttgaagttgtgctaaacatgactttaccatttatttgtaattcactacatatatattgacatgtttttttccctacagagtatgcaaccgcgcaggtaaatgagaaggtggacgtgtacagctttggtgtggtgcttctgagctcgtcacgggaagattgggtaacgagccaggcgtaaataatgggcacttggctatgtgggcgcatagagggtacggtcgacatctcagcaaggacgtcgttgataaggagatcgtccctgatatggcacgatacttgaaggagatgaaggccatgttcaagctcggtgtggagtgcaccgctatggacccacgggagaggccgtccatgctgacggttcttcgtcgcctcaccaagcttggttccgtatatgtcagttgtttcaattcatgtgataattaactatagtggggatggcttgtatgtagtgcttccttcagtcattaatatataacattttttttctatttgtaagtactactcactttgcccaaaatataagaacctattatgatgagatattttctagtagatttatagtattagaaaatgtcttatatttattctatttttttatattataggatagagcgagtatatgactccgcacttcgtctaggttaattaaatagcgcgactcatagccctaccccgtttgccactgtgctagcgtaattatttcaccatcaagtacacaatgaagaacgatctcaaaatggccggcgtattaagttttcaagtctatctgtaatctgtcgatgaactttctcaatgcacgagtcatggaatgagtacggagcgccagtcggtcaatgaccgaattgttatacattctgtcattatgatattattatatttgtaagagctccaacggttagcctaataagtcaaagcaaaagttaaaatttaaaattttaaacttgattttgaagttggttttaaaatattttcaacgtaatttctttttagcgttaggtttttagtcgctacgaacaaatatacaaaagttttatctataaattaatttgtattctctaataagtcgttttagcttataagggagtatgtgccaccggtgaggctctaatattgtagtcttagtctttagacctatcttctatctttgtcggctctagctagtttctgcttgttctttacatttacgtttctttgggaagtttcattcatggatacaccaatatatgcttgggtattatcgatctacctaacgaacaaatcaaggtttgcaatctcgaagtttggtttttttcgcgtgggggtgggggggggaagaaatttcttagccgaaattatttgaaaatttgacgaatgttgaatgattttgaaggaactttaaccaaattcgaaaaaaaaatggataacaaccgaaaattttagacgagatttgtgcttgccgttgatcggtggagggcgaaatttcgtttcgaaattgcaaatcactggaacaaacacttggttcttgttcgtcggagtataaccctctggacgtgctttctagtctgttgtgtcagtatcagattgcaaatcgtaaaatgatatcattgaagagcatcagccagaagatcaatacaaactgatcaattatttaagtggaaatatctgtcaagctgtactgtccttgcgtagttgtgtattatcgaagaccttgaccaatatagcccctaaacacacggtaaagactagacaccaagcttcaagtctgcagtagcgtactgcatacgtacactgattaattagtgatcatcaactgagagattctcactcactctccaagtcacagcctcactgagtactcattaaacaagcaatcaccactcgtaaaggctaacgaaaaatgtccaataataatactagtaatattttattactactgctcctcttcttcttggggtccggtgctgagctcgatgacggcggcgagctccaaacacttctaaccatcaagagagattggggtagccctgctgcactcagctcatggaagtgagaaactccagttctttcagtcactgtaattgggcaggaattggttgtagaaatggccaggttacatccctctccttccacaacttccaaatagccaatctaatcccagcttctatttgtagcctcaagaacctgaagtacttagacctctctttcaacaatctcaccggtgagttccctacggcgctctacagttgctcagctttgcagttccttgacctgtccaacaatgagttcactggcaaacttccggaacatgttgacaagctgtccttggggatgcagcacctcaacctgtcaagaaattctttcatcggcgacctgccatcggctattggtcggttttccaagctcaagtcgctggtgcttgacagtaacaatttcaatgggacctatcagggtgctgccattggaggtctcgtggagcttgagatgctaacattggcatataatccgttcaaggctagtctaattccaaacgagtttggcaagctgactaagctgacatatctgtggctatcatggatgaacctgattggtaacatccctaatgttctgtcagcattgacagagctcgagctattggacatatcaataaataagttggaaggaaaaaatcccaaagtggatatggaagcttcagaagctcgagatgttgttcctctccggaaacaatttcattggtgagattggttctgacatctcagctctcaaattgcaggagcttgatttgtccatcaacaagctcaccggatcaataccagaagatattgtgaacttgaagaacttgaaaattctatacttgtactacaacaacctcgttggacaaatcccaagtggtgttggaatgctgccgaatcttaccgaccttcggctattcacgtgccatggagtgtttccggtgagcctcggggactgcgacaccatccacattatcaaggcatccaacaaccactttgttggggacttcccagagaaaatatggtcgtgtgcgatgcttaccatagttatgattggaggaaacaacttcaccggtactctgccaagttagatatcatccaacatctcgtagatttagataggaaacaataggttctctggtgcaattccaacatcttctgcaactggactccatagatttttagcgaaaaataatttgttctctggcatgctacctccagacatgtccaagctcgccaaccttgtcaggctggatctttctaggaaccaactatctggattgattccaacatattgttaaacacaaaaccacctgagtattttatatgttactctgtattttgcatgttagttcaaggccagagaggcagagatgcacacacacattcatatcaagctccatctactttattcgtcgtagccttgtaggagctatggtgtgtgggcaatggtattgagtggctaatgtgcatcgtggcctacgtctatgttttttttcttttaagaataaaggtaataaagacctagctttttattgaaagccatctagattttgctggggttacctgcttaacatgatcacatgtttaggggatgataatctgactactcgcttacaccctaaacaggtatgcaaaactcaaataacatgttccatatatgaaagcaaaattggctgtgtacaactgtacaaccgctctatggatgtagagtctggtttcaatccatctcatcataaaaaaaaatgaaagctaattaagaggtagaaacaacagagctagctataagcaggagtgcaggagcctcccctgtgaggtatgtactggagtacctagcaaaaagaacacctaccagaactactttgataaatgcaaacagtgatgctattgtcgtttgaacatgactgataagtgtctctaggacagggttttcaattttgatttcggctaaaatttcggccatttttatagaaccgaaatttaggttttattggctgaaattttctaaaattttgattaaattcacaaaaaaattgagaaaacccgaaaatatcgaccgagatattgacttgccgagagggttttcgaaagagagaatccattatatgccactgactttatcacaggtctatgatataccattgattttgttacgttttacaatatatcatcgacttttgcttaacttctacgatttaccatcgccatcgacttttgcttaacttttatgttcactgagttagtctccgttagtactgtacaaatttatcgaaatgaccaaaatacccctgggacagaaactttcaaaaattttgaaatatcggattttaagtttttgccaaattttggatatttacaatcttatgtttataatatgatattttagaatttttattcaaatttcggaagtttttttctaggagtattttggtcatttgggcaaaattgtacggtgctaatggaggataaccggacggcgatggtaaatcgtagaatttaagcaaaaatcggtggcatattgtagaatgtgataaagtcagtggcaactcatagatctgtaataaactcagtggcatataatagattctctctttccgaaattaccagaatttcggaaattttgaaactaaaattacaatccctgctccagggctgcattgttcataaggatgtagtacgtcgtagcatcttccactgcaagagtaaagacatgattcgaaagacaacaattagcgacgtgtccattttgcagctttatcggtctataaaattattaagggtgagtaatgctgtgaaaatcaaaattttatagtataaatgtatggacggattaactggtatgaacacgtcctcggccccaaggcccaacagcccaaggctaacattctgtcttggcccattacgcctactttccattgctgtcaagatattcttatggaacttgtcgagaaaacagaaagaaatcagtccagcaaacgcaacaggcagcattatatatcagccttgctaataataaacggcatcaattgtctctaattacagaaataccggctcgggttacaattatctatttatagccagcatcaattacgataattaacattatctaaaaaaattgcgataattaacactattcacgaggcctctatataaatagatcatctactcgtccagtacgagagcctgcagattatattcttctctaaaagatcatcgagccctgcaaaaatcagaccacaaataatggagatgaagaacgtcgattctcggttgctgtttctgctgctgctgatcatcggatgcgctgctgttcctgcagtgcaatgtaagggcaatcctaattagaaattatcgactctgggctacggcgggagccaaacgcctagtgcagatattgccttagtgtctattcgatctttgtaaatattaccttttctccttacatgtaaatattgctccctgctttattcaatgaatggcaagcattgccgtcgttcaaaaaaaaaactatatactcagcgggtgtggttggttcaacataaactctcatccaatcacctctcttatctctcctttttttttatctattgttttcattcttgatttatgtgtagaggtagtttcttactaatgatttcttcatcttttttcatctctcctcattaactttttagatacctcggtttttgttttacatgaaaatgcatttaacactataaaaattagatgagatggaacgttgagtgcccttagtttatctccacatatattgttaattgactttgtttcttttggtggaggtgaacttaatgattcgaaaaggatctcttagcatgaacacctaataaatcttatgcaaaatagggtagaacaaagggtggattattgaccagaattgttgatgccattaattgttcgtggttcaaaagcctctgttgatgtaggtgttagtgtagtgcagattcacctgcagcagaaaactcaacgccaaaatggattagcactggtgcatgtggaccttaattaagatcgatggcgtatgtatatggttttgggggtggcttaaatcaaagtccaaacatctttttaattagtctcgagaatactgatcaatatatatacagaaaattccttaggttcctcggagttttcaattaaatttttcccctaaattttgtttcgttccttacgtgtctgagttcttgattattttggattccaatttccaatccgtgcattctaaacccttgaagcccagacaccttaaagcaccatatgaccgtcctatatacatctagctagtcgactgcgagttaaccgttagactcttttagaaataataattagcatacttcctctgttttatattataagactttctagcattgtctacattcatatagatgtttgctataaaa

SEQ ID NO: 82853 - DNA, 1558 bp, Oryza sativa
tgtgtgtttcttttgggacgcaaagctctcgctcgcggggagcttactgtgtaagcaacatgccgcgttgattgcgccttcttttcccttgggaaaaagaggccgaatcgtcgtcttctttcgcttgctttttggcaaggatgctggattgctggccacctcacttcgaaataataaaaacaaagtaggagtagtaaggtagacggtaaaaaaaaaaaaagaaaagaaacttcgacgcacatctggccatgtgaaacaaagaagaaataaaagcaaaaaattccgttgccgggactcgaacccgggtctctcgggtgagagccgagtatcctaaccagctagactacaacggatgctggtatctattcctgcattatacaaattaaccatggcctgatctgatccaaaccataaacacgggtcgggccgtacatccagctgatgcattatgggctgcacgcacactcgtcacagtaggaaaaggttaaattgaggtccctcatcttgtcatcttgtcggtgagtttcaaaatcgtctctcaactataataccatatataacttatccctaatctttcaaggtatcagcgtcgtgttacgacccgacgcgccgaacacctgcaggatggacaccccgtcgtgcccgatggcacgtacccgtatgcctcgaattgccacaccccagaagtgtacgtcttctgctcgaaacaacaaataaaatataataatcacaaaattttcaagaaatcaaagacgatgaaattcacagcatggaatttagcccccattgttcctcgaaaaaaaaatagcccccattcgttttaaactgtggaggacggatggtagattattctggttttgttacaattatttaagggcacaaatgagtgaattaacattgaacatataaagtattccaagaaatctgtatatatagttttttctttagaaaaaaaatgccctacccaccgaataaggtgctgtcaaatttagaaatggctccaaaactaatctttaaccataaatctctcacatatataaaataaatttctcatatattataatgtttataagaaaaatcgtaatcataggaaattaaattaaaatgtcaacccaataatattaattgcatcaaataaaatttaatttataataaaataattattggccaaatgtttaaagcgttgaatattaaaatgcgcgcgccttgttcagtggaacgaatggaagcgcggaggaacgaaacggtctccatggcgcagttgtcggaagagttccatgcctagctggctgctagtcaatcggtgaaggggaaggctagggacacgttatatatgatactagctgaaaccccgcacattgctgcgaaaatttagtatgataacaataaaaaaataatgtgtaagatagctagataatatcagattaagtaaatcaatatggtttatgataatttaaatttaaatagtatgtagaatggtgattcaaacgtaaaaagtaaggtggtatgactttatagaagaagaaaagtagggagatagtttgtaccgtagattatt

SEQ ID NO: 82854 - DNA, 935 bp, Oryza sativa
gagtaccgcaactccggccccggcgcggcggtcggcgggcgcgtaccatggccgggccaccgcgtcatcaagctgccggaggaggccatggagttcaccgtcgggaggttcatcggcggctactcctggctgccgcccaccggcgtcgccttcgtagccggcctgaccgtgtgaggcgactctcactgactcatggtagcttaagccaataagttgcatttgctaattgggagataggtggtagtaaaagtaggtgtaatttttcaagtatgatgtaatcatctacacatgctaactgattcaggaaaattatgattaatgattagtttgtaggcttgaatttggattgagaaatgagaattctgaattgggcacaaaaacaccatgaatgtgaatgaataaacctgtgaaatattatacaataacgatattttttgcaatgttggtgtaatgagaaaataaattgtttgtccaactacttggtccctgcaagcaatgagagtgcagatgaaaatagtgtactagctagtaccctggaaataaaatatgccaaccaaaaagctccttttggttgtcacttaggctgctcacaatatcacagtgagaatatatgcttttctttgcattggatttccaggaaatagtacctgctagatgggtgtggggcttaccactagaagatcgaaagaaccaaaagctagcataaagagagaatatcagagagtggcttataattgatgggctattgccactaaattcctggcacaaattcttagctaaaatatcgtgtatttgtgctccttatcttgtatgtaggggaataattgtgtatttgtgttcgacaatcttcagctattttttcccggcaaagcagtagcattgtatcgttatcaacaatgacaactgataaaatctaaacataaacaattggatcc

SEQ ID NO: 82855 - DNA, 1428 bp, Oryza sativa
catcatcttttttcccccaaaaccttgataaaacctggagcggcctccaatccttcacaaaccaaacaaattgaagcattggagcccgatccggattggaggtggccgcggccatgttacggaccaccggagcggctgccggaatggcggattaccagtggccggccggtgtcggtgaagcggcggcggccggtgcatgattgcacatgcacgcacgcacacaccgatctggcaacgaacaagctaagcactcgccgagtcgccggcacgagcggatgggagtaatgcgataccacatcaccatttactcctattgccctattggcatcacatccataggttcaggcccctttgattcaaaagaaattcatatgaggctgtgtttagatccaaagtttggatccaaactttagtccttttccatcacatcaatctgtcatacacaacttttcagtcacatcatctccaatttcaaccaaaatccaaactttacgctgaactaaacacagcctgaatttcagagaattttattcctataggattttttcctatatagccctttgaatcaaaggaatggatcctatggaatcctatgaaattcctatggattgtcttttcctatgcaagttttgcaggaaatttaacatgaggtagaacctcatggaaagaatactttgagtctttatctctccttaaattcctgtgtttttcctgcggcccaatcaaacaatcattcatatgtttttcctgtgttttgatttcctctgttttacacttgcattcctgtcagaatcctatgtttttcctatttctccgttttttcattcctgtaattcaatggggcccttatccttttctatttgcttcggttgcacattttttttaattacacattaaagcgcacacatactcattcttatgaacatgcgtacataaaaccctatcgtgtctgatcacaattttgagttttccattgcgaattgtatgagttcccttcgtagtttaaaatcggtgtgtaaatgactaaatgcacaccaaatccagtcgacacacccaaaacttggcaatatgaaaatcaccgaaattacaaaaaaaaaaggtgaattccgaagcaaagagtggccagtgtgaaactaactcagcgaacactctcctcacagctataaattctatgcttcacttgtctcgcttttgctccacttacaccaacagagatttgcgagtagattttgcatggcccatgccacgctcggctcgcctgagccggcggcaaagcctcggctccggtgcgccgacggccgccaccgccgccgccttatcgtcgtcctgtgcatcgtcggcgtggcgctcgccgtcggcgtcgccgtggcggtggcgatcgccgtcttggggaggtcgaggatgacgtcgtcgtccggcggtggccgg

SEQ ID NO: 82856 - DNA, 2350 bp, Oryza sativa
attagtagaacctattagtatatcatttttttaaaataaatattgaattccgcatatgtgatccttgttcaaaaaatgtttcaagaaaaaccatggaggtgttagcatgctgggggcaagaataacctagtgttaacctttatatcttatgtcccatattctaatcttgtacggagtactaatggacttcaatttaggtggtgggcattttattttgccaatgttcggtgagtgatgccgagatgcatattgaattgtgcgtgatatgtcatatgtgttctaaattattgccttttatgaataatattgcatatcgtgtgtatctcaatgtgaagttatcaaatttataggaaaagggattatccaatttttttagcattttttgactactttctacatttttaggaaacaaaaataaattggaaatttctcatcggtttctcgacataatcgattggttttcgatacgaaccaattgatattttcactttgcttgcactttcaattgccgatcggaattttaatgtttatgtttgacatttggatagagtcgataggatttcgacacatgaccgatccactttgcttgcactttcaattgctgatccgaattttaatgtttatgttcgatatctcggtagagtcgacaggatttcgacacatgaccgaacaaaaccgataatttgaatttaaatttttggctacaaaatttgttcggaatctgtctcgatcggatctggcagcatactgccagcgtccggcatggaaggtgtttctgaattgtgaaccctggtggcggtggccccgcgaggcgagaaaggccgggtctcagtctctacgagcttgtgttttgggtggatccacacaggagtagataggttcttccggcccgagttcgcagcgggcgcgggggcgcaccgcatgccccgcgggaaaactaattactgtctgacgtccgatacaatcacaaatatcgaacgcctccactcaatgttagtagtacatgtgttatactgtgatttttttttcttgtgctcaggtgcacctacgggtgatgtatacgcttataacaactttattttaaaactttaaacaactttttttttctgttttacttatctggtcaataatttgatcgtactatttgattcgttacaattaaatctttacaacaagacctcactcgattatattctgattattttttaaaacttattttttaatgttgcgcatagttttactcagttgtttcaataagtatttcttagtgtttcactattccatttataaatgttacacatatttttcccacagtctaaaaaatgttttagcaaattaattattcttgtgaatatattatgtttcacatgacttttttaatgtttcattagttaggactaaatgtttcatgcagtaattgtcgatgttgcagtcagtattatcgaaatgttgcatctctttgaaacacatttaattacatgatgaaacaatttttctataaggggtgaaacaacgctcgattttttatcaaaatataaccatatgagatcttgttgctaagatttaatctattatattattaaaacagctttgaaaggaggcaccacgttcgttgtgagagctagaaattcccacattaataggataaaaagaaaaaaaaagaaaagaagagtccaagtagaagtacaatttaaaaatagttcaaattcggaattaaaactaagcaatattgaaagaagtttctatataagaacccaatacgagatcaatcaaaattcgaaataaaactaaaataaaatccaaaattataaaaggaaagaagagtccaagtagaaatacaatttaaaaatagctgaaattcgaaattaaaaataagcaatattgaaagaagtttccatataagaacctaatacgagattaatcaaaattcaaaaaataaaataaaatccaaaattagaaaaggaaatgggagtccaagtagaaatacaatttaaaatagctgaaattcggaattaaaaataaagaatattaaaagaagagtccatataataacccaatacgagattaattaaaattcgaaataaaaataaataaatccgaaattagcaaaagaaaataaaagaagagttcaagtaggaattcaatttaaaattagctgaaattcggaattaaaaataagcaatagtgaaagaaaaatccatataaaaacccaatacgagattaattaaaatttagaataaaaaataaaataatatctaaaattagaaaaattaaaagagagttcaagtaggaatacaattttgaaacaactaaaattgaaaataaaaaataaaaacattaaaagaacaca

SEQ ID NO: 82857 - DNA, 6686 bp, Oryza sativa
gtcatgttgatgtgtcttttcctccatttgcaggcatttttgtactccttgaagtatagtatacctcttgttgcataccatgaggaacaatgtttgaccctctttgaacatcctttggttgatttgttgcacacaatccactatgagaccaaggtctgatctaaagatatttgctacgcaaacttatcttttcttcctttttaacaatggtcggcagctgagtaaatgttaaattctcttcataggtaaaagtggtgccttcagttgaggacctcttggggtattcatcttttcaggtttgtctatccgtaactttggcatgcaaaagtttacatatcatatctgttaaggatagtatgcctttctaccttactgtgaaatgcattagtatatattagttgaacaatttttgaagtaacactgcgatgtggtaaaagagcagctgttgctgggaacttgtgatatagcatgaggacccttccaaaatagacagaattgtagttgaattatccacattatcgtcacgactcgagtccatgactggataaccactgccggaactagcaatagcggtagagctgctattttctgaaagcctttctctattagcattctggaatacagacaaaaatcttccattctaatcactgcagccactcaaccagtagtgttaaatgtagtaattcctgatgtatgctcccttcttggctgtccaacataaaaataaatccataaaaagttaagctaacccataggagggcttacacaaatctcttgaagatggggtttctagaatatggctagaaaactactccctccgtttcacaatataagtcattctagtattttccacattcatattgatgctaatgaatttagataaatatatgtctagattcattaacatcaatattaatgtgggaaatactagaatgacttacattgtgaaacggaggaagtactatttaacaatcctcggtgaatcttcagtaagtcaaccagatagatatttagaccagttttatttggattggagttacacaatttatttgcacgtgcagaagttgcttttccttgacaaagtggatggggattcatctgtactgagacagcattggtcagaactaacacaaggaagagcacgtgttatcaaagcgcattcaagtatgattgagattgttccacttaatgcttcaaagggtggtggtataaggattttacttgatcatcttggaataactgaagatgtatgtatctgtttccatcaaagaaagcatttacctttttcattttgtgcgtaattttgctctctagattgtgctctcttagaagggaacatcgccgctaacaatatttttttttcttttacaaaattgtttctcctatgcagtctgatcttgatgctgtgggagactacacaagatggctaagcaacatatttacttaaccattcttaagcaaaagcttggtgataagcttgagataagaagaaatgacatgcatatgtgatgcacaaaaaggaaaacaaacaaggattccacattggacatgtctattttgaagcatgtaagaaaacaaacttcataccaccgtccttttgggctggaagagaaattactgtacccttaaacttttgaaagggatatgggtgtggatggaaagtttgctacttccttcaggtaatgtatttttttaaatttagattacgttactctatttacattggattgtgtgagaaccatttgtccttttgtttaaatttaaatagcatgaaactcatccttttgttgttcacacttcacagatctcatttatggaggtgtgttggaaataaaatcagaccagcccatctgtgatgtcaagaaaacaaacatcaagaaagtgcaatttgcaactagtgaaaattttatgtgagactattagtgttcctttgctctgagcaaacgtgtcaaattcatgccaattttgtttttctgtagaatacctgtatagctgcgctgcacaaagcattgctagttgttgctcgatcatgtaatgcaagagtactctagttcccagctgataggattttgcttattagctagctgtatttcattccacccgtttttagtagttgaatttcaaatggatggacttaaggaaatgtaagaagccaggttgatcccagaagaaaaaaaatagttgagtttccttgtgaaaaggagcagtacaagcgcagcacaacatgttagctgaaactggatacctgaaaccctagtacttgtttgtttccactttccagggtcatattttttgttacgagttaatatgcatttgtacatctttcttgctctggtgtgtaggtggtttagcactgctgcacaggaggctggtgctgcttggtcttgacagcagacaggtaaatgatcctttcgagggcctcttcgctatcatcttgttgcatggctttggcaagtgatttgatcgttgattcatgtctagtcctgctgcatagcttttgcacgccttcatcctcttattgtaggtaattttctttgcaaggtcctgaacacatgtagcatcagatatcgatgtgaatgattgggattttccttggtaatagttggacagccctctcctgcagaaaacaaatttacttgttagaaaacatatgatttagtgtcaattttgcaattgaagtagattttatggaagtggtctggaacgtttgatcttttaatatcgacattattttctccagtcatttcgtcttttgaacaaaatgttcaaataagacctgatgctgcatacatacatagatcaagcccaatttgaacattttgcttgtcataaatgttatgcaaaatagaatctctacaatttagcaggtaggcaatatcattaaaattcaaccaacaaatctgaaaagctgttcggagaaaatcattgtctagttgaaaaaatgaactagctagtagctactatatcatttgcaaatgtgttcattcaactaatatagtttacagtagtcaggtgataaatccttgtttgctggcacaaattgggaacacaagcaacaaatttcacaccgttaaagcatctaccgaaacttgaaattcatataagcatggtgcaattttctctaactacgagtacttctgcaggggaggagcaaagcacctgataggaagctgggctatcagtgaggacaagtcacagagcggcccttcagaatccagctgcaatgtgctcgaagatgctgatgacgacgacgatgacggctcaagataatcaccaggacggtaagaactcccatcatcactcagatccgatgccgatgagcacgacgacccgatggacgaacccgagaaggaaccatcttcagatcgatcatcactttgctctatgcaggcctcctcatgagccccaggaggcaccggcgcgcaagcttctctcattcttccaggagcaaatggctgcttatctcctgtgtatttttggactccagattttggaaggcaaaggcaagtatccaagttaagttcccctctcttccccatgtgcatatatgtagtagacgcaaggaagagatagggtgaaataaaaaaaataaaactaaaaaagaaacagccgttccggtgggctgatggggtcatggatagatacataggtttcctgtatattcagatagggttcatggactctggcgccgaaaagtaagccgaagctatcctcaagttccttgctccatcaggtcttctagacaggctggtgataaacacgccatatattattacatagttattacttattaatgtagatagataaagtaaaaacatatttatcatgcaatcacatattgagagaattttgctttataagttagatgcatctacatgtggtagtagtgtgtgagttataggggagcatgtgaaaacgatgaggataaacttacttatgggggttgagatgagcatcttatctgatctgtttatccttgaggattaggatagataaggtaaattacggtggcgagaaggtggtgtcggctaaggcatgcagctggagattggtatgcctgcttgtctacggagttgattatgctaatttgagtgtcggattaggttgtttattattgtggtctctggtaaggtggttacatggttgcagccagtcagcttcgatatcggtcaagtcgtgttgtttattttcttttttgttaatggaactgtgaaagcaaccccttgttgctccctttcatccctacacgttcccatgaatgcttccttcctgttcctgttcctggaggtttggcctgatcatgttacttgcaagtctcctccattacgtttttttcttcttcttttggtgaagctactgtttcataaggtgaaaattgttctccagtctccagtgagataaacgcactgttcttctgatcttctctggagaaaaatatttctccctttttaagacttaattaactcgattttttgaccgacacgtcacttcacttgaattccgcaggttccactacgatttgtattgagatccacgaagaaaattaccagaataagattctaatttggttagctcacggtaagaacagttgtgttgcgtgctttaccttctcatgatgtgccgtatgatcgcaaaaatgaacgggttacatttgcacacatctcatgagagtgattctcacgtcaaaggttaaccacgtgaaattcttaaatccattaccattagttatacgatgcttgtcttgtcagcagcaaagctacaaaaaaaaagaatgcattttatatgccgtttccctgataaacccatgtattaccaaacaagaattccacttgtaatgcccgaaagacttgctaccctttcaactttttcttgcaagcttagaacggaggagtcggatagggatggataaagagggaagaacacttcactacacctcgctctcttcattcagtagcctaaaaatcaagcaagcagggaagaaaaaaggcatcactgtgcttttgtatgcagcacaagtgaactggatatgttctaaatttttagtggtacgtaccacgtacgtcgtctgttcttgcgttacaaagatcagaacctgttttgtgttgtttcaacctgcagaaacaaagaaacagaacagatgcgaccactcctcttgacaccgaagccgtgatctatcataccttgcccaagcttcagttatttatatatctttatcactagagctgatctaaccctccaaactgataataacttcacagtatcaccacttgtcacaaggaagaacacaaaatgatgaaccgggggcacagcatagctgttcacatgggcttaaaagagcattacatttccatcttttattcaacttcaaattggaaccaaactggattcactggtctaaaaggcaacagccctagtctttacaatgcgaggttaggttttcatataaggaattaagattaaaacataaaaattgctgattcattgcagtacacgtccaatcatccatggatgaacggaataatagagatggattcctattgctcccatcaacctcgcctgctatcgaagaaatggataatcagtacaacgttctcatatgtacagttgcgcatcaggttgacctgtcaatcttcccaatggtgttctgtcttgcgttccgtagaatggccttatcagcagtgatgaagaagccagcgatgcatgctgtaaaataaacaggaagacatgtaaggtttccagtgtggtcttcaattcaattttgttctgcacatgaatgccaatataagaaaatggggtcataaagtctgtattgaaaagaaactacagaaacagaatctagtagtgaaagctagattgttatatgcctaaacttaaaataatggtcagaatcataacaacatgttaacttccacggttccatactgcgtatatcctcgtagctagttcctactgtgcatatccttgtgaggcaaatgctaccaaagctcattggaacaagctgaaatcattcaatgtcattaacagggataaatccaccaaaacaactgctaaagttagtgattatcatatgcgactcatgaattaggacatattgaacagaagaatgtaaaaagatgcaagtggtcgctaatcagtaattgctcaggtacttcacttcaacagacagaaatactggcaagcttcatttactgtcagtagtcagtagtcaatactaagcagaatatctctgcagcatcttgttcagtactaaaatttaatgggaatcctatcctagaatctgatgagggcatgagggatgaggctattgaaagataaaaattccaaattaaaataaaatagagaaggccaggctgtgagctggtgacaccagttaaacttgagccagcaccatttttcattttccctagaacctgataatgaaatgcttgaagtgcaatacagtaacacaatcaaccttagacttgactttacattttataaaggtctaatttcttgcatgtcccaagaaacaagccaaatcatgcatgagaaacaagccaaatcatgcatgtcctaaatcctaagaaatacgccaaatctgtattgtactccctccgtttcgaaatgtttgacaccgttgactttttagcacatgtttgaccatttgtcttattcaaaaacttttgtgagatatgtaaaattatatg

SEQ ID NO: 82858 - DNA, 5199 bp, Oryza sativa
ccaaccgggactaaagatcccgggggggcctgacaggtcctgacagcattcgaaccgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctacttaaacaaattatagctagccattaaatccttcacatatttagcacatatatataacaccttatgtattatgtataatcgcaattccacatcacctactgtcaaacttaaaatttgccactcacaatttatgacacgtgagttttcatctatatataacatgtgagtccagtgatgaattcttaattgtcacttgtaagagtagcaaatagttaaatatctcctgtaaaaagcattgcaagtttactgcctaccaaaatttggtaacaccaaaaattaatagtgctacaagtggtagtaaagtgaacaaagccctgagtcttattagcacattctgagctcattcgagctcgtctcgttgacagccctaccgttagcccacatctttgttttttttttcattttaataataaaggttataaagacatagctttaaattgaagggtcaatttgatctatgctactgtaaatttggctattcagaaaaatactattataattcgcctattcataaccatgccactggaattttacaaaattaaaaccgtgccactgccgtcacattttccatccattctcttccttttccgtcttcttccttccttctcccatcatcttcccggagtcaagccggagagggagcttgctggcaaggtgaacgaacccaacctagagcgtggcgcggatcctggcgttggtctcctgcagggtgcggtcaagcagctcgacacgctcccgcagctcttcatgggactccctcagccgagccacctcccatagctcgctctatcaggcgcgactggcaaatccagcggtgggcacgaccgacgaatccggtggtggcggtgtcggacgatagtggcgtcgggcggaaccggcggaagcctaggctgcgcgtcgagagtgaccggcggcgtgaccctcttcttccccatcgctgctcgacctcggctcccgctttggcctccaggtcggtgagcacctcacgccggccgctgtccctcacggcggtgttctccctgctctcctcgtccgcaggcctctccaaatgcctcctcgccgcctgccgcgagcgccgcaagcggcaggacacctctccaccgtctttaagtcttcgtcgccaccgtcaggcctgctcgcgccatgccgtgccagatccaccgacgcttgctccaccaccgaagctgtcgaagctcgcggcggccatggatggatggacgaccgccggtggcatcgccgctaccgctcccgcgcgagatctcgcgtgcttgggtctcgctgctgactactctgagcttgccagcttggctctcggaagaaatgcgagaaagaaggagccgccactgccgtgacgcggttctatttttgtaaaattccagtggcacagttacgaatagacgaattgtaatgatatttttctgaatagccaaatttgcaatggcatggatcaaagtaaccctaaattgaaagccatccagattttgcattttgctgcgtttaccagctgaacatgatagcaccatatatttaggggatgataatctagctacacggttacaccctagctaggtaggtaaaattcaactaacatgtccgatatatgaaagctaaattggctatgcacatgagcacatccactctgtggatgtagaggatgggctattatagtttcatgaatagtgatgctattgtcatttgaagatcagtaatgctattgtcgtagggatgagcatccgtaattagtgccctaaagatataggctaactctcttataaaatattatgccttaatatcgtatcaagtttggatattctatggcattctttcgtgtttagctaccactatattgattttgtaacccgttttatttttttagataatggattaaataaaacctggcctctatatcctgaaggatgtacacaaccatagtattacatcatcaagcacttaggcttacaaacaggttcaaaagcaaacgatgccgtaggaggcgaatggacgacaaagacatccagaacaagtctcacaacaaaagattttatctaacacaattcaatcttcctcttcaattccacctagattttgagtagaattccataatgataactttcaattttaggcacccaatctttaaagctttctcatcaccttctttaagaagcaaagaccactggcgagcccgatgcgttaccctgaaaataacctgcaagagagagttaatacttgagccatttaagactacatcattactagcaagccaaagtgaccaatagatattgaatatcggtttaccgccctattgtttttttatactttctgtgcgccaggaccacacaaaaagatagtaatactcacagcatctatactacgttctttatatatgcagcacaccttgaaccacttaattcctactccggtatatacggagtacatataaataattggtgtcaatgtgtcatgcaccagcgcctgaaatcacggagaatagacatcgatgcttcctgacaaaacttcactccatttgttcactgaaccatacacatatagacacctagttgtataaaaatatatctcacgcgttactaatttatgtgtataaatacaaggcatatatacagccctgacgatcgaagcacgtacactactcgatccagcacatcatcatcatatcgatgaattttctgccaattgatcaaagcggagccgataatcaggggcggaaatggcacccccttattgccgtcgtcctcgtcgtcttggcctccgcggccgcttcactacctctgtaagcacctctgagacacttggcagatatatcttgagattgtcaaagtcgtcagggacgtcttgttgtcacccgtatatactgtctataaccgaaagaataattagccatgagaaaaattaaaatccaatcccatcatactaggaattaatagcatatgcacgcgaggatgagagcaagtataatagtgatctataagcttactataagcttatgtggaggaaagagataaacaaaagagaatggtgttggctctcatgcaagagctaacttaacacaagctccaagacaaatagattaaatgtatgagtgagagatagagatagaagaagaaaattataggtaaccttatagctaatctattatatgtgttgactttagtataggttaggggcgcgggcgccgcctcccgccggctgcgccggcttggctgccctcgggcgtgccgagtggctgctgcgtggggcccggccgtcagccgcccacgcccttaggtgcggctgacgcgtgggacccacggcgctggccggtgcgagcccgggtgcgcccggtccaccgtggaccgtgaggctgccgcgtgggccccactcccgtggacccggtccgcgcgccccctcccctcggctcacgcaataaaccctttttaaattaaaatttaaatgaagaaattcgcaaatattcatttaaagagcatataaacttcaaatagccataacttggccatttgaactcggaattggaccgttcaagtctctaatttttccttaagaagtcaagaacccatttttgtgctttgtttctgcttgttatatggagtttattagagtaaaagccttttcttttccgttggtcgtgtagacgctgcagcttcggaagatccgctcttcgtggaagttgaagccgacgtttgggaaagcgagcaaggcaagtcacatcatccttgaacatattgaatcccagtttataaaattattttgatttaaattattgcattaccgctttgtttaaattcccgcgttatcactgttttatttagccatgcctatttacctttgttatgaccttattattattgttattgttattattaccttgttcaccctagaataaacaaaacaccaactagtggacactctactcatggtaccactagtatgattttaggtagatgcttcgctggttaattatgcaacattaggtggttttacaactctagactttgggaatattcatatcacctggacactatggaatggttggattattgtggaattggattcacacctccccctctattcaaaaccctcaaaatggttttaggctgggctcggggtgcatggttttgacagtagcacctcggccatataaggaccggtcatcgggcctctgttgcaaagcactaccgtacttccacatgtctagtgggtaaggcttagtttgtgtgtcgcgtcccaaaacgactctaaaatacatcctcaaaattatgcatagaataagtaaaatccatgtgaaagcctccaacaattaaaatgtgcaaagttaaaagtcaaataaggtttggaggatttttgtatatttcctaaaagcctaaaatgcgtaaataaattttagtggaattttcagagcacaaataataattattaagaaataaacaaagttaaaaaggttttataaaaagaaaaaccctaaaaagtcctttttccccccttcccctcttgggccggctcggcccacctccctccctctctctcctcttccccccgcggcccaatcggcctcctccccgcgcgcgtgccgctgacgggcgggcccgcccgccaccctcgctgacgggtggggcccacccgtcatcccctacctcccgccgctcccgccgcctcgcccgtgccctagcgccgccgccgccgcggattccgccgcatcccgccgcccccgcgtgcaataaagtgaggggaatcattccccgtgattccctctccctttccccccatttttccctctctctctcgcgttcaaacgggcggatttgcccccgcaaatctcgccggcgccattgatggagcccgagagcgccgcgccggtttccttctcccccggccgccctctctcactcccaacactatataaacgctccccgtgcctccctccaccgttcccgccactcgccgctctctctgtccgccggaatc

SEQ ID NO: 82859 - DNA, 12664 bp, Oryza sativa
tcagacccatccattacctatacttcatgaaacgaatttttttgagaattaatattatttttatggaaaattgcaaaagtagtggccaatcggggaaaatcgcgaatttaggtccatgtcgaacggctgtagttcgatagggtagatatcgaacgttggggattcgactgggacctgtcgaaccgctggcgttcgacaagccgacctgtcgaacggagggagttcgacagggcccaccacccagcgccgcgcggcctgtcgaacagcgggcgatcgataggccccgcaaccgaccctgttgaacaatggacgtttgacaggccggtttaaaaccctgtgcgcccagcccgcgatgctgcttcgatttttctgaggaccacatcgccagccgccgccgagtcgccacttcatcgccgtgggcgccggagggagtgaggggaggagctagcaggccggagtggaggccgaggaggcgccggctgggaggagagggttggcaacccctccaccagtgaagttaaggtatacattagtaatccctaagtatgaggcataagaaagtttaataaaaaattggtttgtgatttgttaattgtttcgcattgttcaatgctagtatttattgtttgcacgtatttgtcattgttaaatgttagtagaggtatgtaagtatttgtatggttaaattagttcttagttagtacatgttattaatatgttctgtgttaaaaaatgtacaaagatattatattttatttcgattattaaactagtcatttgttactaatagttgtaagttagtacacggcaatgtagtataagttgtaatagggtaattatcgaaggattaaatgattaacgtcagacaatttgtcatgttttatcaggatgtcaggtgatatgcccattcgtctgtattatggcgatgctcctatacaaatatgcgatagtggggtggatttgactgtatatgccttccatgatactagtctgaatgcaccggagtatatgggtttgaacgacgtgttagggtggttgtataatatgtttggggtagatccagtgcatgataaatttgtcataaatgccgtgtggccagtgaggggtcaacatggatggcagtggagagtagtggaggttgcgtcaaccgggagttggaggaagtttgttagtaaagtaagggagaaaggctatagcctggcaatagtggtgtagaagaaaacatgtgttgatcgatcgggggagtcaagtcataccgtggtggaagaaactccgttggaaggtggacaagttgaaaatgtttggcggactgagcaaggtcgaggggaagaagtaatagagggtaatacacaaggagaggtcattgttcgtggtactaatcgtgaggccaatgactcagacgatgaagaaccggattcgcctatgcgtgttgattcagcggaggagaatgaggcggtagtggattagatggaagtggaaaacgaggaatacattgcgcttgtagtggaaggagaagatacaacactgtgggacaacgaaactaacatacccgatgattggacgaccatatcaatgagtcatatgaaggtaaacgatgatttagatgcccactggtgttatgatagtaagcaggtgaaagttggacagatgtttcatgacaaaggtcacttacaagatgcggtgaagaggtgggcatttgaccagaagcgtgaattcaaggtgaaggtttcaaataggacgacgtatgacgtgaagtgcacacagggtggatgtccttggagagtgcatggttacaagccacaacatgacactttatgggtagcttcgagggttgagcaacatacatgtttgttggagaatacccgtctggtgcacaggaacatgacagcggcatttgtggcacaaatggtatattcaaaggtggttagaaaaacatctttgtcccctttcacaataatgcatgacgtaaataaagagtacggatatgagatatcgtacgacaaggcttggagggcaaaacaaaaattttcagtcttaccgtagtttgtgcgacttcgttgagtgggttgatacgactaatccacaacgtgacagggcacgcctatatccatgcagcgaaccattatcggactacctaaggaggaaggatgaatacgaacgacgaaaaactgccgaatccttaccatggcaagtgaatccactgggactccccaattggcgggagcatccagagtgtaggtgtggagaccgttgccaggtcataaggtccgttcgacaacgaactctaggacagagatgcttcgtgtgtcctaacattgtcgacgatgatttcatcgtaagttgcactaatttttactcactatgattacttctgtcatatacctacatacatccatgtacggtcattaatttctgggcacaggaagaagaccgcaaatgtagttacgtaaactggatcgatacggtgcgaagaacttccatcggatcgatgataactcaacctgagacgaccacacaattcattcaagcatggatggagtacgagcgccatgttcagtccgctagcttaaactggagatcaaatccattaggtatacctaaatggtctgatcgtcccaaatgcggttgtagagaacgctgccaggttgcaacgtccttctcacaagatacatatggcaggtggtacttcgtctgtcccaacatagatgacaacttcgttgtatgtcacatgcttaattactaatttacattttgcttcgcgctcccacaacaattatttcccattatctaatttgattgattgttcaggggaatccaaggatgtgtgcttttacttcatggatcgacatggtcaacccgacgtatgaaagcggaagagtaactgaagctgaaacgcaaacagagtataagagattgaaggatcatgaagttgcattacgtacacaatgacgtagaaggggtcaacagagaagcttaaccctgaatcgctctatttcggcattttgttatgttatgttgttgtatgggtcatgaatggattaggtttatctatttgttagctaatgtttcattctcttttccatctattaagctcattactgcatccgctgcaatgtattcaatacccttctcttctttatccgtccttacttactaaattgcgacaaagccattaaccaaaaaattatacaatcaatgaaactaagtaatccaagtattttacccaacaaataaatagtacaatttccccaccaaacattataaaaaccgtaaaccatatacataaaacattacaaaaatattatcctttcttacatattattaaataaataacttattattaaaaataatttgcgaaattacatattattaaaataaataacttattattattttaataatatgtcgaactgcgggagttcgacaccccagcctatcgaacaggggctattcgacaggccctgtcgaactgcagccgttcgatctcctttccagtcgcgctccggctcttcgatatctaccctatcgaactacagccgttcgacatggtcccaaattcgcgattttccccggttggccactacttttgcgattttccataaaaataatattaattctcaaaaaaattcacatgaaaccccatgccttgctgttagagttttatataatattaggagtaaagtccatcatcggtccctaaacttgtaccactgtgtcatcccggtccctaaactcacaaatcgaccgtccaggtcctcaaacttgttcgactgtgtcatcccggtccctaaacttgctgatcactcgtttaggtcctccaacttgttcagttgtgtcacctcggtccctaaacttggatttgaatatcatctgggtcaaataggacagtgtaaagactttatatttaaaaataattcataacttttttgtgtgaactctaatgaagacaaactttatatcaaatttgtagccctcgacgcgatctataactttgtagttgattttttttattttaagtcatttttgtcccaaaatgtaattttaaaattaaaatttcaaaatctataaacatgcaccaatattttgggaccctaaacagttttaattcaaaagcttttcaactacaaagttgtagttgcgtcgagggctacaattttgatataaagtttgtcttcattagagttgatatgaaaaagttattaattattttttgatataaagtttttagaccgtcctgtttagggaccggggttacacaaccgaacaagttggaggacctaaacgagtgatctgcaagtttagggaccgggatgacacagtcgaaccagtttgaggacctgaacggtcgatttgtgagtttagggaccgggatgatacagcggtacaagtttagggaccggtgatggactttatctaattttcatctctggtcgactattgaaaaaaaaggctaattataaaccatttgatgatgtggtttataacaatttaaatagcgtgaatagccaaagtgtcatcggaggctcaaattagtccttgatgtttcaatatatacatattagtccttcaagtttttattttagttcaaatttatccttgaacccacttagaagccacatggccaaacataactaacaactctcttgataaatgacactttaaccccctcattcacatatataagagaaaaaaaatcgaatgcaatgaatttttttatagataatgcatcgtaatttatgtagaacgaaaataattatgtacttgcaagtgtatacgatagacattgcttaagtttgatgtgcacatgttaaaataatgggaagtatttctgcaatgttatttattcatcttggttttctcttttctagtgtatagttatatacaaattattggcaaaaaggatattttctaacagaaatattgactagaaatagccatatggcatattaagtgggcctaagaatgattttaagccaaaacaaatacttataggacctacgtggacaaaatgaaacctgaaggacctaattgaccttcggtgaaacttgagggattaaattagctattcacccatttaaatatatatggattaattgtttagaagaaaagactaagatgatgagactcaatgagagaaagagaaaaaggtatataaatcaattatccaaaaacaaaactaagttgatatgattttataagataaaaaaaggaaatgatataatttggacgatatatcaaacatccaagagttagaaataattgagatgatatggcttaatgagagaatagagaaataatattacctatacttaataagatgaattttatagatatataagaggcctgtgtgtctaattgtctatttcttccaatctgaaaataagttcaatataggctgtgtttacttcagcgcaaagtttgaattttagttaaaattaaaggtgacgtgactgaaaagttgcgtgtatatgatagattgatgtgatgaaaaagaactgaagtttggatgtaaactttgatctaaacacagccatattcacgagtaatatcaaagcgcatcaacgatcactttttacgagataaattacaacagctcgatgtgtggtgctctgctatgacatgacgttgacgtactcgttagcgctgtactccctttgtataaaaaaaacttaattcttaagtgtgtgtacaatgtttgaccgtctgttctatatgaaatttttttatgattagtatttttattattgttagatagtaaaatatgaataatactttatacataacttatctttttaaatttttttaaataagacggacggtcaaacaataaaaacagaaacccagaaattaagtgtttttgagacggagggagtagaggtgtaggttgtccgggcaacgcttgattggtgctcggcgatggcggctggctggattggttatgtcccttccttccccttctagcagaacagaggagcttatgtggtggctgcaaggagtgagaaggcgtggcactgtggcagtggttaggagcgcttagctccgttttatcttaagttttgaagcaagcaagaaaagctttaatcccagccttttaagtatttccttttcgcttgtttgttatttatgtcagttatgagattaggaaagtatgtactcgtgtaatctttggttatgtatatccacttgtgaatgttgtatatgctaaattcctatctattatttaaaaatacagtaatatcagagcattttccacataaaaacagtccagccgttgtactctttggaactgaggatccaccggaaaaaagattccatttgatttcttaagaaccaaaagacatgtggccctagtctcaattaaagattagctttcgttgtcgaagaccttgaccacttactttgcagtctcgagtgtttggctctttcctacaaagatgtgcacatgttaagaccattagcccaagtcttcggtcatctatgagctctgagggcatatccaatctcttctttctataaagctaatacctattaaacacataaaacttaacatacaagtataatatttattagcactcctaaaacttacatgcaagcatgtcacatcaacccattaattaatcacacaaaacccaatatgtaagtatatattagttatatttacattttagtctgcttcagtcacttcctctcaaccaatcggaaactcttcctcctctcgcgtcacctttccccgggtgacttgggaggcgacgccgccggcgccttcctccttctcccttctcctcccccgcctcgccaccggctgagcgggcactggcaaagccgtgcggccgcaaggacagcggcgggggggccttctctcaccctccacgcgctgggcggccaggggcgctcctcggagcggcggcggcggcggtgtccatatccgggccgggcgcggtcggatcttgcggaggggtctctggcggcggggagtgaacgtggcgacggcggcacctggtagtggacgtggcggtgcggggtttggcggccacggcggcggaggcccccagatccgccccaactcggcctgatctggatggcgattgccgaatggcggtcagcagcagctggcggcggcggtgttgactgctgtggtggcggatggcgacgaagcagtggctgtgatggcggcggcagcggctagcgacggcggctagtgacggcggtagtggcagacaacggtcaacttgtggcgtccgcggctatggaggccgggggtagcggaggccggcacggcgcgaggtggcgcgaccagtggcggtggaggtcggcttagcacggtgaggcgtggccggcggtgccgtaggcctgttacgacacggcgaggtgctgctggtggtggaggaggcgggcacggtgcgacaaggaggagctgccggtgggtgcggtgcggtctacgacgcacgaaggctggccggcagggggcgctgatgcagtggttccacgtgccagcagaagtttgatggtggtggagcatcggagcgccagctgtggactcgcaggtggtgattggcgggtgaaaacccagcccagtctcgaccaggccggcaacgatgacgttcgacgcgtcattcccctcctgaggacgttatcgtgacgtctcatccctcaagtgtggatgccgagcgaaagccctgtctcggttctctttgagaccttgacggatgggggcggcggtgttttccatcgcttctcttcttgaaaacgtcgtttagacatcccctagcggaaacccccaagcaattgatgcaagctcgctctagatttcatcctcttatggcggcgtcctagacactataagttggtcacatcagagggcctaaggggagaagtgtttcattcttctctctcaccctctctctctaacttctgaagacttggatagagcggggtttgtgttgattgtaagggttgggttttgggcgatctcggctgtgttttgttgttggcctagcggcggtcggtcatgcttagcggcggccggttcggtgctagccttctcctggacctgtgtgttggcgttgccggtgtgtgggtggtggtatactttttttcttttcctggttacgactttccagggttgtaatcttgtaattttttttctgctctatcaataaactttgcaccgtcttttgcgagttgttcaaaaaaaatttacattttatgtcattctaaaactaaacatacatatgctaaattatcaatctcaaatcattttcataatatttcaatccaaatcatttcatcatttttgcaatatctaacatatattctgcagcaaagcgtagagcatcatctagtttatctatatctacatatcctatatagttgtatccaatagctcaatatgtattgagccgcatcatttagaaagaaaagtcatttgatcattttcatacttaatcacaaattcacaatcattcatttagtagttactattcctcgttaattagtatataagtcaacattagtgattcaattagtgtagaatattatcgctataaagaagttaggccatcaccatatttaacaccattgcatacactggtggagaaaccctttgtagtcccggttcgtaacccccctttagtcccggtttccaaaccgggagtaccaatccgggactaaagatagagctgaccttttttttttttgcatgcccctgttgctgcatggtttatatatatatatatataaaccatgcatatatatgttatgcaaatgcatttgtatatagatatatatatgaacaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgtaaggcagtggcaatactcgcacacgtaatagccgcacaagttagttccctgcttttgctttgcgccctacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctacaagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgacattgtctggaaggataccccttattacaactggtagcagttgtgtcatcaacacgtgacagtcatgagactttaggtttatgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgcgatgtttaggattcgtacggtggtcggccttatgttcgaagtgcttgcctttcttccgtaccgggtggtttgctgcaaggaatcgacgatgacccatgtatacaaccttcctacaatgcttaagatacgtactttttgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcttcgaccagtggtcttaggtacacgtcgatgtcgttacaaggttgcttggggccttgaataataatcggcatcattatgtacttcctcttcatgcatagccagggggggaggttgtagatacacatcataacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattataggaaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcttccctggcatcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccgatcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaatttttattttagtttgttttctattatttaatattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatataggggtgggactttagtcccggttggtagcaccaaccggggctaaagatcaccgggatcattagtcccggttggtattaccaaccgggactaaagttaagatctttagtctcggttggtagcaccaaccggggctaaagatcaccgggatctttagtcccggttggtattaccaaccgggacacccggatctttactcccggctggtagttaaga

SEQ ID NO: 82860 - DNA, 16819 bp, Oryza sativa
caaaattagaaaaggaaatgggagtccaagtagaaatacaatttaaaatagctgaaattcggaattaaaaataaagaatattaaaagaagagtccatataataacccaatacgagattaattaaaattcgaaataaaaataaataaatccgaaattagcaaaagaaaataaaagaagagttcaagtaggaattcaatttaaaattagctgaaattcggaattaaaaataagcaatagtgaaagaaaaatccatataaaaacccaatacgagattaattaaaatttagaataaaaaataaaataatatctaaaattagaaaaattaaaagagagttcaagtaggaatacaattttgaaacaactaaaattgaaaataaaaaataaaaacattaaaagaacacaatacaatattaactaattttttttaaaaaaaatctgagattagaaaaagaaaaataagatttcaattaggaatacaatttattaataactaaaatttttgataaaaataaagattattgaaagaaaaaaccatctaaagcacatgacgagataaattaagtaacaggcctataaaaagtagagtggtgcaggcggttgatacaatatataaaaattattaataaaacaccaaataaaatcctaatgacgattaaaaggagggacattagacaggccgtgaagcaaacgagtaaggcagttgccgggacttctaaaaagtaaaaaaaacaaaccccattgataatcatatttgatttttaaaatcctaatgacaataaaaaggataagcagcggacggggtgtataagggtatagttgcggagccgccgacggttgaggggacttctagaaaataaaaaatgaattccaacgatagttatgttcgatttttagaatcacaatgataataaagagtaggcggcggacggactatacaggggtatagtggcatcatttgatggggcttttaaaaattataaaaaatgaaagtacaagtccaattttaaaggttcagaacttctaaaaagtaaaaaaaacaatgataatcatgttcaattgtaaaatctcaatgacaataaagaagggaggcagcgggcgagccgtagaggagtacattggcaaagccgtgttaacgaccaaatttggtaatctaaggatcggagatggagaagaaatcgagaagaagtcgagatggaaatcgtcccggaaacagagtgaagatcggctggagtccgaatcggctacggctaagatcggcagagttcgagtcagacggggttagccgattaagccgaatccgacagtatgacacagcatacgttgtcggtttaggttgatgtgcttcataatgattgccacgcatggatagagtcctcagaaggcaattgtatctattaattaggatattttatgtaatttccttagagatatgtttgggcaaaagtctgccgcaaagacttatggtatcttagagtttgttagagataagagtcgtgtccgatgtggacatatcttgttataatgattacaatgatataattataccgtagattggattgataaattattagataaaactatttatactgggtaaataagtatgtatacatgcatgcaagaggtagtgagagagagctgttagagagacgtccgattttagtgcatctatcggacgtccgatgcgtaggcgtccccggaaaaaaggctagggaaaatggtagtatgatcaagtatataggaactacgtagaaccttctgaatggaatgaagtactagtactagattctaagcacaattgtgcaaaggctaaatggctaatgcacgactgttacaaaatgtttatgtgtgcccagttgccagcctggcgacatgcttgagaacccaccttttagttagactaaccgaacgtcaatttaagtatatagtcatctcttgccttctaaggtttaggcaccattattgtgtctcccttaagccctcgcttgttcggctcatgatggaaatggaattgaaattgacgctcctaatttcctatatgaggtttctgattaattaagttcagacatcatgcaaccagacagccgtgcaaacttaattagcaccacggctatcgtcccaatccatccgattaataattaattaattaattaatgaacgtaacgagcagctacattttcttattattctcgctgggcctaatcactctctgtagtactccctccactccagtttcattttaattgacgttttggacaatgacatggtatacaaaatatatctttgactttatttttctattataagatatacaataaataaatacatgctcacttttattatagtgatttgaatgataaatctatatatgttgttctagtatctttaaactaaatattttaaaagttattgatggtcaaagttataaagtttgacttcaaccttatccaaaacgtcaattattactacctccgttttttaatagatgacgccgttgactttttctcgcatgtttgaccattcgtcttattcaaaaattttatgcaaatgtataagatataaatcacacttaaaatattatgagtgataaaacaactcataacaaaataaattataattacataaattttttgaataaggcgaatggtcaaacatgtgagaaaaaatcaacggcgtcatctattaaaaaacggagggggtatataacaggagggagtatacttacttcaaagtcaaaccgcgggtattattacatttatgtccacctctacgcatttcaagaaatgtaattacagtgattctctgcgagcgtttggtacttaagctaagctgaccgagttcgtgctagcgtgtgcgcggcgagcggcctcatcgtggccggaaaaacaactcgtcgcacgaagcagcgaccggacaccgtgctgctcacaagccggcaatgccccaacacgcccacttgtttcttaccgttggcttcgaggccccacggtctgacaagtcctccacattctgtccaggtcaatcagtccaactgtttatccaacaagacaataataatggaactatggaagatgaaattttgatcttttttagatgggtgaaaaatgatccagaccaccaaccaaagtccaaactacttcaggctctagaaaaaagagaaccactgtaacaccaaaagccactttcctttttgcttgctcggcgactcaccgccgctgacaggtgggcctggtgattcggtgccagtctcctcgtccatgtttgccactttcgccgacgtgggtgggtgggccttcgggtgaagctgaaggaagcacaaacagagccgacgatacggactgtaactttttcgcatgtgcttcgcgcgaattattcaggatctctctctgtcatccggtcgaaagcgacctcccatgtcatactgtctccggataaactgcccatgtttatcacagagaataccgaacggattgcgtagttttctcgccatgaacccgtgcaggtagattcagttgctcgcgcccgatggtttgtacgagccaatactcgtcccctatccgttgtactgccaccgttgcatacgctacaaaacgccgtgcgtcccatcagctgctgttgcgtatcctactctcgtttcgtcacggagtgggtaaaaggactaaattaacagcaaggtaatccaggattacgcgagttccataccgcatcagtgcccttttttacctagtaggcgccaactaggcgaaccggacaggacaaagccacgaaacggagcaccgaccacgctggccgatgtgggctgtgcagctaaccatgtcaccaggtcactagcccgttacgcccgcgtcgtgttccggcccaccttacgcctcccggtagatccacgagccccacacgggcggatccactgtcacacgggcccaacggttcgctggccccactggcagcctaacgatggtttctcggttttacatggggggaaagccggtggctcggcacccgaggtcagtggaattgatggcgcccaactgccacgtgagaccgtgaccccacatgtcatcctcccgtaggacggcctcggacccacaccgagcctcagggacgaactagccgtttgcgggtcggcactaaaaaaatcggagacccatcggttcaacgggagggacgcgcgagcgccgccaatgaggcgaggggagggtggccgcgtcgtgcttcagtagtagtgggggcagtgggcgagttcttgctgcgagttcgtcgcgagagaggaagcagcagagagaaagagagcaaaagcagcgagaggttgtggggagagagaggagcgaattgattagtgtcgccacatcgtctccaccaccaccacctccgtccttcctcgccaagccaccatcattgcgccaccgccgcaagatctgagctcgactcctcctctcctcgcccccgcacgggcgcacgacgctagcttcttaagtatttttcttcttaccgcgcagcgcgcggcggctggctggctagctagcttctcggcaaaggcttgttgcggttgcggttgcagtacaggggcgtgtgtgcgcgcgagcggcggtggtacggtgcccgcacccacccaccaccacccccgccattaaaggcgctcacgcaccgcctccagcttcttcgtccacgagaaagcgaggtgatcagagagagagagagagagagagtgagtgaagcggagctcacttcctcccctcacgggagcagccaacgcccagcgccgccaccacccacgccgttcgcgcgctttaaagaaggcgcgccaccttcgcataagcttaaaagattccccacaccacctcctctcacctcgcgccacgagcgttgatcggtgcttttcattgttcttccttgctgcagaagagacagagagagggagaggcagaggacgaggatgatggcggtgctcgcgcggctgggcgtcattgtggtgttgtgggcggtggtggcggaggggattcttgaccccgtcgacttcctggcgctgcaggcggtgcggcggtcgctcgacgatatgcctggctcgtcgttcttcgaagcgtgggacttcacggccgacccgtgcgggttccccggggtgttctgcgacggcaacaaggtgtcggcgctggcgctcggcgacccgagggcggggtcgccggggctgtccgggcggctcgaccaggcgctggggcggctgtccgcgctcaccgagctgtcgctcgtgcccgggcgcgtcgaaggcgagctcccggagtcgctcagctcgtgccggaacctccgattcttggccgtcagcaagaacctcatctccggccagataccggacggcctcggcgggctgtccaacctccggacgctcgacgtcagcttcaaccagatctccggcaccatcccggcgtcgatcgccacgctgccgtcgatcaccaacctcatcctctgccacaaccatctcaccggcggcatcccgtcgttcccggactcgtcgccgctcatccggctcgacctcaagcacaacgacctctccggcggcgtgccgaacctgccgagcacgctccagtacctctcgctctcggcgaaccggctcaccggcaccgtcgactccgtgctcccccggctcactcggctcaactacctcgacctcagcatgaaccagctcgacggcccaatcccggcgtccgtcttcacattgccgctgtccgtgctccagctgcagcgcaacttcttctccggcctcctccagccggcgaacgacgtgacgatccaggtggtggacctgagctacaaccgcttctggggccccgtgtcgccgctcctcgccggcgtggggcagctgtacctgaataacaaccggttcaccggcgaggtgccggcgcggctggtgcaggagctggtcggctccggcgggctccaggtgctgtacctgcagcacaacttcctcaccggcatcgagatttcgccggcgtcgtcgctcccctccagcgtctcgctctgcctcatgtacaactgcatggtgccgccggtgtacgcgccgtgcccgctcaaggccggctcgacgaacacccggccggccgaccagtgcccggagtggaggggctaatcaaagctggcaacacaacgccgacgccattgccggatcgcctcggatcgtccaagctcaagaaaaccggaaaagaatggaggagattgcaaatggcggtctccgattctttgattaatttgtccagttactagcgttccaatgtggattactattctttttggttggggggagatggatggagatagtcacagacaagaagtaagttccttaataatcttgggtttataggcgtaatttctttctcctttttttgtgtttaggtggtgtatgttcttttgtgtcccctgctgtatagttgcgtgagtagtaaaacattggctcttgatgttatgtgaggtggcgacgatcgattgatgtatctgatgatgatcatgatgatggtggtgttagaaatctgtgatgttatttatatatcgcattgccattgggcaagcatagtatcacaagcattcgctgtgcttcattttagttacagttactcgtcacagttcattcttgtcagagaaacaatggctatattatggatgagcatatttttatgattatttcaggggaaaaaaaagcataacggtagatgatgaataacacgcttgtagaatgattgctcagggcgcaatcacaaaaacagaagcaaagccaagaattagcaatgcagctccccacactgaacaatcattacgtaaagcagagaactaactaatcaatctatctgctggccttctgaagtctgaacaatcatcctatctgcatttgcaagactggcaggaccagagtacttgcatacaaccgatcattaggccatgttgttccttcttgattggagttcttttttttttaacaactactctacgtgatatgatttccatgcagctgatccttcgtatgtccttcacattctctcattcgtcctcctcctcccctgttcatctccctgtcctaaccctggcttaaaaccctctcgcgtgtacagtactcgtcttgcacagtgaaacataactctcgtctcgccttaatttcgctgtcagtacgcgatacgagcgatccttgtgcgtgcgtccttgcgtactcggtttgtggcgagttggtagctctggtttttaatggagctgcaactgcacgcaacagttggaaaaatcgcgcgagatcagcaaattcgcgacgcagagggggaggacgtcgcacggcgaggcggaagccgtcctctgctcggcttccggtggtttcgagttggagacaagcgggttgttcactttgttgcaaaaatcatattttgatgttatcgaatttcgataacgttgaatgtatctagtttacgattttatcaaagtttgatagtgttttcgtgagtttttttttgtcggaattgtaagatcatgttttgccacgtataccggccgggctgtcggtgtaactcgtacgcgatacgtatcccctcgaggccttgaaggcttggatggtacacgtactggtacgtacgagaaataaaagggctcatcgtgacacgggcgcgatggtaaagtctctctctcttcattagccgtggtgcggcgagcgtgactgcgcgatggccatttaattctctgtttcactttctttttttcctctcttcttttcacatcgtcatgtttcatgttagtgatgctttctttaccttgccacccccacacgcatgtaacgaatgactactcggccggagtactcgctatagactgtaaagaggtgataacaactcaacatgatccaaagcactccttcttcccctacatcctgtgggggccccgtttcaccgccatgtgggccatggcacatgcaaagcggataattgtacatgtttggcagcggcatgtcagtttgtccccacatgacagtgacgcagcacggcgaaaggcggtgagtgtcgctgcaattagcttgggcaaaaatgtggtactactactacaaactgccatcgagatcattcatcacgccgccccgacgagcgagcgagcgaccttacctcggctttcctcttttctgcctgtgaagtgcgtggttgttccgaaagcgtgatgcccactggtctttccattcctggctcttttgagttttgactgtttgttcggtttctagctttgcaaattgcaatcccttctttcgcgccagtgactgagagacagaataataatacagacagctgcttactatatagatttttatagcctatctctcagctcacttatatagttgttaatttttcactataaatatatggtccacatgtctgtctcatagattttcttggttacagtgtctaaaccggctgtaaacttacagccggcttctcatctatctcctctcctttctcatccacctcagcattcagaccctgtttagatgggactaaaactttttagtccctatcatatcagatgtttggacactaattataaatattaagcgtagactattaataaaaaccattctataaccctgtactaattcgcgagacgaatctattgagcctaattaatccatgattagcctatgtgatgctatagtaaacatgcgctaattatgaattaattaggcttaaaaaatttatcacgcgaattagctctcatttatgtaattagttttataagtagcctatgtttaatgctctaaattcacccgatatgatagggactaaagtttagtcctgtatccaaacaccacgtcagtcttcttggagccctctattatactcgctgacggatgatagaattttagaattgagcggtatgtgcaaaagcaggttttgtcgtcggagaagaggacgtggctgtggctcatgtgaaaagaaaggcaatttggctggtagcttttgctttgtacggagtagtactactagacttctagagctgaactagcagtaatagtttctaaacctcagtagtctgttgatccgtcggccatggcctaccgatcgcatgggcaaggcccaagcccagcacccgctatccaggttctttctggcgcacccaccgatccaatcgagaggcctccgtataggaataagttcactttgggtccctctatttgtcgctcagtctgattttcgtcacttgatcgcaaaaccggatacgataggtccctcaacttacgaaaccgtttaaatagaatccatcagcagtatttaacctggttttggctgaggtggcccctacgtggctaatttgacttggccttcatctcacgtggcattgatgtggcgcttacatggcaaattgaacccaaaaataataaaacctatgggacccacatgtcaatttcacacacacaataataaaaaaatggtggggcccacatggaccccacatgtcatcatcactaccatctctctatcccctctctctccatcatctctccttcctcttatctctatccccctctctctcccctgacaatggtgagcggcggcgggcggcgcagaggggcggcaagcggcaggtggagcggaggggcggcgggtggagcacgacgacgaccactgcggcgtctccgaagataacgacaacgacaacgacgctctgcccagaactcgcgtccgtcctgtcctcgcccgtccgcgctgctcgtcatgagcttgcaggcaggggtgtccatggccgcatggagggtgcccgcgctgctgaagagccacgtcggcgacgagatctcctaccacggtggtgccgtgctccggggcgacattctcgtcaccgttgtgtggtacgggaagttcaagctggcgcagaaggccatcgtcgttaacttcctcctctccctcacggccacgccgccgcctccgaacgcgacgacgccctccgccgagaagtggtggagcaccatcgctgccgtggttcttgcgagtggttctcgcgcgcgccgaccaatgggagggagggagaggagtgggggtcggcagtcggcgggagttggcggtgcgcgtgaggaggtcactggcgagcacgggctccacgccgtcggccgcttcgcctgcgatgcccagcagaatagcgccgcccctcctcgcccggttgccgagcgccgcctccctcctcgcccaccgttgggcaccgcctccctcctcgtccggccgccgcgtgccgctccgcccaccgcctccctcctcgcctggctgccgcgagcggcccctcctctcgcccggccgccgccgccgcctccctcctcgccggccgccgcgtgccgctccgcccaccgcccccctctgcgttgccgctcgccgttctgtaagggagagatagggggatagagataagagggggctgacatgtgggaccacatgggccccaccttttcttattatttttgtgtagctgacatgtgggtcccacgttttattattattttcccgggatccaattgccacgtaagcaccacatcaataccatgtgggataaggacctagtcaaagggagccatgtcatccaaaaccgggcataatactgccgagggatatcttttgcacggttttgtaagttggggaacccgtcatacccggttttgcgaccgagggacgaaaatcggactgggcgacaaatagagggacccaatgtgaacttattccctccgtataaggcctcggagctgacaggccgaacagcccaacccaccattcttcgcgcgacctgtgagggaataagtccactttgactcccttaaaagtgactcgaatctaatccgtaaccctcaaccgcaaaaccggataagatgactccctgaattattgaaaccagcacaatttgactccctcagcggttttggagggcggttttgctgatgtggtaatgttgacctagtcttcgtcccacatggcgcttacgtggcattagacttaaaaaaatatatctatgggacccgcatgtcatcccctctctctcttcttctttctcctttctctctctttctctccccttttctcttcaccttctctctcgtgtagcaatcggcgggcaggggcggcgacagcggcaacggcggcggcggcaggcgggcgagcgctggagtgtgcggcatggaagctgccccctgtgacggtggggtgcgcggggaggcgtgtgacgaaggggaggaggccatggcggcgggctcgacgaagtgggacttgaggaggcgcgagcacccggtcacgcacaaagacgagcaccctgatggcggcgacaatgtagccgacatatatatggcaaaagtatttgcggttagttttggttctcatcggcgagcgtggttgccatcgttgggtgtcatgaacaacatgtcaccatcgatgatggctggacctagtgtttgctctgttgtgtcgtacgtctcaagtgaataatttctaggtttttgtccctcgccttcctctctatggcactgagtttgttgagctcccatgtgagcgagtgtctgagcgagcatcggtggcaggctggcagcagccacagccagcaggcgcacaacttgaggtcgacctcgccgtcgggggtcatgctgctcgacgccatcactgttagagtacgcagctcggcccatcaaccatgggctacccaggtcatattgggtctgctccaccacaggttcaactggagccacaactttaggtcctgggcctacacccaaaagactagtctgatgggtaaggaccgccctcaccttttaagtcgtgttcccccaccctcaattaccgatgtggggctaaacccaacaatctcccccgtcacatcaacccatgtgaccccgaagacttgtcctgggcctacacaacccaaaaggaccgccctcaccttttaagtcgtgttcccccaccctcaattaccgatgtggggctaaacccaacaatctcccccgtcacatcaacccatgtgaccccgaagacttgtccggggcctacacaacccaaaagactagtctgatgggtgaggaccgcccccaccttttaagtcgtgttcccccaccatcaattaccgatgtggagctaaacccaacaatctcccccgtcacatcaacccatgtgaccccgaagacttgttacctggcctcaggcccaacaatctcccccgtcacatcaacccatgtgaccccgaagacttgttacctggcctctccaccatatgacccatggaaattgttccaggtttcaaaccttgggctctgataccacttgttagagtacgcagcccggcccatcaactatgggccacccaggtcacattgggcctgctccaccacaggcccaaccggagccacaactttaggtcctgcgcctacacaacccaaaagactagtctgatgggtgaggaccgcccccaccttttaagtcgtgctcccccaccatcaattaccgatgtgggactaaacccaacaatcaccacccgactcgaccaactccatcgccgttgactcgtcttctggttcgccctccaccacctctccttgtcttccccgacgccttcctcggtccgttactctgtcatgtgcacgtcgggctcgtagctcgagctcgagtagttttgtcggtccccaactcaccgccgccttcctcccttcccacggacgggcagctgacatcgagctcgatggggttcaccggccgcgccgctgccgtcgggagctcaagtttgactcgtgagctggttgttgttgaggtggagcaagctgagcttccgcattgcgccgatctgggaaggtatctcgccagagagctgcacgtagccgccgccgcttcagctcccgccggccgccaccactctggcccccacccgccgccgctccagcccgtgctccccgcggccggccgaaggggagagaagagaaagagaaagaaagagagaagggacgaagagaggaggaagaagaaagagagagaggtcagtggggcccacattttttttatgtgtgtgaataacaaacgggtcccacgtatactttttaattcaaatgccacataagcgccacgtcaatcacacagattaggtcaacaccgccacgtcaacaccatgtcagtgaaaccaccctccaaaaccacccagagagtcaaattgcaccggttttaatagttcgggggtcgagatatccgattttacggtttagggtcatggattagattcgggtcacttttaagggagtcaaagtggacttattccacccgtgaggccgtgacgctactgcgcggcccgacagcggcgccgccccggattcttccatgcttccggcgggaccgcgtcgcgcgcacgctggaacggacggtgccagccggtcccgtttccgttttttcctttttttttctttttctcttttacggtgttgggaaggttccagaacgggtggacgcttctggaaacagactcggccgcggatctctcccctgcataaatcccgggcacccgagcgctccgcccgtctcggcctcacgacacaaaagtttgtcaacagcagccgcccgctgcttctagatacttcttcctccatttctttcctccttgccaccgtctcgtcccccacgctcttgcgacctcttataatttcaccgctatgactcatatccttcgccacaacaaaatgtttttttttctcactatttttctattttaaggagttattatgttccttctttggtctgtagtagagtttaaggaatttatttttcaattgttttctgtttttttaccgcgcgtgttcgtgtgatgtttttttggatctgtggattgcgctgctcgtactgtgttgtccttgacctgaggagggtgcgcacgcggcgaccagagggagcgggacaggcagagggcgcaggcgcggaagccggttgtgaaggggcgcgacgacgggctcacgccggagcagcgccgcgagagggacgccaaggcgctgcaggagaaggcggccaggaaggcggcgcaggccaccgggcagggcggcaacggcggcgccggcgccaagggaaagagcggcgggaagaagtaggcatcggcatatgccggcatttgatctgttctcacctcacgtctggttgcgtgtgacaacaccgttctttcgatcgtcatctgctcctgatcctgcccatgttggcagatctgtactgctatttcttggatctttggaaattgcattacaaatttatgtagattgtgaaagcaaatttactccgctcctgcacggatcaaattaactcccagctcatgctccataaatcagtgacatatacagattgacatgtatacggaccacatgtaaagctccaccaagggaaacgctgtacagacaaccaaagaaaactctgtgtattcccggacgagcgcatgactctgactacgagtatccattttttacgacgcgccatcttcttcacaatatatctaatatctagccaaactgtgtaatctgtttaaacccatttgtttcgtgccattatctgcatatatgctaatggaagatcgcaagcaccgaatcaatcgagatcagtagtctcttcttgctgacaggaagacctggaccacttggcaacccggccgtcccaggatgagctgacaagcatagggtcgaagggatgccaactgcagtctcgaattgccagctgatgatatcctttgagttttgcaacttgtgatccgctcacctgaacatggaacaagatagtgcaatatgagcctttcgaaatactaattgaagtaacaagatgaaagaaattgtctgaagaatccttatgttactgaagtaacaatatggacaaagaaattgtcaaaagaatacttatggtgaagggaggacaacggtacactttttgtcgcctattctgtggtagaataggttttcagtgtacggaatgaatttaatttttttgcactgtcacagatccaactactctttaaaagatggcatgtaatttggagcatcatcagttgtccatattctctaataaatcaaaacagtttatttgcgaataaatattaatttatcgataaaaattttatatatttgttcgtagcgacttaaaagttagtgtaaaaaattacgttgaaaatatcttaaaatcaatttcaaattcaagttagaaaatttaaattttggcttttgttttgacttatgaggccaaccaatgaggctcccaatatctttcccatcttcccctactctaacgctgctgcatgccagccatcagggactttgcctaccaaaggctgttgtaacagctgtttaaaaacccttcttttcccttaataaacttcggccggtttcaaccggcctggcgaaaaaacctaggctgtttgagcaaaacgcattgcaaagcaaaacaattgggctggcattttgtaacatcatggatttgtaacccataccatttcctttttgcataacatgattaatctaattacatgcaattctcttgcgtgtttgagaaaaaaaggaataatctaattcggtattggaggttatccaaagatcatatacaactctcaagctagcataagtgcacaacaactgcctgctggtactagactaattacattgctaaaagaacgaataggccaattggtcatggtattacatttgtccactagaggaacgagtcagcgtataggtggtcagtcatatgaaccgatgctgtatacaatctatgacataaatacaaggtttgtttcctatagcccgaacacccaaaatagttatattatttttcgctttgattgaaggcactagccagaacagatatcatgcagtgagatatgcaagtcaaggataccagtaccaccatgtgaactattacaagcctggaattggccaaactggctgagatcttacatatttggatgcagtcttcaggttctgggaaaggcaagagtcattttggctttggcgaaaaaaaaaacaccttgttggagtgatgtttttagggggagaaatatatgtggcacaaatgcacaatgcagaatctggttgatagttttatttacatattcagacaatggtgtttgcctattgccatttcagatttccccaatttgcatgtagaaaaaatcacacacatatacaagtacgcaactacacaagcattaaaaaaatagaatcagacttccttgaagaagatcgaaaaaaaatcaacaggaaaattcatccaagaaaggtgcttgagtatagcaagcgcagtgcaatctgtagattgctgtcatgaaagttgaaaagagacataccacatcgtagatacaaacactagaatcataggatcctgtatatatgtacttctgtcctgtgctgtagaaacaaaaaaaaacataaagggacattagcacttactactttacatagtttgactaatacaaaatccttcatatgacatatcagaaccgagaatcatgaagttacctatatgcaggagaaaaatagcaacggatcaatgtacgaagaactgaatggccccagtatgtagctattgactgatcatggggatgctttagttgcttatactgttgtggatatcttgaatatctatagtcccaatttgaggttctgtcttcataactgcatgaaacaataagattggtaaaattcctgtcttcataactaaaattttacgttttatgttgatagctcaacacctacctatcagcattggatgtcattttcctgatgtcccacattttgatagcttggtcttttccatttgatatgaaacaccgaccatctccacggctatcaatatga

SEQ ID NO: 82861 - DNA, 9342 bp, Oryza sativa
aaaaactgctcaatattcaatcttttgatatatcaaattttgtttggttttaccacacaggttacttttccaatcataagtatttacagtgcttaggataagattatgtcaaacttttgaaattttgatcattaataatttctcaaatgcttagttaaaaaaatgcatatgcatttttgtcttgaaaggtatacaatcttggaggagtttactttgttatcaaaattaatcctaccaagttttggcaaggtaattagtaatctaaacatggtcaaaatttatctccactaccaaagtttattaatctagaatgtttagcaaaggtaacaaactaaacacaacttacacttctcaactaaccaaacattggtgatgccaaaatttgacacaaccaaaatttaataagattgatttaggcatcaaagtgaatagctccttaatatcataaacttattagatcctgtaaacttattaatataaaattaatattcaaagttttaaaagtttgtccgaatattatctaaaacataaaatatttatgacgaggtacattaccactattttatttacctatgaacagtaactaccaaagaactgcacacagtgatactcccaatgaagtcaaaaaagactcatgatagaaaattccagcagcatattttccatctaaaaaacagctgttgtgttcccaatccaaacaacgtatacaactatacatacagttgtagcaaaaaaataaaataaaatagtgcgagttgattcagcttcaagactcatccgggcatgcatgtgcctgtagcacaataattgcagtagttttgtttcatttcgagtactcaccaatccatcagtgtgatttcaaataggaaaataccagtgcgtacaaatttgtataccttccaggagttgtatccaagacaagtagacaagatacttcttttctcatcatcttgatgctattctgccaagctaactagccaatcatttctcagataagaagttatgaaatcagatcagaagcagcagaggttagacccggttaggccgttgtgagggccggccggacaggaggttgccgctgccggccggcaatcagagcgagaatattggattaggccggctgcagccatgtgaaatgagcagagccggattaattagtagtagattagttagtttaagcgaaaattctaagctctgttgcttagggatgagctgaaatttagtgcgatatgatgatgatgatgatgatgtgcttcgatagatgcttagatggaaaagaaaaacacacagtggcccaggtcatgtgattatatttatcccccgtgctattatatataggctttttctctgagcaaatgctggtgattagatccttaatttgtactttggggaaatgtcaaagcgagactttttgatgagctgagcgcgagctagcgtaatttccacacgttttatgttcactttggacaggaggagcaaatggagagatgagtcactgaaaagcctaactggttgcatcaaggacaagtcaggttcatagattcaggacaagcctaatgtgtgccagttaagatgagatgttttctcggtgctggcccatgtttagaataccaccactgggactaggaaaatcttggtttgctatagctgcaaacctacggtcaattcaactactaactcgtactactagtttttagcctctttcagagttggcaaagttttgtttaggactgcatcctcagcatttggttaatcatttaatcttagtaaagagtattttgaaatttctagtagtaggttgagtaggagtacttgagtatgtcctaatcgtcattaggcgaccaactgaagctgaaagtgggtatgtgtctccccaagtcacggtaataaggtaattaaaccaccatgtaggaatttcattcagataatggcttcttaccacaacagaaagcagagcgtgttgagagggatgcccggccaaacaggggtttttatctgggcgcaacatgccactgaaccagccactaaattgatttaagccacatataaaaagttttagtaataaatttctttgaacgttatattgtaatcgccacttaaattgatacatatgggctgtatttagattcaaagtttggatccaaacttcagtcctttttcatcatatcaacctgtcatacacacacaacttttcagtcacatcatctccaatttcaatcaaaatttaaattttacgctgaactaaacacatggttgattcgagaattgttcccctggatatttatttcacggtctatgcgtagctcatcacattcccggcagccaaatcatgaacccaaaacggatagagattacccctcccgatccatgctcatcatcacccgtaccatatgcccacctcctgacagaggcgccaatcaacttgacaacacttatctgttccccttacctcacctgtttagttagtgagcatgatgcagagcagcagacacattgtggatattgtgggtaccccatacccatacggcatggttatccgactagtcataggggataacttatatctatggaatatgtaatagatcatgactcgggtattacgtttccttgtatattacggaacggcctaaagtcctggtttgataatattgtaaagtagatttaggaaaccgataccgtattggttaaggtttctatcttgtaatcctgccccccatcctatataaggtgggcaggaggccctctagggggcagatgagacaacctgatcgtcagatcaatacacactcggcggattcaaatccccaaacaggagtagggtattacctctcattgagagggcctgaacctgtctaaatcctttgtctccgcatccatccacttttaggtctcgtgcgctaccccgttttattattgccgaaatcatgtttcgacagttggcgcgccaggtaggggttgcgtcgagtttcctatcaacgagcgcgatggaatcaatttcatgagtcgccgacttcgttttcgctttgggagttttcacttcctttccgtcgaccacttcttcaagctcctcttctctgacttgatccaaatcagtcagggggaaactcaatctgatttttatcattatttatcatattgatttttaatctcagattaacctcttgctattttttgttgttgttcgcatataattacgcggcactattgaggcgattgatgctggtcatggactcgaggcgtctcagctttccggtcgatcggccgcgagtccactctgccggcttgtcttcgccaccgccattgctgataacaacaacgacttcaccgccggccgcctcgtctgccgccgactggtgtctccgcctgcacggctggcctattatgctgtcgttgttgggcgtctacatcttcatcaccggcctgccttcgtcgccgccgattggtgtcctcgcctatacggttggttggtcacaccaccgttcatgggcgtccacgtcttcaccgccggcctgcctccgtcgccgccgactggtgtcctcgcctatacggttggttggtcacaccaccgttcatgggcgtccacgtcttcaccgaccggcatgcctccgtcgccgccgattggtgcctccgcctacacggctggcctattatgccgccgctgttgggcgtctacgacttcaccgaccggcttgcctccgtcgccgccgattggtgcctccgcctacacggctggcctattatgccgccgctgttgggcgtctacgacttcaccgccggcctgcctccgtcgccgccgagtggtgcctccgcctacacggctggcctattatgctgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctgttatgccgccgttgttggatgtctacatcctcaccgttggctcaccttcgttgccgtcgactggtgtttccgcttacacggctgacctattatgccgccattagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgaataacgcaaggtgctaagtattattcagaataaatcaaaagcatagagataagataatttattttctgctcttaataattgcaaaagtacccgagtagtaaactccgatccgtgaaactttgttccattaatgacgaactcatgacactcatatgcatgtttgggaagtgcttaggccgactcccagtgcttggtggctatgactagtcgggcagagtgtttaaacgtaatgagtcatctgctcggggaaatcaaaattgacaagaggagaaatacatatttataaatattttaaaatacttgattttttctcgagtattatatttatatcagatactactcatcctatatgattgttctgcaggatccagatccagatatgcataaaagggattcatggctttaagcttatctcttacgctccaggaatggatcagtcagaacatcaccaccggcttgccttcgccgccgccgactggtgtttccgcctgcacggctggcctattatgccgccgttgttgggcgtctacgtcttcaccgaccggccgcctccgccgccgccgactgatgtcctcgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgctgccgactggtgtttccgcctgcacggctggcctttatgccgccgttgttgggcgtctacgtcttcaccgaccggccgcctcgtccgccgccgaccgatgtcctcgcctgcacggctggcctttatgccgccgttgttgggcatctacgtcttcaccgaccggccgcctcgtccgccgccgaccgatgtcctcgcctgcacggctggcctttatgccgccgttgttggacgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtcaccgcctgcacggctggcctgttataacgccaactgatgctaccttcttcacggctggctacatcgctgtcactactaataggcatcagtatcgtcaacacaagctgcctacgtttgccatggctgccgactggtttcttcacttccatggctgcatgattctgccagtgttgattggccttatcttcttcaccgccggtcgtctcgtctgctgctgactagtgccctcacctctacgtctggtttatacagctaccactactgatggacatcatcgtcttccgttgccgactggttatgccgccgccgactagtgcttttatcttcacaactgcgcgtcttcgctaccagtttgcttttgttgccgccgactcgtgttcacttcctcacggcgatgcaactttgtcatcatggtggagcgacttcatctttattatcttcggcaccggcaaactctattgctgctacttcacaagttttactacttcaccaaccacgacgtctttgtgaacctcgacatctcggcatgcaatgccatgatattttactacaacaagtgactctccaatattcaggatttctacttggacaccttcaacacatatcttcaatcaagcaatgactactcgacgacaaggagctataattctcgactctatgttcagttgtttcccaactaaccaaagagtcgggggctacacaaatataaggctcaaaatttgacaaattaatcagccaatgagtcaactccaggagtcattatcttcatctttgcttcggaacagacattctacttcaacaacttcaaatatttcggtttagacgagttgggcaacaacatcaactctcctccaattatttgtcttcacggttggcctactacgcaactgccgatagaggatctcatcgttatcatcggctgctacatcgctattgactggatcaccgacatcgtcatcttcatcaacatcttgtcaagcctcatcaacatagcctactctgctgccgttgatgggaaacttcgtcatcatagtcggctatctctgttgccgctaatcatcattaccgtcggatgcgtttgtcgccgccgattattttcttcatcttcatgattggtggatttcgccatcactgttgatgcgcgtctacatcttcatcgtcggtttgctcttgtcaccaccgactgttctttcgttgttgttgggcgcctacatcttcactgctagctgacctgactgttgccgactggtttcttcgcctccatggttatgcaacttcattacatttgattggtggcatctttactactactgacatcttccgttacttctgatgagcaatttcgtcttcatgttggtcatttcatctccatgccgactgcgtcagctattgccaatagacaattttgactatgacagaaggacaagctatatgctcaggggctcatcaactcaagcgtgaggattatatctccaatttggacttgttccggatacattccacgtggattcatagtcatgagtctattttctatgctcaaagactggaccaattattattccccgtaagggctatcaaccgaatacttgcgccagtcgggattcaattattatatttatttttggagtatcccataagggataatcattcagatcagaagctattcatatgagctacacttggtctatattacccggaagatttattactcaggagcatgttacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctgccccgctgactttttaatatagtcatggtgctgtttgggtttttaagcaattgattggatacaatatcattgctttttgccacgtaagtgtgcgtttttattgaccaatattatggcttaggctgattatatattgtggtcattttctaggcggttggtaaatcctttatgagtttatttactcggattttacaccacatatgccatatatttccaggtgtggtgaaaccatgtgtcttctagggacttaagtacatctgttaaagcagtgtgcgcatggcgtatgcccaatactttggaaatttctttattcataatatacaagcttctttatagctattttgctatatcactcatcatattttacaaagcggttggtatatcactcggatcatgttatttggaggattcacaccgcatatgctatatattgatatcaagtcacttggttgattacgattatcaaaaccactcggttggttggattatttattccttgactatatgcttggtttgttcaattaaccacattgtcgggggctacacctattaggtgcatctagtcggtgcacctgactttattttccagccctccacagtcttcagatttggtaaaagtactcgggagaccatgacaaagatgattgaagcactcggctttggagtaatctggttcgagagaagattatcttttcgactgcgaaggtctcaggggctactgtggatattgtgggtaccccatacccatacggcatggttatccgactagtcataggggataacttatatctatggaatatgtaatagatcatgactcgggtattacgtttccttgtatattacggaacggcctaaagtcctggtttgataatattgtaaagtagatttaggaaaccgataccgtattggttaaggtttctatcttgtaatcctgccccccatcctatataaggtgggcaggaggccctctagggggcagatgagacaacctgatcgtcagatcaatacacactcggcggattcaaatccccaaacaggagtagggtattacctctcattgagagggcctgaacctgtctaaatcctttgtctccgcatccatccacttttaggtctcgtgcgctaccccgttttattattgccgaaatcatgtttcgacacacatacacacacatccattagcagcaaacagttaatcatcatcagtcagctgctgcgctcgtccaatgccgtgccccagcgtcgtccacgtacatctctactcttatcatttggtgtacctaataagagtaggaggaggagaaggaggaggagaagaaaggactcgcgagaagaaaacaaaagaaaaggcgaggaaaagagagaaaggaactctcacaaatggggcagggggcgcgcggtgcagatccatccaagcgagagtacgtataaaaacaaacaaaaaaacacaggagagagagagagagagagagagagaaagaagcttggagagagagagaaaggagtagtagtagtagaggggagagagagagagggagaaaaatattggagaggggaagtgggggaggagggaggggtgggggcccacctccacaagttttactttttcagccgcccggttttgtcgtctcctccgtcctctcctcctcttcctcctcgctattaccccc

SEQ ID NO: 82862 - DNA, 33884 bp, Oryza sativa
ctacttttgcaattttccataaaaataatattaattctcaaaaaaattcgtttcatgaagtataggtaatggatgggtctgaactctgatttcccttaagcaaacaattgtgcctggtcatgttccaagaaatgcaacgacgaaaaagacaacaattattaggatttttacaaagtacaaaattgcagaaaatttatgaaaacggtatgataaattgtttgcttatacagtagtgggacctgccctggcacagttgatctagattaactaatatatattgtgtgggagaaaacatcatagtttcattgctattccacagtttaatcaagggactatctaaatctttttcgacagaaaaaagcttccaaaattatgcagttggatcgctttgagattcatgccacatgctcaaaccgtttttttttctcccttctcttcctcatcccgcctaccgccgttgctttcacgtgctcgcgtacgcgaccgcgcactcctgcaccgcctccgccccaccacagtatagctcgatcggccatctaggatggggctgcagaggaggacttctgcataagctctggtttgagaccaaatttaggttgtgtttggttccacgttaaaattaaaagtttgaagaaattaaaatgatatgacagaaaagttaaaaatttatgagtgtaaaaaagttcgatgtgacggaaaagttgaaagttgaaagtaaaaagttgaatctaaacagggcttatatgtcctttctataccttcggcaattggacatcactagtgaacacgtcacacttactctcgcacaaatcatttttccagtacaatctaccgtgaaagtagaaaacgtcgcatcgaaccacacgtaatttacagcgactcgtgtaggtgccacgtcagttttaaaccggatgcgccacgaagctgccgctttcctcgtcgctggcgccggcgccccacattttcccggccatcattcccgccgacgagctcttccacttcccgtctttcttccccttcgagaacgacggcgcgccgccggagtcgtcgcggcaggcggcggccacgctgaacgtgcggtcgtactggaccaactgctcgagcacctccttcatcgtcggccgcgacgccgggtcttcgccggtgcagatcatgccgagcaggaacaccgccacggcgtcctccaggaacgccgccctgtcctggatgctctcgtcgacaacatcgtgcagctcgccgccgaccttttacctccgccacgcccactccgccaggcaccagtctgcgccgccgtcgttcgccaccctcccgtcgtcagctccagcagcacgacactaaatttgtgatactggccttatcatgtgtagtactttattttgttttagattataagacgttttaggtttttgaatagattagtgcatagaatttatgtatagacttaatacatgtgtttaaaagttatataaatatcaatagatctagacgagaactggaaaagccaaaacattttagatggaacggagggaccgagggagtaggaaagagccaaggactcaagactgcaataggtcaaggtcttcgacaactaaggcgaatcttcttgggcctcttatttcaaatgaaatttgggactatttaggcccacatgtcttttggttcttaaaaataaatggactcttctgctagtggatcctcaggtcgatgccaaagaatactcaggctggacagtttatatatggaaaatggtctgatgttactcctgaatatactgaggctgtgtttagaggtccagggataaaaatttttgctgtgtcacatcggatatacagacatatttaaagtattaaacgtagtctaataacaaaacaaattacagaatccacccgtaaactgcgagacaaatttattaagcctaattaggcttaaaagatttatctcgtaatttacacgcaatctgtgcaattagaatttttttatctatatttaatactttatgtatgtgtccaaatattcgatgtgataggatgaaaaaacttgccaagggatcaccctgaactcattttcattttggaagaactacaacacaaaggtatatatgtaagggtctgaactctgatttccccgaagcaaacaattgtgtccgggccctcatgttccaagaaacgcaaggaaatagactacaattactaagattttacaaaagtacaatgttgcagaaaaattgtgagaaacatcaatcatatgatttttcctttgtttcaaatgggttctaaaatctatatttttgaacatgttaatttattcgaaattttcaagcactcatctctacaagtaaacataacttaaaacaatcacgttctgaaacaaaatttatttttacttctatgccttcggcaattggacacaaatatggtggacacacttttacccttacacaacccgtttgttccctgcacactctacagtagaagtacataatttacagcgaggtgtcacatcggttttaaaccggatgcgctatggcagcagcgacttgtgttggttccccttgccctaccccttctcttccctaaggccttatttggtttggagggaattaaagaggattgaaagagattgagggagaataatttcacaccacaataggtgtgaaataaatcccctctaattcctcccttatggagattatccgaacaaagcctaaagcagcggcggcaagtacccccgtcttgccgtctattccatctccagcggctctccaccaccaggtccacaaccgatcacggtgtcctaatcataagctctaatcatggccatgactccaaactcattgatcttcctttttccccttcccctcaacctcctcccataaccccctttttcactacgctgtacagtagaagtagaaaacgttacatccaactacataatttacagcgactcgtgtagttgccacgtcagcttaaactggatgcgccacgaaactgccgctttcctcgtcgccggtgccggcgccccacattttcccggccgtcgttcccgccgacgagctcttccccttcccgtctttcttccccttcgataacgacggtgcgccgccggagtcatcgcggcaggcggccgccacgctggacgtacggtcgtactggaccagctgctcgagcacctccttcatcgtcggccgcgacgccgggtcgtcgccggtgcagatcatgccgagcaggaacaccgccacggcgtcctccaggaacgccgccctgtcctggatggcctcgtcgacgacgtcgtgcagctcgccgccggccttgtaccgccgccacgcccactccgccaggcaccagtccgcgccgccgtcgttcgccacccgccccgtcgtcagctccagcagcacgacgccgaacgcgtacacgtccaccttctcgttcaccttcgctctgcacccgtactctgcgaccgcgagacagacatatcgtcgaacacttgactctcatgagctagctcgatcgatggcgagcaaatcaaatcaaattaacgaacaacaatcttgtgatgaacctcacctggagccatgtagccgaaggtgccaccgatggcggagatggaattcggctcgccggacttggcgaggatcctggcgaggccgaagtcggcgatcttggcgcggaaggccgggtcgagcaggatgttgctggacttgacgtcgcggtgcatgatcggctgcgcgcactcgtggtgcatgtagctgagccccctcgccgcgtcgatggcgatgcagagccgcgtcggccactggagcggcgccgtcggcgcgccgccgtcgtcgcggcggtgcagccaccggtcgaggctgccgttctccatgtactcgtagacgagcagcttggtgtcgtcgccggagatgcagcagaggaggtcgatgatgttgatgtggcttacctccccgaggatcctcacctcggcgtcgaactccttgtcgctcttcgcgtccgacttggccgccgtccgccatagccgcttcaccgccaccaccatgccgtcgctgcccttgccgccgatgttgatgcggtacaccttgccggagccgccgctaccgatcacgttctcctcgtggagattgccgagcacgtcgcattcggagaagtgcagggtacggaacggcgtcatcttccacccggcgaggtcttgctgacgcttctggtgtcggatgatcagcaaccagatggcgacggcgccgatgaacacgacgccggtgagcaccgagaagacgatgatcaggttcgtcgacgatttgttgtggctttggtgggggcaagccggaaggttcatgttcgtgttcaccgtggcacagaggccatggttgccgaggaagctacgatcgtaggcgccgttttgcagcgtctccgggacctcgccggagagctggttagaagaaaggttgagaaagttgagatggagattgctgaaatcttgaggtatgtcgccggtgagcccgttgtcggagaggtcaagaatgtagaggcccatccacccgactgcggcagggatctcaccggaaatctggtttctgctaaggttgagggaggtcagacttgtcaatgatttgatagacggcggaatcgagccggataactggttgccggcgaggttcaactcggtgaggttggcaagcctagacatgtcagctggcagttcaccggagaactggttgttctccgccgtgaaactcttcagaccgacggcggtcgacgggagggcaccggagaagcgattgttctccatctcaatcctcgagatgttaaatgatatctcactgggtagagtgccggtgaagttgttgttgtaaatcatgacattggtgagcaactcgaatgaccatatcttcttgggaaagtccccaacaaagtggttgttgtatgccatgatgttgttgatggttttgcaatccccaaggttcgtcgggaacacgccggagaagctattgttgaacaccacaatgtcaaagagcttcttattgaagcaaagtgtatccggtagctcaccagagaggttgttgttggacacctcaaaattccccaattccgaatgctttccaagctccgcgggtaggggcccagagagcttgttattgaagagacggatgtcagtgaggttcggcatcataccaacaccagccgggatgggtccagtgagattgttgtagtacaaaaatagtaatctcaacttcttcaggtttgcaatgtcctctggtattgatccagagaacttgttcatggacagatcaagctcctgcaggttgagagctgtgatgttaggaccaatctcgccactcaaattgcttgcatagagatatagattctcgagtttctggtgcttcaatacccactcgggaatttgtccctgcatcttattttgtgacaagtccagcagtgtgagctctgtcagtgacgatagatcatcagggatggtcccagtcatgttcatacatgataaccacaacaacttcagctttgtgagattgccaaactcttttgggactggacccggctcaaacgggtttttcgccagcgtcagcgtctcaagctccaaaaggcctccaatggcggcacccgggtagttcccattgaagctgttagtgtcaagtaccaatgacttgagcttcgagaaccttccaatagccaacggcacatcgccggtgaaagcattgctggacaggttgaggtgttgcatccccaacgatagcctgtcaatgcggtccggaagtttgccggataattgattgttggataggtcaaggaactccaaagctgagcaaccgtagagcaccgtggggaaatcaccggtgagattgttgaaagagaggtctatgtaggttaggttcttgagtctacaaacggaggctgggattggtctggctatatggagacttggcaaggagaggccagtgacctgacctgtgctgctactgataacaccagtccagttgccggtgctgctccatgaactgagtggagctgggttgtcccaatcttgcttgattgctaggagtagtttttgctcgtcggcgctgggctgcgcagtcgatagagagaagagcaatagtagtagaaagaggatgaggatgttgtagacagccattttttgcgagtgtggtgtgttcttggatgttcagacatggcgtcggagtgatcttaagtagaaattaaggcagagagagaaccaccatcgaagtgcgtcactacctcaggtcaagtcttcggtatagcttccttagcaccaatcctctagtgattgaaagatgctctgatagagacatgtgagttgtcagttgagcactatgctatcctctttcatccaacttgaatgtatttaagattagaagcatgaaaaggatgatcaccttctggtgtagtacaagacaattacttggaatatgttccgtttgatatatatgcgattatatatcactatgatacggcactcgaaagcaaggacatgcagtgagaatggaattgccgtttcctagtcgaaatgttcttattctgttctgtcgaaagtttttttatgctttacatacatatgttgttctgtcttttcggcagaaatgggggggggggggggcgagattgtatctactaccgtctcttgtagctgaagaaactcgtgtgattctcgatcgcccatatctgaaactctgaataattggtgcaggttcagagagttcaggacttcaggtatattcgccgcactctgtttctgaattcagtttcgtttcgttgtgcactgtttcttttgccacgtacgtgtgtaaatcatggaattctcacaagatgttattaatcgggacaaaaactaagctctctccaatggagtggtgtcatcgatttttattgatattacgtatggagaagggaaggtatctcacgctcatgatggattttatgttctaacatcaataatttgccacagtagcatactactataaatccggtttttccaaatgtccaattgtggagattatgagtatcccatacccacacgatatggttttccgactgattataggggataacttatatctatggaatatgtaacggatcatgacttgggtattacgtttccctgtttattatggaatagcctaaagtcctggtttgataaaattataaagtagatttaggaaaccgataccgtattggttaaggtttctatcttgtaatcctggcccccatcctatataaggtgggcaggaggccctctagggggcatgagcacatatgatggtcagatctatactacacccggcggattcaaatccccaaacatgattagggtattacctctctaaatccttgtctcggcatccatccacttttaggtctcgtgcgctaccccttttattattgccgaattcatgtttcgacaccaatcctagttttggcaggcggcaaagcgatcatcacgtaccaaatggtctgtaaaaattgatatcgccgccggagcccgccgcctagagagagaagaggggagagaaggagtagaagaggtcagaggagatagccgggcatagagagtgtgggtgatggaagagagagaggagtggagaataaataaaatagagtgagctatttttgcgtgcgggtgagttaagagccctgcatgtaaacataccttatttttgtgtgcggatattttaagtggtccgtctgaaaaatttgaattttgcgtatagatctcttaaagagccgtatgagaaaataagggtcgatttttgcagacacggacactaatggtccatctataacctattggggtgttcgtctagaaaaatcattttttaagaagtggcaagcataacccccaatgcaaaaacttttaccagatttgtagataacacctatacgacaatctatcatttcgaaaaattccaacacaaaacagtaacaaacctttgtcttctctaaagaaaaacaaacacaaccctcttatgtgtttcaaaaattacggaacaaatcacacgacaatatctcctaaactctcaagatgacattctctcgttgtttagaagtcaactaaatagttatgaaaatttttttaaaaaaaattaacaagactgattattatgataaatcactctacaaatatacaagttaaaatttaacttctacaagttccaacagaaaaaacaaattaaactatgactagttaacgtatattcgtaattaatttttttattgcagaagttaaatttgaccatgtttatgaagtggtttatcatatattaatctatcttgttgaatttttttaaaaaaaatcataactaattgggtaacatgcaaacaccgagagaaaatcctgtcaagagtttaaaatagttttgcaatctctatcctttctatacgcaagctatctttgcgacgaatattagccatttagcattatcaaattttagtagggcagagaaccggaagttcgagatattcgcacgtctgcttcagctggttgtggacaaagaggtgactccgtgactccccgtcgtccgcttgtcctattgaagtattgatgatagagcttgatgactgatgagtgaacgacatcggctgaactcgcagaagaattctctaacgccgacgatccagtcataatcagtgcggaaacttgaagctttctgctcttataacccactgtcgatctggccatttgtacaaacgaagggacgggtgtgtaaagttttggcattgtcacatcaggtattatgtaggatgtcgcatgagatgtttgggcactaataaaaaaactactccctccgtattttaatgtatgacaccgttgactttataaccaagatttgaccactcgtcttattcataatttttatgcaaatataaaaatacttatgtcatgcttaaagaacatttaatgataaatcaagtcacaataaaataaattataattacataaatttttttaataagacgaaagatcaaacgtttgtcaaaaagtcaacggcgtcatacatataatatggagggagtaattacagaatccgccagtaaaccacgagacgaatttattaaggctaattaatctattattagtaaatgtttattgtagcactacattgtcaaatctagagcaattaggcttaaaagattcgtctcgcaaattagtcgcaatctgtgcaattaattattttttagcctatactacctctatcccatattacttgttgctttgacttttttcttacaacatttgaccattcattttatttgaaaaattagtgcaagtacaaaaataataagtcaaacttaaagtacttttgataataaaacaagtcacaaacaaaataaataataattccaaaatttttttgaataagacgaatgatcaaacactacaaacaaaaactcaaagcagcaaataatatgggacggaggtagtatttaatacttcatgcaggtattcaaacattcaatgtgacagggtaaaaaacgttcgatgcgatggggtgaaaatttttgggatgggatctaaggtgtgtttaggctgtgtttagttcctgaaattggagaaaagtttggggaaagttgagagtttatgtgtgtagaaaagttttggatgtgatgtgatgtgatgaaaaattgagagttgggggaagtttggtgtgaactaaacagggccttagtttacgccaaaattaaaagtttgattgaattagaacaatgtgacggagaagttggaagtttgtgcgtagtaaaattttaatataatagaaaagttgaaaagtttaaaaaaaaaagttgggactaaacgaggccctaagcagccccgaaaaagagagaacatctctctttatgtcagaaccatggtgcattcagcagcaatcttcctgagggcatgtgcatcactgattcactgtcaccggctggcatgcgtggtggctgtttcgcttgtgaggctgttcgtgtgccaaactttttttaaatatacgaatacaagtaataaatatagactaataataaaataaattacagattccgcctgtaaactgcgagatgaatttattaagtttaattaatttatcattagcaaatgtttattgtaacatcacattattaaattatggcgtaattaggctcaaacgattcgtctcgtaatttacagttaaactgttcaattgatttttttgtctacatttaatacttaatacatgtgttcaaacattcggggctactttggtttgtgacctaaattggccttaccaatttttggcaatgccaaattttggcaagttttgatacgaaaaattttgagaaggcaaagttgtgtttggattgaagccaaaatagcctaagttaactattgaaatagcctattttcttaggcatgccaaaatttagcttcaaatcaaatagacactaaatactattaaaattgtcaaatattggtaagccaaatttaggccttagaccaaaccagtccttgattttacggaaaagttgtgtgtagctgcctgcagtgcaagtgattggtttgtcagaagtcatcaagtcaaagtcttctccaccaataatgtaattgtcattgtcactgtaactgtagttgcagtggcccacctagactattccacttctagaaggatttattttagtgcttaatacttttatcgtaaataaacaaattaaacacgaaaagtaacacatcatgctactgtaagtttggataggctaatatgtgttacagtacatctgtattacatctgtgtttagttccacgctaaaattaaaagtttaaaaaaattagaatgatgtgacagaaaagttgaaagtttatgtgtgtagaaaagttcgatttaacggaaaaattagaagtttgaagaaaaaaaagttaaaatctgaacagagcctatgtttgttcattttaaagagagggagtattaattattgtttgttcattttaaaacagagagagtattgattattgtagggtctacttggaatacatacagcattacttctacttctatgtacagcatgggcaactggcattggtcaccattgacctatttttatattaataaagcactaaaataactagaaaaaaggtgatgctgcaaaaagtattgcccaatggtacataacggtccatatagattattacgaagtactagtggcccggcgaaaaacgaagtaccacaagtgtaaagaatgtgggtgcagaagaactatccatcgtccccaaacgactcgaacatcaaggttgtcgacaaagcatcaatcaaatctatgataccgttatttcataataaaacaatctcaatcacgtatattttgtaaaagaaaaaagtgaacttcttcttgtagagacagatatagtattaaatattattgcatagaggaggaacttgacgcgcgttcaagtcgatcttatacttaaaattgatacctgtattttacaagaatttaatttagaggataattcatgtatctgtatgtatgcacgcgcgccacgtgaacagctgccctcctctagtcctctctcctgtatagtttatgtatatatgtatgtatatgctatatactcatatatattatatgtatgtatatgtatgtatatgtatgtatatatatatatatatatatatatatatatatatatatatgtatatatatgtatgtatgtatatgtatgtatatatatatatatatatatatatatatatatatgtatgtatgtatatatatatatgtataatttttaatgtataaaaatatatatatatgtatatatatatatatataatataaacaaatatttatgtatatatagaaagtttatatacgtacggataaaaagtataaaaatatatgtatacaaagttctatacttatacgtattaaaaaaccgaaaaacaaacaagaaagaaactgaaaaacacaaaaaaaaaactcgcttgctctctcccatgagcagcgcgctgtccgccaccctttcttcgtgcgcgccatatgtctagtcacgtggggagggacacgcgcaactgcccaccaattagcaaatccacacgcagtgtgtattgggttgtgaaacacgtactcaagcttaggggatagcatatgtatgtaccaatctcattgaaatgtgtaatctgatgcacccatgtggtgtgtgcgtgagcgtatgggtgagtttaacttcttgtatttaaaagaaaacgacacacgcttccaatggtagatcccaggcggttgatatttttgccatgtatttgtgaagtgagcaaaaaccatttgaaagaaaaaggttttttaatatggagtacaatacatggccgatttatattttagtctataatcttggtttaatgtatcaccttaggtccaaagtgcaaaagacttaacttgagtgttaacgtggtcatccatagtaatgagaattttgtatttaaactcccaccattacaatattccccaaaatatattaactccccatgctcccaaacctacttcccactgtgtgtgtgtgtgtgggagaggaggtcaagaggtggttattagggtggctgcaatccaaggtagacggtgcaaggcccatcgcttgtcttcacaacgacaatcgtgccacactgagttcgtcggattactctcttcctatcacatcatctatctcgactccgaggacctcctattactgacaatcaatgacaccctaatcaccatctctgcatctccacttccatgatcgtatggtggggggtcaatttaaagtacgtcctatttggggaagcttctatctactgcacttccagaagttccaaaatttgaaagcataatgtaacacagaagtttgaatgcaaatttcccatcaccgtggatggccacatcaacgcatgagttgcgtcatctgcactttaaacctcaggtgatacattaaacgaagattaaaaacccaaatgtgtatttctacaagctcacatatctagatgacacttagtccatatttaaggaacggttgtgtagtttttactcttttatatattacagtagtatgaggatcatactttatgttgggagaagtcacaagttgataaatccaagctgtagtagtatctattaagcacaggaatacaaagaaaacttttcaaaaaaatcgttgatggcacctaaaaaatgaaagaggatgaatacacactactacagaacatcaaatagatgctggcactacaggtgccggaagtgctaaaaccggcacctataggcctttttcggcctctacgggctgaaaatacaaaaaaaaacgggcatctttatataactatatgtatcgattctaaagaaaaaccgacacctatactatagatgccggtttttgataaaacccaaaacctttaatttattaaaggtgtcggtttataaccgagccaagccgggtggagacaagccagccgagtgggcatctttttatctctctcgatactgtgtccccaccttatctcttctcctcctcccaccggctctctcccactgtctatctcccttatctcttcttctcctcccaccgactctgcggcgggctcgcggaggggacacggcggtgcgcttgctgaggtgaggcggcggtctagccgcggggaggaggcggcgacggcaggtggaggagccctcccctccaccagatccggcgggaggggaggcggcaacggacacgacggagctcacagatggaggcggcggtggtctcgccgagggaaggcagcggcggcaggtggaggagccctcccctccaccagatccggagggagggaagacggcggcaggggcggcggggctcgcggatggagatggcggcggtctcgccaggggtaggcggcaacaggcgacgggctcaccaaggggaggcgacacgacaggaggtggcgcacacgcaacggctcgaagacgacgactatggcagcggctacacgaccgtgcgacgatgacgatggcgggacaacgacagagaggtgtggaagaggtgtggattcttttttattattattgccaagatctgggatgaatttgagtgtcaaaatttgtgttgtggatgaatccatctatggattttttattaccaagatctaggatgaatttgagtttcaaaatttgtattgtggataaatggattgatatgtggatgaatccatctgtggattggatatgtgatggattagatgatatgctcgtggtcgtggaacctcaaaggcagcacctatttcttttcatatcagtgccgtctccatagtgctggttgggaaaaccagtagctaagggggtttctcaaccggcacatatttgtgttttgacactatggatgcatgttggtagctttccaatatatacacatcatgatgcgcacagcaccaattttatcatgaaattattgcctagtgacgattattttgactggacataagaggattagtggttcacggacaagaagtaaatattagggcccactcataaaaatctactgtctccggtcaaaaatataataactgttggctaagtatttgacatacagtgatatatcaagttatcaacttctaactatatatcagaacatattcaaatgtgtccaaatacatagagcacaaaattattatattttaagataaagggagtacatagaaattactgggttgcaaatgctagcactcaataccacgcacgcgcaatttcatcaataaccattagagtttagttgttgacaaaaactagctagtttttttcagattatttactattaaatgaattatttgctaaaagaaatacattttctcagaaagctttcttctattaaattgtttggaccacttgttttaagttgtttgttaaatttatttactaaaaaaatatttatctccataatccactagataatccatagcaataatccgcttaataatctatttcaaaccaagccttgaacaaattttactttttatttttgaaaaaatgctcagtaatttgtaaaatatgcaatggaagtagtaggtgggatgggggcaaccaccaccttatttttagtatagtacaatattatatattaaaaatatatgcacacaacatgtcgataacatcaaccgggactaaagatcttcctcttataaactgggactaaaaattatttttagtcccagtttttaatggaaccaggactattgtgaatttgggtcgaccgaccaaagatggtttctctgccagtgacagcaggttaataaatatgaaggacaaatttgtatgccacacaaatttctgctgaaaatatgatgatttaaataatgataaatgaagtcaagcaaccccacaattataccgtgctccaattcgtagggtgtgtttttattgttcttttcaagtaggatatgatatacatccatccatttcaacaactcgtacacacattgtgagggtgcctcttgtgcaaacggagtttaataagtagctcaaattgatgaaatatagatcgagacaaataattaagcatggaaaaattggccagtataatcgggtgtatcccttgatgattactcctatgttttaaaatattcgaattattctataataaagcagatttacgataataatccaatcaataatctatctctaatacgacctaattcatttttatgcatcgagaaggcgtggcttggcatcgaggcatataatcatcgatctggattatgaacaacccacatagcacgccgaaacgagcgaatatgacatccacgaacaagtggcctgaatgcctgatcgatcctaggctagctcagctcctacacacacatcactatataaaagttactttaaaatgtcatattactctatttttcaggtttaaaataatcaatactcaatttaccatgtagttaatggatcatcatctcgtcttgtttacgtatattctcaatcttctcttttcttctcctctcaaacacatccagcaaagtgtacatcaaccatgagttagttgcacatcttctttaatttcacaagtgacccactactgtagctttgcgagttcttatctgcgagtagaagatattactgtgcctaaccctgtaaacagtgcgcccacagggcctacacttgcatgaatcagcaatccacaaacttttagaacaagttcggcagtgatgtttggttactgcggaactccggatgaattaaccattaaaaattaaaaaaagatttatttgatttaaagaaacttatatgtagaaaatgttttcacaaaacgcaccactatactcacggaaaactaggaaattaaagttgcttaagagcaagtttaatagtatagcccactactatctccaaatcatctatagccaatatcatagccaattcatgcaataattgcttactatactattaatacctggtcctacctgtcatccacacattacgtcttggtgtccgtgttacagctggctataaatctgtagcccgctagtcttctctctattctcttatctctttaaaatatatttatatctggcttatagcctgctattgtacatgctctaaataaactcagccagtgtctgattcctggctcactagacatattatcccttcaagtgcttcaagatttgtgcatggcatagatcaggcctgttgaagaatccaacggcccgtactacttcgccatcctaaacacatcgacgcctatagctgcagtgatccaatacagctagttccgtactaggtcctgtttagagaagaatatatcctacataattaagctagtttatttgtagccctgtcgacaggttaactggggttgtaagatttgttcgcaccaatggaggcaacagcatggtttcagctgtggcttcaagcatggtcaggcttgcatttctaattgcatggatggtacacaatggaattttgtccccaaaagattttggaatttcaaaggagaatatgtgcctcagtggactgcaactgcaagcataatttgaccatggctattcgatcctccgctgttttttcttttcagaaaaaaaaggtatcatatatagggtggtctagttaaactataagcggaatccattgtatgccatccacaaaaatcattatatgcgatgaagcttggataaatgagtccacccaactgagttttcttcctttatatgttgccaccacaaatccactagcacccaacaactttagatagaatggaaagaaatgtttgttcctagctaggttatcatgcattattattctcacatgaaatagtttttggataacacaaattttgacagatatgcacatggaagtgaggcctttatttgtcagtgctgggagcaacaaccctatttcagtcctctagatcaaaatcttttcctaagcttaatggagaattgcttgcggatttgtaatgccgattgcatgaggaaataaaacgatttaccccatggcagataatggatttgggccttttctttattggtgtaatgtgcaaggaaattttctcttagactatgcatagaataattattctccaaacttaattggctactcttcatagccccatttactttagttagttactccggtcaaaaattacttgatgctgccggtggagggagtacttcatgcgcctaatgcacctaacatgagtggatcattatgaatataacaagtattgtatgcttgaatataagtgtaagtccgacaaagtcttttttatcataagcaataccaaacaaaggaggaccaagtgcatgccacatcaagaagaatcaaaagatcaaaacaaagtcttgggtgaactttaaaaaatatgcatataatctgccataaactaaaaagagaaatccaagatttgggctgaacttgatgagccatttcagcaggaaagaactcagtcaacagagtatatagattaacagtataacagagccccgtcaatgtattttttttttaaaaaaagaaaccgtttaatgtttaatgtgtaagtagttagactgcgtcaaaagctaatactgtatgtcttatttttaatcaacaaaacagagtaaatatagccgcaaattgtgcatccttctgtaagctagaaattgtgcgaatcatgcatcctgacaagctagaaattccaaatgagaactctacgaacgaccggccaggccggcactggaaagtggcatatcttagtacgtatgcatatgcctccattcgttttcataaaccggctgcacgcgtgcgcagaagctggggactattcaggcaaatggctaccaaacagatggatgagtgtatatacaggttgtcccttttggtaccaaccgaactgagtgatcaaatctatgctatatatctcaggatggtggcaatcaatttgtttatccacaaagataaggcagtgatgtaacttacaatggattacagcttttttatctgcttttgtccatcagtggacgagtccaagaacacgacctgcctttgaacgttgaatagtgctcaattagttagctaatatacgtaggatcgatgtagccatttcaattaatcaagtggcgaaaggtgaggagctttggcctttattaggaggtaagaaatggagaatctaggaggcaatgatgcggcaagaatcatcattatatataatggagagtaaagtggtgggtgaaaatccaccgtagatatgatatgatttatcctcgtccaggggccaagacatgcctagggctggtagtgcttaaattctaggccaaactctgcaatccaattcaggccctataaaaatacaatagaaattctgaaaatatataatgggtagttaagggcatatttgctcagccctagccgccttggcttttcctatggctcaatccttgtcctcatcaatcttgttgagctttcaccgaagcttcggtagatacttattatcctgcttgcaaggaaatggcacgatgctctcttctaatgttgcataaaagcaagatatttcattcaaaatgaagggaagtgttgtgatcaacaatcaagcttaaagatgagtgcaggacattcttaataacctaactagtaaatactacttgactgcaacttcaaatctatttgctttgtaaaaaaatgcatgtacggttttgagcgcctaggaaaaaaaatgcatgcccttgtatttagattgtttatttcagttagctaaacttccactattatcacttctagaccatggttgaacctccaggtgttcataatcgatgttccaaatagttaacatatgatgttccagttccagtggtatcgatagtatttagatttcattttcaaacaataaaaccagaaactttacacctctaaactaccatactgtgtataatgatagttacttcctaggatgttgttttttcctttatttttagaggactccttaaactaccatatctgtgcttgttctgctgctgccaacacatgttcattaaaccagatacaaccatgcataacatatacatttagctaaaaaaatttggtgaaaatgttgtgcattggagacaggaaaacttcagctaaagcttactactgtatattgggaatccagggaatatatatatcagaatattcagaattatcaaggcaattaataagcaaagacagcaggcggtagtaaactaaatttcgataccttcgtgatgagagcgaaatcccccgcccaattcttccggagaaggaggaagagaaaaaggcgctcacggcgacggcgggggaagaggtggttagaacccttgatgctgtcgcttcgtcgtcgacggggagcggcggatcgatgagcgcgcctcgtcctccgcggcgatggaatccgtggctaggggtggggggaaggaggagaggcgccggcgtcccgcggggaggtttcaggggtgcgcggcgcggaggcggcgccggcgcggacgcggaagaggggggatcttcgcaacgcatatgatccgacggccacgatttctcttctgatacgattttcacaaagcccccttgattcgagtcgatacatttggtagcgatccgaagttttacacaaagcccccactacgtttacatcttaaactcaattttaatcttaactaattaaaagattcatattattcctctcgtcgcatcctttgacccgcgttttttcgtccgtcaccgtccccttccgctttgtccacaaaaactaggattcggtttggacagataagctcgaatcgagctcaattccgcgttgatttcttcaagataagatccgattcttgaggaaaacggaagaggaggataagagaaatatttccccttaaccaattttggaaaagatcgaaaggggagccaggatttggaggagaaagcggcgccgggtcgggctcagtctccggccagaggttgaagacagcactgtagcgactgggacgtggtgtggactttggggaaaaaggctggcccgagaggagaagaagtagggacatgaaacggactttcggcgctgtaaacttcgtggattaggcccaagaaagagagaggatttttaattacttctccaaataaattaaccaatgaaataatctttgaattgttaaaaatatttccaatgctcaaataatttcaagaaaaatcttgaacatacttggacactctaagtatttaacaacattaaaacaagatcatttaatgattaatttattatttaaataattactgaaatgttctttgtattattaaaattagtagttgagctctgaaaaatcctagaaaattccaaagagcagaattaaccatggagaatttaataaaattaaatccagccatgctttatatttaggaaattttattatacatttacaacttactaatttatttatatacaacattaattcaccaacaaatacatagcattaagtgtaaccaagagcaaaaaaatgtggttggatttatcacgtcatctttccattcactacttttaaatgatttttctagatgagcacccgaatagattgtagacaggccataagtgttcgtgcctgcaaaaattgatcccgattttcccgtacggtttcttaagaaacccgtatgcaagaatcaatttttccaaatggaccatttaaaatatccacacgtgaaaatgtggtgtttaacttacccgcatgcaaaaatacccctgaagattctcacttttgtttattctctagtcctctctctctctcccaccacccccactcctctccaccctaccggcggcgggcaagggcgacgacgacggcttcctcctcttctcccccactcctcctctcccctctcctccctcccgatgcggtggagggctcaggcagtgggagagggcggaggagggatgcgacagcggtgacggatccgacgatggtgaggcgtgtggtggcggatccgacggtggggaggcgcggcggccatcgcccgcacggatccgacaacggcggatccggtggtgggaatgagcggtggcagcggatccgatggtgaagaggcacgggggcagcggattcagctccccctcccgcgcgtcgacggtgaagggagtgggcagacccagccaaccctagccccctacgccccacgacaaggacggggacgaggatgaggacagcagcgacgacggtgacaacgacgacgatgacgaggaggacggcgggcatccgtgatatggacaatattacatgacatacaaaaaataaataacttattgtagccataaatataggagtcaataaaaaacaattttatttcaaggtggtatcaatatctttcttataatcataaatcgactggatttaaaacaacaaacaaataggtatgagtgtagtgagtgtcaattcgttgcaccacaatacaaggttcgatttagtggagttgctttcggttgatgtgtcatcgctttcgactccttatccactaacttgcatgtgcagagtatgtatgtaaaatcaaaattgacttcatccgttacaacacacgagcactgtgctagtagaagtatagaactcccccatattttgtaagaaaaataacctagtagggccaactcaactttatttggtagtagaaaaaagataattttttggtgagtagtactctcaaatgaggttgagtttcaacttattattatttggtgttaatatacttcatgcctatacttatctctagtaaattttttctagcaaattgtctttcctagctgaatgtaatataagtttataatctttcagatgcatgaattatttaaccaaatacagagtgttcagttatttggaaacgtgaatctttttctctcacataatgtcgatgtttaagcattgaaactattggatccatgccattgtaacttcttcggttataaaaaaaaatgacattactattcacttattaaaaatgccattacaatttgactaaaattagagatataccactacgtaccccttcaatgcacttataaaaaattttgaaccaaattacccctccttcattcacccccttcttccttacactagaacctccgccacccacacactaatgttgaaggtgaaccaccccctcgtgtcctcctctactttgctttctcccctaccaccgccaggggagctccaaaaagggtgacagcaagattcgagcttgaaggggctaccacaaaccgctcctcgacatggtcatcccagttaccaaggttttcatcggggcagccccgccgccaccactgtcatccaagaggacgacgagatccgcgattatctaccacgagctcaatgggatggctagtgatggagaggtcgcggctctatggtatggggatggacggtgagaagtgggcctaggtggagagggcggcagccagcggactcgattgggatcaccggattggaccggtggaagagatgacatagattagtgagagggagaaggaagaaggaagtgaaggaaggagaagggataatttggtgtaaattcttattgcattggaggggtacatagtggcatatctctaattttggtcaaattatagcagcatgtctttaaatagatgaatagtaatggtatttttcaaaattgaagaaattacaatggcatgagtccaattaaccattgaaactaatttaactcacttctctgatttgttttataacaattgaatgtgctatattaaattactaacccaattaaagcatataaaagcatcatgaaacatctgagctttggccactgatcggatgagccatttgcaagttgcaacacacgttggagcctcagtttaggccccctgatcaacgtttgcaacaaatttggccacatttctctgaactaggaaggtagcccgcgcagatgcgcaggcaatttatttattgtttacaaatttaattggtaaattttgagatagatctaatggtttagaaaatttgaagatttttttcttaagagagtaggaaaggaaagaggagatgaggagagtacggaagggtgtggagaaggtgggagcacatacttttttttattcgaactaatagttaaaaatattggacccaccaattttaaaagaaaatcaatggatagattttagagtgtcacttggcttaatccaaacaaattaaaattaaatcagatctacttgaaaaaacacaactaaattgctttattttttcgcaattacgtagtacatttatcaagtgatatttgatatcctaaaatataatatgaaattatttaaaattatcataacattaattattatataaatttagaaccgcaatataaattttataagacacaaatattttatttaattaaagaaatgcaacgggatcacaaattgattatataatttaaaataatttaaaagatgaacgtttagagataattgatttcatattttttatttatattatagatctagtttatatttgcacatatttgtggagtaatatatttttatatggtaaaaagttatattttaaagatcattgattttgttctgacggtaatatgtattatcgattttaatttattttgaattttaaattgttggtttaattatgtatagagcaacagttagattagatatgatatgtgtagcttaaaataaccatggttgtttctctttatcatagctactcaaaaaatatagagagaagtggagggggcagaaagtgttgtgcgtatctaatggtgagggtgaggtggaggggactttgtttttctatttttttctaaatcatttaggtcaaaaaccaattatcatgtattttgttttttaaaaaactttttaattttaaagtcattataataacttaaaaaggtaatcttaattacacctatttaagctggacgatttaactggattgcttggttcgaattagctacataatatcacggtaaagccatgtaaactgatttaattagctatgtataatcttcttgtaaatctcctagcttacatatatatatatatatatatatatatatatgtgtgtgtgtgtgtgtgtgtgtgtgtgtattgccgtgcatgtaataaatatagctatgattagtagtaacacaatatgacagctaattaatctcaacttctaacaaccatagttactaatccttccgacaaaccgtacatacgtacgggagaaaggtagatctaattcattggtataaaataatgggtccaccaatttaagtgaaaatcaacggcaggtaaagatctaatctaatggtataaaataatgggtccaccaatttaagtgaaaatcgacgatgagattatattatgccacatgacggcctaggagcatttgtaggagcgcctcgtggtggcttaagagcgtttataggaagtttaatggacttttagtatataactaggaaggtagcacgcgcgaatgcgcgggcatgcgtcgtacgctaagtttgagatacttataaaagcgaaatattaaccggtgaatatctaccacgatttctccataaattgttttcgtcgacattaatttcctttataattttctaacctattagctttatattatatcatatttatgtaatatctataagcaattatttataatcttcttcatcatttgaaaagaaggtatacttattttcttaagaaaacatgtcaataaaaagtaagtgtaaaataaaactaaggtattttactttttttaattacatatatattatcatggtttattcgaggattaattgggtgggacatgaagctccactaaatatatgatttatatagcctaatatgatttatgtaatttgagatccatttatgaacattttatgtggagtgggtcagaagttctacgcaagctaacatgaaagcgaaatataattgaataataatatttttgaaatgtgatgtaccatgtatacacatatgttttttcttatataagatagatctaactattctaaatagtgattccaccagtttaaaaggcataggagtattccagaaatgtagcttaaaaattatggttgttttaatatccaacattattgcgaagtaaacgtagctcaactggttaggttcattgtgatggaatttgcccacttgggttcatgtcctagacttggacaaattcttttaagtagtaggtgacgtacccgttgacagcgagaagtgcatagtgactttatcaatctcaaaatatgtcagcctagtctctcgaaaggactaggacaaattctttcagtagtaggtgacatacccgtcgacagcgaaaagtacacagtgacttcatcaatatcaaaatatgtcagcctagtctctcggaagtactcataggggtatgtgcatgcgtgagttcatagagctgagtgtgtgcgttgtgaacacccgcgtttgtactttatttttaaaaacacatcaaacattatttagaaaaatagataaaacaatagggatgggacaacactgttgtgtagatgtgagagtgaggaggtagagattttatttttctaatttttctaaatgatttaagtgaaagctgatgacaaggtgctttattttttctaagaatttccaaggattatccccttttttataggacgtgccccaaggtaacttaagattttatttaaaaaaatagatctaataatttttttgatagataggtttagaagatggtttaaaagaacattgattgaatatttattatagatcttaatttaactaaacatattgatatttgtgaagtaatatattttatccttatatagtagaaaatcatattttaaaaagaccgttgattattatgtatgtatgtttttttctgtctttcttatgtatacgtatatgtatttgttttcttccagcgaagatcaggaaactttatcgttttgttttcacaatcatgtacgtttgtatacgtacggagagaacagcagtaggatttgtaacgtacaaactcatacgtacggacagtagtagcgctggtacattataaacatgcggaagttattattttttaataatagatttgatctaatagtgtaaaataatgggtccaccaatttaagtgaaaatcgacgctaagattagactgtgccatgtggtgacgtaggaacatttgtaggagtgccacgtgacggcttaggaacgtttatagaaagtttaatggacttttagtatataatagatagatagattgattcctagcaacaacaatttcatgtccagtaacagagaacaaaactattaaatgggtctcatgcaacaaagcaacattccaaatatcatctgccagagaataaactgcataaatgtagagcatttagctgaacatttacatgatggtcatgtcaaattgcactcacttcacacaagtgtcttaaacagaaggaagcaagttggttaagtaggaacaggaaaaccccaaaagatcagcacagcaagacattgagagaaagagacgatgatacaagctcagaagatcatattcttcttcacagcaggtcactgaatgtgtcaaagcagctccaaaaaagaaggtcaacactcagcagctgttcttttccgtccagaggttattagctgcatggattacatggcgtgaacaaatttcagaataatgcggagataacagagtttgatgtaatagaactaaggtggaaagaggtactgacagatgaagagaggtcagatgtcttcagtactctcagtctcttaactgaagaaacaaacatcctgcatgaattgcagtatcagactatcagttaggaggcatatggtccagtttgatggtaaaattattttctcccagtttgataatcaataaattttttaaaaaaaacaagggaatagactgcatatcattttcaagcattgctgtttgcataatcagcatccaataaaagtagtaactttgtttactactctctgaaaatgcaacggtaaaacgaaaaactcacccccatggcacatctccaacaagcaccttgtcgccttcataatcctcataaaccaaagtgtactccccagttccatctagcaagccagatattgccacatcttcctgctggcagtcctttgctccagcagtgagggggtctctttgggcttaaatacaacgacggaaattgaacacattggatcagatactaatccgataactcagccattcaaatttcaaaatactgaaaataacaaagaaataatttgcgaactttcgaaagaacaataaggaaataatttatgcagtgccatggttcagtatcagtggaaaactcttcagatactctatcataaactgcagtcgcaattgaatgatttaattgtgttacaaaacaacagagttgaggttcatatacctgcaagaaggcctcggaatagcttgtcaaccgctaaagaaagcttctcatagctatcaaaagcattcagatcgatctttctaccaatagggacaccatccatgtttatctttatgaatggagctctcttgatctcttctgcttttgcagccttctttccattctgcagttcaagagatgctttgctggatgtagccagatttcttctgaatgttcgaaccggaggccaaccaacaacaggagtactaggagatctgcatttcgaggttgtcaggttgaaaaaggttcagaaatgatctcctgtattattttgcaaataataactacagcaaactaaaactagagtatctgactagctatagttactatttttcaaggttgaaaagttcagaaatggtatcatatattattttgcaaagaataactacatcaaactacaaaatagagtatctgactagctatagttattacctttcaatttccgttttttgtacaaatcctaaatcacctatgcatcagaaactatttctctggaaaaaggatgttcaaattaaaacatacacattgtagtagtctacattcagatcaggaagcttagtgcctgatggtgtacaacaccagtaaatgattgctagctaatgccaaagctttgcctatatatggtgacacaagagtggcttataaatggatgcaatctaaagggtggcatatgatcaattttcctgaaattatacttaagtaaataatcctgcaaccaggtatgtcaggtgaactaacaacaactgtcatgaacagaagggacaaactagaaagtaaacaacaaacagtactacatgttgacaaagacaactgcatccctcataaatggagtaggagatctatctatctatctccatggatagcatgcaggcaggcagaagcaaacaagcaaaatggtttttgtcataaatgaggagcaggcatgcaggagatggaggcatctccctcttcaattcatgcagatgaggaggaaatgaggaataaaagaatcaggagctagtagctagctaccaatccaatagttgagtttgcccactcataaaaagcaaaagattatggtgctgtggaatttttgacatgtgaggagaggcccttatgattcccaaccttgtctggaagcagccattattgttggatgcaagtgcattattccctgtagctggtggtggatgtgcctcttcttcctctggggaccccttgtttttgtttgccttgcctgcacaagaacaaggaggaagaaacaagatgtgatatcatgcttcagagaactttttcccctgctgttcttgacttttgagcatggcacatgcaatcaagattgaagaagaaccaatgatgcaatattctactcatatgcaatacttctttttttttgtcagataatggatttttcattaaacaacaatgatattacctaggtttcttatgtaaacacacttaccacaagtattttcttgagcagtgtttaccacaagtatatatcaagtcaactaaacctctgaaaccatactgttaaaagttcagtgcacctatcagctccccccaataaaaacacaaaaagttcttaacaacaatcttcttaacaactaatttttcaggtttcttttctgctcattctcctcagccaaattttagaaaccactcctacttcagagttgagagcaatggcacacacatttctgctcaggtctcaaacgctgcattacccatatatctaactaagtttcatcagaaaatgaggcacatttttgtggtatgtcacaacaccaaaacactaacaaaaacacacgtataactagatgtctattacagtaacatgcaactgacatcgcaagaacacgagatcagttacagagttgtgaactttttcttttatctgtaccttgcgagtgggagacgagtgtggagtagcccagggagagcatggagctcttgtcaccatcatcatcatcagcagcagcagctgctgcaatggagtgcttcgtcgtcgtccccttgtccctgcacgccgctcgccatcctcctccggggagcccaaggctgagctccagcgtcttctcctcctcctcctgttcatcgccatggcgatggtgatcgcttggctcccccatccagcttccgccgagacggcctctgctgatcttcttcatgctctccgacgcctcccccatcacccgctctctagatgtacagctcgcccaaatccaagaacaaatcaagaaagcagaaactagctagctgagctgctgctgctgctggttgctgtcttggctgcaatgcaagagggagaggtgtggaacagagagctagaaaaggtgtgggaatggtagtagtagctgcagctgcaatgcgagcaacggcacacggcaatgtgatgctccgatgcgagtagcgtctagctgagcctgagctgagctgagatgccgcccatgacatcctatcctgctactcctcctatcatgccctgatagagagagattcgtgtttgcttctgctgcctactgcattctctctctctctctttctctatattcctctcactcaaaaggtggcagatggagcagttaaaatagcataagctagctataaatatattttaatgagataaaaatgagaaagaaaagcagtgggctacagatctgtagccagctgcagcacggactccaagacacaatatatgtatgataggtgggaccatatattaatagtatagtaagcaactattgtatgaattgactattagatcggctatagatgaattagactaagtagtgggttatactattaaacttgctctaataatgtggtggttttgctttagactaattaaagtgccattaacaagctcatcagctagtaatagagtagtattagcaagaagatgatgatgattatggaggcagaacagcaagcgacaaggccataggtgggtgagaatgagatggtgatggggataattaggcgtgcagcggagaagatttgcaggatcctgctcttttggccgctgctgtagacctgtagtactctactattcctattcggctagtattcctttctactctctctcatggcctctgtgcctgcctgcgttgggccgcgagcacattgctgttgtggttgccctgtctgtctatccgtgtgtcgtcagggtcatcaggattcaggggcaaatgcaaatgcaaatgcaaatatgcagtgcagagaaactgcaggccaggcagaggcagaggcagcagagcactgaaaaggttacagtggccaagcaagcaagcaaaggtgacaaccaaaccaaaatatgctttgctttgctttgcattgctttggctttgatgatttcctcctcttcttcttcttgcgcgcgggcgaggccggctcccgagttggtggttgttggcatgccaacggacgacgggttgttggctcaagaaagctgcctttctcttcctttcttgtgagttgggatcagagtactcatcgctagctctgggttcgtttgtttgtttgtttcggtgccttgcattgcgttgcacctgtaaacaattgcagggatgcaggtgtggcatgcataatgcattgattcttggagcaagcaatggagagttgttttgttggagaattttatgtagaaagtggtcttatgttgtgtgatacttcctctcttttcaaatactacctccgctttttatatatataacattgttggttgttcgtataatgtttgtctattcgtcttattaaaaatttagcgtaaatttttaaaaatataagtaaaggtcagagttttatatgataaaataaaacataaaaaattaaatagcatttatataaactttttaaacagaacatataatcaaacgtcacattaaaaatcaacgacgtcatatattataaaatggagagagtttaatatttctcagcacaatagtctacttttcaaggcatttaatagggtgcgcgcaccctcaacaggatcactctcccaactgatagtggtagctcggatctaatgttgaaacatgaaaccactcattttatattgtaaatgcccttcaaagataatagaagaaatagggcatgtttggattgttgcaactttcatgaccattctgttcctgtaccaaattttggtattagcattttggtattaccaagatttgataatgcaacaaatcaaacatgttcttgtcatttctatcttactaaaagttggccgtcccgaaggttttcgctcttaaaatctctatcatattttggtaaagcctaccaatcaaacataatcaatattatcaaattttggtaataacaaaatttatacttgggtattaccaagtttggtagggttggtttgggcagcaacaaaccaaaaagatgcttacctttggcctctgcaaaaataaatgataacattaatatttgaatcccagtgaatagagttatgcatctacgactccctcccatgatcacattgatgttgctttctcaatggagttatcttttgctttttcttatttcctgttttgtaaatttgtaacatctgttggcaactgaaaatagaatgtgaagtgagcccatggaaaaaaaaaggcacattgcacaatttgcggaaaaaatagttatcttagatatcatgcaaaaccttgcttgaaacttcatgcaaaattacttgtagcatgaaaccatccatgcaaaaaattgtgagagcacaagaatgcactttctgcatctaggaaagcaagtgcccctagaggtcaacaataatgagctggtggcagcatccaagcaacaacagtgtgcaggtggtgagtgactaacttcaacttgggtgccattttggactttggagggaatcattgtagtagtaacctccatccaccacctttgcataaacctctctctggtcccctacatctttgctcctcttcttcttggtggccgttggatcaaggattccttgatctagcgtcctatgtaaggtttgtcaatgtttctaccgcgagagagagagagttagatgaaatttccacgcttctaataaatttaattccattaatcatgtaactatgtgttgtcgaatagacaaccacgtcacgtcgaagacgtggtttttttcaaccgttgttggaaaagtgaaacagttgtattacttagtgaaaaaaacttttggaatccccctattatatggccctagggggctatttatagccccattacaagttctccctattagggtttagattttacaggggaattttcattgttacccttatgataggaatattattgagggcacactgtgtcctttacacatatgggctcctactggacttaaatggctcggcccatctatctgccaaaatttcctgaggacgtagcggcccgctaggcttcccgacgacgaggttccgtactttggcgaaaccgtgccttcatgccgaggctttcgccgcatcatctacacccgtgcagccttctggcaaggactccgcttggcgaagctggcgtaacccaagccacggcttacgcccatatggctttattctcaaccttcgccgcctgcctccggtctgagcctgttgcccgagtttttggtttcggcaggtccggccgaaggcccttcgtggtatacctccagcactatgcaaatgttgcatttctaactctagttttcctaataacctgtaatatgtccatattatacaacggtataggcctatataattagaaattgactagatgggtggactaataatctctactattataaaaactgaagatgtttttattggtctcttggtacaccatccgtatttgagtctgtcagtttgttcgcttttggaaacacatatccgtatgtaagtcggattttaagtccgtttgcttttggaaataaaaagagtcgtataagaaatctctttaaaaaactcgcatgctaacttaagatgaaagttggactcctaattgtagctcatgattttctaaagaactatccaagcg

SEQ ID NO: 82863 - DNA, 40731 bp, Oryza sativa
gtagattgctgatttgggtctatccaatggctccaagtgcatgattgtttttccttttcttttgggttagaaacatttgcatgcaagtattcgctatcatgttccttacttgacttggcctttttatcaatgaagtgcgtgttgaagggctggaaacaatggactaccttgacaatttgaagggaaaggagcgttttacagagcaaggggatgctattgtatttgaatcagaggtaagtctattactgttaaatgtccacatttcgtgttaaataactaatatttcaagcttcttacctataattttctatgttaagattgataaggtataccttgctgcaccttcaaaaattgcaattattgatcatgaaaagaaaaggacatttgtcttgacaaaagaaggacttccagatgctggtaagcttgatctgatggcaaatcttttatgttgacctaactatttttcgctatttgtgttatttcatctagttattgctgctgtttctgctgtagttgtttggaacccttgggacaagaaggcaaaagctatgcaagattttggagatggagaatacaaacacatgctttgtgtggagcctgcagctgttgagaagcctattactctgaagccaggtgaagagtggaaaggaagacttgcactctcagctgttccttccagttactgtagtgggcagttagatccattgaaggtccttcaaggttgagaattctcatttctgcgtcttgtacaggtgatgttttgctctagtttgcaacgttacctggatgagtcctaaggctaattttgctcttgtggatccattgcattacttgtgaaattttgttgttggttagatgctatataccttggttgagttcccgtaaaagaattagtggctgatgaaaaagttgaactttccggtactactatttgagatgcctatgataggtgctcgctccggtactttctaatgggtgtttgaaaattctgataggaaaggtttggttgttaatgccgaaagtgtgtttggttaggagcaattggttgagttgactgcttcctgaaagctttgtttagatgaaggggacagctccttttgtgattggggatttgtggtggttcttgtttgcctactcaatggataaataatgttttcttgtgtttggctgctttggcattagcataatagagattgaactaagtataaaaaaatctacgcttctaaattgtaagctttactaaatatggtatgcaattaaaacgtacactcttcgttttttgtctaataaccacctagctccactcgtaccgtcaccgttactgctacatgttgtgtttggaaaattttatctgtatgaggtggcaatgcttttaatgtttggttgctttggcattagcatgaaagggattgaactaaatgtaaaaaaaaaaatctacgcttctaaattgtaagcattactaaatatggtatgcaattaaaacgtacgttgcttgtctaataactgcctactcggccgtcaccatctgctatggctgttgtgattggcaaattttatctgtatgaggtggcaatgcttttaatttgcttagtttttttgagtgctcccccttatggtcaacacttaacacatgcccattaatacgatgttttgaaccgatttctcttcattactaataattaatatgatgttttgaaccgatttctcttcattactaataaatgaatggtttggttttctgcaggagcacctcattgcccttaatatttgatgctgggctggcgcgcgaccttttctttctttgccattttaaatcccccgtgcttcgttctttttttgtacctagaagtgagtagtagggtacctccgaaataacagactgtgccacctgcttcgaccctagagcggatcatctccttggtgaatgaattcgaccagtggacacaagccattcgtgccctggtgatatgattcatcgtccatattccaggaaatattcgccatgctgcataaggtccgtagcattctcagttaatctgtagttatgatcattgggagcatttgagttacactggcttgctactgtgcttcaaagcctagttctttgcctccttgtgcaaacgcctctaaagaatgatgtcaggtgcagctagtagtaatatgttgtcaatacatgagaattgagtatcgactgttttgagtcgccttgggtaaggcccagtttggatcaaagcatattttgcatgagttcatgagattgttgcgttccaaacgggttcgtccaactggctggaggaggaagcatgtgccatctgtcatttgaaagttattctcaatggaaccaaggtttttttagtggaaaaaatgaattcatacgcttctgttgagtgggtaattaattagcctatgaaatttcaacccattcgtcaactccaagcttcttgggttgacatctcagttcgtccagtgaaaagaggcgtcagtggatgtcacggagaaagagagcttcaggccagctggcacgttcatatgctgcccaggaaagagcaaaaccgtgaaagctgaagatcatcacataaatcttctaagcacttcacatgaaaggaaaaattgataaaagatgttatggtgccaaacttctgtggaagtcaaattcaacccttaacttcagaaatataaaatattgattctagcctttcgaaatacagaacatcatgttatcgccaatttaaaaattgaattagatctataatttcaacaataaaatgactccaattggggaacattacatcataaaataattacttgctatatgctactcccttcgtacttgtaaagtaagttgtttaggacaatgtttgagtcaaaccttgggaatataaatcataaataactcttaagttgttgagtttgaaaatataaaaattatatgaatagatttgtcttgaaaaatattttcataaaagtatacatatatcacttttcaataaatatttttatagaaacaagaagtcaaagttgtgttttggagaccgtgtcgctttcctaaacgacttcctttatgagtacggatggagtatattttaaaatagtgacatgttggggaagcgcgtggtagtagagttatggttatatgacttcactcataagagagtttaaattctggtgcttatgaatataaattatgtacacacaaatgggattttagtgcagtcaaataggattttaatgcaaattcagtgatcatggatgtaatgatggttgcaaaatagaaatttagtgagattagggttgtactactctttttccatctctttgagcgtacatgcactccatcctactctgcccatacgaggaaaacctcttgtgtgaattctatgttacactcattcctatgtattagttgatacctacggtttgctgcaggatatatatgtttaaataatgcaaaaataatatagagataatgatttaacattgcttgcatattgagttctaaaaatgcaataaaattgtaaatgatatgtcatatttgtatgatatttaaaatattctagataataattgctagtgtgtgatgacgtgacacacttgcatgtgatttaagatacaaccagttgcttcatcctccttccttcaccaactttacaccagtcagcacatcttcctccctctcctcaactcctcgactatcatccctaacaccgacgatatccactatcctcttttcgcacttcatacaccggatctaaagcatatcctcatcctccctcccttcatacaccggatctaaagcatatcctcctccctccctctcttcaactccttgaccatcatccctaacaccgacgacatcccctatcctcttttctcacttcacacactaaatctaaagcatgagagagtcctcttttctcacttcatacactggatctaaagcatgagagattcgctggagagggcatgtatgttgtgatgtgtgaggagaaggaaagggaggcgtcaaggctgaaggggacttggaagagtgtgcccctcatcgcctggctgactggcaagccacctatcgttgccttatctcttctcccttactctcctcaatgcctccatactcctattattgctatgatcggtgggggcaacgagctgagggttgccgctgcttcgttcccttgcagcgtgggagatcaaacatgggggaggcaggaagtggggatcggattcatgaagtatccatcggaacagaattccgtgctctcgcaatccttatatttttagccattagtttttgggaaaagtccattttacaccctcgaactcttatacttgtctaaaatacacccccgaactacaaaaccgggtataatacaccctcgaattgtcaataccggacacttaaccccccgggctgtttttatcgtggtttttgccacgtcagcacacaaagtaatatgggccaagccgcctagcccatactatgttcgttcttctctccctcccctgttcgttcttctcttcctcacgactgttggcggcggcagcgacagcgacggctgcggtggcggcgcggagctgcgagggcggtgactgctgcgagggcagagctacggcggcggctccccgttccgcacttggccgccaccagctcgcgaccggctgaggcgttgagtctcctccgtgcgaggggcctgtgcggctccctcctccacccgcgccgcctctgctcctctgttgcgccggtagcagccgcaaagcccggggccgccggtaagcctccaggccccgctcctccttcccctcgcatgcatggtgctgaaccgctgatatgtgcgatgatatttgcagggacgaccggggaggccggaggcagctgcggcgccggtggaagagctagcgaaatctctgcagggggtggaggtgttcgatctgagaggaaaggcggttcccgttgttgatctgtggaaggacatgaattttttgtcgtgctttggaagattgattgtgtatgagacaattgatgctggttgtttgcaggtgtgtgatgtgccgtaagagggccgatcttcttgtggctaagaaggttagtttactgctaagcaggttagtttagtggccgattcctctatgcgaatttcgaggaacaaaggaaatacatcaaatgctcaaagtgatgcattcttctactctctttttttcaatctaccaggttccatttacaaaaacataaaatgttttcattttcaaacttcgcagctccgctccgccgccgccaacggttgtgaggaagagaagaacgaacagggtgttggtatttcttaatgatattactagaaatataattcccagcaatggcgcagaaatactcatggtatattatggttacagagttcatccgcaagcgcacggatataccattgtagcatttcacccgagagtattccaagggtatcgtatttattttatcccgtgggaagatcatgtagagagaactcaactaataatttatatattacttgtgataatcatattctaagcaggggttaagataatccaaaggtagagtgacacacaagcattactactcattctcataatatattatctgagctaagtggaaagaaaagagaaagaaaatctattcatatacttctaatatacatagtatacatattctcataatatattatctgagctaagtggaaagaaaagagaaagaaaatctattcctatacttctaatatacatagtatacatatacattctagttaactgatatactagctaataccctctatctgatgccctcctggtacttcgagaagccacccctaactgccgagttccttacgacatcccgtcatgaccatacaactggggctaaatacggaggaataccctccccagggaattaacttaggattatataccggcgcagaggaatactcgtactgagctgtcaccatcagcggcccacctctcatccgcaatatataaccccaaataatgatatcccgtaatctagacacaacgtctaaactaccagatactactctaatatcatcgtcatgacatagagtaattgcataagcaaacattatacccgcaccaaagcatctcccagataagctagccgtatattcagtataacatgaacataatgtaaagtaggtattcatatacttggaaagtatttcaataccataaatatatttagaagagtattctaataaaagtacaaaacttacaaaagagaagagaaaagctactagagccatacctgaactcttccgaaggcttccggactcctgatttctactctattcctattccaccagctagatattgctagactaaacttgagagaaatgagagagctattgcttgaggtgtgtgagtgaagtgaggatgagagctcctttatagcctcccaatgacggttgtgacggttggaatggtcggtaataccctccaaccgtcattggggagcaatctcagccgtccaggggaaccctggatcaaacggagctgctgggggttcggccgaacctggggccggcccaatcctgcccaatttcggctagcggcctcctctgttgcttctcttcgcagacttgtgaattttggcccgattcgttgtgtcaattctgagttcttggcccattcatacataagtctggttctcgacatcgtccgattgatttatcgtctaagttgatgtcgattctcctccactttattgtcattctctgcaaaaggttagtatacctaatactagtggaatattattattctaacagatatatgcattgcaagcatcactagttctcctctattttggtaatattgacggtcgaaactgatcgataacgaccgtcaacacagggaagggagagaagaacgaacagagtatgggcttggcccatattactttgtgtgctgacgtggcgagggctgacgtggcgtccgacgtggcaaaaaccacggtaaaacacagtccgagggggttaagtgttcggtattgacagtttgagggtgtattatacccggtttttgtagttcgggggtgtattttagagaagcataagagttcaagggtgtaaaatgaacttttcccttagttttttccccatgcacatctgttctagacttaaaattttgttagatggtggctgcttatcacaacattgttgtatttttcttttcagagattgtatattaattttactggtatttgaggattgagaagcaagggatgcgtacatacacttgaatttgaactctgactcaatagagatcgccatatcaataacgaataatgtggacttcaaattgctgtatagaatgggttgtctgttcaataacaaaaaatttttctaccttgatttatttcctgctacttttctttgcccacgctgcattgtgtggagtgagagcaagaacagttctggacatttgagcaacaagttgaatctaaacaaagaatataatgaaaatctatgtaaacaaaatgaatctgcatcttgttcaattctctcaagtacactaatgtttcgtagcagaaccgacggatttgcagatggggcaccaattcttttgccgaagccattgttggatgcaagcaagatgatagtaatgcttgcacgccatctcggccacctcctcggcaggtaaatattcctcctgaaaagataagcaggagaaggaacatgtccacatgtcatcaccagattatcttttcaagtactaagaagtttcttcagcaaatccagtgcctgaatttatgtttgattgattggtacatcatatttttcagtacagtatattagtcattcatctcgaaattaaataacagaaatgttcttggcccaaattttcatgatattttagactagtttactatatagtagtattatatcatctgattgacttataatggtttgtatgttaaaatatatttagcatcgacagtaaggatataaaactcattattccttttcttttgctgcatgtcttggaagaagtgttgacagtaaggaattaaggatatcataaataaccagagcaactcacatatcatcaaactatagatcattctaatgatgcaatgctagtaaatgaacatacctggcatattatgcatttgatatcaccatcttcatgacttgttgaagctgagggcacatagtggattctcttcagacaatttgacagttcatcctctggaaggccagtgctcacggtaccaattgtttcccctagagcaagcaattcctagaatgccacacaaccaacatcaaacaaacggaaaggaataaattccaaacaaaaggttcttggggctaaaatgtttacatgaataaatatggactttagtaccagctctcttagaactgaataatagatatacctcataagacatgtcgtcgatgtccattctcattcctctatgcctatcactggaagcatcctgcaagacaataaagaattaaactctatgtttcaaagtggtcagcaacaaaatgcaagaggattgcatttcctctgcatcggtacattcttttcttgacataataatcaatacattctcagaacatctacagggtggatactgcaaatccattatggaagtaacaatggaaaggcgtacctcatcactttcatccacaccgaagcgccagtattcagtggagtcattcaaactgttttccaaatgagatactggttcttcttgatttctgcttctatgtctcaacaagctttgagaaacaaacctaccggtaggtccttgcaaatcagctctcctatgcacatttgctccagaatttccaccactatcactacgcattctggcattgcttccatttgtgcctccatccttccttgtctttggaactgatcgatgcaattgtcttgaaattgatctactactactactcaaggaacctgcactagatgtgtttgatgatgatgggctactccctccactcaatgagcgcttcctcgacgaatttactctttctttcaaatggtccagaagatcctgtccagcagtttctcttctaggtctgttgccggtttcgctacaggtgccggctgcattcctcctgctgccataagccattcttccttgaggtaacagcctgttggatccactgacaagtagtgatctctgaggaatcactgcttctttggttggcctgcgcattttcttctctttgtcacggaaaagcttactgctacagccagtgcgcgtacagcaagcggtcgctttgtggcgcgggctatcttccctatatacaaggattgagccccctttggtcaatagaaggccaccaactgttctcctccccatggtttcgtccatattcaactgaaaaaaaaagggagcaagctcaagtttgagagatgaataagtcatcatcaactaggtcaacagaatatcacaattggaccgagggcataattaacatgttaaaatcaaacaaagctttaggtgatacaaaacaatgaagtgctcccttataattcgcaaacaactaaagtgggaagagatctccgcaaataatttgcagaataagtatttttctactgtccaaaactttgcagcatcagcaggtcagaacaagataatggatgaaaccaagaatttgccaccaatcaaaatcaagtataatgcagaccacatatggtgacaatcatgaaaacaacggttcttgaaattaagaatcaacaaaaaaaacacacacatataaaccgataaaaccagacctgctcatcatgaaagcacaaccaaagacgacatcgacatctgtgcagatacagttatgggcaatgtgaccaaaacaaacagcattgtcagaagacaacttcagttaggtgatcctacatacttacaaattaactctacatatagattaggtcttgaggtgcttcttacaaccataaggcttatgcaaggatgaaaagccttttatcattctaccggacaaaaaaaaataaaaagaaaggaaaagttactggtagtctagtactgccccctttctagctgagatcattgccttttgctgaaaggtgaatccactcatacccacactaccacgccaagccaccattgaatcaagacatgaaacatgatccttaaaagtatacgccactattagcctagaatcaaatggcattcatcatcttgcaattgcaaatgaaaaaaacgtgacagacagtactacttggagtaattactgaatatcgaagatttaaagacagtattaattaatcgaggaaaactaaaatgatggtcaaacagagtagtaagtgatgctcgcagtaacagaagataaaaactaatcaagccaaaaaaaaaaaaagcgggggaaaaaagcagaagtgccaagatggtaaagtattctaggatacgaaccaaaacagattaaacggttttcccttaactcctacgatttgcagaagccaagaacaatcaaagatttggtaggcaagcaatttcataattgtgcatcgcgatcgtacggtcgtagtactgcgtggtggatgaacaaatacgcaagaaacgaagagagagagaggaatcaattgattgatcgatcgatcgaaacgcccgccctaatcgggcatcttttctcacgccccaagaatcgcccgcacgataccaacaaacctcaaaagaggcagagccaaaaacaatgtttcttgtcgtttaactccctaaaccattatccaagatacaaacaaaaagaaatcgttcgtacgtacgtataatctgacttgttctcgcaagaaaattacaattaaattggttccgcaatctcgtcctccgatgaacaagaacaacctatctatctatctatatctgcctgatcaatcacctccgtatcgaaacaaacacggacagggattaattgattcggaaaggcagtcacagccaggaggagaaccaaatcaaaatcaatcaatcaaacccaccaagaaaccacaagaaccatcaaaacggcagacaaagattcattcaaacaaggagatagagcagaaatcggagagataatctgagagaaaaataccctcccaatcttcttcttcctcttcctctgctgcgtgctccagctagaagggtagagagagagagagagagagccgaacaactcaactcgatgagagaggaggtctcaaaccctcaacaatgtctcgtgcgcttggcttcctcgtctcctcctcctccctccgccatggccaagaagaagaaataaaagaagagatcgagagagagagagagagagagagagagagagagagagagagagaaaacaaacgcagtcggagtcgatgatgaggtggcggtgggcccgacgtggcatatcatcctggccgtccgatgggccgcggcggatgggatccgacggcccgggacgaggtccggcacgtgggcccggtccacgtaggcggtcgagtcggacgcgcgtggcgctgagctcgtatcgggatacctgagacggggctagcgggagaggctgacgggtgggccccataggttgggcccccaccctccgggcccacttccgatgtggataccgtaagcggggctagcgggagaggctgacgtgtgggcccgaatggtgggcctcccgccctccggccccactttctggtttgcatggtggggtagttggaaggtgcacgcggcgcggccgccacgtcctcgcgtggaaaattcgttcgccaaattctttgcgaattatttttctcctcccgtgaattttttgcgaaaaatcattccgcaaaaaatttgacgactcctataatcaaatttcatgttagtatatactgcatatagatgctattttcgatcatttaaaagaaaacacgacgatagttttctttttccccttcaataattatagtgcattagtgtgccacatgactgttaatttctttgatattccctatgagataaagatatagcttttaatatcgaatggagaaaatatattctataccactgaatttgtttgagttcaacaatttgctatcgacattgtaatataccgacaactttatcaattgttttacaatacaccattggatcaccattggattggtccttcattttaaaaatgcctaaactactcttagaaacatactccatccgtttcaaaatatttgacaccgttgactttttagtacatatttgaccgctcgtcttattaaaaaaaaatttgtgaaatatgtaaaactatatgtgtacatgaaaatatatttaacaatgaatcaaaagatatgaaaaaaataaataattacttaaattttttgaataagacgaatggtcaaatacgtactaaaaagtcaacggtgtcaaacattttgaaacggagggagtacaagattaacaattgatttatctcattagaagtttcaaaatagtatgaaaacttttatgtggcctggccttcttatacaacatggaaatttgtatagaagtttcaagatttttacatttctattttttgtaaaaaaaaatataacttatctgtattacgctacataagatatttttgtgctatgatatcttgtataagcaaattctctctcatataacacataaaaatatattttttttctaaaaactaaacataccaaaaaaaacttaaaaattgtataaaaacttccatgttgtgtaaggaggccacgtaaaaaatttcatatttttttgaaacttctaatgagataaatcaattgttaatcttgtatgcctataaggatattttgggtatttttgaaaagaagacccaacccagtgggatattgtgaaacaattgataaagtcgccggtatattatataaagagacaatgtcgatggcaaatcgttgaactcaaataaacttattggtatggaatagattctctccgaatagatactaaccaaccgtgcttttcttatagttgtgaacgaatgtactagtacattatcaagggttttttttagacaaatgaactcattgttttttgacaggttgtataaattcatttgtggaaaaaaaagagagctggttttacacatcttagggccacttattttattcccacaatacctgtgtgaactgggctacatgccggtcatgtctcgtgtttttttcttgacatgcaggacattttttttcatcctgaagacgactgcatagcacggtagttttgttctttatatcgttaatgcaaaaaatatatatacagttaatattggtaaaggcccaaacaattagcttctcttttctctacagatcattaccgctttgtggttgagtcaaaacatacatacatatagtagataacactttctatcgggttaatcacattcacatcattactggtgttagcaaaaactattgtatttaaatatataacacggttgattttaattttttaaaactttgacaaataataaactatcaaatatttggtccgaaaacataaaaaatatattggcatctttttctttataagtacttttataatataatatttctgttagatattaaaagagtatgttataatatgttttagagtaaagtgtacggacggtccttaaatttgtaggggtgcgtcatttaggtccctaaactctcaaaatgcatatccaatgcatatccaagtctcagaacttgtcatattgtgttatctaggtcccaaatcgccacagccccttcagaatcctatgtggcgttgatgtggcatgccacacggacatgacgtggcattattttggctgacaaatggtacccatttaatttttttccttttcttttcttttctcctctttcttctcctttctctatgacccgtgcagaagaaaggaaaaaaacagaataagaaaaataagaatgagaagaaaacgaaaaagaaaaagaaaagaagaagaaaaaaaaagaaaaggacatgtcacgtgcatgtggcattgccacatcagtgccacgtaggatcttaaaggggatgtgtcaatttgggacctagatgatacactttgacaagttctaggatctggatatgcattttaagagtttaggaacctatatgacacaaccctacaagtttaaggaccgccaatgcttactctatgttttacttaacgccgaattaattccgttatgaaatctgagtaaagccctgtgaaaaaatgagccgaatcatttgtactttgtaaggtttcttgttgtattctgctgtcaagcgaaacttattttggtatgtcatgatacaaaagtgaaagtacgcgttgatcttactgtgaagggaatcaaagaccattttacttgatggagaaaataatttacttataatacattatgtgaattgtgatggatggcacaaaacaaaagtgttgataggttgctgcttttcaatcagaacataatccttaggagataagaggaccaagtagaagaatcaagaaccaacttttccttgaccatagacctaattggacctctcaaatttctcatcaccttttctttgaccggtcagttcccatttcaacaattaatcaacaagctaggtgatatcatgtgatgttgagtgccttgtcaactgcaactactactggagttgggtatgaatccacacaagccaagaagctgatctcaaatcaatgccacttgtgatgcacgaggaatgcttttgttttcctcccttctttattttttcttttggtcaatgagtcagttatggccgtttgtgaaactttccattggctccatttgggcctcctgcaaatttccatgctctgaaactaattaataattgcttttgtaagactaaacataattaattaacatagatgagggtcataccgtagtactgatggtgatttgggagtagaccagatagcaaagatgaacatggctacaagcacccgtagtttctgacctgaactttgaaattcagttggattagttaatacagtatttgggtaggtttctttctcttgtatatctctattctattggagtatatatgagtgatatttctctgttttctctttcttccttttccattttaatttatttgtgttctgttcttttcctttggtggcactactaattaataaagacaaaggtactttgaaaagatacggagtgtatatttttttttcaaggagtggttataggttattttattttattacaattaaaagtgtcacgccagtaaaattggaacaattttgaaacatgaagtgtatctattttttaaaggagttcttattggtccatttattttattacaattgaaaatgccatgtctgcaaagttggaacaaatttgagcatcttgcatggttacacacacaggacacatatgtataaccaaagaagaatagtactagattgactacatgtctaagaatatgtcaatctcacatgggatgttttcatggtgcttgctgcttggtgaaggcaatagtggtaccttcactttaaagaaattgtggccgtaattagctgcacagtaactatcacttgccttagcaacagtttggtcaggacacaaatgatggcaaaaactgcagcagaatcaattaaactacagcatgacaagtggagcttctactatgtatgtcatgaaaaagacaagggaaagtttctgctgctatgatcatcttcaaatgccctgctctgagaagggacaagcacagaagggacttacatagagtttttaacccttcttcagagctgtcatggaagattttgcattttgagaagataaaagaaatccctcttgaaatttaaaacactgctaaactgtttattttgaatgaaaaactctgttaaactttgttctgggatatccttatgaggatgaaattacaaaacaatttttttatctgggcccaactaggagtattatgggcctgtaaatactagacaaagttttcggaatgcatatagtacttacttttcggaatgctaaaattaagttcaagcacaaaaccctctcaagaagaaattaacaatgtacaaatgcatttttagattaatccatgtagctgacaaaatatctaacttgattttttttctatgcctttttcttctaatgttttgtaagaaaaattgtcaggaaagatgtttgtaggaaacactaatgtccaattaaacaaacaagtaattaagcccctgttgctcaaatatggatatgattattctcttgaaacagaagctgatttcatccactgtgtcatgaggaaactgaagatcactgcctcctcaagaacacatgcagaaacagacaggcagacataaaagaaatgtacaccctgaggcataaattttgccaaacagataacaggagatgaacccctcttgctccctcttcactcccaacatgcgagaaaaaaaaaatcagcagcagctgtatttacacacacacacgcaaaagaggctcatatggcaccacaaaatctgatgctctcctgagcctatctccttctccatcttcttcttcttcttattgctgcattttttttctctctcgctcttttgccggagtaaactgacagaagggcagggggacggattcattggctgctgattgcagatgcatcaggcaaaaccaggactaaagctgttgtagtactaaaaactgggagaaagaaaacaaaacaaagaaagttcagtaacaaatgttgttgttcttcttcttctttcgagtgccgtgcattgcaagcgcacggtctcctcatcatcttcttgctgttcttgttgtctctactgcttcgccggggccggcgacggcgagctgccgggccacgccggcttgcgcggcgacggcggcagcagctgctgctgctgcttctgggcctccagctccgacgtcagcatctcgaacatgacctgcacatccttgtagtcgcaggtctgcacgtcctcatgtagcttcaggaggccacggctgcctgcacaccatatattgcagtttgtgattagtttttcagatgtaatggtagttcttgccagttccaggatgtatagagtcatgcttagaaaatgatcagaaataaatgagcagcaatcatgtttcagaatgtatagatgtatattggattagatgatttttcgatagatggacacttgttcattttccaatgatggtgaaaatgcatcagaaggtatatgcatttgctactgatttatgcaaggatggtgagatgaataacatgatgtatatatagaatcatgcttagaaaatgatcataaataaatgaacagtaatcatgtttcataatgtatagatttatattggattagatgatatttctatggatggacatttgttgattttccaatgatggtgaaaatgcatcagaaggtatatgcatttgctactgatttatgcaaggatggtgagatgaacaacagaaggtaaagaaaaattcatttgctactaatcaacaccctttcttcttcttctcctttttattttgagagagcaactctttttatactttttgagaggactaatcaatgcattcggtagctttccaacccagtatatggtggtttactgtatgagagccaaaccttcaatgctaaaggctaaaggcaatgaggcccatatactacaggtagatagtactgagcctttttctgatgctttgggccttgggctccacactcaacaggctgttggcccttaaatggtcatccagtagtacataactctaacgacttaattgctaatttctaaaacatactaatttgctaattctatgaaaatcaaaaactgtttgcaattatttggtgaaaacaaaaaatgtttgtttagaaatgtaaactgaacaaaaaaaaaggttaaaagagcatgtcaatgaaacaaataaggcaatacggaaaataatttttttacatgacgccaagaaatatgggtaatacattttacaagccaaggatatatactgcaaatgcaaacacttagttttaaacaaaacactcaattcaagacaggagaagagaaaggaagctaagataggtatgaaaagggagaagggatgcaagtcagtgaaaaatatccaactattatctgctgtgtaattaatggaatttccttcatctttcccaggataaacatccattttctcgtggcctgacatcacggaaactttacaccattccagatactacaacaaatggcagtatggcaccacagattgccacagcaatacggccagggagcaaataaaaaaaagaagaagaaagaaagatgcaaaagtcattggtccaataacaaattggtgcaagtcagtcataaaagttcggcttagtgatcccttgccctctgcaactttctgccaaagaaatggccaatggtctccattactttctaatttatagcaagggcttcagaagcagcaaaatctatgagaagtttcctattccctactaactacaaaaactgtaaaatttccgcgaaattcctatactccatcggagtgtctcggtaggccaagattattattgatttggatggtatatagatttgaaccacaatcccaacaaaactctaatcagctataatctacatctatccattggccgtgtacaaccctgttggatgtagaggacgggttccgatctatcatctaagaaaatattctactacatctgtccagataatttgatccagaaaatacaaagtacagaggtacacacggtgaagtatcctcctgtgtacctaagattgttgagtaaagagaggtcgacattagcatgatgctagtaaaggataggagcacgttgacatgggatcctctggaccaggtccctgcactgcactgcactgcagcaccaaggacgatctggacaacgctgtgccgactgcccccagtagtgtaggactaccatcaccaggatggaccggggaggccccacctgtaagtgtcagtggcagtgcctcacctactgcattcgcatcaatggcaggcaggcaagcaaggcaaaacgttcttcagtgcacacacacacacacggcctgtacgcctcgtgacgccacgcaaatccccaaatcacaaatgcagaacatgcaaaatgctattgctaaatgctagtattaagatcgaaatcgagtcgaaatcgaatcgagatcgtgtgtggtggggagcaagacagaatcaacagtacagagtactagagagacgctacgcaacaagatctggaagaactctctctctctctctctctctctgtccttaattccactcactcatcatcacgtaattcatccatgctggttggttactgaatctgttattctcttgttctgcatttttttttctgcttcttttcttgctctatctgcagtgagcctgcagtaactaactaactaaccaactaaactaactgtgagcattttttccaaattgtttttttagttttgttgttggcgccgcctctataggtacagtagtacatggtactctctaaataaaaaaaatatatgaaaatttattcaacaccttatctctttgctaagtttgattatcttaattgtattaactatgttggtttcttctctaattaaaataaaaaaatgttgatttcttctctaattaaaataaaaaaaatgtgcagttccaaacagaaaaaaaaagagcaagaagaggagacatgtaatgtaaccaaccacatgagcaagtttcagagtttcagcaaaaggaggtgagaaagaaaaaaaggactagtggagtaaccgtatttatcatttctttatttttgttcctttttaaggtcgcattaattagcatcatggttatatccttatcattttaaagatcaatttgcatagtcaaagatggatactcttaattaatcgaatcgcagatacatctaaattaaaaaaaagcgaaaaaaaatgaactcttaattacggatattgcacatggagatagagaaaaaaatggaacgaaaagaaaaaaagcaaagaaatcatgatcaaagaaacccctctttttcttgatgaacaaccaccaccaccaccaccaccaactcgcatggcgtcaatcgaacaaaaccgcgcatacgcataaaagattgaagagaagagacaaaaaagaaaagaaaaatcctaggaaaaaatggcacttcgcttcctccatggaagcgaggagaggacgaactccgattctccaaccccaaaagaagaagaaaaaaacagagagagaacacccgaaatgagacgagattaactaacatcacaagagaccggagatatgcgacagcgacaatccatcatcaaccaagcaaacgaacgaatcaaccaatcgattctaagattatctacgtgggatacaccgatcatggaggaggaggaggaggaagaaggggagagagagaggaaaccgcagcaacagcagcaacaaacagtatacacacaccttgcttcctcgcgcggaggcggccggagacgagcgccgcccacgcgcggcgcgcccggaacgcgaccttcttcctccacccctccatcgatcctcgccgccgccgccgccggttcgccgtcagaagcgcgtggccgccttcgtctccgctgctgtgctgggagccgcgcgcgtgtccccgatcccacggggtttttatcccctggggtttgggccgtgtgggtgtgggttggggttgggttggaccgcccgggttttagggttcatgttaatgtcattgcggtggatggatggatggagacgcggtgtggctgcaagggcttttggttgggtgcacgcacgtaacaaggatgatgattttagtttgggttatgaatttagtttgtttgtttagttaaagagaaaaaaaaactaatacgctatacgagatagtatagtgcgtgttattaaaataccatcttacggagaaggatgttcacgcttgtattaatagtgaagaggattttagtctgggtcgttagtttaatttgtttacgtaaaggaaaaaaaaatactaatacgctatacgagatagcatagacagtattattaaaataccatctgacggagaaggatgttcacacttgcattaatagtgaggagggatgtaatacgtctagaggccggcaggagacgtggtgtggctgcaagggctggtccgatgcatgcacgtaacaaggatgatgttattttttttaaaaaataaaagataaggtcaaggatgaggatttaatttgcttcgtaaaaagaaatgtataatacgcgacttgagatagcaggtcctaaaaataccatctttaagaagggtgtgcatgtttacattaaatgtgaagagtattacaatatatcagcttagctgaatttggacttatcgtgtcacttatacgtcatgtggatgacagatagctatatctctttgttgtagaaaccatttacactctcccgctgtggagctcaccatgcaatgaattttagatttttgaaagactcaataaactccaatctagaaacgtaattccttgctcaccacgtttctttctcatccgccctaaccacctctatttcaacttagaaatgttaccatgttttctttctcctattcttttggcaaattatcctgatctcttcattccgtgctaccaacttcattggttcactactgattagtacatctccgtcgtgagaaaatataggagaggctgacaaccccctaaattcctctatcatccatcgttagactctgatgattaactttcttagcaccaaaatgttagagcattggtagtaggcacaaccaattcctaattggtgtgggaaggatgacactacattgccttgattgttagttcagaatcctatcatagtggcatattacactatatgattggaactaaatacaacaccatatcatttttttgaagaaggctataccatgagtcttaaggagcgggatgtgcacgcttgtattaatagtgaagaaggctagaatatgtctggggtagtcaaatttgaactattcatttcacttatacgtcatgtagatgatagatagctatatccctcttgatgtagaaactatttactctctagttgtggggatcactcaaaataaattatgactttttataggctcaataaactcaaatttagaacctttctttcttactcgccacgtttcttcccatcctgtcctaaccacctctgttacaagtctattccaacttacaaatgttaccatgtttctctttgcttattctttcggcaaactatctcgatcgctcctctaccttatttcgtgctaccaactccattggttcactactgattagtaaatctccttagttaaaaaaacatatgagatgctagtggctcctttacgacaaacgatgttgctaacgttctctatcatccatcttttgtgatgatataatgttagactattggtagataggcacaagcatggtatggttgcaagagtttggtctggtgcacacacacatgcaacaaggattttaggatttagtttaggtcataaatttaatttgttttggaaaaggaaaaatgtaatgtgtgactcaagatagagagctttaaaatattgtcttaaggagcaagatgcacacgcttctattaatcgtgaagaaggctagaatatgtttggggtatctgtatttgaactggtcgtgtcacttctccgacatgtggatgatagatagcttcatagctatatctctcttgacttggaaaccatttcctctctctcattgtggggctcaccaggcaataaattgtaactttctatgaaggctaaataaactccatttagaaacttccttttcttgcttttccacatttcttcccaccctgtgcaaaccacttgtactacaattctatttcaacttagaaatgttaccatgtttccctttgcctattctttcgataaactatctcgattgggcctctacctgatttcgtgctacgaactccattagtctacgccatgaatttaatttgtttaggtaaagaaaaagaaaaatactgatatgctatacgagatagcatagagagtattattaaaatgccatctgacggagaaggatgttcatgctcgcattaatagtgaggagggatggaatacgtctagatgccggcaggagacgtggtgtggctgcaagggctgatccggtacatgcacgtaacaaggatattgtttttttaaaaaaaataaaatataaggtcgaggatgaggatttaatttgtttcgtaaaaggaaatgtataatacgcgactcgagatagcaagtactagaataccatcttaaagaagaaggctctgcaaacttacattaattgtcaagagtattacaatatatcggcgtagctaaatttggacttctcatgtcagttatacgtcatgtggatgacagatagctatatctcttgttgtagaaacaatttactctctctctctctctctctctctcgttgtggagctcaccaagcaatgagttgtagatttttgaaaggctcaataaacttcaatctagaaacttacttccttgctcgccatatttctttctcacaccaccctaaccgattctattccaacttagaaatgttaccatgtgtttttacctattcttgcaacaaattatcctcatctctcctctacctgattttgtgctatcaacttcattggttcactactaattagtatatctttgtagtgagaaaatataggagaggctgacaaccccctaaactcctctatcatccatcatgattaacttccttagcaccataatgttagagcattgataataggcacaaccaattcttaattggtgtggaaaggatgaaactacattgccttgattgttcgttcaaaatccttttcgtagtggcatgttacactatatgattggaactaaattcaacaccatatcattcctttgaagaaggctataccataatgtcttaaggagcaagatgtgcacacctgtatcaatggtgaagaaggctagaatatgtctagggtagccaaatttgaactactcatgtcacttatacatcatgtggatgatagatagctactatatccctattgatgtagaaattatttactctctcgttgtggggatcactcaacaataaattgtgactttttataggttcaatgaactcaaatttacaacctttctttcttactcgccacgtttctgtcacgcccagaaattcctgaatagaattccaagtagaatgtgcattaaaatccctgtctaggaccggccggggtacacaaacgataaagttgacatacagatccacgtcttacaaacatcataaaagtcttacataaatgctggaaaattaaaagataaatggagctaagccttgacttggactgcagtgggaacaccactccacaggcatcctcgacggcacggacgaagcctactcctcggagaagccaccatctgacacgtactcaaaactctggggtttcggggaaagtagggcaagactgagtacaaccaccgtactcagcaagtcataccggaataggggtatgatgcaggatataaccaaaggatagctacagcggttcatttgcataaagcgagcatttaaaggcagcagttgaaagcagtaaaacagttgtaataattcatcaatcttaaccatccactgttcaacgctaccccacgttgcaataggcctaaccatccgcctgaactaatcaattccattagactaagctagggtgagactaatcacggtgaatctggttgaccgcccgtaaccgcgggcacgggtattcgaatagttttactctgatcagaggtgtacaactgtacccacaagacacagccctgcgacacgttaccgtgctccgatatgccaccacgacataccggaaagggaccatgacaggacccttcgcataaccccctctagccaagcacaccacacctcaggtttcacccccgtccccagcgggcaacgggcggtcccctctcgtgcctaggtgaatccggaagcgacagaggccatcgcagggcccgccccactccatcacgcccaccattgcctagatgcgtcaacgagagggaagctacactataagcccagccgttgcctacgctggcttgtggtaagtacgataagttcttccagggcatcccgcgaaccggtccttaagtgccatgggcgcgaccatcgaaaccatgcacccacagcccaccatttaatatattttaattaaccaacaccggagcggtgtcattaaccaacatcattactagaatctgatatctatgcattaatgtaactcccccattgtgtgctagttgaactaagcatggctaagcaatccctagtccaatatctagtcatgttatatcccaagctaacaaaggagcatggtacaaaaatagcatggctataacagtaggtaaacatcccatagtaacattataaaacaatgcagtatttaagggaaaacgatagagcatttgcaatataggatcaacatgttcaagtgataagcatgacttgccttgctccgctgctggaggaacctcggcgactatttcaaagtacaccggagcgtcgggagagccgaaatctaagcgacatacaaagcaaacaatacaaacaggccataagactactgaaacagagaaaaaaaaaccatttttaatggattctatgcatttttcttgatttaccgagacttgaatgggcttaaacggagctcggatgaattagatatgaattttagaagattcactgtgtttttactataaatagaaaaatccttaattgatttattgcgcaataattaaaatcgcggggagagagagggggcggcgccgacatgcaggccccatatggcagtgactcgggtggcggtctgcggtggaccgggtccacggaccggggaaggagcggcgcaccacgtggcgctgacgtggcgccgacgtggcgcacacgtggcggccacgtggcagccacgcgagcggccgaaccgacggccccgatctaccctcagcggcgggtgcgcgcggccggcgcgtacgggcggctcaagccggcccggcggccatggcgcacggcggcgctaccgcggggcgacgacggcaaacggcggtgaccgacggcgagcgacggcggtgtgaccccgagcagcaaggggcagcggcgctaggaggagaggggaaggacgacggggttcttaccgaggattcggccggcatggaggggcaacggcgaacggcggcgaggaatgaccaggaggcgacgacgaacggcggacggtctccggaaccacctagcgggcatgatagagagagagaggaggatggaagagggcaaggacgccggccgaagccggcggccatggcggtgctcaccggcacatgatgcggagtgggttccggcggcggtttccgacggaggagaggtggacgggacggcctgcacgacggcgaacgcaatggcatcggcggcggttgcgggatgcggcggcgccggctggaggtaggagacgggcccgacaggtgggccccacctgtcggcgacctgaagggaggagggaggaggcggccggctgctggaacttggccttcggccggcccagcggggaaggggaggggaagagaatgggtcgacgacccattcaaaaaggaaaaggagggaaaagaaaaagaaaaagaaggaaatgaatttccagggattaaatattgcttgtgctcatttttaaatgattaaaattatttctagagctctaaaaattccactaaaaatcttgttagcacatttcggcatgtagaactcaagaaaaattccacatgccaattccaattattatttgcattaatttattagggtttcgctattgcttttacaccggtattttcttgaggccatttataaattcaatttaggcttgggaaaagaacttcagggtatgacaaacctacccccttaaacggaatcttgaccccgagattcggaagagctggtgaagaggtgcggatgggcggccttcaactcatcttccctttcccaggttgcttcttcctctgagtggtggctccactgaaccctacagaacctggtgaccttgtttctagtcctcctttcactggtatcaaggatgcgaactggcttctccacataagtcagatcttcttggatgtcaatgtgctccgaattggcttgttcttcgggtaaactcaaacacttctttaactgggacacatggaacacgtcatggataccgatcatgttggatggaagttctagctgataggcaacttctcctcttcgttccaagattttgtatggtcccacgaagcgtggtgccaacttgcctttcgtctggaaacggtgtactccccggagcggagtgacacggaggtacatataatctcctgcttcaaaagtgagctctcttcggcggttgtctgcgtagcttttctgtcgagactgtgcaattctcagcctctctctgacggttctgactttctcctctgcttccgttagcacttctgttccgaacagttgacgttcgcctatttgatcccagaagagaggtatgcggcacttccggccatacagcgcttcgaacggtgccatttgtagactggcctgatagctgttgttgtaagagaattcagcataaggcagacttttatcccaagctccgccaaaatcgagcgcacaggctcgcaacttatcctccaagatctgattgaccctctcggtttggccatctgtctgcggatggtaagctgtgctgaaattcgaacgggtacccaattcctcttgcaacttctgccaaaattttgaggtgaattgactccctcgatcagatactatctttttgggtactccatgcaaacacatgattcttgagagatagagctctgccaaccttttgcctgtataagtagtatgcactggaatgaaatgagcaactttggtaagtcgatccacgactacccagattgaatcgtggcctgatgatgtcgtgggcaggcctgttatgaaatccattccaatctcttcccatttccattctgggatttgaagaggttgtaacaatcctatgggcctctggtgttctgccttgacccgctgacaaacatcgcagagtgcgacgaattcagctatttcccttctcatgctggcctaccaaaatttttctttaagatcttggtacatcttggtactgcctggatgaatggagtactgagtctgatgagccttggtgagtatcagatctttcagctctttgtcatcaggtatgcacaatctttctcccagccagattgtgccatgttcatcttcaagtaaatcccgggcttttccgaccctcatattctttttcagttcagctatctcaggatcatttacttgagctgctcttacttgatccacgagcgtaggccgtgcctttagagcagccacaaacccgtgttctacgattcccaagttgagatgttcaagctcctgctgcaattccttacacatgccttcggtgcacaaagcattgcagtagctcttcctgcttaatgcatttgccaccacattggctttgcctggatggtagtgaatgctcatgtcataatctttgattaactccaaccatcttcgctgtcggagattcagatcaggttgggtgaagatatatttcaaactcttgtgatccgtatatacttcacagcggttgccaatcagatagtgcctccagattttcaaagcatgaaccaccgctgccatgtgttggatagtttccttcatgcggacgcaactgccgcgaggcataagcgaccactctgctctcttgctttagaacgcatccaagcccgtgacgggacgtgtcgcaatagacttggaagtctttcgtctgatcgggcagaatcagaactggagcaggtactaatttcttcttgagctcctcaaaactcttgtcacactcggctgtccacctgaatttctcgtctttcttaagcaactgagtcataggtctggcaattctggagaaattttcaatgaaccgacggtaataacccgcaagtccaagaaaactccgaatctgtgacacggtcttaggtggggtccacttggtaactgactccacattcgatggatagactgccacgccctgagctgtaatgacgtgacccaagaatttgacctctgataaccaaaagtcgcatttgctgaacttggcataaagctggtgctcctgcaacttctcgagtaccagacgaagatgttgctcatgctcttcttccgacttggaatagattagaatgtcatcaatgaataccacaacaaacttatccagaaattccatgaacactttgttcatcaggttcatgaagaaggccggtgcattcgtaagtccaaaatacataaccgtgcactcatacaacccataccgagtggtgaaggccatcttgggaatatcctcttcctgaattctcaattggtgatagcctgatcgcaggtctgttttagaaaacaccttggctcctttcagctgatcaaacagatcatcaatccgcggcaaaggatatttgttcttgatggtgacctcattgagtgtgcgataatcgacgcacattctcttcgtcttgtccttcttctccacaaaaatgaccggagcaccccaaggtgaagtacttggtcgaatgtaccctttctgcaactgctcatcaacctgcttcttgacctctgctagctcgttggctgccattctgtacggcctcttgtaaattggggcagtccccggtgccaaatcaatctggaattcgatctccctcttgggtggcatggtagtgaggtcctcagggaacacctctggatactcgccgactatagggatatcttccaatttcctcgaactcttctcctcggtgaccatcggattttccacctcaatctgatttaaggagattccctgcttcagtacgactggtgacttgtacaccactgtttcccctttctcattggtcaaggtgaccgtgcgattcacacaatcaatgacacccttgaacttggtcagccaatccatcccaagaatgacatctaggtctttggattcgagaaggatgaggttggctagaaatggtgatctttggatttctattgttacacaagggctgaattgaatcgaggtggagctattcccgggggtctgaacccgcattggtgtactaagttcttctcttattaacccatgtaccccaacaaacttctttgaaatgaatgaatgcgttgcaccagaatcgaaaagtactgttgcagggattgaggctgcattcgtttgggtgatggggagtgagaatgcacatcgttttccgcgcgcacacttcccaaactactaaacggtgtgttttttgcaaaaattttctatatgaaagttgttttaaaagatcatattaatccatttttgaaatttaaaatagttaatactcaattaatcatgagttaatggctcacctcgttttacgtatcttcccaatctcctcaatccctttctcctcaaacacaccctgagttaacaggaaacgtacccagtacgacctctggtgctacttgcgcctcttctgcggacgcgtggttaacccgagcctggacaaacttgggtccagcacgcctgggcttcgggcacttgtcggcgaagtgaccggactcaccacagttgaagcaggctcctggcttgcctccggtgtccttctttgggggaacgggtgcagtttgctgaactggcgccattggcgggcgtggggctgcgctgcggttgtgctgaccttggccatgatggctgccactgctgccggggtggaagttgcttgggttgtaagggcgatgctgtcgaacaatcatggtggtaggcccaccctgctgtccaggagtgaagcgcggtcgctggtgacttccttggttggaccggaactgtcgaaacctgaattcggcaataataaaagggggtagcgcacgagacctaaaagtggatggatgcggagacaaaggatttagacaggttcaggccctctcaatgagaggtaataccctactcctgtttggggatttgaatccgccgggtgtgtattgatctgatgatcaggttgtgtcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccgagtcatgatctattacatattccatagatataagttatcccctatgactagtcggataaccatgccgtgtgggtatggggtacccataatctccacagtagcccctgagaccttcacagtcggaaagataatcttctctcgaaccagattactccaaagccgagtgcttcaatcatctttgtcatggtctcccgagtacttttaccaaatctgaagactgtggagggctggaaaataaagtcaggtgcaccgactagatgcacctaataggtgtagcccccgacaatgtggttaattgaacaaaccaagcatatagtcaaggaataaataatccaaccaaccgagtggttttgataatcgtaatcaaccaagtgacttgatatcaatatatagcatatgcggtgtgaatcctccaaataacatgatccgagtgatataccaactgctttgtaaaatatgatgagtgatatagcaaaatagctataaagaagcttgtatattgtgaataaagaaatttccaaagtattgggcatacgccatgcgcacactgctttaacagatgtgcttaagtccctagaagacacatggtttcaccacacctggaaatatatggcatatgtggtgtaaaatccgagtaaataaactcataaaggatttaccaaccgcctagaaaatgaccacaatatataatcagcctaagccataatattggtcaataaaaatgcacacttacgtggcaaaaagcaacgatattgtatccaatcaattgctttaaaacccaaacagcaccatgactatattaaaaagtcagcggggcagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgcagacatattaagtctaggccaaaaaatatgccttcgacaccctttaaaggatgacgcatgtaacatgctcccgagtaataaatcttccgggtaatatagaccaagtgtagctcatatgaatagcttctgatctgaatgattatcccttatgggatactccaaaataaatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgcccttctgtcatagtcaaaattgtctattggcaatagctgacgcagtcggcatggagatgaaatgaccaacatgaagacgaaattgctcatcagaagtaacggaagatgtcagtggtagtaaagatgacaccaatcaaatgtaatgaagttgcataaccatggaggcgaagaaaccagtcggcaacagtcaggtcagctagcagtgaagatgtaggcgcccaacaacaacgaaagaacagttggtggtgacaaaagcaaaccgacgatgaagatgtagacgcgcatcaacggtgatggcgaaatccaccaatcatgaagatgaagaaaataatcggcggcgacaaacgcatccgacggtaatgatgattagtggcaacagagatagccgactatgatgacgaagtttcccatcaacggcagcagagtaggctatgttgatgaggcttgacaagatgttgatgaagatgacgatgtcggtgatccagtcaatagcgatgtagcagccatggaagtgaagaaaccagtcggcagccatggcaaacgtaggcagcttgtgttgaagatactgatgcctattagtagtgacagcgatgtagccagccgtgaagaagatagcatcagttggcgttataacaggccagccgtgcaggcggtgacaccagtcagcggcggatgcggtggccggtcggtgaagacgtagacgcccaacaacggcagcataataggccagccgtgcaggcggaaacaccagtcggcggcggtcgaagcggccggtcggtgaagacgtagacgcccaacaacggcggcataataggccagccgtgcaggcggaaacaccagtcggcggcggcgaaggcaagccggtcggtgaagacgtagacgcccaacaacggcggcataataggccagccgtgcaggcggaaacaccagtcggcggcggcgaaggcaagccggtcggtgaagacgtaggtgcccaacaacggcggcataataggccagccgtgcaggcgaggacaccagtcggcggcgacgaaggcgagccggtcggtgaagacgtaggcgcccaacaacggcggcataataggccagccgtgcaggcaaggacaccagtcggcggcgacgaaggcaagccggtcggtgaagacgtaggcgcccaacaacggcggcataataggccagctgtgcaggcggaagcaccaatcggcagcggcgaaggcaagccggtcggtgaagacgtagacgcccaacaacggcggcataaaggccagccgtgcaggcagaaacaccagtcggcggcggcaaaggcgagccggtcggtgaagacgtaggcgcccaacagcggcggcataataagccagccgtgcaggcgaggacaccagtcggcggcgacgaaggcaagccggtcggtgaagacgtaggcgcccaacaacggcggcataataggccagccgtgcaggcggaaacaccagtcggcggcggccgaggcgagccggtggtgatgttctgactgatccattcctggagcgtaagagataagcttaaagccatgaatcccttttatgcatatctggatctggatcctgcagaacaaacatatatgatgagtagtatctgatataaatataatactcgagaaaaaatcaagtattttaaaatatttataaatatgtatttctcctcttgtcaattttgatttccccgagcagatgattcattacgtttaaacgctctgtccgactagtcatagcccccaagcatcgggagtcggcctaggcacttcccagacatgcatatgagtgacatgagttcgccattaatagaacaaagtttcacgaatcagaatttactactcgggtacttttgcaattattaagagcagaaaataaatttatctcatctctatgcttttgatttattccgaataatacttagcaccttgcgttactcggtccatccaacgggcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaatggtgacaaaaaacaccagtcggcgccagtgaaaccaagccagtggtgtagatgatgaagcccattaacagcggcggagtccgccaaccgtataggcgaaaacaccagtcagtggcggcagaggcaggccagcggtgaagtcgtagacacccaacagcggcggcataataggccagccgtgtaggcggaggcaccagtcggcggcgacggaggcaggccggcggtgaagtcgtagacgcccaacagcggcggcataataggccagccgtgtaggcggaggcaccagtcggtggcgacggaggcaggccggcggtgaagtcgtagacgcccaacagcggcggcataataggccagccgtgtaggcggaggcaccaatcggcggcgacggaggcaggccggcggtgaagtcgtagacgccaaacagcggcggcataataggccagccttgtaggcggaggcaccaatcggcggcgacggaggcaagccggcggtgaagtcatagacgcccaacagcggcggcatattaggccagccgtgtaggcggaagcaccaatcggcggcgacggaggcaggccggcggtgaagtcgtagacgcccaacagcggcggcataataggccagccatgtaggcggaaacaccagtcggcggcggcgaaggcaagccggtcggtgaagacgtagacgcccaacaacggcggcataaaggccagccgtgcaggcggaaacaccagtcggcggcggcgaaggacggccggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggaggcaccaatcggcggcgacagaggcaggccggtggtgaagacgtggacgcccatgaacggtggtgtgaccaaccaaccgtataggcaaggacaccagtcggcggcgacagaggcaggccggcggtgaagtcatagacgcccaacagcggcggcataatagaccagccgtgtaggcggaggcaccaatcggcggcgacggaggcaggccggtggtgaagacgtagacgcccaacaacggtggcataataggccagccgtgtaggcggaggcaccaatcggcggcgacggaggcaggccggcggtgaagtcgtagacgcccaacagcggcggcataataggccagccgtgtaggcggaggcaccaatcggcgacgacggaggcaggccggtggtgaagacgtagacgcccaacaacggtggcataataggccagccgtgtaggcggaggcaccagtcggcggcgacggaggcaggccggcggtgaagtcgtagacgcccaacaacggtggcataataggccagccgtgtaggcggaggcaccaatcggtggcgacggaggcaggccggcggtgaagtcgtagacgcccaacaacggtggtgtgaccaaccaaccgtataggcgaagacaccagtcggcggcgacggaggcaggccggcggtgaagtcgtagacgcccaacagcggcggcataataggccagccgtgtaggcggaggcaccaatcggcggcgacggaggcaggccggcggtgaagtcgttgttgttatcagcaatggcggtggcgaagacaagccggcagagtggactcgcggccgatcgaccggaaagctgagacgcctcgagtccatgaccagcatcaatcgcctcaatagtgccgcgtaattatatgcgaacaacaacaaaaaatagcaagagattaatctgagattaaaaatcaatatgataaataatgataaaaatcagattgagtttccccctgactgatttggatcaagtcggagcttgaagaagtggtcgacggaaaggaagtgaaaactcccgaagcgaaaacgaagtcggcgactcatgaagttaattccatcgcgctcgttgataggaaactcgacgcagcccctacctggcgcgccaactgtcgaaacctgaattcggcaataataaaagggggtagcgcacgagacctaaaagtggatggatgcggagacaaaggatttagacaggttcaggccctctcaatgagaggtaataccctactcctgtttggggatttgaatccgccgggtgtgtattgatctgacgatcaggttgtgtcatgccccctagagggcctcctgcccaccttatatagggtggggggcaggattacaagatagaaaccttaaccaatatggtatcggtttcctaaatctactttacaatattatcaaaccaggactttaggctgttccgtaatatataaggaaacgtaatacccgagtcatgatctattacatattccatagatataagttatcccctatgactagtcggataaccatgccgtgtgggtatggggtacccataatctccacaggaactgagctgcctcctcttcctgtccattttgttgcgctgatcctcctggcggattgccttgtctaccagcttctcgaagtcagtgtaatccccggagatcaactggttggtcagctcgtcatccagacctgctaggaacttctcctgtttcaatgtgtcaatgtggacatcctccggtgcatatcgcgctaggcaattgaactcatggaggtactcagtcactatcctgttgccctggtggagtgcctggaattctctcttcttttgtgccacgaccccgtctagtacttgcgccttctggaagctgcgacagaactctgcacaagtaacttctgtgcctggcgggcgggtagccatgtggttatcccaccaagctgacgtgggaccctggagctggtgtgtggcgaaggcgaccttctcctgatcgttgcactgcagaagattgagcttcttctctatggcatggaaccagtcatttgcctccatggggttggtggtgctagagaaggtgggtggcctgacgcgtagaaattccggcagcttggactgagggggagggggaccaaactgctgctgctgctgctcggcttgctgctgcatcctctggtgcatctgctagggctggtgctgcatcagctgcatcatggccgccatcatctaagtctgatgggccatcacttgtgcaagagtcgggttcttggggagcggtggtggactgttgccagaggcgctgttgggatatccaccgtcggtgcgttcttcgccgttgctgccttcacctgctgcatggctgccattcctggtgttgaccatctgaaggaagagcagacggagggggtggaaaagaagaaaaacagatgctcaggaactaagctatattatataggaatttaaattgcaattgttctgatctgaattaaaacatttaaaacagcaaacaaatccttattaagacagccacatcataggcacatgatgtcgaccgtcgactgacccacaagcgaacaaacctaaacacacaaactaacaaacaaatactaagcagtcgataaactaagtgaaaacaagcctaatgctcggaacggctcctgcggtcggtggagtcgaaggcgtcctcctgctcgtcgccaggtccctctgagcggctcctggagtctggcagatacgtctcgccgttgcccggctctgagccactggaactgctgctgctgtggtcgtggctgccactgtgagtagcaggcaaccaacctccgttgccaatggctggacccctggcggctgacgctagagcgaaggagagagcggacgcgggagctgacactggaacggaagctgggactggagctggaactgcgggcgctgcgggaactgtgggaggtgctggaggagctgcgggaggaggtgggttcctgggcgcaagctgaatgcgcacgggtgcagtcgttgacttgcgaggcgtggtgcggatccggactcctccgggagcggggagacccttcagctgagcgttctccttcttctggcgtgctatctcatccttcagagctatgatcctcacaagcttcccatcattcgaggccttggatgccttgtgcaggtcagagtgcatcgtgtccattcccctcatcacggcacacatgtggctgaaggtggtgtcattctcactggccgtcgggcggaaggtgctgacgtcgtcgccacttgctcggcgagggtggaagcggtacgccgtgttgcagaagatttagctgtggcgatcacgaagcctggccatcatcaggtatgctgcctcctgacaagtgtgatctactgtgcctccagaggcctcaaccaccatgttagcgaggcaggtgcccacaaagccatgaacctccagacgaacacggtggggaagctcgccactgagcggcggaacggtcgagtactccggcgcgttggggtagcccaccaccagggtcatgcgagccaactctgccacaaaatcatccatgccttctccacggtggttgggtgggtggtcggccatctagagaagacaaagaagtaggatcaatgcatgttcaaatccaatttaaataaagcagtaaaggactcaaataaaatgaacgaatgagagcggaattttgtgcatagatcatttttgcatgagagcgaataaataagacggacttacatagcgataaaataatgagaaattagatacatactaataataccaataagagcataaataacttgcaacacatattcctgagttaggacccaatgcattcctcctatcaaatcccgactaactgtcaaataaacctcaaataattttactaaaaccctagactgacctgatttgataaatcttacttaaacgagcgaccaagatttttcccttgaactacagaaacaaatcccaattttcccagaacaaatccaattgcaaagaacatatgcaatgaaaaggattcagagggctcttaggttttccatttggcttgtcctacagtcaaggtcggctctgataccaacttatcacgcccagaaattcccgaatagaattccaagtagaatgtgcattaaaatccccgtccaggaccggccggggtacacaaataacaaagttgacatacagatccacgtcttacaaacatcataaaagtcttacataaatgcagcggaaaattaaaagataaatagagctaagccttgacttggactgcagcgggaacaccactccacaggcaacctcgatggcacggacgaagcctactcctcggagaagccaccatctaacatgtactcaaactctggggtttggggggaaatagggcatgactgagtacaaccaccgtactcagcaagtcataccggaataagggtatgatgcaggatataaccaaaggatagctagagcggttcatttgcataaagcgagcatttaaaggcagtagttgaaagcagtaaaatagttgtaataattcatcaatcttaaccatccactgttcaaagctaccccacgttgtaacaggcccaaccattcgcctgaactaatcaattccattagactaagctagggtgagactaatcacggtgaatctggttgaccgcccgtaaccgcgggcacagctattcgaatagttttactctgatcagaggtatacaactgtacccacaagacacagccctgcgacacgttaccgtgcgccgacatgccaccacgacatactggaaagggaccgtgacaggaccctttgcataaccccctctagccaagcacaccacacctcaagttttacccctgatcctagcgggcaacgggcggtcccctctcgtgcctaggtgaatc

SEQ ID NO: 82864 - DNA, 7773 bp, Oryza sativa
cccccccccccccctctccctgttggttgccttctccgtgccgaacaccacagcgcgcgcgcgggggggcgggttcggctctctcgcgagctccgctctctgtccctctctctctctcgccgcctcctgcctcgcacactcgagattggtggggtggatttgggggaggaggaggtggggtggggtggggtggttgctgaggaggaggtggtggtgagagatcgggcggcgggttgccgccggaggaggtagagggatcctcgggggagggcggttcttgggtcgggggacccccccatggcgtgaggagagggtgccctccgggagatcttgcggggcgggtgtgtggtgttgctagctgaggctgttgggtgggtacccccgagcggccggggaatctcctcccttctcgagcgaccgcccgcgtcgctccgccatggccggcagcgacgaggtcaaccgcaacgagtgcaaggtgcgtgtgctcttccttcttgaaccccttccgctctctctcccgcggtggcgtgtgtgtccgtgtctgtcgcctccggattaggccgcggccgaggcggtcgcggttggggttcttgatttgcgccgccgcgcgcgccccgctcgctttatggtttgcggggggaaggatcgattggggccggcctggcctgcgatttggcggtcaatcgctgccttttctttcccctttgggctcagccccaattttatcccccctcgtgcttgcctcggccgttttagggcgggtggtgaactgtggtggtggtaatactgcctgcctgctgccggccgcagcggcagctacccaacaaagccggaagaaacccccattcacaatcaccgcggccgcccgtgttggttgggagcgttcgcgcgcgccaaagcttgcatctttgtggcaagcgcctctcgcattgggtttttttttttttttgggggggggggttgtttcttttttgtccgagcaggaatcagcaaagaaaaacatacgcatatgcacaccgattgattgattgctctggtttcgcttccgcgattgcgagatagtagtagtagtagagggtcgctcactgtggttgtggttgtggttggttgtggtgcagacggtggtgccgctccacacatgggtgctcatctccaacttcaagctgtcgtacaacattctgcggcgggcggacgggacgttcgagcgggacctcggggagtacctggacaggagggtgccggcgaacgcgcggccgctggagggggtgtcgtcgttcgaccacatcatcgaccagtcggtggggctggaggtgcgcatctaccgggcggcggcggagggtgacgcggaggagggggcggcggcggtgacgcggcccatccttgagttcctgacggacgcgccagcggcggagccgttcccggtgatcatattcttccacggcggcagcttcgtgcactcgtcggccagctcgaccatctacgacagtctgtgccgccggttcgtgaagctgagcaagggcgtcgtggtgtccgtcaactaccggcgcgcgccggagcaccgctacccgtgcgcgtacgacgacgggtggaccgcgctcaagtgggtcatgtcgcagccgttcatgcgcagcggcggcgacgcgcaggcccgcgtgttcctctccggcgacagctccggcggcaacatcgcccaccacgtcgccgtccgcgccgccgacgagggcgtcaaggtctgcggcaacatcctgctcaacgccatgttcggcggcaccgagcgcacggagtcggagcggcggctcgacggcaagtacttcgtgacgctccaggacagggactggtactggaaggcgtacctgccggaggacgccgaccgggaccatccggcgtgcaacccgttcggcccgaacggccggcggctcgggggcctccccttcgccaagagcctcatcatcgtgtcgggcctggacctcacctgcgaccggcagctcgcctacgccgacgccctccgggaggacggccaccacgtcaaggttgtccaatgcgagaacgccacggtggggttctacctgttgcccaacaccgtccactaccacgaggtcatggaggagatctccgacttcctcaacgctaacctctactactagtacatatacagcccctctccctctcccccctcgctgatcgtcgtctccaacacaaatactccttatagggaagatggtaattcagcttgactttgttatagtacctactactactactactactacctcctatactactgctgctgcttgggatcgcaatgccgtcgtctgctcttgtgtggcgaaggagaagctagctccatgctgtctgatcagctctaatcaaatggtgactcggttgcgtcgaggaagaagaagaaagtcgtccgtcgtcgtcgtccttgttccactaatcatcgttcatccttttctttttttgtggtttggatcgttctttgatccatgttttccatgttttgcctggggtcagtgtagtcaagacaagttgagggtagttccatgtctgtcatgcatgcctccattagtactactactgttgtgactttggttgatggagagaagaagcatgtttttttttcttttaatctcgcattccatccatcttctccatgtactccaaagagaggaaagttgctatctaacgttatgtgtacagtgatcgatcaacaaggagatttgaggaggcatgccccttttgttgctgttgatgttctagttttatcttctttcttgttaacaggattggatggtgctctcttgctcactctcaatccatgcttgctcactctcttgctcactcgtactagtcctttttagggtataaagcatttgcacgctgggtcgtcgtcgtcgtctcccttctgatcttttttctttattccctccgtttcaaaatgcttgaagacgttgactttttaagcatatgtttaaccgtttgtcttattaaaaaaatttaagtaattattaattctttttctatcatttgattcattgttaaatatatttttatgtagacataattttacatattttataaaagtttttgaataagacgaatgatcaaacgtgtgctaaaaaatcaacggtgttaaatatttcgaaattgagggagggagtatattgtggttgtaatgcgtgaactatgaatgccctctgcttcactccacatgggtgtcggtgagtgtaaacaagaagaggagaggagaggagaggatgggggctcatgcatatgtgagatttgtagtagcgctttgaggtgataactgtttgtcctttctctccccaatgccatgtgtcattctttctgtatgcgaaaattggatggacagccaattctgtgacgggcgtacttggatcctgccagtattacggcggtgtctgtcggtggtaaaaaaaaaaggcgctaggaaaaagcgctacgcaaaggaaggggtggcagcaagtccacagctaaatgcgaaaaccactaccccgtggaagtgacgtcgtctcgtctgtgttattttcgtccctggtacggccatgtgttggctgccagcctctgataaccgtgccaaacgttagtcgtgtcacagtcgtgttattagctgcaaccatgataagcttcacatcatttaacgtacttattgtccggtaaaacgtgtgctagtagtgcacgtagcaccatgtttaggaagggaatgtaatggagtttgtgggggttttgcctcttctcttcgatcctggttgtcctgagcgcatcggacgctggctgcctcgcggtcgcgggctggtatggatgtgacattattccgctccgtgcatgcatgtcaccgttgcgccgggccacgctttggctagtcgtaccactagcatgtactccatcatccttatgattcaagttataagttgttttttttggtctcgcaacaagacgtcgcaccagagctagcgcaggcgagatccgttgaatcacagcgtggcacgagcggctagctacatggtcgccgtcgtagttccaccactagcccgttgtttgattgatgccttgatgggtggctcctccgctccccgcgcgcttagcttagccatcacaacggtcgagcgcacctctctccagagccggggtagtaggttagttcatgtgaacgtccaaaaaagaacaactcggattgtgtaggggctcaacggtgagatactcctactttgtgtccaaaaacagctcggatcgtgaattcatgtacgttacatcaaaccggagcttactgtttttagtctctctcccatctccattttcatttagattgtgctcaaagcaggtacttactactagagagtagagaccaaccaatatttatttgaagccatccaagaagagtccatatgaatatggtcccgttcttctaataagagttggatggaagattttttaataagagttggatggaagattaagattttcgtggcacgctttttaaacttctaaacggtacattttatgtgaaaactttctgtatgaaagttgttctaaaatatcatattctattttttaagtttgtaatgattaaagcttaattaattatatgttaatataatctcgttttacgtaaaaaaatttcatcttttgtcttaagaaggaaagaacaccgcctatgttgatcgtcgcacggttgtaaagcggggaagaaagctactagcatggcaggtatcatcaaaaggccgagactttctcgtgcacttaaagtcacggagtagtgcagctagcggccgttgaaaatattgacgctttggaaaggtggcagaagtctcccgataaaggacaaacgacgcctgcctgcagctaccctcgctttcgactattattacgtgcactgtcccggctgcgctcgagctgaggctgaggctgaggctgagctgagctagcgtggtggcatcacgcggaccagacagatgccatatgccactccatttaattatgcgtgtaaaccctagtagtaacatttctatttctatggcatttttttcttggtgtttctcctcctctcgccgactagccgagcctatttggagcgtctgtcaactacattgacagtttcttttaaaatcttcagccgctaaaaactcttctatacaattcagattttaggcttttaaaatttaatttagaatataacaacttttctatatgttcccttatctaaaaatcacaatcatttttatttaacttcttcgtctatttatcttagctaattacagtaattttctatttaagcttacaataattttaacttaacaattttgtcgaagtttttatatttccggacaaaaatacgaggaaactggaactcttgttttctttctctctacatttttagccttgtttagattccaaaaacttttgacaaaaaaagtcaaatcaaatatttagacacatgtatggagcattaaatatggacggaaaaaaatttgcacagtttgcatgtaaattgtgagacgaatcttttgagcctaattacgccatgatttgacaatgtgatgctacagtaaacatttgctaatggcggtgcgggcagctagctagggtccgccctagagccgtccgcgtgagagcgacacgaggacttggcagtgtatacaatcgttatcgattctcactgtacctatatcaaggcattatacactatatatagtacacgtcctttttgttttttgacattgttggctggagcatgtgcaaaaatgtaagctaaatgatgattaccccagcgcgtgtgtactagtaaatccaacgtcttaacgacgttgccgcgggagtaggttgacacgacggccgggcgcgtggtgtgtgtgcttcgtgtcgtcacggcaactcgatcgatcgtccgcaccaaacgacccacacccgcacccaaaatcgagccgtaatcacggcgccgcgtgtgggcaaaaacaaacctcaccgccggccggaatgattccgggctagtgcgcccaatcatccgcgtggccgacgatgacgcgacgcgcgcgacgacacatgggggcgtggcacgggacagaggcagcagctagcgcagcgcccgcgcgcaggtgaaacgcgcgcgcgccccacgtgaagcggccgccggttacacggctcgcgcggacgccacggcgatgcctcgcgcgtggtggaatggtggaaaccgcggctggcacgttggcttggctcccggccggcgcgggggtttggtatggttttgtgctgggtggccacctgccgctccagacacgtacacgtactactcgtacgtatggctcggcttgtctcggtgtgtactagtagtattgttgtctcatcctacgtcagatagctattctcttcgtccacttgatataaaagattttttttcttaaactagcaaagtattctctccttcctataatacaaagtgctgtgttgtgttttagagcgatttgacacatcgtaatattataaatttgaaaaacaatctacttatatttgtagatacgtcacatctctctaacctccaaaatcctttatgttctggacggagagagttgcagatataaagaaaatgatgtaaaaggtgataggagacgtaataaactagtaaaaaaatggatatatggggattaaacccgtataaaagtgagtaggtaaaaaaaataatctatggctgtgtttagatccaggggtaaatatttttaccatatcacatcggatatacgaacacacatttgaagtattaaatatggtctaataacaaaacaaattacataatccgcctgtaaactgcgagacgaatttattaagcctaattaatatatcattagcaaatatttactgtagcatcacattgtcaaatcatggagcaattaggcttaaaagattcgtctcgcaaattagtcgcaatctatgtaattaattattttttagccaatatttaatacttcatgcagatattcaaacattcgatgtgactggctgaaaaattttagggtacgatctaaataaggcccctataaaagttggtatacgaggaataaagaaatgtctcgagatatcgcagaaaatcttttattttaaaacaaatttaaacaccaataatctccaatgtccaatttttcatcacagaataataatcaaaaacacctttgattttacaatctccctcttaatgaacacattggcaaaccttattaaaaatatttttgtgtttggaaaaataaaaacaaaagtggtaaaaagcacactgcgtacaaatgtacacatcgtgctaaaaaatccaaaagaaaacttctccccctttttaaaaagaaagaaattcccaattgaaccaaaaacatgctgttctcaataactctccaaaaattcaccttacttctccaaaaatccaaaaattttcacattacttctcccccttttgacaatgatttcatcaaacataggaattatgtttattaatgttcaagagcttagcatacatatagcatatcaagtcatgtgttgcaataaaaagaagataaacccatctataatataacaagcatgcattaaagtataaccatgaaccacagattttacaattaagcttgaatcaacaatcaaaattcatgatttcatacgatttataatgcaacatcttaacaagcacataggttgaaaaataaacactaaacacatatacctattgcatttatcactctttctcaaataacctttagcacaaaacaactaagagaattt

SEQ ID NO: 82865 - DNA, 93658 bp, Oryza sativa
  unsure (1)..(93658): unsure at all n locations
agttttgttgtttagactataatagtatgaattaagtctagatatggaaattaactaggaatttacaaagttttttagagtgtatgtattactaatgtactgatgtaggatatgtaaagacattttctttttgctgatcgattttgcttaccgccccaacaataacctccaactccaacaacatatttcccttctctttttagagcagcaaagatcggtttagaatcttcagctgccttcacctgaaatttcaattgaatatactgatcaatatcaattgactcctcgataatcgtcgttgaataagctatgtaattggtgaaaacaattaccggagagtgagccatgatccattttgtaatgtttatacttgggtctccattgtaaggtcgcctttggaagaaatctggcaccacgacgtaatatcccgcttcaccaactttgtcagctattttcctgtaattgtcagcattattaaccacaaatttgattttaaattgtctttgcaatctagaatgggagtaaaaatgtaaggtgtattgaaaggaatccagttgggacgttttacaatactttcaagctaaaggaagcacttaaaattggaatgaaaaacagaaaccttagtacaatccacatgaagaaatctttgctgttataccattggaatccacgatatttttacagaaaaactgaatttctgaaattggatcgttgcttggttatccattcataaatcagctttacaaggacagcaatgagatattactattgactattgagttacgacagcgtttgcccctaaagaaatgatgttttagaaagcatgtaatgaacatagttatgcacagtaatacagtatacaatgatagtactactccttttgtttcaaattaattattgttataactttgtcccaagtcaaatatttctattttagcctattaataactagcaatttgtataatttaaatacatgtggattgcatatttggaagtatttcttattgtgaatcaaaaaacatattaaaacttatgtcatcaaaatatacattttttttaaaaaaatgattgttaaagttagaaattgttgacttaggataaaactagaactacaaataatttgtaatggaaggagtagtagatttatcttcaacttcgtagggatacagaagatgaaagttttagcatatatgttgtctaagtagagtagttaaaataatgaaattgcacattgaaagtaaatgatgtatttcaaccgcttaacatatttatatcattagaaggtcagaatatggaaaatagcaaaaatgagtatacgcttctgattctccgtatgaattgatggttactcaaaaaaaaaaagatactaactactccctccgtttattcgacgccgttaaattttttaaatatgtttaatcatttgtcttattcaaaaaatttaagtaattattaattattgtcttatcatttgattcattgttaaatatacttacatatatacatatagttttacatatttcataaaagttttttgaataagacaaacggtaaaaaatttaagtaattattaattattgtcttatcatttgattcattgttaaatatacttacatgtatacatatagttttacatatttcataaaatttttttgaataagacaaatggtcaagcatgtgctaaaaaatcaacggtgtcaaatatttaaaaacggagggagtatttgaaacggaagaaacatgtacatagcaatgttgaatattctttgttcaagctcatggatggtgagggcgaatggacgattatttgcttttacacttttgcgtgtctaaagtctaaacctgttatccttctcacaagtcactgcagaaagataggagatagttcactaaaactgacctgaacccattgtgacaagaaaaacaggtatggtacacaattaagccatatctgtctttttctttttttttaaatcagtctctttccagagttgttcaagtgtcaagtatttgtcatgccctgttctctttagattttcccccggataattgctacagattatttggtccatgctttaaaaaatattatttattctactgcattattagatatttgcaaagttcatttttcaaaatattaatttgttatgttaataaaataaacaatctgcgcctataatccagagagtgaagaaatgaagaaaattactgtcgaagatgacaacgaacaagaagctaaaggaaatgaaaagaagattttgtacctcagcaatggtgcttcaaatcctgaagaaaccaaattaacagcaacaattaacggctaatcaatcgataatcaccaaaggatggcagtgagccagtgactgatcagtaagcaaatcaggcagacatgcacacacacactactaaccaaagacgtcggaggcgaggacgatggcccggccggagtgggcggcgccgccggtgacgtaggccgcgaatcctcccaggttttggacgaccacgccggcctcgccgtcgccggcggccgtcagctccggcgggttctccaggcactgcaaccgcggagaaccagcagcgccgccgccggccgccgcggcgagcacggcgaggcagaggaggctccggtggagcatcgacgtcggtgccatggtgatgggtttagtttgcatggtaatggtcattagatgcagagggttttgtactacattttggctttagcacggtaggtagcaaaaagaagacgcacttgacatgttagtgtcgcattgatgttgcaatcctaccttttcaaattgtgccattctgtcatgctaaatctttgttacacgtggccaagttcgttcgaaagattttatctcggtttctgttagcgcgttttttaatatgttaaacggtacatctcatacgaaaacaactttcaatatagtagtggctttgaaatattagataaaactatttttttatttattttgtaagtttgaaataattaaaactcaaatgatcatacgttttctcgttttctatacccatacttaatattcatctaaatcacttccgttaacactgatttgagattggatggtagcatctcatctaaagaagatgaaactgcgccttcagtttcatttgcagaggtccctctttcaactttgattttttttcttccccggcgtttaatttggagatcttacctttctacttagagagttgagcttttgagttgaattccttccattatttgttcctcaccaccaatacaaagaatcatttctagtgttcgacactaacggcatgtcatttcctgccatcacattgtcaaattcaccacctaccaaattttaccccgaaaggaaatgggccatgcaataattctctaactcaatactgggaaggcatgttgttaaaaacttgcttcaatttccccgcaaatatcacattcgttggcactcctgtaatcctattcgtttccatgaaaattgttgagtcagagaagccatcggctggcatttagcccaacggttaagtgatgatgctgtctcgttttctcaattaccagaactcctgaatcattactttgtcaagagctacatttctaaccattgtaattaagaagtacaagatcgctgattgcacatcaacgcattatgttattatcagacacatgagatgtgctatcacaagtttatgccgcctaaccttcaatccttcagttctttccttcaagctggaaggcaggcctgccatcaccatccgccacaacaggctgctacacaatgagggcccctttgaatcaaaggatttatataggaatttcattggattcaaatcctataggaaaatttcctatttggccctttgattcaaaggattgaaacttttcaaatcctatgaaattcctatagaatgacacattgtaagtggattttggaggaaacttagcaagaggtccaacctcttggaaaaattcctttgagtctatatttctcatccgattcctgtgtttttcctgcggtccaatcaaacgatcattcctgtgttttttctgtattttgcaattctctgttttacacttcaattcctatcaggatgaatgaactgtactttttttatggaaaggcataggaagtcccgtagtagttgcatcaattaagtcagaaaaccttggccagaaagaatttaaagaaaaaaaaatctgaatattgttctcctaattacctgtgttttggagaactaaactaacaagaaaacgtaacatggatgggggacataaattacagatcgtcgggtggtggcagagtgtaagaatactttattccccacacttcttagacaaacgaggaacaaatttcgccaggcaaatgaggaacaaattgaaaggaacaaaactggaagagacttggaaaatacagtacctgcatgtcttgttggtcgtgagtcttgtcaatccatacagatctttataccaatcagtccatacacataatgtttaggtgttataacggcatcaatggatcttcttaatctttagcgagtgatgcttgccattttctgtaggattcctcttaatatatacagtgtttatagtcgtcttgacatgttcacagccatcacactccactattccaggctttctgtaagcatatcatacttgcattccatgtgagcttgcaagcaatcaagaacagccaggacattgtttacttggtggctctttgatctgttctctgccgtgaaggaataaaccttatcaccgacttctatccagctacacccaatgttcgtctttaggcctctcgccttcattgccatcctcactctggccacatcactccagcaaccaattgtggcatacagatttgctagttgtatatgagttgcagcacaacctggctcaagtttaagacggtgctctgcagcctggatgccgatcgaaatgttcccatgcaccctacaggaacccagcagagagccccatatgacggcatttggagggatagacattgtttggatcaaatcccacgcttcttcaagcaatcctgcgcgcccaagaaggtcgaccatacatgagtagtgatcgagccctggttttattccatgttcaatcattgtcttgaagcagtgtcggccttcctccacaaggcgtgcatgccggcatgaagaaaggacaccaaggaaggagagagcatcaggtactatgtgttgcctctccatttctttcagcaagtcaaggcaatgcttagcaagaccatactgcgaacatccaaagataatggcattccacgaaacaaggtccttacaggcaatgcagccaaatatgaactgggcttcatcaatacacccacactttgcatacattgacagcagggcattggaaacatgcacatacgaatggaaacccattctcatttgtaaagcatggacacttctaccaagtgctagaagtgcatgtttagtgcacacactaaaaagagtggcaaatgtgatgtcatttggcttgcaacttgaaagcatcattgatgcaaacaaatggagacatggctcaacccgattatgaagcgcaaaaccagaaatcattgctgtccatgacactgtgtttttggttggcatggtctggaaaaccaagtacgaactttccaactggctacacctcgaatataaggtgatgagtgaactgccaataaagacagttgaatcacagccaactttaaccaatagaccatgaagctgtgtgccttgggtgaacatttgcctatcagcacaggaactcatggcagctgccaaaatagattgatcagtactggtttctcctttcctgtgcagctccattatcagcataaacatgtcctcctttatgaatctagtcctggaacacaaagccgagccattatttgaaacaaagctatcaaatttagcctgtgcaggattgctgcatgagttaaaagtgacaccatttcccttgtgtatagtatgatttgattgaacccccaagatgtcattcatgcagtcatggattagtcggtgatggcatggacctcccactttgtcatagtcagcctttcttggtacaagattcaaaacttttagcgcactgttgatgttgctgccatgctggtcctttgatgtgctttgtgctgcagaagtcccatagcttgcaacaggtacacgaatagccgatgctactgctgctgacaaactgctgaaacagccacctacaagacggttgtgcataactgaagccgtccatgtgtgagccaatgagcacgattgaggagcagaaaatagcaagcaatccagagcacttaacatgtgccatggagtcccagtagagccccaaacatgtttggaagataatctgcacccgcaccttgggattaatcttgctcgctgaagaagaagcacataaatcatcaaaccaaggatagatggataagattggtaaggatagcaccatggagaaaataaaaatctaaaaggctataactaaatgaacggagagtaagattttcgatttgattcctcacagacacagcattacagcaatctaggggttccttaaaacaggagaaatcaaccaaaattcaaatggacctccccaggatttcagagttataaataaagttattgttcaaagattgataacagcaaaaaaatcaactacaaattacaacctgtgtagcaaatacaactatgcttctaaatgcaagaaaaatgtgtgatctaatcgctcgagaacagtggcggccccaggattttaaacttgtgtattcgaaatagaaaggggtaaaaaaaatttgttcatagacctaaaaacctaataattggctaattggcttgtatagtatcacaaactaataattatataatatatagcgtataattgagcataaattcacacattgatagaattgatcatcatttgaaattgtttaacatatagaatactaattagtaaacatatcaaagtgccaacatatgaaatacataaagggtagaaaatgataaattgggaagaaatcttacagtttggagatcaacttttcgttgtttgatattttggaaataagtgatgatgtccttgtctttaatttgcaagaaaaattctctttcaatgaatgtaactaaacaatcattcaactattgttgccctatcttgcttctcaagttcatacattatgatacaaagcacaaattagcatatatgatgcacagaaatatgtttgctaagtcgctagtaatctcaattaaaaaaaggttgttagcccattactagttcatccaacatcaggatcaggaacacatggatgctaaacatagaaaatcatgcgaaactgaaatctagatgcaaaacctaagtaccgaggggattcacatgagacaggagctagggattaaaccaaaccaggaggaaggatcgccggggggtgcggtcgttacctcggggctcgggacttgatttcttcgcgctgggcctcgaggcgggtagagcttgtcgtccatggccgcactgccgctgtcgcagcaggccgcgcgtcgcgccgcaatgccgctgtcgccgcaggccgcgccgcgccgctgcctcacgagtcagccgctgccccgcgccctggcgccaagccgagtggtcctcttcctgcgtcgacgcctccacggccgtgcgcccgctccgccgccaccctaggagatgctgcgccagtgcgtccagccggcagccgcccctgcctggctggctgccccgcggtcgccggctcgccgccgccgtacaccgcgcccgccgccgcaccgcacgccgcacgcagcgccccccgccgcccgtctccttgcaaagctagggttaggttagggaatttgggaattggggattttgggttagctgcctggcaggtgagtttggcttcgaaatggtcttagttgcggcccaagtagactacgggccgagtgaaagggggaggaaggtggaaaatttagacccaatagagaaagaaatggcataacgaggcccaaatgagtagtttaagtctttttctttaactttttgaatacatatatgaactatagagtatatatacctattttttgtctaaaaatcttgggtatacatctgaatacccttgaattatagctgggcccgcccctgctcgagaagttcagcgcttcagctagttggcacaaatctgcaaagcttgtaaacaagtttatacttgaggagcttaggttcttgtttgcttcaaaattttttgattttccagaccttttaaccactatggacaacagctataaagaattaaagattgtgagttgaaatggaagatgcatcagttctatttcttcaggatggaagtgatctagcattctagcctaacccaacctattcttgccaggataaaaatggcccgttcactgattcaccatctcgaattgaacaaaaaaaaaattgagtggggaaaaaatcaggattcacctgcttgctacctgaactgggaacggtgcccgccagcccaggacgccgcccgcagccgtccgccgtaggctgcagcgagcgccggcgacctagcctcgctgcatggcgtgcgtggccctttgaggcttgggccgtggacaacgccggacagagagagagagagagagagagagagaggtaggtttagcctggacaagcacgctgctccgccgctggtcggcgccccgccggctggcctcgtctggcagccgctgcgccgctcgatctgctgccgcctgcggagacgatttgatggtttggttatgggactttggccgaaacacatgcagggatgagtcggggaaaagatggcccaatgggcttaggtaattgaattttgaactccattttattcggaaactgaaactgtcagccttgctacttaactactaggcatcactgtatgtataccaccaggtgttccctttgttccattttctaagacattttatatcctcttttatttagacttataagctaggggctgatcgggagatattactgtggctatgcaactgcagcggtagcatcaccaaacccaaaaccaggggtggatccagcaatgaaaaattggggggggggggggggggggggaggctcaacctataaaagacattactcccaaaattttcaggttttcctggctcaaagcaaacataacagtacaagcaaaacgctgcattctttgattcactgtactctaaccaatcatagatctccaaccaacgttgttggaaagatctctattcaccactttgccatttgtgaggaaatgtataaccaactggttgggttgggacccttaaaacatatgccctcttcacttgatctctaatctcaaatggatactcatcaatttgcacattcctggatcactaacaatatctgagcaagtgaactagacccttgccaatttttgttgtcttatgttctcatcgtcctctgatgcagtagtactgctactgccacttgaataatagttgaacaatgttcttttcgagatgctgagattctagtctagacaaaaaaagaaaatgaaactgtgctaaattgctaatggattgaatcattccaaatttccaatcaattaatcattaatcacaattgcattgcatatttgcataaaattctaaacattacataccttgtttagttattctgcctgcctgttgctcgcctggtcctgcctcttgctcgcgtgctcccgtgacgtcgccggcgccgcccgccgccgacgccgcgcgcttccgcctgctgcctcgccggtaggggtgaaaacggttcggaatttttccggattccggacctgttttcggaaacggaatcagccggtcggaattttttcggaatttcacggaaacggaatcgaaaacggaaatattttttcggaaacggaatcgaatatgataatatcagtttccgtcggaactcggaatcggtcggaaaaattccggaaagtttgtcggaatttccgaagttaaaaaggcccatccaaatagtccataattcctccccaaattcccagcccaacccaagtccctaactggctaaccctagagaggagagagagagagagatcgagagaggcggcgcatcagagatcgagagaggcggcggcggagcggcgcatccaggggtcgagtgcgccaccgctggccgcctggccgccgtcctcggctagtcggctctctcgctccgtcctcgcccccaccattttcgccggcgccaccaccacagacgacgccgccgacgcggacgacgccggccactggccacaccgtcgatgccggctacccactaaatcacggaaaaaaataaaattccaaaaagaattcaaaaaaagaaaccctagccgtcgcccaagctcgccgccacctgcccccgcctcctcgtcgtcgtcggcggcggaggtgaggaggagatggctttggcgccaccgccctaggtctccgctggggcttcacccaaggccgccgtcggattcgggcgggacgaggtccgccgccgccggatccgggcgggacgagaaccgtcgccgccggatctggcccgtcggctcctcgtcgtcgtcggcagcgacggtgaggaggagatggcggtggtgccgccgcccgaggttgccgcccactcttcgaccgaggtcgccgcccccgccaccgccagctccaggccggagcccaaggcggccgagccatgccgccgccgccgccgccagctcccgccaccgccaccgccgccctaggaggagtggagaggagagaaagagagttaaggaaagaaagagagtgaggggagaggatagaaagagagagagtggaggtaaaaatatcaggatagggagagagaagaggagatgaaaaaatttgaagcgaggaggagtgaaaaacaattaattttaaaatattaaaactttgaatcgaattttatgatattaaatgaacttgtgtgaaaaagttatcaaaaataaagttgtagaactcgttaagatctaccaattttcttttggccatttctccattcaagtttgattggactatataaagtttgaattttaaaatataagaaattcaaataatttttcgggtagtaaatgatttcaaatgggaaagttgtcaacaacaaagttgtataactcatcaagatctacaactttagtattggtcatttttctatatgactttgtttgaacagtttgaatttgaatttcaaattatgataacttcgaataatatttttaagtattaaatgatttcaactgaaaaagtcatcaataacaaagtggtataactcatcaagatctataacttttatttgggttatttcttcatccgataaagtgatttataagatcgttcacaaaatgtacatatctcttatatagtttatagactataggagatatatgtaaattttgtgaataatattactatcactttatcggatgaagaaatgaccaaaataaaagttatagatattgatgagttatacaactttattgttgatgactttttcagttgaaatcatttagtacttgaaaatattgtctgaagttgttataatttaaaattcaaattcaaattatagaaacaaagtcatatagcaaaatgatcaaaacaaaagttgtagatattgatgagttatacaactttgttgttgatgactttttcatttgaaatcatttagtatttaaaaatgttgtttgaagttgtcataatttgaaattcaaattcaaattattgaaacaaagtcatatagcaaaatgaccaaaacaaaagttgttgatcttgataagttatacaactttgttattgacatttttttcatttgaaatcatttactaccctaaaaaatatttgaattgagaggaaggaggcattatagacttctcggcgagggaggagcaaaagggctgggccggcggcccgaagagggaggaggggaaggggaagccggcccgtggagggagagagaggctgcgggctgcgggctaatagtgtatactttataccttataccatggtattttgctgtaatttttttagaatatttgttatacaaattatatgaagttatagaagaatatattttgctgttgagacttaccaattagacttcatataattgtgttttataatgaattgttgactgttaaaacttgagaattgaacttcacaaaagtttgaagctcagtttgaggggtttctgtattccgataaattttcgttaccgtatccgcaccggttcgttttcgctctgttttcggtttcgataatattcgtttccgttttcgtttccagggtttccgattccgattccgattccgaaaaaaatatggaaacgaaaatgataaaggttgtttccgtaccgtttctgccggcgcgtgctccgctgcgccgctcgtcttcacctcgccgcctgcccccgcgccgctcgcctcttgagccgccgaacggggagctcactgccttggctgctagggattcggggccgggtactggggaattaggtagtggaaaaagtgcaccgaaggtcccttaacttgtcattgaattacaatatcgtcctccaaccgcaaaaccagatatccggcaggttcttcggtggttttttgacaaattgacccttttcaaaaacttatttcgaaactaacccctgccaaaaacttcaaccaaaactaggccgtcggctcagcgccaagcgcattggcgctgaggttggccgtgtcagcgccaacgggactggtgctgacattgtgccaccgtggcggccgggccgatcccctagctgacgtggcagctacctcagcgccaaccgcttcggcgctgaggtgcccaacctcagcgccaagtaagttggcgctgaccttggctacttagagcccggccgaggccgccccagccagttcttcctccgttttttccccagccgcccgcctagggttcgatcgccaccgcgttctcctcgcccaatctcccccaaaaacctctctaatcgaaggtgatttgtgcggcattgagtttgggatcggaagagaaggtaaacccctctataaaccctaagctccccaaagttttattggatattttgcattgttttggttgtagacgtggtttgataatagttggctaaggatggattattagatggataatatgggtggggatgaagtgtggaggtggcatatctttatctatttggttgttattgatacatttgacaaaatatatttgggatggatgtttggtgatgcactagggtttgatgggagatggatgtgtggtgatggcctaggatgtgggatggatttgtggtgattgagagggtttgaaaggggttgatgtgtggtgaagggtaggtaatttgtaggagtagagtttttttttatcaataatgtgtagtatttgagtaatgtacttatttattggaaaaattatacatgttgttagcttttgaagtattggtattgcaatggtaattacatattattttcaagtaattaatgtttatgcatgggttaaaaattgtagatggatagattggtccggcttcattatggtggttgtgtggtagatgaaagtacacatggaagccaatttgagggaatgacagttagacaattagtgttttttgcgaagcctacctttgaggagttaatgtctcgcatcaagcatgaattggattggaatgatgagtcggttggtatgcaagggagatacgatgtgggcggcggtgtcatgtcacataaatttatgttagacttgaatggagagatcgaatggcaaacatatatagatatagtattggggtcacatttcaaatctcttgaggtgtttgcatggaagaaagatggtaggatagggaagaaagaacttatagagcttaatgaaagtccactcatagaatcacccattagctgtcacgaactgtcggagaggtgtagtaggaaggaagaattgattgaggaagacgtggaggggggcgagggagtaaatgatatggcggatgtggaggtcagggaagagaatgacccggtaagggaggaagtacatgctgaggagaatgtgccgttaagggaagaagtacatgtagaggacaatgtgccgttaagggaggaagttaatgtggaggagaatgtgccggtaagagaggaaggagatgttgaggatggtcgggaggtaggagatgatgtggagttgcctgaggaagaagcgaatgctaagaatgtaagtatgggcctaagggagttggctaggctgaaattctatacccgagaggagtgtgaggaggctatgatacgcagtggattgaacccaggctggttggagtatgatacagaggatgaattggatgagtccgcttccgactccgatgatgatcgtccagtgcgtaagatgtcagagcatgaaaggactgtgtttgcgaaactggtgggtagaaacccggaaataacacaattcgaggatcttaccagatctggtgttggtgaaagatagcggcagacggcagcactttgttggcagaagatcttcagtgggtgattgatggaaagagaggggaggcgcagggtatagctatttcggagggagcagctcaggtggttgtgcgtggcgacgacgggggagatcctgagcggcgtagggggcggcgatgtgggaggagagcgatggctgcgtgatttggggaggtcgtggcgcggttggcgtcgccaatcttgcaaaatactgaaggaacacaaagagaatcaaatccagtatgagtaaaaacttttgaaagtgcagtgtgacagtggaattcttctgtttgaccattttagtgaatagttttaacaattgtcaggaaacatattcatctagattagagtgtttatactcaacaaaccaatgcatatggaagatcaatatgtacaaaggtatattactacaaggtttcgatggcaatccatgcagaaactaaagggaaaaagataaatcaacagaatattaagaaattagctctaaaaacaatgaggcattcatcagctgcaatgaatatcatgaaaaattgcacaaacatcaataggtttcgtacggaataacatgacgatgaaatcagaactcattcaactgcatgattgtctagggtgaactgaattttcgcctcaacttttttgcccccccccccaaaaaaaaaaaacaccctaaaggcatatcatcgagcactacgggagcaatgccacaatggtaccttctcaggagccacagtattttcgggctggaggagcgcgccacgtgcaggggggggagcacggcgggggggttggacggcgattcaaactccggttctgccgcccctgaattttctgatacggggcggcgcgatagcagctgggcggcggcgaactgcggtcggggtgaggggtcgccggcggcgtgatttgcggccttgcgggtgtgcgagagagagaggagagaggggaggggcggcggcgcgatttgcgggtgtgcgggcgatctgagagaggaggggataggggcgagaggtgagagaggagggggaacgtggcgatacgaggggcgttggcagggtttatacattccagcacggttttcgacaagttttgtactagtaccgaattttaattttgaccaaatttactgtatgatatttgaatttgtctgaaagcattcgaaatcccaatcaaaccgagccttgtcaaaacgtcgaaaaaccgcgaaaatcgatcggctttcattggctttgtaaaccatgggcgttggattagatgattatatggatcatcggatttgatataatataataaataatgaataataatataatatataataataaataaatcataggttaatagactatagtgcaacagtaaccgtgtaggcgtgtactagtcatgatgaaggaattgaacatggtgaaggaattgaacgtgttgacttgtgtaactggtggtaaatctagctatcaatttagtctactatgttgtagcgtatcgggtgaaattaagagaagaaagtgatagtactcattattgagtgaatttttttaataagtggttatagctttttaagtaaaggccaaaattttttgttccattattgaaaaaatagcaaagcccagcaggcattgagagggtagaaattagcaaccaaattcagattgcagacactcattgtattcagcctgcatacatggctgttcatgcaaatttgtacacggacaccggtaatttattctgaataaacagtcgcatgttctttcatgtatttattaagtttcatcacttcaagtgtttctgaaaccagtccagcattaaggcgagagcttgtttcccggtttcgagagcaaacgggtcgctggtgttatatcgaccggcaaatccatgggaaactcctggaaaaatcttggcgtagaaatcaatctgcaacaacaaaaatatcatggtgttactctgtattatatgctagaagaataaattgggtcaaagccacagttttttttaattgatttacaagtgccttgaacattgatggacttgttaacctgccaaatatttcagtttcagttattcagagctttcaatcctttattagaacacacataagtttttttttctttctctatttaataaaatttgccgcatgtgccgatttattaaaaaaatcccttatttattcacgatgagtcatcaacacgtggatttaacctatatgtgattgagaggatgagggacaaattagaaatcgtgtcaacttttagtggaaaatgaagattttatccgagaaaaaaaggtaacgagacaaaaacatgctggacgaaatcaaacaagaactcacatcgtttctttgacgcaaggcatgcacatactggtagactaatcttggtggtgtaactgtgtcattctggcctccaaggatctcgatgggccatttaacctctgtttatcaacgggaataattaatatgagtaaataatacagattagatcaaatgataaatattgcatagcgccaaaaagatcaacttcacctttcatatcatcagcagtcactgcgtaaggatgagagatgacaaccgcttctacctcattggttttcgctacctccacagcaaactttcctgccagataaacatgtttttagagactttaatttctatcaaacatagtataatgtggatagcaattgaggaagtttcaagaatatatgtagatataaacacataaatacattttcttttgtttgatcaatatgactcaccaccccaacaatatcctccaactccaacaagtgatttcccttcgtttcttagaaaagcaaagattgatttagctttttcagcttctttcacctgccatgcatggtcaattgaatatgctcatccctcgcaaaaaaaaattgaatatgctcatcaatatctacttgttgactcaatttcaaccttttgactcattgatatgcatcttaattttctaaaaaacagagggggaaaccctcagcttcctacagaaaccatcccttaccctccataagcatctcagacaggtcaaggactgaaggttttgttatgcaactaagatcaaatcactccttagtaggtaaatcatttgtatttattcaactaagatcaaatcactccttagcaactaagatcaaatcactccttcgtcacaacaaacttgaataaatcatttttcacataccccaaaatctaaactttaaaaggttttattttttaatgatcaaaattagctcgtattgacagcacgtgttccaaaacgaggccctatttgtttcagcttaagattattgtgatctagattattaaatcagattactataagccagattataataagctgacaaagaataagctgtgagttgtttgtttctctagattattggaggcatctaagggtagtgagtctttagctactcaataatctagaaaaagctcctccaaaggagattattaggttataataatctggtttatagattataataatctacttatttgtttcagcttactcctaataattcagattataataatcctaagctgaatcaagcggggcctactccctccgtcccataaaaaaccaacctaggatcggatttgacacatctcaatactacgaatctaaacatagtactaggatatgtcatatccggttctagattgattttttatgggatgaaggaagtatttctcggagcataagtactgtaagaacaaatcacttcagcctcgtttcagtggaccagttgccccatccatgtgtatggggtatgactttgaaattttggcctatccaaacgacggcttaagatggtgatcgagacgaattgtaccggagagtgagactcgagccattcggtaaagttcacagttgtggttgctggatctccatgaaacaaatcaggtaccacgacgtaatatccggcatcaccaactttatcagctatttgcctgtaattgtcagcatcattattatcacgcaaatgtgttctgttttccgaagttatagagaaaacatataagagcaaaaacacacacacacatacatgtgttagggacttaaggtgtgttcagaacaacattttcccaattgctaatccctcgttttccatgcgcatactgtccaaactgtcaaatgatttgtttttttcaaaagaaaattacatgaaaagttactttaaaatcatattaataaattttttaagtttttttacctaatacttaattaattatatgctaatttgccactccattttatatgctggaggtgaagggttcctaaccttcaacaccgaattcagccttacagcatctccaagagactctccattcaactctctaagctaaattttagccaacatagcaaaaaaaaaaaaatagtgctccaacagactttccgtctatatggccaagccatctagctggccaaatatggccactcaatgctatcgtctattttcctcctcccacgttctctctctacctccatcaaccatagcaacattgtcgtcctgggagccgactgtggccgtggccgagtaccctaccaaccactgactgcatgcgtgccgaagaggtcgtagccgcgcactaggtctgccgcctcaccggacttcttccaagcaccgtccctaccggttcccactgccaccctgccccgccccacgccgattcctactgctgcgggtgatgaccaccaccaccaccatctgccgctgccccttgagaccaccaccgaccccgaccccatcaccgcctagactagcgccctcctccatcgctccttcatccctctgccagctggacccgtgccattgtggccatggtagcggactagcagttgcttcgcggcatccgcacccgtggcctccactgcttcctcccccgcaccgtctccgcctccgttcatccttgtcaccgttgctttatgccctcatcgccatcaacatcccaccctccctccgtcacgtgtcaccccacggagcggcgacgtggaggaagggacgagtagctgatgcaccagggaatgtcgcggcggctacacggagggtggccatctagaggcacccttcccctccccttcgtcctctccgccatcgccagcagctgctcccaggctcccagctcctcccggctctgcagctactgctccgggccgaggaagtggcggcagcgtggagaaagggggagagacagcggtgtggagggagtggagagagaagaagaagagaagaatagagaggatgggtgaaaaagggtgggaaggtcaacatgtgggacctactgtcacagacgtagaggatgttgaagtaagtaatgaatctgatttgacaaatcagatgaagagttagctatatgagtgtttgaagagtctaatttatataatttggatagtatgttggagaaactcataggactcaccaacataggtgtgtgtttgtatgtgcgtgagtgtgtttgcttctgacttgtacatgaaaaaaaagtaggatttgtcaaaaagaatttaattggaatgagaaacttgggcaagcgttggtgcatcttccatttaattgaaataaaaacagtttaccatataaaatgaacatttttccacgccattattttctatgtagaaattaaatcagtctctttccatagcagttcatgtgtcaattttctttccatgcgattgtgacatggctacaaatcggacacccgattttatggtgaaaaagtaggtgctctcccctactacactgttgcatttttggctagtgcaaagaggagtctacccatacgcatgcaaagctacacactttatatctcattcccatatattttattttagcctccttctcgtatcttcaaactattttttcctaaattatttaccatataaacgatttgatcataccattatatttgttataattaaatttttacagtaatatcttacacgattatattttaatcaaaaaagtaatatgatttgtgctagaaaagaaaactagaaaagaggaggatgacaaagaaaatttacctcagtaacggcgcttggaaacctgaggagttaaaccaaattaacaatcacgcatgcagcagcaagcaatgaaattagcagttcatcatcagtccataatcaccaaggaatgaacaaatggcagtagtgatcactgatcagttagctagctagctcaggcaatcatatgcgtactaaccgtagacgtcggaggcgaggacgatggcccggccggagtgggcggcgccggtgacgtaggcctcgtagcccgccaggtcgtggacgaccacgccggcctcgccgccgccggccttcatgtccggcgggtgctcaaagcactgcaagcgcggcggaacagccgcggcggcggcgccggccgccgcggcgaggcagaggaggaggctcaacgaagcagttgccatatggttaatttgcatactgatgggtgagagacgatgcttgggcttttgtaacatggatttaaccggtagagtcagatgaacgctgcaatcctgcccccctttttttcttggaaaaaataaacagagtgaaactaccacactttgtaggacgtactcactccgtctcatattataatttgtttggtttttttttcttagttaaatttctttaaatttgttcgattttatagaaaaatatagtaacgaacatattaaaatatgttcaatgtcaaatttaataaaataaatttagtattgtagatgttgctattttttctataaacttgctcaaaccctgaagaattttgactaaaaaatataattaaatgactgtaatatggaacggagggagtactccctaactatttgtcattgtcgtttagaattatatgttattgtcctttcgaattatttgtcgttgtcgtttcaaggtggtccaatttaatgtttggaatatagtgagttgaaccacattcgcatcaattctacgtgtcccaagctcaagaaatatttcgaggaggatgagaaagacaacaaggataacaacgacttatcttaatttgaagataaaattaaaggaagaactacaagtgcaaacttgtgtgtcaaatgctacaagctttcaaaggaagttgagtttagcgatgaagaataatcggaaagcgaggatgataaaaaagcagatgcaaaaaggtagccatttgtaagtttatgtcttactgtaaaatgctcgtgcgttgcaacatgaaaacctacccacttaaaactgtgacaccttattacacatgtagtattccagtgaaacgtgacattgcctcatgtgaattgttatctcgtcacgctcgcttcatacaaaatgggaggtatcgaatcatatgtgttgaaatcacatcaatattggggaaaacaacaaagaaaataatatcataaacaatgactaaccaaatgtaatattattttcttatcgcccaaaaattttagaccatttaataattgagaaaattcgatcgatagcataggaaaaaaaacagtaccaaaaaatagcacaaaaatttttcgctttcgactagaagcacaggccaccggtttttcttcgctctatagcacttccgtcaggtttagagttaacagcattagattgaagtatagaaaaattttgttggacccatttgcccttcgtcttcctgtgtcatctcgtcctctcggaccggtgcccacgatgacggcgccatcgccaaactgcgacgcggcgacgatccccgtccccatccccgccgccgccatccccgtccccagccacgtgccattccgtgtctctgtcggctcccgtcgcgacgacaacagtagttgtaggaagctgtacgagccccggctggtggccatcaggctctaccaccgtggtcgggacgagcaccatgccatggagcagcacaagtggcgcttcctccagcgagctgcacccaccgtcccgctctccgacttcgtggacgtggttcgggccgtcgagcagcgtgctcgctgctgctacagcgagagcacggccatcttgaacgacgacggcgacggcttcgcggagatgctgctcctcgacggctgcttcattctcgagttctcggcgaagctgagccgcacgaattagtgcacttgcaaaaagctaattaggatttaattaattagttgattaatttgttggcgctggcgccgccatggttgcagatgctcccgatggccgccatctcatcaccgctgccctgtggagacgacacgagcgagctgagcgcggagtcgaagtgcgccatggactccgctgccgccggcaccatcatcaccatctgttcagccgccaccgcccatggcggcatcattgtcatcgtcgcgttcgccgccacagcgggcagcaatgcgcccgcacctgtgccggcgctggacgaggaggtgaaggaggagaagtagtcgcgcagcggggaagaagtgctcgtcggccatcatcgtcgtcggcggcggcgtacagcggcccacatccatccacgctcgggcagtcggggagacgaggcggtcgcccggcacgccgatggttgccgcgccgccgtccacgagggagtggaagaggagacctggtggggaatgtggggagcgaagggcaaatgtgtccgacgaaaattttctctactccgatctaatgccgttacttcaaaatgcgacggaagtgctacgtggcgaagaaaaatcggtggcctatgctatggatcgaaagtggaaactttttgtgctatttttttaccactttgtttcctgtgctatggatcgaattttctcttaataattttggtgatggtgctcaattgaaaaatgaattgaattcatgcgttacagagacaaattctcagtgagaaaatggttaataccagtgttgaattagcaaaggataccatagtttaccttgaaccatgacaatctctaaaagttaatgttttgatatcaaaagaaactgataaacatcaagcatgttttttaatcaccgggaaaaaaaaggcttgttctattttttttaaagtaaatttcagaaaactgtaactataatgataaaattatcagtttactacaatattagtgatctatttcagtttgctgcaataatagcgtgagaaattatcacaaaactattaacttttacgtgatatgctgctacagttgttacctacatgtcatgtagcagtatatcacataaaagttacagttttgtgataattttctacgctattgttgtaacaaactgaaatagaagccccctccaatttttctaagctccactgctgtgggacttccaactttctaagctccaattgcagaagtcctctctttcagtttgcatttgttccaacgttcaaatttgaagattagttttaactttgaacttgagaatacatgcatgtgcgttgggttgaattcccaccgctgagagatttccaggggaaggaatcggaaagtttcataaatcaattcagcagttaatacatcgacaagctcaattcagagaaaatcatagccaattaatcacattgacatggctggttatacttatacatggacaccggcaatttatttagatgaaaatgaataagtgcaattttctgtattttcacaaatgactatctatattgtcatttttttaatagaataatctatattgtcatttcaagtatttctcaaaccagtcaagcattaaggcaagagcctgttgagcagttttgacagcaaactggttgctggcgttatatctgcaagcaaagccatgagacacgtctggaaagatcctgacaaagtaatcaacctgcaacaaagatgcagtccattagaggcactttgtaatttgcatcttttcttaaacatcattgagtggttgtgttgaagaaaaaattagggtcttcttgcaaatatagaacaagtcaagaagatataggatattttccgaatttatggccatgtacatgtatggaactttaattgcaataatgtactagtgttcagactttagttattgtaaatttcccaaatgttcttctcaaaaacaactttccaaatgttgactaccaattagagccagcatgatcttttaatatctcatcatttctggtagatttatatcttgtctgtttaccgtttcagtttttttttttgggggggggggggttgaataaactctgtttcagttattcttgtgctttctaatatgtatttttttttacaaaatttaagatcatttggcatcaggtgccaatgaaacacaacagcaactcacctcagttgtttgacgcaacacattcacaaactggtccaccaaacttggtggtgttatatggtcattctgacctccaaggatttcaatggggcatttgacacctgtgttcaatgtgaactaagtaacaaaacaaaggctacttggatacaacttacataaaatgactagataattcgtgtatatgtagtgcaaccaattaagcatcaaatcaaaacaagttaaattcacctttcatatcatcagcaatcacctctgaaggatgagagatgacaatcgcttcaacttcattggttttggccacctccacagcaaacttcgctgtcagttgaacttgtgctgagactataatatgatctaaatctagctgtggaatctaactaggaatttgcaaaaaaaatttagagtgtaatcctaatgtactggtgtatgatatgtaaagacatttttctttcgctggttagtttcgcttaccaccccaacaataacctccaattccaataacagatttgccttccctttttagagcagcaaagattgatttagcatcttcagctgcttttacctgaaattcaaattgaatatactgatcaatatccattaattgactccacaataagcaccatatggaaaaggttttttttatgcaactatgatcattattacttggcgttttgaaacgaaccatgtaagatttcatattgatatagcattaaaaaattacaagaccatagccctaaatagttatgaatagggggaaaaaagaaacaacagtcacaccacgtgtctacaagatgtaaacttcctcctgtttggatccccttgagctattttggggctaaaaggggtgggctaaaaaatatccctaggatctaaacaccccctatgtaaacggtgaaacaaattaccggagagtgaagtgtgatccattttgtaacgtttatacttgggtctccattgtaaggttgtccatggaagaaatcaggtaccacaacgtaatacccagcttcaccaactttgtcggcattgtccctgtaattgtcagcatcagtaaccacacatcagcttgtaaattgtttttggaatctagaatgggaataaaagtagaatttgtatgagataaatttagctgggatgtcgtactatttgaagctcaaggaagcacttaaaactggaacgtaaaacatagatttcagtaaaatccacatgaagaaatcacgggtttgtcgttgtattgttggaattcaagatatttctacagaaactggaacactgaaattggatcattgtcaacccttcattgagttccgaatacgtttgtcctaaggataaaatcggataaaatctgatggctttttacttataaaactgtcagaatttttatttatttcattataatgcatagactttacatattttttgccccaaaaaaaaagttccgacttcgtttgtcctaaggacaaaatctgacggttttttacttgtaaaactgtcagaatttttatttatttcagtataatgcatagactttacacattttttgcccaaaaaaaagagttccgactacgtttgtcctaagtacaaaatctaatggctttttacttgtaaaactgtcagaatttttatttatttcagtataatgcatagactttacacataggtataatattattggcatgtacagtattttcaataatttccactgtatttgtcacttatatatatgcacgatgtgtggacttaaagtttgtgtgaacatgaaattttccattaaaattatatatatacatatatatatataaacccgcttgacatatttatatcattagcgggaggatagaatatggaaaaattgcaaaatgagtatatcacctctttaaattataaattattttaggtttgttatagatcaaacctctttaagttcgaccaaatttatagaaaaattaatatattgaacgatggttgttgaatgaaattaatttgatgttgtagatgtttctacattttttataaacttatcaaacttaatgatatttgacttaggtcaaacccaaagtggcctataatatgaagggagggacgaatagtttaaaaccatgattagtcccaaaatgatcaggaaattaaactatttgaaatgaaagatgagcattgtctaatattatttattgaaaccctgatgatggccttatgggtgatgagaactattattcacgcatgtcactgcagaaagatagggataattcagtaaaaatgacaatatcaccttttaagtcatacaattatttgtcatgtttgctctgtttattttccctcaaattcagtctctttctagagttgttcaggtgttaatttctttcactaaatttgtggagcaaatgaagaaaattgcggagcaagatgacagacaacgacgacgaagagaggaggaggaggttaaagaaattgacgaatactgtacctcagcaatggtgcttcgaatcctgaagaaaccaaattaacagcgacaattaacagctgatcactcgataatcagttgataatcactactaaccatagatgtcggaggccacgatgatggcccggccggagtggacgtcgccggtgacatacgccgggaagcctgccaggtcgtcgatgaccacgccggcctcactgtcgccgtcggccgtcagctccggcgggttgtcgaggcacggcaagcgcagcggatcggcagaggtggcagcgccgccgccgccgccgccggccacggcgaggcagaggatgctccagcagagcagcaacgaagacggcgccatggtaattaattagctctactgatcatagttgctgaagcagcttttgtacatggatttagacggtagtaggtagcaaaaggagacgcacctatgacatgtttagtgtcgcatcgacgttgcaatcctacgtccttaaccaggaatgaaataaataggtgacttggaagttttcaacttaaatttgagagttaaaagttagaatctaaagttttaaaatctatacataattatttttttaaaattttcgagttgaaagatttgaaagtttaaattagatacaaactttgtatacgtgtatatggtttttatacatcaaaagtatatacatataaaaaatttgtattatatgtacgtatgtatataatttacatacatacgtataacctttttatatgtgtatataaagttgagagaatatattttataccattgaatttatcccagtttaacgatttgccaatgacattatctctttctactatgtactgatgactctatcaattgtgataggcctctttttaaaaaatacccaaaataccttagagatatacatggttaacaattaatttatctcattagaaagtttcagaaaatatgaaattttttatatgccctccttacacaacagagaagtatgtacataagtttcaatttttttatatatttttttaaaaatatttttgtgtggtatatcatagagaaatagcttacacaaaatataagagaaaaaatcttatgttgcatatgaaagataatttatattaaaaacaacaacacaaaaaatattttatatagtatataacaaataagttatatttttaaaaaatagaaatgaaaaaaacttatatacaaacttttatacttacaggaggccacataaaagttttcatattttttttaaacttctaatgatataaatcaactgttaaccttatatgtccataagggtattttaggtaggcaccaaaatcagtcgaaaccgtcattcacacaactatgatactcgatttccactgattttgatagttgacggatactatatactccatctgttccataatataaggcacaaccattttttttggatgttctataatataaggcatgcatgcatatatacaattaattagaacctcttctccattaaattattacttttctaaatcctccaccctcaagatctctaattctattggatacatgcattatatttattagagtggtccaaattagaagatgataatagatagttgtgacttatatttttgaacggagggtttgtggtttaaggacgcgaatgaaactaaaaaacgaaacaagataaatcagcccagtagcaaactgggcctgggaaagcttcggctcgagccccacgtgcgtcgtcagaaggatggactcatcgtccttaggtcatggcccagcatcctgcatatgcctgagtcgatgatgggtaatcctcctcctccccttctcggcttctcgctcgctcccgacctctctccaccctccccaagaccggtggcgagcagccagctggggatgcgccctctctgctgccggagaatctggatccggccggcatcggcgacggcgacggcgacggcgagggccggacggccagatcgacggcgccctcgacgtggggtggagagcaggtatgccacgcacctctactcctcctaggtcgctctgcgcgctgttctttggctccgactgaatccatccggttatgagtttttgtaccatatcgcccattctgagacaacaccacctgtttattagctcgatttgattctattccatcgccaccccagggacacccaccccgactgcaatgggcagcggtagggcgtgtatccgccctaccgtttcagctgcaaaaaaaaaaggcagtgaaaagatcccctactttggggcacggcaggcgaccccctgccggccagctgcaaaaaaaaaagaaaaaaaaaaggagcagtgaaaagatccaactagactcaaatataaatgatatgtcattggcacttagccgatcggctatcatttataggtttaaatgcggtttctttgtttctgtttcttgttgattgcaggatcaaatcaactggtacgctagcatacccgaaggcgagttttgggcctgcactggagttaagcaaatctcctaggcctcgtgttttacgtcaacaataattaattgaaatatcaatttcctggaatatttaggtatttttaagtaggtatgtgtataattaaattaatttataagtaaagtaagtgtgagaaataaaatgatatgtgtcggtgatatgggcccgggggtaccaagactagatggagtaggctgcccccatcgccacgtggccctctcctgagggcggtcgggcccggggctaggcggcggctgccccctcccatgaacccgaccccctccgtgggttgccacgtgtggtgggttaagtggccgcctccgtgcgtccacttacccgtatttatggtggcttgagcgggcgtgccatgcctcatttaatgcggtgtactgcgtatccatctggtctgtgatcggttgattgactgacgagacaaggggtgtcagacgcactaccgcgcatgccaggcggcgtgtgtcttgccctgtcccatcggtcatgatgatgagaggtcttagcctcccatcacaaccggagttggctcgtctgccctgattagggcaggggttccgtttcccggtaaaaatgagaatctcaggctggtgggtccttcactgttacacgtttgtaaccaccaagcacaacgatgacgagcagtatgaatgggaacccggaagtcttcaccccataaatggcgattgataggggcgtcccccgtgtcaagcggcaagatttgatgggccccatgaccagcgcaatattcgtattgctttccaagtcaaggaacaagacatgcgtttaatacaaagaatgtaatccttctcccctaagttaggtttttgggcccatgtggtaaccccttgaggtataaaaggaggtccaggcctactgagggagaggatgagcctttttgtgtagagcgtacaccccgcctccaaaatccgcattagtctgctctacacgttgagcggacccacgttctcatggtatcccgcttacacttttgtcctcacttcgtgtaaaagggttaacccggggataccatggttggagcaccaaggcttataagcaggccctcacccacctaaacttccaaggtggtactaaactaccactacacatccacttctgggccacatgggccaaactcacactactaacaggcttcaaacgggctggggtgttacattcagcctgccttaagggctgacgccccagcagctcaccgtttacacggcagaggcccagaaccccctccggtgcagaccatggcccaaagcacatgcatcatacaacggaggtttatgctctgataccaactgtaacaccccgcctccaaaatccgcattagtccgctctacacgttgagcggacccacgttcgcatggtatcccgcttatactttcgtcctcgcttcgtgtaaaagggttaacccggggataccatggttggagcaccaatgcttataagcaggccctcacccacctaaacttccaaggtggtactaaaccaccactacacattcacttctgggccacatgggccaaactcacactactaataggcttcaaacgggctggggtgttacaccctcatcatcaacaccttctagtccaacaaggagatattgtaacttcttacaggatcagctaagcacaggagtagggtattacgcttcttagcagcccgaaactgtataaacctccgttacctcatcttcctcgagaggcccgaccccctccttttcacacttccaccacagagttcctcgaatctcaaccgctatccccggccgaactaaaaaaggaggatctcacaattccctaatagaggagttcaccctctgacaatatggttggatttaatttttactaaattaagcatgatttaataacactctttgaaattttgttgggacatcatttcagtatttatttaaataaaaatcctcatttctctccgggccattttcagcccattttatttgtcagaccgcaactgaagtctaattagcttccccaaactcctcctctcagcgcgttgtgttggacccaccggcctgccagtggcccatcaagcgtgcgcggcacaacaatgatgcagcatggcgatggaggcggcccgacacggaggcgatcagagccgtccgatctgatggatggctcggatcgcctccgcgctgctaaagattcggatcggggaaaaccctaaccctaaccatcactttctccccttctctcttccgatcccctcccccggcgacgattgtgagaatggacggcggtgactggacggtggtccggagaggtggagcacgcgtgcgacgacaagcgctgagtgcatccttttgtgccggctgggggtgtgcccgaggacggtgccaagtcgtgccacggtgtcggtagaccggcaaggtggtcacgcaagtggcggttagcgccgtgtggctcggacctcatcggcaaccacgggtggggtggggagggatggggacagcgaagccaaaaggcggcacaaggccaacgcttccaatccccggcaagggacggtggggaaaattccatggcggcgcacgcacaacggtgaaccggcacgaccccgacaaggccggtaagtttctgaaacccgaagcttacattttatgattttatttggatttgatttggatttaattagttaagatatttcaatgtcctgtataatgaggttattatggggagtggacgatatattatctgttaactcaaccgatcgctttttgtgataatggtctcgcagcaataatattattgtaggttgtccataatagtatgaatagttggactcagtggcggactcaactttgaaatatatatgggatggaaaacggagatgttcactcgataagagcaatcgaacacaacacatatcttatatcttatttatagttcaatcacaaaactgcctcgatcattgtttatggcgtacgcgtgtgtaataccccgtatattaaaagatatttaggtttttttagtttgggttgacttgttaaaataaagatgttaacagaaataaataaaagaaaaatatctttagaagtgggccaacctgagaagacccataaacccagcccattagttctcccctaaaacctagagagaggggaaccgaatcccacctcccctcatagtgccgccacccctctccctagccgtagcctccttcctcccctcctcctgtgttcgcatctctccgctctacaacaaattgctctccctaaatctccaccttcatagcttggatcaagaagcgaagtagaaaaatggaacgaggaggaggagaggagtagagggaggggttagaccgaagtctcccctattgtctcctcacaagttctctaaagaaaccctaggtgagacttatccccttgttgtatcagttgttctagcatggctttagtgctttaattcgtggttagggaaagatagagaatgagtttgggtagttgtggttcggtttgttgcggttcggtttgctgcagttctgcatatggccagatttgtagtgcttcagtatttcgatgttttgggctctaaatgtataactaggaagttgtagataatgtttggatctatcttctgaccaaagggcgcaattttatctcaagtggtttaggagatataattttttagtatgactgttgtttttgtgtcaaaatctggataatagtagattgaactgtttttagaggggttaaacagtggaatcatgtcacgcccggaatttctatccaaaactccaaacgcttacatgtgtgtaaaacctttgtccaggaatcagccgaggcacacaataacaaattgataatagagtacaattattaatctaattacgaagcgaatataaggtcattacagaggtagatagtttctctcaaacaataaagatgtaagtagcggaaaataagataaacggcgcaggagactctatcccacaagcagcatgaccagggctacgcctaatcctccacaccttcagcatcattatagaactcctcttctgatgaatgattgcaaggtgagtatatgacatactcaacaagccatgcaacaaatatgcaaatgcatgggataacaaaggatggcataatatagtctgatttgcataaatggcatttaataaatacttcagaactagtaaaacagtaaagtatttaattaaacaatattaatccatcgctatacaacatacccgttgcatagacccaaccattctgaacaaccattcctgactgcacagttctatctccaaaccaggaatataccattccaaaccaggagctaaacaaattattaggacgatgtatgtggacatccctatatccacatacattaacttaggaggggttacatcccttttagattgattctttttggatggagggagtacatgatatgctttgtggttaggatatgtcccatataatttgacgtatgcaccaaataaacaaggaagaacaaaactgattgatctcggtctcaattttagtacgtaaacataacaggaaatttactagaataacgactaactcatcataaaattacaaatagattaatgcatttgacatcttattatagacgttctgttctgtcgctttctatcattccaagatggccattatcaattcgtgtaatcaacatgttgaataaataaattttccatcttttcttataaaaagtatagtacatgcacgagctattctaaattacaacatatctgcgctcacaagtcaaagataaggtgacttgcgtttttgtcctgtcgatatccatgggcagtcacccgacaagatgatgtcggaagagcttaattatagagaaaaatgaatgattgttttttttagctagcgatgttagagtttacaattcaaagttgacatgaaccaaaattgtagttgttttataataattaatgacatgtcatatctcaacaaactgttcagtgtttgtgccttcgtggactgagggcatgagggtgggctttcctatagtcagcattactaagttttaagagcaacattgggcgtccgatgaaggagtgaaaaaatcgggcgctgacgtcagcataacgcatgcgtgcaaaccattttaaactatatttttctcttaaattatttatacaaatcatgattcgattgcaccattaaattcattgcaattaaatctttaaaacaagaccacacatgtatatattccgacgaaattatttttagcttattattgaattatttttaaatgttgcacgctgttccaccaagtatatcgaaaatgtttcactaaataaatctaaaatgtttcaatcgtttaaatcggacgttgtttcaccttatataaaaacaatgtttcagcaaatagcgaaagaatgtttcagttcactgcaatatttgatccatatatagtgaaatatataagtacactaggtgaaacatttttttatggaataaaaaaatgaaacgagttcatttaataaagggattctaaaatatgtgggtgatttattgcaaaagaatgtttcagttcactggagcatttgatccatacatagtgaaacattttgttcactgcaatattaaatctatacatagtgaaacattgtgagtacactaagtgaaatatttttggtggaacaaaaaaatgaatcgaattcccttaataaagggtttccaaaatatgtggataatttgttgcacggaggtatgtggtgganacacgtggcagttgggggcagtacacatggtggggcacgggggggagcgaccgattttgctcccctcccccctcccgccggtcgcccaacgctaagcaatttcgctaatttttacaaagttgtacaatgtttcgatcgactctatatgctacttatcataaggcagaagtcatggtccacttggcctacgggttcgtcgttcatttcctcgcacggaaaacagagtagctcattaggccataatttattaagtattagataaaaaataaattattataatatttgaaagtaactttcctatagagaatttgtgaaaaaactacaccatttattagttcgggagtgtgcgtgcaaaaaaatatacgaagtcttttaaacctggacacgaaaattgaggacgattttcacagacatgaccagttatggtgcgtctgcaatccaaaatctaaagagatctctttataagaaaatcgtttttgtaggagtgctctggacacttagtagcattagagctagccggtgcctgtccttggtggtgcctggcttctggcccttcacttcaagaacattcttgttaatttaaatctgaatttaaattaaaagaaattatgtaaatactttgattttcttaatacttcctcgttcaaaaaaaccaacttagtaccggctgtgacacattaattctagtactatgaatttgtatatgcatatgcctagatttatcgtactataatagtataataatagaatatgttacatctggtgctaaatttattttttatgggacgcagtaagtacatgttagcatttttggtaaaataatatatttatttgtcaggtagttttgcccttgacgatcaatcgtgcgcgaccctgctctctcacgttgtatggtgccccacagcgaaatcaacggttcctccatgctgcaataataataataataataataataataataataataatagtaataataataatagtaataataataatagtaataataataatagtaataataataatagtaataataataatagtaataataataataataataataataataataataataataataataataataataataaatcagcggttcctgttgctttctgtcattctaacatgccctattatcaattcgggtaatcgaaataacgttgaacaaacaaatttgccatatttttcttataaaaaggagtacatgcaggagctataaagtacgtatcacgagtctaataagttcacttttgtttgtcatgtcgatatccaaggagagtcacccgacgagataatgttggaagagcttaattatagagaaaaatcaacgattaatatattgttgttggttgaggtagcgatgttagagtttatattacataattcaacgtcgacatgacatgttgtgtactattatgggcctattcggctgcttgttttcgcagctgcatgcatggcagctagctgcaacagcaagcagcacagctgcagccgtagcactgcccccaagaatgggagccgaacagatccgatgtctcaataagttgtcctcgaatgggctaaaggcttgggtgggcttccctattgtttaaaaatattactaccatcatcattgatgataatatcactaactcggatatataacaataaataccttatgtatttaataattaaagatgtatactttctatgtacgatttatatattatatatttaaataaacgatactgcaccataagtattttgtatggtttcgttttgggcatttgcttgggtaaaactagcttggctcgactcgagttcggcttgagtctgtaccgagtccgagcctaaacaagaaaactagctcagcttgtgttgacagtactagtcccagccaggctgccgacccctctattgttcttcttcccccttcacctctttgtccagtcaaacaaccacgcgcacagtcatgtcattccaccttagttgtctcaagctgacacagtgcagtgccaaccatcgccatcagatgtgacaccagtgacaccgcctctcatccaccatcaccgaacctgcaataacctaaagcattatgatcaagtactgggatggcagtgacaaagacaagtaatgacacattaagtagttttagtattaatcataagtgtgaagtctgacttttgtgaattcatttgtatttaggcgctgcgttcattcctgcaacttgcttccatttcactggcatataaaacaagatgaggggttatagtataattaatgaagtattaattatatcaacatggaaaattgacttatttgattttttaatgatattttaatatataagttatagtaaaaaaacaaaccttttagtaggttaggaaatgaggaagttcccatttggagttgaacaaaagaacatacctttttttacctcagttatttgctgctggctagggaaaagataataattacccgctaccctatggatggcaccaaacaacaactagggtggcgtcaaagcaaaaacaaacaacccccgtagagctaaagcagatcaatccgtaggatctcctatggctttccaaaaaatgggtggaaatgcgccaattacaagatttctgtatattagaattttgtatctacatatgtatatgtataacaatataatgtagtggatatgtgaaatttttaactcacgtaactgatcaaaaagtctacatgaacaaaaagaaggagtgccaagcggtggaaaaacaagttatggctcaacatttgttagatactacctcctccccataaaatgccgcttttagccacaaatcttgacaaagaatgaaaacaatatcatgacgtagatttgtactagttgtttagtatagtaatgagattatgtctaaacgttatcatgacacagcaaattgtctagtgtttggtgccttggtggaataatagggtgaggacctggactttctcgtagtcagcgttaccatgttctacaaaataaaataaaaataacaagtagaagtataacaggagaccaagtaaaaggggagggatgttgttgtgacaaagactgtaaattacacattaattgtttttggaaaccataaatgtagagttgtcatacaatatgtattatatatacggactctacgctaatacggggatctcaccatgtgtatatattaatcatgaaattagaagtcgtcaccctctcctggctttggacagggtggaatcacaacaagggcaggaacgacttccgtcgcctgctagaacaataatgtatactttttgacaggttgtcaattcgattgaataagatttgtcaatatttgttagatactacctccgttcccataaaacgctgcttttagccacgaatcttgccagaaaatgaaaacaatatcatgacgcaaatttatactagctatttaatatagcagtgaaattatgtcttaatgttgtcatcagacagcaaactgtctactgtttggtgccttcgtggaattattgggtgaggacatggactttcccgaagtcaatgttaccaagttttacaaaataatataaaaataccaagaagaagtataacaagagaccaagtaaaaggggagggatgtagttctgacaaagaccctaaattgcacactaactgtttttggaaatcataaatgtagagttttcatacaatttatattatattgatttactctacgctaatgagggcatctcaccatgtgtatatattaatcatgaaatcagaagtcatcgctctctcttggctttggactgggtggtgtcacaactagggcatgaacgactttcgtcgcctgctagaacaataacgtataattcttcacaggtcgtcaattcgattgatggagatttggccacatttgtcagatagttcctccgtccccataaaacgctgcttttagccacgaatcttgacaaaggatgaaaacaatatcatgatgtagatttgtactagttgtttaatatagtaatgaaattaagtctaaacgttatcatcacacaacaaattgtctagtgtttggtgccttggtggaataattaggtgaggacctggactttctcgtagtcaacgttaccatgttttacaaaataaaataaaaataataagtagaattataacaagagaccaagtaaaaggggaggaatgtagttgtgacaaagaccctaaattgcacactaattgtttttggaaatcataaatgtagagttttcatacaatttgtattatatcgatttactctacgctaatgtggggatctcaccatgtgtatatattaatcatgaaattagaagtcgtcaccctctactggctttggatagggtggaatcacaacaagggcaggaacgacttccgtcgcctgctagaacaattatgtatattttttcacaggtcgtcaatttgattgatggagatttgtccacatttgttagatactacctcctttcccataaaacgctgcttttagccacgaatcttgccaaagaatgaaaacaatatcatgacgtagatttgtactaggtttttaatgggacaatttcgtttttgcccccactttaatttgtaatatttattttgctcctagtttttagtgttttcgtttttactcccacttttttgaactgaaagaggcgtttacctctggtttggatggaagttagtgggaccgggtttatggcaggaaataaagaatttttgaattagtgatttaccattttacccctgtggaagtgttaaccatatggactctctctctcctctcgctacacagcaacccgaaacctagcccgtgtcaaaaaaaaaaaagaaccgtagacctagcctaggcggcggcggaggaggagagcggccggggagaggcggcgcggcagcgagcggccggtgcctaagcggcagcggcgagtgggtgagggcgagcggcgcggtaggcggcggcgagcgggcggctgcggcggcgaaggaggggagcgagcgtcggcctggtgccgctcctcccggcgcgtgcaagagagcggccggggagagggcggcgcagcggcgagtggccatcgcccaagcggcagcagcaagtggatggtggccaagcagcgcggtaggcagcggcggaggaggaggaggaggaggaggagagcgggcgtcggccaggcgccgctcctcccggcgcgtgtaggagagtggctggggagaaggtggcgcggcggcgagcggccaacggccaagcagcagcggcgagttgttgaaattttgttgaaatttggacaaaatttttgttcaatttctatcaaaatgctgccaaaattttgtcaaaattccatcaaattcaaaatttgtccaaattgtaatgtcaagatccgtccaaatctgtcatttgattttaaacatattcacaaaaataattttccaaagccattgcaggtggccgtgcaccaccgccccagcttggcgtctcaccagccgaaaatgatcatgcgatggtcaccagcggcaaggccgggattcgtcgcccggtcgatcggctcaacctccacgccatgccactctcgctagttcctcacacatatcgtgtagctctagctgatccccactggcgcaccgctatggaagaggagtacaacgctcttctggccaaccagacatgggacctggccaaccagacatgggaccttgttccgcgtccacccggcatcaacgtcgtcactaggaagtggatcttccgccataagtttcaggctgacgggacccttgacagatacaaggctcactaggccttgcgtggcttcactcatcgcccaggtgttgattatgatgagaccttcagtccggttgtcaaaccggccacagtacacacagttcttagtattgctgtctccaaggattggcgtgttcatcagcttgatgtcaagaaagcctttcttcatggcactcttcaggaaacagtctactattcttagcccgctggtttcactgatcctaccaagcctgatatggtctgctgcctcaacaagtccttgtatggtctgaatcaagcaccccgcgcatggtacagtcggtttgccaacttcctgctcaccctaggattcaccgaggcttgctttgacacatcattgttcatatacactcgtggctctgatgtggtctatattttgttgtatgttgatgatattgtgctcaccgcctcttctgacagtctccttcgatggactatcgctgctcttcaagccgaattctccatgaaggatcttgggactctggatcactttctggggatcagtgtttgccgcacttctgctagtatgtatctcagtcagcgtcagtacattctggatattctcgatcgtgctggtatgtcagattgcaagccatgctccacgccggtagacaccaatgccaagctttctgctgttgacggtgattcagttgctgacccaacggactttcggagccttgctggtgctttgcagtatctcacattcactgacctgacatctcatatgctgtccagcaggtctgtctccacatgcatgacccacgggagccgcaccttgccgctctcaagcgcattcttcggtatgttcatggcactcttgatcatggactacacattcagcgatctcgagcagttgatttggttgcctactctgacgccgattgggcgggttgtcctaacatgaggaggtccacctcaggctatgtcgtatttcttggggataatcttgtgtcttggtcttccaagcatcagaataccttatcccgctccagcgctaaggcaaagtacagagccgtggctgaaacctgttggctccgccaactcctgaatgagttacattcacctccctccaaagctacagtggtctattgtgacaatgtcaacgcagtttatctcttcaccaatccagaacaacaccaacggactaagcatgttgaaatcgacctacactttgttcgtgaccgtgttgatgctggagttgttcgtgtgcttcatgtgcctaccacttcacagtacgccgacatcttcaccaaggggctacctagttctgttttttcctagtttcggtccagtctcaatgttcgtttcaccgacgttgcgactgcgggggaggggggttagaatatatctcgtgtatagttgtttccttctgctgatcctatccatatcgtctctctcggttttgtttctataaaccggttgagtagataaggtagggcttgtgcctatatgtactccacatcgatgtcaatctaataattgcgttgagtctattccgctttcacctgccaacccctccccagtcgtcttgttcctgtccttcatgtccatgcctagttcaaggtcacctcaccaaatcaaattatcttagtgaaggcgcttactccaactacccaaaacaactcaagcaagcacacgcaaacatgtcctttcgctcaacttggctcaagttgccagctgtacggggccagccttcgctactagatgtgacacaccacagtcacaccacctctcatccactatctattaacctgcatgacctagcacattaaatacgaagtctgacttttgtgatttaatttgcatatattcattgctaggtatggataagagaataatcacccactacctagaaggaacggaacaagaacacagcataaaagtgaaaacaaacagcccccatacaactaagtcaaactataggttgctatgggcctttcatcaatctgtaggatctcccatggctttccgagaagtgggtggcatacgctgctgaagtaccaatatgatgttacagttaacagatgaaccttatcatgaaaaataattgtactagttgtttaatatattaatgacattatgtgtaaacgttatcatcagtcatcacagcgcaaactgtctactctttagtggcttactggaattggatgaagacctgggcgttcccgtagtcaactttatattaccaattttttcaaaggaaaataataattactttctccgtttcataatgtaagtcattctagcattttccgcattcatattgatgttaatgaatctatgaatgcgaaaaatgctaaaatgacttacatcgtaaaacggagggagtagaagtatagcaaaagagaccaagtagaaggggacgggtgtagttgtgacaaaaactctaaatggcctcgttgatcgattcgcgacggcggtttcgctggcacgacgcacatagaatgatattctgttaatgagatctgcagcacatacatcaattatatcacagcggccaaaagatcagtgtttgaaaaggacgaaaaatactgaatcaaaaacatgagaaacagttgggaacttgggagggtattcgatcggctgggagttggatcatcacacagcacaaaccgggcatgctccgtctgatctaccgcccccgtctcccaccgagattcctatcacgcgcaaacccgccggctagccaaatcgcgagcgttttcggcccatatcctcacgcgcggcccactagctacaacttcttttttcttttttttcgcagcgactcagacttttttccctttaactcccgttatacgcaagtatggtctattaaacaaaccattcttttttttctcagcacaaaaaaattgaaaatctacaactttcaatgtaaattttgaaaacttttaactcaaaatttgaactttcaagttaaattttgaaaactttcatctcgaatttaaaaaatttcaacctgaatttgaaaactttcgacccaaattataaaaactttcaactcaaatattcaaaacttttgacacgaatttcaaaaacattcaactcgaatttaaaactttcaacttaggtttgaaaactttcaacttaaatttaaaaacttccaactcaaaatttaaaaactttcaactcaaattttaaaacttttcaactcaaatttataaactttcaactcaaaatttaaaaacttttcaactcaaatttaggaacttttcaactcaaatttaagaactttcaaatcaaaattaaaacttttttattctacatttgtaaagaggtgtgcgaaagattgaaaaaaaattgggaaaaaacggcgaaaaagaaaaagaaaaacgtgcccggaggcaccaaaatcggggaaaaaagtgcaaacaaaaaaataaaaaaaatacggggaggggggcagctggcatgcgcgccagctaaattgctggcgcagatgcgcgcatcagccacccccgcctcccaccgcctttgcacaaccatttgcagaactggtgctctctctcgtacgtcatcctataatccgtcacaacgctggccgggcaccaacaacgacaccccgcacagctagctcgtcgcccggccgatcttaattaaccatctagcctgttgccagatccatcgagcgatcgtgtgcgatgaccatgtgcggctggggtcgagctggacagcctgggttggatgtgggcttttacttgccggacgaaattgactcttcctaagtattgatgtactttaattttgtccaggttttttttcgaggagcgtagaagcttgcactctcaaactattattatgggagcatgtagccccctaaactattttcttctcattttatacccataaatgtttatgtggattgtctcgctcaccgagaaatctctacggtgttttttttttcactaacaatattgacattatgcaaattcttggagttgggttttgctgaaatgccatcctcacatgtggtttcattaaaatgcgatgctcaaaggatcaaggatgccataatgctagagtgccattttctatattatttgaggtgttttctcaatgtttttaccctcgtttttgtgctggcttgaccgaaatgcccctttggtcggctacagtggtcgcaacagccggtgaccaagactagatgacaagatgccttgtgctccctcaggggtgaatccactgttgtaggagtggtgtcagatgacaccaatgatttttcgctagtacatgtatcctctatcctctttgtattttatcattggtgacatcactctcagaattatttcggccaacatttgttctgattctcatccgtggacagcagccaacagaaaaaaattcatgcagctcaaccaaactcacgatgattggttgatttcttgcagccttcttcctagcctttcacgataccagaatggcattcacgcagttgtatcgcacaaacagatgtccgatgtctcgatgaggagcagctagtgtatggatgagttttcatttgctctagaccactgaatatcccaatttcgtacacacctaatttgcatacaaattttgatctcacctatgtattgttgagagggccttactcaattaatttccttaatctcacatgattatttagattcgggacatttggtttgcagagatttcaatccttcgacggattgagggttgttattctttgatgaaccactagatgctgggatataggatatctgatcttcttttagtcttctagctagtacataatatatttactttgaacatgttgtatcctgtagtttttgtctagtaatttataatttaatttttaccaattatgtcaccattgcttaaatgactgaatgtttgaattaataagttgtgttcatggttactctctgttttttacatttatcatacatataattaattaattatataagtcatgctagttgagaaccaatggtgacaccatccatctgaaattctggctcgggaactatcgccgatggcccgggcgaggggcgacaatggggtggctactgcagctatgggtggcggcagcccgcgtcaagaaggcgccggggctcgtcgactggttcctcgacctgtgtttatgcttgcggtggcagcagcagctgtgggaggaggtgcggtgtattctgggcagcggcgaggctaggttcacggagggaggaagggatcagtgcgatatgataggcatcgatcgattccctttcgtacgcacatgaaggaatagcctaggggaaaaaaggtcagtgtatgtgccaaaataaaaagaaagaaataattaaaaatggagaaaatggcataccagcaaggttaccttgtgagtggctggttgaacttaacgacatctcccccaaattcggcgcccacgattgaagattggtggatcgatttatgcaaaattacaccaaaagagattagaagacagaacttgggtgctttgataacaacctggtggaacgtgtggctagagcggaatgggaggattttcaatcatagataccggaacgaattccaagttgccctccaaattaaggaaaatattgagttatttgttaaatcgagagactagctctgctttcagttttctgagtcgctctctcttctttgtaatcttccagtttttctagcctaggcctatggcctaccaggcgtttttccttttccttcatgagacttttgtatggttttttttgttccttctaatatatccagcaaatctcctgccgttttatcgtttcaaaaaagagcaaggttaccttatttaatactggctttatttagattccaacttttttctttaaacttttaacttttccgtcacatcgaacttttctacatacgcaaacttcaatttttccgtcatattgtaccaatttcatcaaacttctaattttagcgtggaactaaacacacccactgtcattttaacaaagtcacatcgtggagtggcattacaatgtcaattttctcgcttttaccatgctttgtcttggggcatgagccatggcgctccacttgcgttgcgtgggggttctcttatacttcttctctattcaaaaatataaaggattttatgttattttcggttacttagatattaaaagaaaatatggtctcctcattcctttcatagttgattatatacttactagagacttaaaaacgatataagttatggataaaacttttatatatgtagttttaagctacttaaaataaatgctgaaaaaaataaactatattagaactgaatttagagttgactttaaagaaaatatttcaaagagaacttaaaaatcaactttaaattaagttttaaaatttaaattttggttataactgataaggtcaagatcaaacgatgagatagtaatctaaaataacttttatgatgtacaaaaaatatttttctatcaatgaggcgcacaaatggcgacttgcattgcaacgcaaccttctccagtcttatgatctccccggttcctcgaataatgagcaatgtgcaacgcctagctaagttcctattcccgaccacccagttattccgctcgagacaacaacaatggcgacattctgcaaggtacggaaaagagatgatggtatctacgtcctgacgctggccagcagcgacggccaccactatctgaccaccgaagccatcacccagctcaagcaagccctcgagagaatccgcagcaccaaggcgagaggcctggtgacgaccaccacgtcgggctccttctgcgacggcatcaacgccgtgtcggatgacgacgacgacgagccgctttcttcgttggagcgtggcatggccgaggtggtgcgcctgctgctggacctgccgatgccgaccgccgccgccgtccgcggcgacgccaggtggctgggcttcgtcctggcgctggcgcacgaccacctgttcgtgcatacggaggccgtgctgggattggccgccgctgccgacacgacggccaagccccgacggcgcccgctgccggactacgtcgtggcgctcctccgggagaagataccgtacgcgcagctgcggaagctgctcttgctcaaggcgcacgtgttcaccggcgaggagctcaaggggaactggcactcggtgcacgaggcgatccccaatcgggatcatgtggttgctgttgctgtgcagaacctccaaagcgtggttgtgggagacgggatggactacgccaaggtgaggcggaccatgtacaccaacagctgcgtggctgttgcggtgacgacgacgacgacgaccatgctgcctttcgatggatcatccaggtatatatcatagatattgatgatgattacataaaaaatagtactctttttttttctgagaaacatttttttgagcaaggatgattccattaaagttaactagaatatcttgaacatctgttaatcaacgtaacaaagcagcgtagccaacggtgtgacgataagcagtgaaatgacgccttcgggggaatccttcaactcaaggtatgcacccatgtatcaatttcaagtttaaaagctctctcacgattgaacaaaccatgcaaaaatcggtctttaatttaattttcctaaaaacgtacttctctcacccaaaatagtacttatatataataattaaaatttgtactaaaatgtaagcgctttactattcagtatactacctaaataaatcactacctactcatttagagtacctcgacacattcaaacttcttgacgtctgaccctcgacatctactgtttaacgaattgagttctatgatctttgacaatgagaagcatttgttaaacaatttatacgtgaacgcaaataaccgatgcacttattttaccattagttttgaaactatatatttctaaaactgttaaaataaggccccatcgtttcgcttgttcgggaaatgagcccaacaacatatctgcaaacgaaaataataaaaataaatctactaaaataataaaaataaaaacaataaaattttgtacatatctggaaactaaaataataatatttgtgaataaaacatttatacaagtattctttacgatttaaaaataaaggctgaaaaataaacttcaacaaaaaaaaccccaaaatcagctccaaatttcaagatgaaaattcaaattttggctgataagtataagcataaacaataaaaaaaagataaggctgtttagttttatgacaataaatctactattatatttttacattttatatcatgatcctctgacacaaaataattgacctaccattttaggacatactatttttaatagcttttgaatatataagtctttagtccatataaaaaatataaggcatatcttgtttcataaggataagtctttaaccaactattattattattattattttattttttttgtgatgcaaaattaatgttattatactttgttatacaaatgaaatgataagtgaagcaattggtggacataaaacgacttatttactttaaaatagagggaacagagggagtacgtctttactcactagttcttaaggacaaaaatgaatcaatgtgctagatctcctctaaaatcaatagaaaagcacaatacaatttgtactctcagttttgatcattgaattaattggccaggtctattccccgtcttaattaccattaattattagaacttcaatttctcttgcatgacttgcaaagctataattcaagtactacaccagtggatataagtctagctgccatagaagcctgtaccgatggattttcggaatcaaaaaaagttgggagtggtgcgtatggaaaggtttacaaggtatatcccttatgctttggactgttttctcaagtgatactagtagctagcaccagtaatagcgggaagtaactttgtatgatgtattaattacataagccaaatataatagggagtttacaacgaggaggaacttgcattcaagaagattgatggcttggccgtgcttaacgaggatcaattcaagaatgaacttaaacacctaatgagtgtccagcatagaaatatcgttcggtttgttggttactgttctcaaataaaagaaaaattcatctggcgaggaaaggaatacgttagtgttcaatatataacaagaattctgtgctttgagtatttgccaggtggaagccttgacaagcatctggatagtaagttcctacatacaattccggacatattttctgttgcgaaaatgagataattttcgtaagttctctcttttctctacattgcagaagaatctgaatctgatggatttgactggcgcacacgatacaatataatcaaggtgatttcccaaggattaaattacctccatgaattggaaaaacctattttccacttagacctgaaacctgccaatgtattgcttgatgagaacatggagccaaaaattgcagactttgggatatcaaagcatttcactggaactaaaactcacataacaatatcaaaacctacaggcacaccgtaagcgaaatctcctcttgcacctaatttattttaccctgcagttaataaatttgtgactttcttatataaactggtcatgaccttaacttccattggccccgtgcagtcgttacatgccgcctgagtatttgaataaactcgtgatctcaaataagtatgatgtattcagttttggagttatggtcatggaaatcattgctgggcctactggttatgacaacttcagtgaagcgaatgatcaagacagttttaaatatattgatcgtgtaagaaaatttatttgtctacatgacctatattttttattagaacacatagtttgcacttttcctcatgcatacaactacagcaacaattctgtttttatatcatatataggtgtataagcaatgggaaaagaggataacagcaaagtcgcacgatccatctgcagaaataaatcaagtgaaaagatgcatcaatattgcggtgaagtgtttaaatcagaacagagatgataggcccgaaataaaggctatcgtgggcgaactaaattaagctgaaagtgtgcttcctacctataattgacacatcaatcgagccagaagaaatcggcgcatgcaccgcctcccatatatagaagttgtgtgttcaactagagatactcgttatgtatttgatgagagttgttgtaacattttaaactaaaagaatttattttttctcttgtatgaattgttttataatccatttgtttttttgaagaatttccattgtctcaaccacccaagaaagccctgcatgcaatgccaaaaaaaagacacacacacacacatatatatatatatatatatatatatatatatatatatatatatatatatatatatatatatgtcatcgatctggagtcgcctaaatgcaggagcggggcagccggggcaaaatcgaggagtcacagtagtgcaggtcatccaaagcagcaggttagtatctgtgtattttatacggcaagatcgacgctcgattcctaaatttttctcgcttgcagagtcatgggagaatcagtttgtcaccgcagtccaaggtatgtcaccagaaattgatcatcttgttgcctatagagaggggttatgcatagttcgggtcatgcatgatctcagttgtggatggcaatttcttgactctgaatgcatatgctgtttatttgggataatgtatatgccgattttacacctgaagtatatgctttccatacatgggtatgtacttattttttttaaacataagtatctattgaacattgtatattctgcatttctgtggattggtatatgcttctttttcccatagagaggtatatactgactggtacatactggattggtatatactgcaattatccatagagaggtatatgctgtttttttttttcatctgtagtatgttctgaactttgcatatactgcattcctatggattggtattgaaccttgtatatactgcatttctatggattggtatatacttattttttccatagagaggtatatactgactggtacatactggattgatatatactgactggtacatactggattggtatacagtatgtactgcattttacaaagatatactgcttatttccttagacatgcttagtttttcaaagagggggcaaatacaggctgaatttgcttcacagaaatatatccttcatttttccagagaaggttatatgcagattttttaaaacagaagtacatgttgaatttttaaatacgctcaatttttctcagccttagtatttgttatatttgtgttctgaaaaataattatccgtaggctttcaaggtctcaggcacaaggggtagccttcaaaagacggctgcacgggtggtatctaggtatcggcaaagcagggtactaaatagacagaagaaagacaacactacctttggtatcaattgcaggtgccagcccaaatgcatagtgaatatcactaaagacttcgatgataggaagaaggagttgattgctgaaattggatttgatggaattttggatatcaaacttactaaggtaaacaggcagtttggggcatggcttctgagcaaggttgatccaaaatcaggcactattgttacagatttcaaccaggagttgccatttggtcccaacgatgtcaatgcagtttttggcttgccatgctcaggtcaacttattatcccttgctcacaagatgaattagacgggaagaaacaaaaattgtgtgaaatatttgagattccaaacttttcacacctgaaaatatcactcttagagagagtcctaaagaagcagtatgttcatcccatgacaatagatgaaaagagggaattcaaggcggcttttgtgtaatatgtcacaacaaagctcttggcaccgcaatcctgcgcaaacttcatatctcctaggtatattagagctgtggctgatgttgacaacataaaacagtacaactagtcccagttcgtcatagatgaggtgaagaaagcagcagaatcattgcccaaacgctttccgaatacgacgcaacaatccattaacgggtgtatcatcttcctaatggttagcactaatacctgccttcctaatgcagtatataatcaacacacatattgacattttgaagcaattgtgcaggcaaaatatttgagcaaactcgtgatacagaaggttgggatcacgagtgttaaatcatgccacatttctcagtttgaggacaatcaaattgctatgatgatccaacaagatatagtaagtaaacataatccaggatacactttccctcgttatgggaagctccaggtatgtatggtgccctaactctaatatacctatttaaggctgcaaaaaataagctaattagcaacgcatatgttcttcagttgatgaaggctccaagagaaaactaccctcaagcgccagaggtgtctcccctcaacttatcctccgtttcgaagatacaatgcagaggcaatgatggaggcgccaatttaatcaaattcctggaatcacacttcaattcgttagacgtgagtgcaatggttgggccacaggtacgtgaaccatagttacagtatgctacttcagactatatccgacaatgggattaagtataatttgtggttactatgattaaaaacacaggcctataaggagttgaaatcttacgttcaggatggattcaatcggattgatgagattttgcctagcatagcagatttcgtagacataagcaacctcaaaactgctactgaagcagcaaacatgttcaagaaagctttcaagtataatatggcagcggcagttaagatagcgacgagggcagcagttaggaatgttattgataccattgaggatatgcaagggcctctccatccatggggagacccctctgccatgggataccacacacccacgaactactccacacatgctacagaatatgaaaatatagtggagcaaccaacaggtaacgcttgactattaacaatatgaacacacaaaatccttacaaaatgtgactttaacaaatttcttacattcttcatttatcagatacccgacactgtgatcacaaatttggagcctcgcagtgcactcctacaaaatttaatggagctccaggttggtgtgctaaaagattaaaaaatcaaataaaaaacctgattactgcgtactaatcagtctcacatatccaggttcgaaagagactaattcttcaatgtcgcctacgtcgggaacacgcatgactaaccaatgttcaattatgctaattgaagaattcggaaccgacgagcagaagaagcgcaaatatactgttgaaaaccaccttctcacttgctgaaacacaaatcaaagcgtgcagttaaaccaaacaggaaactcatgtcacctttcctgtcaaaacaatgttcgactgagaggctggactccaggactactgatgaactgtattcctatgttatgtctatttctaacgaggcatcgttagagtaagtcctgttattcaactataccaagtatcacaccccacctaacctgacattcttttattctcttatggtttatttcagcacaaaatggctgcaatgttcctatccattcaggatttcattgacgctacgaaacatccaggagactataaagattgggagccgaatggattcagattctctcaaccttgctattcgaataatgttctaacaagaagttgagagatttcaaaacacaaactacttgggttggtggcatttcattaaccaagattttggggtaacattgcacacgtcaaaaaaatattcttcttttgctaatgggcattcaaattcaatgattttttttagatgtatgctgtagctggagatgaattttgggaagctagtcatcaacttgcacacttcacgggccccgaagttgtatatgatgtttcagatagtcacatggtgagtttgatttttcagtacgtaatctgtagtcttatttgtgaacaataacagagaagccatcccactaagaaacaattactttgcagatactaatacctgttcacctattcaaacattacgtgttgtacgtatttaacatggagagcaagaaggtattagtccttgattcactgaacacccaagatccactggggaatcacgtttcaccaggcatgacaagattaagatcatggtgtcccggtgcgtaatggaatgcatgcgtctggcatctccagggtggaacaaggacatactgaactgggactatgaggcagtggaaaatataccagagcagcaaaacgggtgagttactactccaccaaacagtatacaacctctccatagcttgaactgacaatacttttacaaaaacacatagggatgactgcagctttcacgtattcaataatatggtgaactgggatggtcttcgtcttgtgaactctacttcacaggtatataatggcttccaccctttgtagaccacactccaccataaagtcttcgccaataagctataacgaaaaactgtaacattcacaggacccgtactacctccggcgacaatttttgatccacctattggctctgcgtgataacgaggcaatacttccagaatatgtggtgcaccgtcttcgacatattaaatacaattagttcaacaattttatccttatagttttaccataacttttcatgtaattttcgatattcacttatgtcttcgcttgacagaatcttaaattcgttgctatgcatggacaaagaaacatctgtgttcaaatgacagttccacatacttagttatttcaatttttcgctaccccaaacaataacagtatgcaagtgtttattcaactgattgtatggcttatttttgtatctacacccaatggtaccatccatagggatgtggttattcacttaatcatccttccaaaatccccgctgccgcgctgcagcttaaacatgaactggatggagcaaaccaaaatccttcggtcctggcctaatgaagtagtacgtgtcttcgttgatgtagaaaatacaactcaaacccacgcaagtgcacataccttttccaaaggataaacatcacaaaaaaacacttccatttctctctttaaagagaaaataccatcatgtaaatgatatagattcctgttaacacacatccatttgtttccactgaagatacaaccaccaaaaatatccaattgtaaaaaattgaagcaaaatttacttaatatagtaaaaactgaccaatccaccacttccataatcataataaattgctcacagaaagcaaacgcaaacatctctcaacttaactggaaacaacttaaagcaaaaccactttaaacattcagaaggggctatacaaaactacaatgaaccatatactaaaattttctcttgtacgtagacgtccggccgcaggttcttgaattatgtcctgcttggtggcatgtgtggcaaaacctacgaggaaaaggcatttcatccgcatgatcattgtcttggttttcttcttcaacggaatcaccctcatttgctgctttactcttttcactccttacttcttttcttcttttcatgctggcagcctcaccgctagatttatacctattcacttttggccttcctctgcttcgctttctcacgggtggaagtacatcaccagtattatctccactctcttcctcactcgacatatcatacgcactgtcgacgtcagcagcgccaacatcttcatttccatcttcggataataccgttggccttgatatttgtatagttgctcgctttggggctgctccactattgtcatcgtcatctaaagataaccgacttttcatgtcttccaaaagttgattgatgactgtcattgccatcttaaatgtctgcacatctttgtttgcaacactagccacctccacagactttttattcagcattacatgtctataactcctctattgtgaagcatcgacatcatctttgtatccatgtagatgaggtggaacagaatcccgtgcattcttcgtccatcttttcaatatgtacctatctggaatttttgacaacccatactgaacaagcacctaacaggacaaaacaatgaattacaaaataatcaagaatacttcaatagaagttgcaaatgaagaaacatatacccttaaaacgtggctgcacagtatccccttatgctcaaacatcttgcaaacgcatgaaaattcctctctttccacatcatagtacacctgatattccttccgaaggaatgagctagactcttctgtgcacattcgtacaacttgcactgtgctttcgtcctccccaggtttcaccatgtatgataaactatcagttaactcctcagagaacaactgaaaaacagctctagtatatacttgggaagcatgaatctctatcggtgagcttgttttaatttcaaccttgtcctgcaccgagtgacaccaaaagatgattataataatcaattaaataagaacaacaaaaatgtcaaaatggatacttacgttactagtttggaattcctctgagtcgtccttttgcagtttctcattgaaaaaccggtcatacctcttaacaaacccgttcatagaactagagggtttcacaaacattttgaacacatggtttgcagactcacttctttgcgtagtagtcatcccagcaaagaacctatgggcaaaatatacaaacgcccatttgcgccttatgtcccaaatgtgacgcaaatatacattgttttccagttggtaatcactaatcagtttgtgccaagcagcttcaaactcatcctctgtcagtgtctgcgtgagaaccttgtgaaatgctttcttgaatgatcgacgcttcgagtagatgttccccataaattcttttgctttcttcagaacgtgccacttgcacacacgatggattgtgttgggaaatacctttcgaatggcagctgccattgaaggacagttgtctgcaataaaaaggtcaaatacttacaataagcatagtaaactttgaaatcctatcgaactctgaaaacgaccaaatacgcgcatacctgttaaaattccaataggttccttcccattcatgcagtctttgaatgtctcgaacaaccatgcaaacgattctttggtctcttctctcagcagggcacacccaaagaaggtactctgaaagtgattgtttaccccaacaaatggtgcaaatggcatattatacctatttgtcttgtacgtagtatcaaatgtaatgacatcaccaaaatgctcataattcaatctagacacagcatgagaccagaatatgttcttcacacggcaagcctcatcgagctgtatactataaaagaaattcttactccttttttgcaaatccttcaggacatttagtgtttttttgcatgtcgtcgctgcactcatcccgcctaattgcatacgctagcctatccatagcttttctcatgaatggaaccatggaagctccgccatgcatgctagacaacaaaccatacatatttgtcagactcatgctattgtccaccatctcttcaataataccccgagtcccctcatctattcgattgtgtgaatgataattctttgtaacccctatactctttttcattggatggttgtgtgcagcgacgaccttagttactgtccagcttcctgcacctttcaacctatttatcttgatcattgctgggcatccaattcgaacagaaggttctttggtatttgtgttcttcccctacagggatcaattacaaattaacacatactccatcacaaaaaactatcagttcattgccacaacaaacatactgtcataaatgttggtacctggtgtgaacaacaaatctgccgcattgttctctgcttattaacattaaggcgctctttattcagacggatcccaaatcctttactaacagcataaacattataaaaattaaaggcatctctctcagtcttaaatctttgccccaatgcgggagcaagaatattagcatcagcatactccagaggaatggcagcactgctgtcaacattatctactaccattctgaaaagattgtattcattcagtcttcagaacatacaaccaacaacatgccattaaaatcaaataaagcgaaaagaaatcaacatgagatccaaacctttccatcggtatccctgccccatctttttcagctgggtttccttcagtccaatctagtgaagggagcacacttctgtaatagagacagaaaatgattttataccactcaattccaaagtatatgatcaactgataactatgccaagaaagataccttgtcaccggagttccatgacctgaatcatgcgagccaactgtcaatgacatgtcctcctccatggctacaggactgcagaacacaactcaatatgcatcagtatcggccgattatttctacaattcagaaaatatggtatcttgatctcaccttgtctggacaccatgtgggattgaatcgccatcaggtatgccgaaggaagggttgcattcatccataataatttgactgaatcaatgatccagaatcattcttgttcacacccataaatcaaatgaaaaaaacccaacggcacatactgaaaaatcaatcatcaaatcagtataacatacctagaccctgtggtacaattgaaatcggtgtggttcttcacaacgtcatccatccaaaatcaccagctccgcgcggtggcttatactcgaccaggacggagcaaaccaaaatcctaatgaagcagtacgtgactttgacgatgcagataccgttcctcaccacccactagctgcactgacctattcttcaggtggttagttatgcattatcggtaattaatcacttttcaaattaataccacgcatcgttcggctaatgggtacatactgcgtgactctgcgtgactctgcactgccaacccgttaacaggtacagatctcaaagttaatcaatggtatgaggggagggagtatgtacacccgggtgtatataagagtcatcctatatatatatatatatatatatattatatttatatatgtttttcaatacatatacatgcataatatatatgtatttatacatatatgtatgcaaatgcatatgtatatattaaagcacttaacattttatgtgcatacatatgaccaaaatatatatttacactaaagtaaatgtgtacatatagaaaaatagacatgtattaattacaattcattatgtcctagctagcgacctatgaattgtatttccgtcgtagtagaattcacctcaggatcaaggacttgttcgttgatgaatcccatgagttgttcttgaaccgccgcgataaattccttgtgtatgagttatccctcatgcgaataacctatgaatgtatgaaattaattagtaaacaacaaatctatatgtacgtaacgaaattttgaatttatttgtacgtacaccgagctctcttgtggtgatgatttggtctgcaaggcagtggcaatactcgcacacgtagtagccacacaagttagttccctggtcttgctttgcacactatatatactgtaggaccttagattgatcaagaatcatgttgaggttctttttaccatcagaaaatctttgcaaagaacttttcaagtaagaaacctcttgagtaagagtagcacaatttttgcaagcatccaaaagacctttttgttttctacaagttgagcaagaaagcacctcatcttatttgacaatttcttccatgtacttaacacgacccaaagcatcttttaacttcatctcattagcaacacatgtcaaacaaggtttggtactatattgcttaatcctcttagagctaatcaaattaaacatcgagctagcaaacaaagcaacttgacatttatttaaagctctcttagtcaaaaacaattcatcaaccaatctagtgttcatggcaaagctaagtgcaagacaagattcaaatttccgagttttcttagattcaacatcaagcttcttggaataaacatctctaattgacttaatttcagcaaataaaacctcacaagatttgcattcatcatcatcagaaataagagatcttattctactattttcagcattaagagactcaatagtaacttcatgttgacttatctttttctcaaacttagaaattttgtaaccaagtctagcaatcacttcttgaagatattcaacactaggagtaggaattacctcattgtcatcgtcagaatactcttcaacgcttctagccatgaaacaaactccaacaacgttcttgcctttgtcatcatcttcatcacttttaaaatcagcatcacttgattcttgaacagctgcaaatgcctcatcaagtgccttctggtagaacttcttcatcttcatgttcttgaattgcttcttgttctacttggtgttcttagtgttcttggaatcatcttgaggttcttcctttggattccttccaagcttgggacaacgagctcgaagatgaccaagtcctccacaatgaaagcaacgaggtggtcctcctcttttcctagacctgagattacttacagctcgagaaattctgttagcaagacaaaccaagtcctcctcacttatttcctccagttgatcatcggacaaggcattaaaaatagaaagagctgccgtaggagaaatatccaaagaaggtccagaagaagacaccaaagcagtagatttcgaatctgttctttttgaactttttgaaagaatattcatctcataggttttcaatttagtataaagaacatccaaagtcaaagtgttcatgtcaacagattcctaaatagaggtcactttaacatcccaaaccgtcatatcaagaccattcataaagtgacgagcaatctcagattgagaatagttaacatcataagaatcatcaacagatctaagatcactcaaaattttattgaaacgccccaaataatcatccaaagattcaccagaactcatctcaaatttaatgtagtcctttttgaaaacatcttttcgcaactccttaatgtttgtagatccagtatgaaaattattcaaagctttccaaatctcattagcagctgcaagatgtgaaacacgatcaaaatcagaacgagaaatcccactgagaagaatatttcgtgctttacaattattttcaaaatcagttttctgggcaatggtttcaatacgatcaggaatctcataaactgtagcaactttcatccagatatcatagccttgagatgtaatgtaagactccatctttttcttccaataataaaaatcaactccattgtaaatatgaggtttgcttgaaaacttgtcagccatggcaacaaatctaaagaccggtaaagatcaaatagaaaaacgtggctctgataccacttgtaggatcgcacaagaccaaacaaacctaccagagggggggtgaatggtagggaagaccaaaaacccaaaaatcttttgcggaattaaagattaccctcaaacgaagtcgatgacgaagttcagtcgccgccggtcgaaccgcccacctgccgccggtcagactgccgaagccttgccggtcagaccgtccggacacctgcggtcagatcgccgctatcccgctggtcagactatgcgcacatctgcggttagaccgtcgggacccagaaacaccggtagatgataaactcgaagatgtagattgaaacttttcgactttattgcatcaactagtgtttacaaagtgcaccaacaacactcctcaccaaaatctcgaactaaactcgaaaccctaactttctctcaacttgtgtctctctaaaaccgataccaggaggcctcactctcccgctctatttatacctcaaaatcctctactcagagtaggtgtagaactcctatttacaataggacttaatccctcaatttcctttttctccacagccgcaccagccatggaaaatccagccgtcaccatgtcggactctatctacgttcgtgatcgaatccatcttcgacacatgtccttctccgtactgctcacgctcgtctcgcgtgggccgacgcctcgacctgctcggcctcccaacacttgcatggcacggcatgcatacatcacatgcacacgcatatactgctcgccacagtacacacacatatgcatgctacagtacatcgccgtactgtagcgctatatactccattccaatttcttcctgtctccttcgcgaaaaccgacgcttgcacgcacacctcatgaagcccgttgtgaagatctctcccacatggtgtctatccaccgtgtgccatctcgtatccaacttcgtcacccggtatccttgaccgtctggacctcaactcatccctgagtccagtcccgatccccaccgttgaccgaagttgatctctaaaaatcctgactctagtcatattctcacatggtatcccgactacactagacctctgctcctctctaagcatagtcccggttctcaccattgaccaaggctgacctcaagtcacctacacacaatcagacaaaacgaccgttactgggcacagatatcacaaccggacccacattagtcacacgcactcacaccaacatccacacatcttttcaaaccaattcattgattaaatcatttgcacagccaattgttcatcacaaatattaatcatgacaatgatttcatatatacatgacaaacggcgagagatctaattaatatacgcttgtatttgaattggagattcaatataaatttagagcatgtgtactcacataaaatttaaacttccgcctaagtttttctttccaattgccgcggaccaaatgacagaaccgataccaagccctacatggagtttaaagctatgattcatagtagcaattaattatatcaaaattcgtaataacattggaacttatgacattacatgtctatatgttcaaaaacctggtcaaacgtagactcttttttatccattgagtcatatacattgactacgcaagcctccaagtcgaagagtaaaaggacccagtggaatctgcaatgtgcgtcggatgcatgacatatgaaacacttagcatgtacgtacaggaatgcaatttggtaggaagaaagtaaaaactaactgtgtgttgtacggcaatagtacgaacgtcttgtaatgctgctctttcaggagatggacgagattgtcctctgtggcttgcggatacttgtcgatcattgcgacgtttattttccgagggtcgatgaatccagttcgaaaaccccccgccgtcgagccctttgaatatccattctacaacgataaaaggaagtatatattatatatggtgcacttatatacaaggacctaattaattaaaggaaacgtaataagaaatctaaatgaacgatacttacaaaatccaacaactcataatagagacgtcgagggcgtccagctcgtatagttcgtagatacccttgaaattgatccaaagaatatcttctccttgcaagaagtccatgtccctgatcctcgctccgatcatctctctaccggtggcgctcatttccacgtacggttgatggaatttgtatatctgtgtcggtagggactgcagctgctcaggcttgacaagcggtttaccgagttcgtacttgtatttcacttccgcctttgggattggtgcgcctcgtagaaattgatccgtagttagcccggtgtcagaaataaaatcttttattccaatttcttcaccggtcaccaatggctcgacctcctggtttggttgctctccaagctgagggactggtttggactttgcagaatatgctttcttaagtgttcgatcatagtccgatagctttatggcctccttggcaggtgcagacatacccctgaagaagtttctgacactagggtctataggaatcttcttttctgtaatttgaggcttcaattacctcttgacttctgctgccacataagattcaagctcctcttgcgtgcaatcgtacgccggctgcttgtttccggcggcgtcaactttcgccttcttcgttgcccttgtgcgggcaggcggtggagcttggtgggaccttgacttggaaggtgccggacgaggagcttgaggaggagtcggcgcaggagcttgaggagtcactgtagaagcttgagtaggaggagcctgaggcagagtcggtgcaggagcctgatgaggagtcggtgcaggagcctgaggtagagacggtgctggagcctgaggaggagatggtgcacgagacgccgcttgtcgcccagggaggatgatgtactgcttgcgccatagtataatggcgtggcttgtgtctcgtagatgcgtctcaccgtctcctccagggtagtccaactcgaagtcctcgtacgcggcttccaccaactcaacttcgaccttcgagtatcgtactggaattggcctgtagtggtaagtccctgaagggtctgttgggatggccattcccgatgccaccttcacgtggtgagaggttatctattagtaatcaacataagcagcaacttgcggaatggacaagtcaaaaatcataaaactatgagcataccttgattgataagttcttgaagggaatatgcaactcacatggtgtccgctgagtgatctcatcaacggggcaggtggtttcgtcctgagtttgcatggcgtccatgctctgtgatcctacctgccccgttgatgcgcagctgctatgattgcctgatgggctgaccattgcaggaggaatgtacggctagggatcctgagaccgatgtgcggccatgcgttcatccaccttccttgccacctcctcttgcatgctgagctcgtagctcgataccctgtactaaagatctgcaatctttgcctcggtatctcgcttgctcctcatccgactcctgtacgtgtggatgttctccttgaatccaatcttccaaggaatcacccctttccctcgtgttcgtcctggatgctcgggagtctgcaggttgagtgacagctcgtccttctctctgtcgggtcggaacgtgccctgagaagaggcttccactgcgttcgttagtcgactggcagcctcgtgtatctgatcgctgaagaccagggagccatcaactgggttaagcgttccaccgtgagcatagtaccagaacttcgatcgatccggccatttagcggtggccggttcgatacccctctcaaccaagcttgcctccatctcctcccacttcggcatcacgacgctatagccgcttgaccccaagtggtgatggtacttcttcttggcggcattttctttttttctgtccatcatcgcctgcccttgtttccctgtcttgtaagcaacgaactcgtcctagtgatcccttagcttcaggaatgtgttgacgtttggtgtctgccccatcaggatgtatttctggtagagatctcccttgaatctctgaaactgttctgccattttctttagagtccaccttttcactatgttctctgtacccgtaggaagggtgaatctctcgagcattgttgtccacatcatctctttctccgaatctgggaccaagctgtcatgatctccacgtgcccatgttctgcgccagtacaccgtactgacaggcacgttatcccacacaacccaaccgctgtgtcgtacttaattcttggctgcttctgccggggcactaggtcggccgtcttcgtccacttctgttgtgatgtgtcgaccctctaacttcttcgcggcacctcattgtccgcgtgccctcttctgtccagcggagggttgacttccactagcctcctctcctcgttcccctccgcatccctctccacgtaaactctaataatcttatattaaaattttagtaatgatatatgctaagtctaacattcacatatgctaagtataataatcttatattaaaaatctaattatcttatattaaaaatataataatcttatattaaaactctaacaatcatatatgctaagtttaagtgtcgtatattagaactcaaataatcatatatgttaagtctaacatcgtatattagaactcaaataatcatatatgctaagtctaagtgcgtatagtagaaccctacataatcatatatgctaagtctaattaagttttgtatattaaacctctaataatcttatattaaaactgtaataatcttatattaaaattgtaataatcatatatgctaagtctaacactcacggcgacgacgtcttttctgcaacatgcaaaaaaatgtattagtctaaatgcaaaggaacatatattgtatttcacgttttcaagtatatataatcatatatatatatatatatatatatatatatatatatatatatgctaagtttaataatcgtttaattatctcgtttgtacacgtttcgttcacgtttcaatggtgttcgttcacatttcattcacgttttgttcacgtttcattcacgtttcaatggttcgttcacatttcattcacgtttcattcacgttcgttcacgtttcgttcacgtttcattcacgttcgttctcgttaagttcacggtcgttcacattcgttcgcgtttcgttcacgttcgttcacgtttcattcacgtttcgttcacgttcggcaatgacggggcggcagcggagcggcggtgtggcggcggcatggcgttgcggcggcgtggcgaggcgggggcggcggcatggcagtggcatcgatcagcgtcgtcggcagtggcggccgtgtggacgttacgtcctcggtggtggcggccgcgtcgaagtcggggtcggcatcggcaggaggcggagtcggggtcggccgcgtcgtcggcggcggcgtcggcaacaaggcggcagcggtttggagagagagatcgagatcgagatagagagagaggcggcggcgacgttggcggcggcggcgacaacgatgaccgcgagacgacggcgagagacgatggcggcgtcggcgcggggatgccctaggctgtggcggcgaaggagaagccgagatcggagaaaaatcttctaagtgttggtggagaagacgatggcgcatcgggaatatatatacccctagatctttagtcccggttgttctctccaaccgggactaaagtctcggttggtgagaacaaccgggactaaagatattttcccactatttccaaattccttttaaacccagttagggttaagaaccgggactacagataatagcaccggatattgaatttcattacatatgtgtttctaaaatagtaaataattcattaaaattatttaaagtcaaaaaagtaatgacaaaaccttcgaaaaattattgttgtctgtattaaattaagtggataatatataataagcacatgaatgatttaaaattgttaaaaattctaataatcatatataattagcatatgcatgatattaaattgttaaaaattctataacatatgtaaataccacatgcacgatttaaaattaataaaaattctaataatcatatataattatcatatgcatgatttaaaattgttacaaattctaattaacatatgtaaataccacatgcatgatttaaaacttttaaaaattctaataatcatacataattaacatatgccataaaacaattgatttatatggatattcaatacatctaaaatagtttacatcgtgtacacaacaattacggcaatacatcggcggtgacggttgaccgcacgtactttctcctcactattgatccttccttgtgatcgctacgtgagtaaggggtatcttcatttgataggaggatgctaggatcaattgtcaccgtgaaagggggttgcccatcaaactgatcgtaatcctcgtcagtcttgtcctctactccgacgatttttttttgcctgggagaaccacgtggcgcttcggctcgtcaggccctttgcccttctttcctttgctagacatgtccttcacgtaaaaaacttgcgttacatcattggcaaggacaaaaggttcgtccgagtatccaaccttgtctaccgttgtcatcccactgtcatcaatcgttacgcctccaccagtcaacctaacccattggcactagaacagagggaccttgagaggtccatagtcaagttcccatatgtccttgatggcaccgtaatacgtgccagttgtaccatcgtgtcccatggcatcgatacgaacagcattgttctggttcgtgctcttcatgtcttgggctctcgtgtagaatgtgtacccattgatctcatatccctggaatgtcgcgatcgagccagatggtcccctcaccaggaaggccagttgttggttaatcgtctcgttacccatgagatgtcgtcgcagccacgcggggaaagtatcaatgtgatgccgtgtaatccatgcatcggacttaccgatgtttctggcgcgaactagacccaagtgctcctcgatgtaaggagccaccaatgaagattgttgcagagccgtgaaatgggttttacggaataaattgttgtctaccgtcattattgctttccttccgagagtcccctttccccgtagtctcccttcatggtgtgattcaggtaccccgattaggcgaaggtcttcaataaattctacgcagaattcaatgacctcctctgttccataccccttggcgatgcttgcctctggacgagcacggttacgaacatactttttcagaacgcccatgtacctctcgaaaggaaacatgttgtgtaggtacacaggcccgagaataccgatctttttgacaaggtgacaaagcagatgcgtcattatattgaaaaatgaaggtggaaatatcaactcaaagctgacaagacattgcaccacatcattctgaagggcttctgctaggcccctttccaaacactactttaagatcttttaccatagcaaacactgttttcccgctgcgatgtttagtcttcttacggtagtccgccttatgttcaaagtgcttgcctttcttccgtactggatggtttgcagcaaggaatcgacgatgacccatgtacacaaccttcctacagtgcttaagatacgtactttctgtttcatccatacagtgagtgcaaaccttgtacccattgttggactgcccggataggttgccaagtgcaggccaatcgttgatggttacgaacagcagcgctcgtaggttaaactcctcctgtttgtcctcgtcccacacagggacaccttccttcttccacaacagtttaagatcttcgaccagtggtcttaggtacacatcgatgtcgttaccaggttgcttggggccttgaataataattggcatcattatgtacttcctgttcatgcatagccaaggggggaggttgtagatacacatcgtaacgggccaagtgctatggccgctgctcatctctccaaaaagattcatgccatccgtacttaaaccaaaccgtatgtttcgtgcgtcctttccaaaatctttaaattttctatcgatgtttcgccactgcgaaccatcggcggggtgtctcagcatcccgtcctgttgacgttcttcagcgtgccaacgcatcattctagcattccccttgttcctgaacaaacgccttagccgtcgtattatagggaaattccacatcaccttagcagaaattatgttctttgttggctgcccgtcaacttcacctggatcctctcgtctaatcttgtattgtagtgctttacaaatagggcatgcttctaggttcttgtactcctcaccgcgatataggatacaatcattcagacatgcgtgaatcttctgaacttccagtcctagagggcagactatcttcttagcgtcgtacgttgtctcgggcaatttgtttccctccggaagaataatcttgacgagtttcaataaatcgccaaatgccttgtcactaacaccattttttgccttccattgcaagaactccagagtggtatccaactttttgtgcccctgctcataacctgggtacaacgacgttctgtggtcctctaacatccgctccaatttatgggcctccttttcactttcacagtcctcctttgcgtcctgcaacatctgaccaagatcatccacagcgtcgttatcgccagcatccctgtccacctcacccgtttgatttccttcaaatctagcgtactgagcccagttgggaatgttctcgtcctgcgcttcatcttcttccatttcaaccccttgctcactgtgggatgtccaacaattatagcttggcatgaaccccgactcaaacaagtggaaatgaatagtcctggatgcagaatactttttctggatcttacacttattgcatggacaacaaataaaatcgttacgcttgttagcttcggccactctcaaaaaataatgcacgccctcgataaactctttgaaccgccggtcagcgtacatccattgccgatccatctacatgaaatgaaaaaaaaatcgtacataaataaattttcgtacaataataacagtcaaacaataatgataaaataattaaaaactctttcgacaagcataaaaaataatgacatataattactcatacaattagtaattataaaataatccaacaaacaattcttattaacaatttttgaagttctgaactaatattaatgttgtacttctcttaattttcaatttagtttgttttctattttttaagattaattttcatcatattttaaactatgagaataaaacttttttaagtaaacaaacaaaatttctatatattcttcttccccacacaaattttctctctcatcaacttacaacaaagttttggagacaattaatgtgtgaaacataactccaaaagtaatataacaacaaaatacattggaggatgaagttactaaccttttagacacttccgatttgtatataatcactaaaaaaatttcacaagtaattttggcatgacctcccctctttctttgagaaattttgaagcttgctcgggctggaggaggaagaagacatatataaaggggggaccaaccggggctaaagatcgccaggatctttagtcccggttgataacaccaaccgggactaaatatcacgtatgtccgttgtagccaccaaccgggactaaagatcatgtttagtcccggtttttaatggatcctggactattatgaatttcgaccgaccgaccaaaaatggtttctccacccgtgtaagcttagagcacaaatgtgatccagataaaatatgtatattgtttatgtggattacacttgttcaaaccaatatttttcatgtgaatttgaatatatggataggcctcataaaaatatgcacgatatctccatattgtgtaaccgagcctgtgccatatgtccagattcgtagttttaggatgggtctaatctcgttctaggtttgctacatattaggacggagggagtataatagagctgtatacagaggttgctaactgataaggtatgtacataatataaagcaattattaagtaaatgacatggacatcaacaaacttagataaataatttttagctgtaatttaatttgtaaaagcaactaaagtaatcgcacagcgacacacacaaaaaacataatcacagtataacataacacatagcataaactgaggctgaaatagtcagctcaatgcaacaactatatatggagttaagcctcgtatacgacgtgttctaaagtccgttttgaagcgaattattagtcgcacgtaaaaggagaaatatgattaacatataattaattaatcattaattattaaaaaataaaaagtagatttgttttattttttaaaattacttttatatagagaattttgatgaaacgtaccagcttgataaaaaacgtacgaagtaggctatccaaaaacagtttatttgcgtggctagctcttgcaatcattttagctgcctattgctcaatttgaaacgaagaaaatcgcaatgattccgcgtttgcccttggtcagcgatccacatgcatatatattaggtacaagctgtcaattaaccttatgccccacgtatagacaacagggacacatgtgtgcattttcttttgctgaaaacataggtcgcgaagatcaagtcaacgtgtttcggttagcagtcgttttttccctatgcaaccaagtggtcacctctcacgattaaatggcgcgcctgtgctcgatcgctcccttgcaagagaaggtgcagccccggcttctcttgctcctttttccctttggagcctttctccagctcgatcagttcaaactgcgccactctttaccaacctacgttgctaaatccagtaaagccactctcacgttttgttttgcctcctctttttttttctgaattgagttctttttaccaggaaatggtattttgtatttgttatttgggattgaaattttcggaaatttttgttctttacaagttctgtgcaacgaaattcttccggccaaaagtttcctttttttgttttgtaaattaatagttcttcccctagatattagtttttttgtgaaatttcggaagtttcagtcctaaggaaatttttttttctttcatagtaccgtgttggagttgttccaaattcacttcaagatattggccgggcttctgacgaagcggagcggaggcccaagccggagggtatatatgccctttgctagggtttcgtggagacttgattctcttgtaagccgccataggcgtgtaacccaaaactcttgagatagtgagattgttgctggctggtgcccgtggttttttcccctttcgcattaaaggggttttccacgttaaatcgtgtgtctccgctgtgattgtttttcgtttactttgtatttctatacgtcgttcataacaagtggtatcagagctttggttgctgttagggttcatgacgacgtcgatgaagttcgatcttccgctgctgaactacgacacgcggttctcgctatggcaagtcaagatgcgggggattctggcgcagactcatgactatgatgaggcactggataacttcggcaagaggagggccgagtggactgctgaggagatccgcaaggatcagaaggcgctcgccctaattcagttgcatcttcataatgatattttgcaggagtgtttgacagagaaaacttctgcagaactatggctgaagctggaatcgatctgtatgtccaaggatctaaccagtaagatgcagatgaagatgaagctgttcactctgaagatgaaggaggaggattcggtgatcacccacatggctgaattcaagaagatcgtggccgacctagtgtcgatggaggtgaagtatgatgatgaggacttaggtcttctactgttatgttctttgccaaattcatatgcaaatttccgtgacaccatacttttgagccgtgatgaactaaccctaaaggaagtttatgatgctctccaaaacaaggagaagatgaaaattatggtgcagaatgacgggtcgtcgtcctcaaagggcgaagctttgcatgtgagaggcagaactgaaaacagaacctcaaatgaaaagaactacgataggagaggccgttcaaagtccaagccgcctggtaataaaaagttctgtgtttattgcaagctgaaaaatcataatattgatgagtgcaagaaggtccaggctaaggaaaggaaaaacaaaaaggatggtaaggtctctgttgcttctgctgctgcttctgatgatgattctggtgattgtctggtagtatttgctggttgtgttgctggtcatgatgaatggattcttgattccgcatgttcgtttcatatttgcactaaaagaaattggtttagttcttacaagcctgtgcagaaaggggatgttgtgcggatgggagatgataacccatgtgctatcgtggggattggatcagttcagatcaagactgatgatggcatgacacgcacgctgaaaaatgtgaggtatataccagggatgtccagaaatcttatttcattgagcacgcttgatgcagaaggttacaaatattccggttcagatggcgttctaaaggtatcaaaaggttctcttgtttgtttgaaaggtgatgttaattctgcaaagttatatgtccttagagggtgtactttaactggttctgattccgctgctgctgctattactaatgatgaacctagtaagactaacctttggcacatgcgtttgggacatatgagtcaccttggtatgacagaattgatgaagagaaacctgctgaagggctgcacttcgagtaagatcaagttttgtgagcattgtattttcggcaagcataaaagggtacagttcaacacttctgttcacaccaccaaaggtatcttgattatgttcatgctgatttatgggggtccttctaagaagccctcacttggtggtgctcgttatatgcttacaattattgatgattactctagaaaggtttggccttattttttgaaacataaagatgatacctttactgcttttaagaactggaaagtaatgattgaaaggcaaactgaaaggaaggtaaaattgcttcgtactgataatggtggagaattttgttcgcatgcctttaatgattattgcagacaggaaggcattgttaggcatcacaccataccccatactccacaacagaatggtgtggccgaacgtatgaacaggaccattatatccagggcccgttgtatgctgtctcatgcaaggatgaacaagcgtttctgggctgaagctgcaagtactgcctgttatttgataaacaggtctccttctattccactaaataagaaaactcctattgaggtatggtctggtacgcctgctgattattcacagttaaaagtttttggatgcactgcttatgctcatgttgacaatggaaaattagagcctagagctgttaagtgtcttttccttggttatggttcgggagtcaaaggctataaattgtggaatcctgaaactgggaagacttttatgagcaggagtgttgtattcaatgaatctgtgatgtttactaacagtttgccctcagaacatgttccagaaaaagagttgcagcgtatgcacatgcaggtggagcatgttgatgatgatacaggtgttcaggtggagcctgttcatgagcaggatgaccataataatgatgttgctgatgatgatgctcatgatgatgttcagcaaactcctcctattttgcagctagaggaggaattacctattgctcaacgcaagtcaaaaaggacaacaaaacctcccaaacgtcttattgaagagtgtaatttgtcttactatgctttgagttgtgctgaacaggtggagaatgttcatgagccagcaacctataaagaagctgttcgttgtggtgatagtgagaattggatttctgctatgcatgaggagatgcagtctcttgagaagaacagtacatgggaggttgtacccttgcctaagaaaaagaagaccatcagttgcaagtggatcttcaagagaaaggagggtttatcttcaagcgagcctccaaagtataaggcaaggttagttgctagaggttacagtcaaattccgggtgttgactataatgatgtgttctctccagtggtaaaacacagttcaattcgtacttttcttagtattgttgcttcacatgatcttgagcttgagcagttagatgtgaagactgcgtttttgcatggagagcttgaggaggacatatacatggaccaaccggaagggttcatagtgcctggcaaggaaaaatatgtgtgcaagttgaagcgatccttgtatggtttgaaacagtcccctcgtcagtggaacaagaggtttgattcatttatgttgtcacacagttttaaaagatctaaatatgatagctgtgtttacatcaagcatgttaatggatcacctatatatttgctgttatatgttgatgatatgctgattgctgccaagagtaagattgaaatcactaagttaaagaagctgttgagtagtgagtttgatatgaaagatcttggtagtgctaagaaaattcttggtatggaaattagtagagacagaaaatctggtttgctatttcttagtcaacataattatatcaagaaagttcttcagcgtttcaacatgcaaaatgctaaggctgttagtacccctattgcaccccactttaagttgtcagctgctcagtgtcctagtatagatgcagagattgagtacatgtcaagggttccttattctagtgctgttgggtctttgatgtatgccatggtttgctctcgtccagatttgtcatatgctatgagtcttgttagtagatatatgtctaatcctggcaaagaacattggagggcagttcagtggattttcaggtacctcagaggcacaacatattcatgtttgaagtttggaagaactgataagggccttattggatatgtggattctgattatgctgctgatctggacaggcgaagatcacttactggttatgtgtttactattggcagttgtgctgtgagttggagggctactttacagtctgttgttgctttgtctactactgaggcagaatatatggctatttgtgaagcatgcaaagagttgatttggctaaaaggtttgtacgctgagctcagtggagttgaatcttgcataagtttgcattgtgatagtgaaagtgcaatttacctcactaaagatcagatgttccatgagagaactaagcacatagatatcaagtatcattttgtgcgtgatgtgattgaagaaggtaagctgaaggtatgcaagattagtactcatgataatcctgctgatatgatgacaaagcctattcctgttgctaagtttgagttgtgctcaagcttagttggtttaattgaatagtccaagagactattgttggcaccagtggttttctatctttgttgttcaagatgattggttgatttatgatacaagaagaatttgtcttaaggtggagtttgttggagttgttccaaattcacttcaagatattggccgggcttctgacgaagcggagcggaggcccaagccggaggcttgggccggtatatatgccctttgctagggtttcgtagagacttgattctcttgtaagccgccataggcgtgtaacccaaaactcttgagatagtgagattgttgctggctggtgcccgtggttttttcccctttcgcattaaaggggttttccacgttaaatcgtgtgtctccgctgtgattgtttttcgtttactttgtatttctatacgtcgttcataacataccgaaccctggtttacctgttaccagtgaaatatatagaagttggactttcggctgacgttacagattgtctgtaggcgggaaaagtaacatcaaaggcacacctgctaggagagacatatcattatggagtttacattccatttgatagaagaaattaccaataaattttctgacaagcaaaaaattggtgagggtgggtatggaaaagtttacaaggtatgttctataagttcaactttttggttttctattttgcaataggatatcattcgacgcctaaaccatgttaaataaaaacaaccctagactataggaggtattaaccactgactattactccatctaacaaaataatataagcatatcaactttgatacgtctagaagtttacctgattgaaaaagataatgtcgagtgatgtaacaataaatacagatagggtgtttttagttccacgccaaaattggaagtttaactaaaattgaaagtttgaagaaaaaagttgaaagtttatgtgtgtcgaaaagctttgatgtgatggaaaagttgaaagtttgaagaaaaaattgggaactaaacaagagctaagtagcatagatctatgaatattttttatttgtggacaaatttaaaacactataaatataatacttatggacgtgtcgctcaagctcgagtcgagcttggtttagatacgagcttgggctcgagctcagctcactaaagcctcgagctttgtcgagcttaactaatgtggcagtattagatttgtagtactatcgtttttaaacattatataaccaatagtagtagtagcattaaatggaggcatgaagctgggttgcatgcatgcttgtactagtagggccgagtttagatgcaaaatttttcttcaaactttcaactttttcatcacatcaaaactttcctacatacataaacttttaacttttccgtaacatcattctaatttcaataaaacttctaattttaacacaccctagtactagtagaggctaggtactagtagtactagcagagactagggcctgcctccacgccatgctctgcttttcttcagctttttcttgggagatgaatcaagtactactactctactagtagactagcactgcttctagctgttgcatggaaaatttgaaagaactggagggagagtaatgccagctcaaaagaaacggagagaactctaggctcgacgagctattcgagctcggctcgtgaagctcgtgagtttgaagctaagcttgagcttagttcgaattaatgacgaatcgagctcaagacgagtctatagcgagccgagctgctcgtgagccttgagcttttttacatccctagcgcacagtagcgcgttaatcttaaagcgagacctctcaattttccaatttcatttgttacttttttgtcacagtcccccctactttctattatctaaaactcaaataaaattttctcttaaaatatttatccaatttataatccggttacacaaatgtgtttgttgcaattaaatatttataacacaattttacatgattatattataataaaaaggaaaaaaagtatgaattattactcccgaactatcgcggtcgaccgaattaccctctaaacccaaaaaccagtcatcatttaccctgaattttcaatactggacaaataccccccctgacccaatctagagcggttttgtctaacgtggtgcacgcgtggcaatccagttagcattttatttaattaaaaaatgtgggacccacctgttatactcctcttccactcctcctctctctcttgtctctctcgctcttcctctctctagcgcagcgtgcatgacgaggacgggcggtgggcatgggcggttggcgaggacagcgcggggaagggcgatgggcgtgggcggtcggcgaggacggtgtggacgtcggcgctcagggcggcacgcacggcacggcggcaggcaggcgtttggcgccgtggtccggaagggagcaacggcggtgagggacacggaggcggcgaccgcgtgggacacggaggtggcgaccgcgcgggacacagaggcagcggcggcgaactccacctccgcctccagccgctgcctgcgccacaggccgccgcccccatcccgagccccacctccagctgcatccaccatcgcccgccatccttatcccgagccccgcttccagcctccttcgccaccagccaccgcccccatcccgagcaccatctcgacggcgaagaagactggaccttcccctctgcgtcccgcgccaccgtttctccctcccagaggtggagttaattcgctgctgccgcctctgtgtcccgcgccgttgctgctccctcccagactgcggtgaaccaaccgcttgtcgttcgagtcccatcgcatgatgccgatgcgcagccggcggaggagatatcgacacgccgtactccgtctccttcagcgtgctgccgtcgccttcggggatacagctcggcgcgtccagctgccgctggcgcagatgctgaggcagcaggcgaggttccactcggagccgaccttgacggtgatcaggggacgagccgacgacgaggcggcgccggtgccccggagcgacagcacgcgggaccggcggttcgaccagttcaagaccttctccggctacctcgagcgccagttctccagtccagcctccgcgggatgctgccgtaggagttgccgatatcgagacggcagactcgaagatctccgaggaggaggtcgacggcggcgaggtgcccaccgttgaccgctacttcgccgcgctcgagggccccgagctcgacaccctccgagtacgtacacaatcaaccacgtcgcttctaaaccttagctagctcaaaatttcttgccattgtaatgactaatatgaggacgacgacgatgtcggcgtgagttcgtgcaagcgatagaggtgccggtgcttcccgaggacgagagccagccagacgatgagcagccaggcgatgctgtggaagacggtggcgtcggatccctccacggcgttcctccacaacagcctcgacgtcaacaacgtcctgtggtggttgtccgtcgctctcatgggcctcgtctcggccatctacctcgccgaatgcctgcctgccgccgtgcacgccgccgtctatgccgttcttgccgaccgcccacgcccacagcccgtccccgcgccgccgtgcgtgcagcgcgagagaaaggaagagcaagagagagagagagaaaagagagagagagaggagggaaagaggagtatgacaggttggtcctatatttttttaataaataaaatacttactggattgccatgtctacgtcacgttggaaaaaaccgctctggattggcttgagggagggtaatttgtccggtgttgaaagttcagggtgaacgatgactagttgttaggtttagggggtaattcggtcgaccacgatagttggggggaaattcgtactttttttctaataaaaaatatttatgttgtaaattacttttattatatatgtaagttacttttatcacatatataaattacttttggatttgattaaattatattttagacattcaatgaacaatttactctttggatagactgatgtttttactcctacaatagatttacttttagtgtcatgacaagatactttcaatttgatttaagttacctctataatatttctatgatatatataaattagttttaggctttattaaatttacttttatatgtctaagaaataatttaatgaaatctaaaagtaatttagatatattataaaagtaatttgtaatattatataaaaatgtaatcttgtgagatattgttataaatatttaattgttatgaacacaacggtaattagatcgtagatcggatgagtaattttaaaaaaaattatttgaagcatagatggtagaaatatattttctacatgcttgatggactagtactatagctaggtaagattctttaagttattttatgccgtcactgattacgactaaaacgagcctctcgatttagattttacaaatacttatattgtatatacgtggacaaagacaaagggagtaacaccgttcaatttttctctccttggcctaaactactgtggtgttttgtgcggcattccaatttacaaagtattttagtatgttgataaactccacctggtagtcacagtcttgtatcacatctcctcccttcctcctctctctttgtacgccacatcttctccatctgcttgcgcctggtcggaccacatgatgaggaccttgatcatgatttttgataggtattaataactcttgattttgtgaaaattgacaccaacgatccggttttcaatcaacacaatctgaaccttgcaatcacagcaccatatcttctctggttatcaatcgtttgttgctcgattgatcttgttgagaaggttaatccctaaatgggaattgaagaacacaaggtagattgcaagttaatcgcatatgaatgattaagcacatgaatttagagttcaacaactgaactagcgaaactgcaatggcaaaaatatgagctcatccataagacatcttggatgggcaatagggcgagcgagtgtgacaagatacagaacaggcgcaagtaaatagctcactgacatgtggaaactatgcaatagtatgcatcagtattaaatattaatgggtgtttttttctatatatggatgataatttcgtgattaaaacataatttgtatgaaaaaatgaacagggagtacataatgggaaggagattgctgtgaagaaacttaatttgttgccgggactcaatgatacggtattcaaaaatgaatctcttaaccttatgtctgtccagcatcaaaatattgtgaaattaattggctactgctatgaaacgaaaaataaagttgttgaatataatggcaaacttacttatgctgaaataagtgagcgagttatctgcttcgaatatttgaagcgtggaaacctagcaaattttatttctggtacgtaccatctaattaattaatttagtagtgtgcaaagaaatgattacatgtttaagtctcggtgaaaacaccttttacattttgcagatgaatctggtggtggacttgactggaccacgaggtacagaataattaaaggggcttgcgagggattaaattatcttcacaatggacaagaaaagcctatttaccatctggacttaaagcccgaaaatatattgttagatgagaacatggcaccgaaaattgcagattttggcttgtccagactctttgaatcgacaaaaacacatataacgaaaactgtgaatggaacaaggtaagcagacaattcgtatgtagccctcttacctcgagaattcaataagaactgcggataacttatcattattgctcaatgcttatttttccagatatatatattagattgggtatgtaagacaagtttttttccacaaatccgccgactacaatttgggctagctatcaatttaaaacacaaaacgtcaaaatagtactcacacgactatttcttgcgaaaaatcatatgacttaaattattgctgatttgacagtgcaagagatgatggttatgaaccagccgtattgatatattattttgtgcggtagtgtatttaggagcaaaatacgtttccgtaacaaattccacaatgtttatggtatcatgcagaggatacatgccaccagaattcatagaccaaggaaaaatcactaagaagtttgacgtattcagtttgggcgtcataattatacagataatcgctggaattgacggctacagacagtgttgtgacatgtcgtccacccaagaatttgttgattatgtaagaaatttcttttatgtctacaccattgaaactaatattcatttcaaacattttgtgatacattccgtaagtgctttaattttctatgagcgtgtttgaaaattatgtctttcgcaggtatatgcaaaatggaacaaaagagtgcagggaatatcgaggtatgcatcgcgcgaagcagacatgctcgcagtgagacaatgtattgaattatcgttaagatgtgtggaggccaaccgagacaaaaggcctgcgataaatgatataatccatcaactgaacgagttagatgctgagattgaaaacatgtttatgcgtcagcccaagtcacttttgggccaggtacgacgactatggactaattctgtttttcctacctgacttattgagcatctttcaggctttcattcatgcactttacattttgcagttcatatgaaaaatgttagaaaagaaagcatatatacttaacaagttcactatagcgtacgtgtctttagtgacagttgcatgttccatttgatttgccgtttcaaatagggataaatacgtccatattacaaccttttacaatcttgtttgcctgaaaaacactcttcaatgacgaaattgattgttttattataataacgccacatatattgaaattggacaaatacgctgtatggcaatacaaatatgttttaatagttattttcataattctaaaatctaatgctttttacaaataattaaaggggctacaatatggacttaggctgtgttcgattgttcaggttgggaacccatcccctttgcacggaagttgaagcggtccattagcacgtaattaattaagtttcagttaatttttttccaaaaatggattaatttaattttttaagcaactttcttataaaaactttttgcaaaaaacgcactatttaacagtttgaaaagcgtgcgcgtggaaaacgagggagatggggttgggaacttgatgcaactaaagcagccttaccctttgtaaattttagcatgtccccacctttctaccaatattgtactttgtaatcatttatggattgttgtattgaaagttaagcaccttattggtaattaattgcctttagatttgtttgatttgaccaatttaaaaataagacgactaagagactatgtagggagtatcatgcatgttcttttctattaattatttttattttacaattaatatctagggatttatgagatcgaccaagatatacaaggattatcagtttatcaccaacacatggatagtgtattccactcggaaatggatagaagagaatgtcccatgggaacatatcatgtgcacacaattttcccatagacactccgtgcataccaattagcaaatatcataaaaaattctaaaaaataaacatttactcctaatagtattttacatatcttcaaagtctcatattcaatttcattatattttacccgtaacaaaaaaagtgaaaaatctcacagttttaaaggtaagaatctgtcagctttttgttacgactaaaatataacaaatttgaaaataagatttcatacataggtgtaatactattggaagtatatgtctaatttttatataattttcgatgatatttgctagttagtgtgtacgtgaagcttgtgtgtataggatatgttccatgccccctcactattacatgatatctgaatagctatggaaaaattgacaggacattatagattaataagtgataaatcactatacaaacttccccaattaaattcgacctttagaagcgtaacaaacattcaagtttaactcaaactagtatagtataggtgtgctcatagctagttttgttttattaagtacaagaagttgaatttaaacttgcatgtgtttttatggttgtgaaatgatatatcacatattaatctatcttgtcatttttttaaaaaaaaaatactctctccaggttgataatagttgttgtttaaggcaacttaaaaaaatttaaccactattttacattataatttatatataaatataaataaatatatgattttattgaagtatttttttaagaccaacctatacatgtggtgtagagaaatattttagaaataatttatagtcaatgaattgaaaagtttggcatcacccttaacataaacacaactaagtattattaacccgagagagtatatgcacatttgtatgatatgtgaagaaacggagaggacatccgtcaaccgattaaaagagtttcccaatccagactatataagtctagttttttttcattaataaattccaatctgctgcccaactgcctcgttcaattaattcttactaatgaacttcatcctcgcagaaaagctctgaatccaaatatgttgggcttgatcctgtccgcgagcttcgattccccttcgaggtaaagaaggatatatcatgctgtctgcagctaacaaaccagacggattacttcatcgcgtttaatacaaaggcaaaccaaaagaagtatagcacacaaccaaacaaaggaaccattgcaccatggtccagttgctatgtcactgtaaccatgaaagcacaggagacggcacccccgtatttgcagtgccatgacatgttcgttgtgcagagcactagagtgaatgaggacctcgaacctgaaactgaagatatcactgaagaattgttcaagaaaacaatgggtaaggtcgtggatgaggagaagctgccgatcgtttatgtggcgttgccccaggcagaaagctagctgtttcacctgccagtcattgaataaaatcaacgaaaatagcctgaaatatgtattccgattgagcattttatttgcgtgttcagggttaatgtttgatgtttgcactcgttttcttacggtttaaaagttggttgaaaccaaatgtaggatttgctactacatttatatatccacgatgtaataagttctttaatttgtgctcaaactcgcagaagtcaccatcagaacagcttatttatttaggtaatttggaaccatatgccattataattttttaaagtttgagatatgccatcggtatctcaatgacatgtaggacccacatgagtcaatgacatgtgggtcaggatgacatatcttaaattttacaaaattataatggcatggttataattttccctatttatttatttaggaagaggattttgatccctccaggggatatcccctcgttgtttgtatatcagtcaaatggttatgataaaatttgaaaaaaaaaattgagaaggtgtattaacatgtgatatatcactccacaaacatgcaagtaaaaattcaacttctacatcttacaaaaaaaaaacaaattttactctaaatatacggtaactagctgcggttttactctgatccgccacacccgtcctcgggagtggcgctggagcgaccggtagggtgctcgagcaacgatggtgggcggtaacagcaagcgacgagggtggcagatccggcggcgccgccctcgggaggggcagatccgccatcctagggagcagctgtggcgaagacaagggctggtggtggatccaacggagcctccctcgagatgggcagatccactgccctagggatcagcggcttcggcaacaacgagggtgggcagcgatggcaagtggcgagggcggccgatacagcagcgccgccctcgggagtggctgtggagggctagggtttcggatttttttttcaaattttaattctttttgccgtatttattttcacgtgcggtttgtgttgcctgcatgcaaaaatccaactttcgcaaaccttttggtgcatgatggtcacccgtccgcatgcaaaaatcacttttttttagaattacacagtacaacgcagacactcacaacgcacacacactcacccctatgaacacatgcacgcaaaccctacccctatgagcatcttcgaagactgggccgacaaattctggagagattgacgaagtcaccacaggcgccttactgttgacgggtacgtcgcctaccactgaaagcacaacgccgttaaatcctgaaaaattcgctcccatggggagtcgaacctaggacctcaggtgctactgaggctcttgtaactactaggcttggtcgcatggaaaaacgatttctatagtagtgatgtttgtttcttgtgaacttatttaccaaaaagccccatttagtttgcaattgggttggaggattgtctcgtaaagaatatcgagtgtcagcgacaaatgtttggcatggaagaagagggaaaaagtacaatggaggtttgctccactttaatttaatttgctggtccgtggatgaactgtcacggtggtgaagggaatttatctccaagaagtgcagtgcttatgtgaaattggaattttctttgagataatgtggacatggatttatatatatggagaatgataggacaagagcgtgaaagcaagaacaaaaaattaagttaagttattttttaaacgaaacagacactactatgtaccggaacgatcacgtctgcaaaaaatcatttttcagggaatgttgacgggcggcgtacaaaaatgcattttcataagagactccttaagaggtctgactgtgaaagtagacttatttttctagcgagactcttaaacggctatattggaaaatgtatttttgcagaagaatctcttaaaggtccacctagaagtctaacttaattcctcctttctttctcagcacttcaagtctcaccttctctctcatatctcacctcctatcctccttatattatctctcattcctctctctcttcaccgagttcccctcctgagcggccagcggccagctcggcgacctcgaggtggtgggcagcagtgggcttggtggcagtgatggtgactatggtgccatgacaggccgatccgccaccgcctgccccgtgacggaagtatccgccgtcgccggccgtgtgacgggtgccaaatccgcaccaccatcgggctgcgaaggggaaatggaggtgtgtggagggcggccttggcgacaacaacgagggcggacaatggcgatggcgacgatgacgagtggtggcggactgcggtctgcagcgatgacattgccagcagatgggtcctagctagggtttcaagtcttgattttttttttggatttttattattgcgtgcggatgatataagcacccacacatgattttcacacacgggtgcaccaactgcatggaaaagtagcaattttcgtaaacacttctgggcagacgtgcagctcaaccccacgcaaaataggttttgatagtacagaaaaatgcttgttttaagtagtgagacacttaagttgtcctagtacatggagtacgatatgttgttttgagttaatggattacgcgtatatcaagatttatgagttgataatttatcaagatttatgaagatttttgagttgatatacttcagtattacttgataatttgttctaagctatctttgaatacataacatataattcatcctataaacaattatccataatatgcccaaacaattactggtttactagctcaagggtaatgtcacgccccgaaccagtcccgaccggaactagcccgtgacgttccaaattaacctgttaatcgataccagtcccaggaaacagtgctggtatcacagggagacagaatatcacagcaacagaggtctctttattatagagtagaggtacagtcatgttgggctgcggacagatcccgagctcacaactgcattacaaaaggggaagcggaagccaagactgggaccaaacatcacaggcgcgacttgggaactaggccgaaaccctaaaactcatcgtagccggcttgctcctggaagaactcctcatgagctggatccgcttcatcttcttcagcaactggggggagattatttatatagagcaagggtgagtacgggggtactcagcaagccagggaaaataagtgtttaatgcaggctttaaggagaggctggtgtttttgcaattgattttatttgaaaccttttctgaaacaactaagtgagtgcttctcaaacgacacggatgagacagtgcgtctcgtccggtcggagtatgtgcaatgtatcagtctttagattttgaaacaaggttggcacccggccaacagcttttcaaacggccacccgggccaacaacttttcaaacggccacccgggccagcaactttcaaacggccacccgggccaacaactttcaaacatcgaaccccttttcacaacagccatatcacaagcagtagacaaacaaaactacgctaggaatcacctcacatccgcccatgaccgtgggcacggctgttcgaacagtttgttaacctctgcagagggggtacactttacccacacgacattactaacccggatcacccagcccgaggggatcagccacgtcgggagacctccaggctttcatgacaaggcattttcaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaaacggtccttaagtgcaagagcaggaaaccgtacacccagtacgttccccggtccgcggttttggaaattcatttagttcgcaagcaccgacccaggtgtcgggttttccaagtcttttgtaaaactccagttttacccaagttgttactcagattttaagtttgaaggcgaccgtcgatactcgcacagagtgcacgaatatcgaggcgcaactggatggttacaaggggacatggtgtagtaattaacaaaggaaggatcaaatgcaacaaattaggtaggtctgccagtctgccttgcagacgggacaacaggtttagtgcgatcctatcaatgcataatatttttcaagcaacataattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacggcgaaaataaagccctattaatgacctctaagcgtgccattagatagatcttgagatttgaggaattttggaagttgaacggagtcaaacggacttacggttgggaagatattgaatttctaagattattggatttttggtctaaaggaaaaatgatttaactaaatcctttttggaaaagaaaaagaaaagaaaatgaaagagggagggattatagacttttcctcgggcgactagggcgcggcccaagggaaaaggagcggaccggccgagctaaatgggccggccggcccaaggcggcccaagtgcgcgcgcgcgggaggggaggagagagagggccggtggaccgggctcactgtgcgcggtcccgggtgggacccgcttgtcaacggctcggctcaccgtgcggagggagcacgtggcgcacgcgcgcgggcgggcgcgcgcgggcggcgggcccatacgcagcctcacggctcgaggtggaacgcgcgcacgggaggggctgaccggggtcggcccgtcccgacctcggctgagctggcgccgacgtggcgcctacgtggctgccacgcgggccggcgggaggtagatgacgacgccggccggaacggacggcggacaacagcggcgagcggcggagcgaaccacggcgataccggcgaaagcgagcacaccgggtggttgcacgagacgaggggagacgagccaatggctcggattcgccggaggaagcttgacgtcggcgaatcgcggcggcggcaaccggcggggagggaagagggaaacggcgatgaggtcacgaggggccgattcccggcggtgagagcatctacgcggtttcgggaactcgatgctagcgtcggattgggcggagctacgccgagtgaggctggcgacgagcgggtgctacggagctcgagcggcgacggcggcgagcacacggcgagcgacggcaacggccggggcggcgccagctagctatggggaggctactcgtgctactaccgaaaactaagggggagagatggagcgaggaggaagaacggagggagcactaccgcgaagaggaggggcgctgtgacgagaggccgacggcgcgggagtaatctctccagcctcgggccgaggaagaggaaggagagggcgcggccgaagtccccttccgcgtcctagtgcgcaccggctcctccggcacacacgcgacggctgcgatcggcgagagggacggcaatggcgcgggcgagaaacagagaagattgggaggggaaaaagggaagggcgggcgcctgggtttataggggcggcaatgtcggtttggaaaccgactttggcggtcaaaggagagggtagcgctcggcggtcgcggccaaagcggtgacagggaggagggaggaggatgacgctggcgggagggaaaaaggggaaaagagggagagaaaagggggcttgtccccttgcctcttcgggaaaagaaggagggagcgggggcgttgcggcagagggaggaggggttctctgcctccgtcccttggaggctagcgcgggagtggcggggccgaggcgatgacgacggcgatgacggcgggcggtttggagcggcgcgacgacatgggcgacaggcgtgggctggcgcggcagagggtgacggcggcggcgaccaggcg

SEQ ID NO: 82866 - DNA, 24021 bp, Oryza sativa
ttcctgcagcccacacaaacgcgaactgcttctggaccagactcttccttagtatatccatcctatgataaaattaaatttgtcagaaaatggaatatgtcatgcacagcagattatgtccaaagcactatttcactaacatcatggaactatggaagtaactccaattaatgtattcctttagtatatatatatatatacatgtatccatatgacaacttaagttcacgtttactttaaaaaaaaaaaatctatgcaactccatgatataactggttatgtatgcataagaggaaggctaatgaagttaaatggaagcagtaataatataataaaaaataatggaattttcccataaagatcaatttggcaatgtcatacctcgcatcttcctttcttactttcctttgcaaggcagaagctatctgtaattccagtctgaacatgaccgctatgaactccacccttttgaagaccaaacttgggaatgacatgatcatcgaacaatgggtttgagccatcgtgtataccatatggtttatttgatgttattactgttatgttcatatatttaagctcggcgaaatcattttcagattggcaattattgtcattgcgcatgctggatagagctacaccagaagtaaaggaatcccacataaagtagctctgcattaggtcagcagaagagaaaaataataataaggtaaaagtgaacaggttcccatattgtaccaaacataagatctaaggatataagcatataacttactgtatagaattcatcattgaaccatgtgtctcgagccatttttaaagagtcaaaacaatattgtgcttcatatgtactttgttgttgttggaatgcataaaagaactcctcattgaccggaattgtattagttgcatcaagagggacaagggtgattgcaatgccagaatggaacacctgaaatgaataaattatattatactagctaaaggcctgtgttttgctacagataacaggaaaaatatcaccatatttctaaaatgaataaatcatattttccgtgaaatatgttatccacattttccctataggaaaatgtggctatccacataattttatatgtggctatacatttattaattttatatgttgctatccatccaaatttagttcttatgtaatattaagaagttcaaggggtaatatgtaaaaattgtaatgggagtaggtgggatggcagattcactgccaccaccattgagtctttttaaggagtatagataatctgctagataaagattaagaatgatgaagtaaaaaagagtttagatataagtaaatgtggcataaaattctttcttcaacaaaagaatcatagatggaagttttcattttagaaaccaagtcttctatagctgttatatgatactagtctaataaaagagttcaagtctcttagatacaaaagaagaacaaggttaacgagtatgtcagcatgtactaattgagtacatattaatttaaaaccaacagaggaacttaaggtacatattaattaagaaaagcagtacaggatgggatgaaatgtaagtttctgactttactccttatggagaagagatactgaagaccttaaatttaacgatagagatcagatcagtaaggcattgcaaaaatctacttccaaatttcaacaaaagaaaacggtggcacagcctaacatgtaaatctgggccatatacctgatatgcagcaaaaggatctgcaaacatgttgaattctgcattcggattggttctgtagctagtaaacaggttaccatggtcaccacactgctgtggcgtgcaagatgtggtagaattttttgggcagcaacctgtagggttctccgatctcactccaccacccataatgtatatgtgctccacattttttttcaggtgtggatgtgtcataagaaaaatggcgaagttcgtatgtgaccctattagcatgacggttgtagggcctgctgatattgtctctatcaacacttgctgtgctgtagactgatgaagtggtatgtatcttctgttaccctgttttacatattaaaagagtacattggagctggtaataaaaacgaaaatagccagattatccagtaatattcttgcagaaaagatcaaagcacacttcagcgattgattgatattgaaaatgccaaatggcatccccgaattccctagacccagttcactgatactgcaaatacaagtgttcagataacagcaatgatttttgagtgtcatactgtcatccataaattcttactagtcagcttgcctcaaactacaaaccaattagagaccaagtgaaagatgaccagtttctagagacatttatacaaatttgttgatatctgcccttctgcctgaaatgtttacaacatgactttgttggaagtcttaaagaataatagaaaaatccatccaaatagtcagtgtagctctttgaaatagacaaaaagaaacatagagcagtcctaggagcacattgtcaatatacagagttcttgctggtagttttgaagttccaacaactttgtgttagcaagacaactgctaagttaacaaggaaatgagaaggagagaccgtaggaccaaattttattgccgtgtttgacatttgctccgactaaaggattttagatctaaggatattagatactccactcaacttaaagtacctcaatttaaaatgatatgttggcacaaaattatgtagtggtgcagtggtgcgaaaactgaccaattttaggaacaacgacttaactactatgtgcactttctttgcgagagatgcagtgtgcacttatcctacctgaacaccaaaattgcggcattcgacaagaaggagcacaaaatgaagcatacctgtggaaggaagccttttcttatgccagagtttgtgtcgatgtccaaccgcccaccgccttcaagtggaatagcctgcctataccggcagggcccaaaggttgtcatgccctaaatttgaacgtttgtatattagtgatcctaaaaaagcagacataaatttgggcaattctactacatattttggtctagatcataacaaagtgatgaattctaaattgtacctgatcaatcagaggtaaataaccaccaacgttcgggtgtatggtgccatggcctgatataccaccatcaccaccaacaccaactgggatgtcatcacggcccatcatgtatagcatatcatagagatgattcacagcatgaccagcatcggtccacgcattcacgtcgatggtgaccgcctgctcatgtttacaagaagagtaatgtaccatcgatttcttgcaaagacccacaaagaacttgtctaatactaccatagataatgtcagaagaaaatttgcataatcagtcggtgtaaaatcactatttaactgagcggctacatcaatccttagcttgacacacaatcgctgtaaaatcatcatcgattccaaatttccgatcaatagctaccgattgctccttgggtggctaatgcgaacgcggaagaaacaagctgcttcgatttctcaccattccgcacattccccggtagcccgcggcagcgcggagaactcaggccagttgcctcgagtgtcccagccgctcgcgcagatccccctatacgggatcctcctccgaatccacggtgataggtggagtgcgccatcgccacctagtttgaattcgcctgccgccgccgccgtggtgtcgccgccacacttgctcccccggccggccgctgccctcggcatcgccacgcgaccacgtatcccgccggagtcgacgcgacgccgcgctccgtccacgggcgctcgtcggtggcattgtcgtgtggccgtggtggtggcggcgccggcgccccatcccaccggcgacctcatccgcttcacaaatttaatgggcgaacggcccaaaccttgaaagtatccggataggaaaaattattgatgggcctaaatttgttgctaccctagttgagcttgagaatttaacccgttagtgtaactgtcagttgcccgatcttcttcagttaaaaaaagaacaatgagttcagagctttgcaaaaaaaatataaaaaaaaattgggcagatttttttgaaacaaactcagtcgtccgtatatcttgaaacttgaaattgacgaaatcatcatggacatctaactgttaaagggtacgttgtctaccactgaaggaataattagccgcaaatgcgaatccctgtgtcaaatctaggacttaaatccaaatggattgatttaataaaaaaactaaccagttgagttatgcttacttagcaagtttggatagatttgttagagcaattttcaacgtgtacggtgtacccccttagaaatggccaaatgggtacctgaatattcttaacggattctggtcaatgcattgatcggtacaaatcgtggtgaagttttatcacgaatcttcttgtaaaagaataatctagcctgcgtgaacactcggtaaaggatccaatgtactgctacaagacttctacacgctcttttttttcccgattacacataaatgctcaacactaaagatgtaatgccacactcacacgtatgtaaattatacccctaacacatgctcaaagatagaaaaatcaacgacgccggtctcactaaatttatgcttaaagttcacttacacttaaataaattcatgtatattaagatttaaagcttagtggattaatacgattatattattcttagaaaagtaatgtgccaagcaatctctccgcgcgatatgtgtcgttttttatgcaaaaaaatatgtgacggtatagacgtatcataacaaatatcatattgatatatactagctatggaagtaatctattatttgagataaaaacaaagagagagaataatacaagtttcgatggcgcccatcctcttagttagcacaaaaaggaatcaacaaaaatgttggcttacatacacacgtcatcaaattcccaaccgaccaaccgcaagaaatactctttgaaattgagttagctaatctctcggttcacttttgggagatatatggcttaatcatgaaatgtggtggtgaagtgcaggtagcatatagtcaaagggaagatgctccatcactgtcttgcctatagctaactcctgtactttaattatgctcgagtaatgacactgccatgcaaccagcaatgcttggggggggggggggggcagttgaatttgcatgtaattaggagcagattctgctcgttttgtttgaaggtaagatgtttttgtattatgctaattaagttaaacttatttaagtctaaccaatcatgcatgcatcatatagaaaaatataatgtagtaacatttataccaaatttatttcattgtattaactgttgaacgtgtatttttatagtatatttgtttgatattgaaaatattactgtattgttgtataaacttgatcaaaattaaatgaataaaaccaaaatatctcgggtacgtcttaattaatttacatatgctcgaatacaagttcgtggcgcacgcggagagatgatcgatcaacgtgatcgatgtatatatatatatttatgcaatgacagaacttctacaagtttgaccaatttgctagcttgcttgtattctaaagcaaaatattaacgggcgatttgagtacgagtcaggatcaagttgaattatttggagagaaaaatatgcatatagctagtatagtacacaacacgaggtcgggaaagtttgcttccgggaaggcgggaaggtatatatatagagagagagacgatttctcattcattaaaaaccaaaagtccaagatacgtacgatcagccatttcacaagtccaagatatatacgtttgggtcgacttcatgggtagttttgagtgttaggaacgagctgttaagtacacaaaataaggaaatgttgtataggatttatatgttatgttatttatacagttaaaaggcatgaacaatattggtggcatctacgcgatgatgctaggatatttggtgggacggaggatgtaaggagaattaatatgaatgtcctttgttgatcccagcacacggtttaataggcaattttacaccatactagcaaaatacttatgctttactatggataaaaaaatatatatattataataatatcattgaaaatatatttttattaaatatattagtatcacttgtttatttatttaaatatatggtattaacttgtttaaaacaaatactaaactatgttaaatatcagaaaatatcatactaacttataaaaaactacaaaacaaatggtgtagatggtaaattcactgccaccaatagtgtcttttaaatcccttctctatcaatatataaggcaaatttcttgccttcttttcaaaaaaaaatagtgtcttttaaaagagtatagatttccatatatatatatatataattataccagtaattatatgaatttgttgtaaatgaataagcaaacaatttataagagttgtttgtatattatataaatattgcataaaaatgtttatacacatagcaatcgtctaaaccaatgtttatactctttgtttatgtttatgttaagccactacgagttactcaaaatccaaaattgaacacaaaacaagaggataaattaaagggacttggtaaaccgtacatgtggatgcatgggatccttttccttgtcaggtccaactgtcggctctactagtctgctgctgcagtacatggttagtcgtgacatgcaccgttttgtttggaaatgttttgtcggccatagacatcgactgaactatgataggaccgaagatgttaatatggatcgctcacgagtacgtactgtatggctattatatacgcattcgacaaaaaaaaaagaaagaagagcaatagtagaaatgaagaacagttatgaggtttgccagtattagctagctagctgcatgtgcttcattcatggaaacagcaatttttggtttctttcaagagtatggagctccaatcaaaagcagcaatatattagttgtcactgcaaggaacgatcaaaggcaatgcctaaccaacgtattatctcctatattttctttgcttggatatatatgatccacatgacgataatcctagttaggcaggaatgcggacttgcagagaaatgcaagaaggtaagcaaaaccattactactactactaccaccaatcaagtcatcaaccatgcatgcaagagaaattaagaagctatacacgctacgtgctgagacgtacgtggctgcagcatcaccacactaaccttgagctcgaactcggagcggttctgcttgaggaggtagagcagcgcgaagaggtcgtcggtgtccatgtccgtgtccaccagtatcctcctcggcttcgccgccgccgccgccgccacgacgacggcgaggaccaccaccagcaccgccgtcgccgccctccgcagcggcgtcatcttcgtcccgtccgtcatctacacgggcggcggcaacgacaccaccggcgcccgagctggagactggagagagagagagaccctgtgtggcagtcgccgtagtctgctatccaattcagcgagcagttaacggaggattggatagttaacgaagcaagtcgagtgagctagctaccctgccaccatcagggtccagggcaagccattaaatgctatagctcgcgcgactcagagagagaaggacgattgggtatgggccgtatatatgggcgtatccgcgtatgcgtagggactagtaggaaggctgttggcacatgcacactcatactagctagatctacaaatggatggattttaaaaacctaggtgctttcattttgtaagtatatgcatgctatctcaatatatgtttttttctttaacaaggtaatatatatatatataaacattatctgtcacttcataaatataggaagttacatttattaacacaaatatgcagagaaaacagtatcaccaacacaggaaagcatgtctacgctgccagtttacaaacctcatgcaccgtagatgtcatattcgcagccggcaccataagagcatcactgataaaccatgattattgtttacaactgacacacataggggaacatatatatggccaattcttatttacaaccggtacatatatgagtcttaagcttagcagggacatgttgacaggctcatatcaaacccatcggcaatagtcctactgtagacatatacaaataattgtctaactaattaaaaaaattaaaaaatccttcttccaccaacaattataaggaacattccccgcaaaaaaaaattataaggaacattgaaatgaaggataggcaaaagatttttagaggattgttcatttcctttggaattttttccatggacccatttgattcttcataggaagaagatataatcttttttttcaaaagatctcattcctatagtcaatttcataggggaaatgagcaagagattaacctcttgtaaactttcatttggtttaatttttccaatggggcaattaaagggcttctctttccggtggttgtgtttttaattcctatagggttggggaaaaaacatgctacttcgatttcaacggtcatgcatatttttgccaacttcgggtggagattcacaaatatgattcaataattgtgatttatttatcttgtgttggtgcctattagtttgtatttgagtattgctgaattcaaagtgtgtcttgtgaactctgtggtgtgtgatcgctgttaagcaagtctgtgtaataagtggttgtagctcttttttagtaaaggccggagttatttccattatctaaaaaaggagtgtaaaaaaataggaattgctcaatcacgttgtttagatgcttcatggaaatagtacatgaatttggagtgagagtgacacaaaaggaattgttcaaaaaggtttgatctcatgttaaatatcctataaaattccagtaatttttaaggtcgttttatagaaatttcaaaggactccaaaagagcccacaagaaatttcttccaaatatcatgtgttcgtaagaagccttaaacattatatgccacttcataaacgtggaaacattatgtccgctccttgaataaccatgtatatttgtgattggaggtattaactctgttttacataaatatatatatttatcatattatcaatttttaagacattatgactggactcgtcttattaaaactatctatcatttatttaattgtaaatgtttattgctaaagatatcttaagaatgcatggtttatattttcttatatttacattagttttaaaaaggtaaattgtcacaacgatgtgttaaaaagttagcgtcatatatttaaaaagaaagagtaggacttaatgtacgcagaaggaataatataatttcagatccatcgttcatagtcctgcggtacacgcacactgtcgaactaatcaatcccttttcctggatatcattgtccccctttttctccaaatacctttggcaatagtacgctcccacacgttaaactcgtgataccctcatgcccatgctaatatgctaagtactcccttcgtcaaaaaaaaacaaaattagaagggaatgtgacaaaattagaaggggatgtgaggatgtgaccatacaacaaatctaggaggagtcacatcttttctatattgtttttttaatgtggggaggggggagggctccataaatgattatgagtgtcttgtcactcttcatgactgttggcagcgtggggtttggagatatctggctgcggagagcccaccggccggggcaggtcccaatcgttggagctggagtagctgacaaattaagtgtgtatgaagatggcagaatggggtagatggaacgaaaagataagagcctttttggcttctacgtgatgtacgatcctaagagctaatctattaagaaaaggctggttgagagtggagtacttgtactggtagctaggatcgcgacctataattaattttatactcgagattttgttagcttgcacgtatgagcatttttttaagcaagaacgtacaccaatttgaggttgtaattgtctctaccctactcgattgataaaatcatttttcatggaatgattgtttcgtgttcatatcagtcaaccgtctattatagtgtgtcttttccgccatataatgagataaatacaagctactctcgtaaaaactactccctccgtcccataatataaggaattttgagtttttgcttgcactatttaaccactcgtcttattaaaaaaatttagagttattatttatttttttgacttactttattatccaaagtattttaagcacaacttttcatttttttttatatttgcacaattttttttaataagacgagtgttcaaacagtgcaataaaaacttaaaatcccttatattatgggacggagagagtagtgaattgtacccgagtcatctcctctcacagaccggtgctcctttttcctctcttattctcttccctttacttagtgaagtttagcggtgtctatgtataactattttattgtttctctacatgctctaaatatgacttttatactgttatagttcttatatgttttccatatatatagccctcgtgtactctagttattcattgctttatgaatgataccatttgaaagcagaatgtattatactagtgacataaaaggaagccattgtgctcgctctcgtgacctagaaattctctaattaatccgaaaaaaaagaaatatgaattattaattaaaatgtgggttcaaatcctatctttctataaagttaaggctcactacatcctaaagcttaacatgcaaatatgccacatcatccactaacatttactacatctcaaatctcatgcaagcatgctaatctattaagttttagagctttaaaatgcaagcatgttaattaaattatcatcctacataattcacataatatttcaatatatctctgcatcattttttataatatcttatatacctatatagttcatcctcacttaaatttaagagctttaaaaaatccaagcatgttaaatcatcattccacataattctcaaaatattttcattttgtataatatctatatacctatataattcattcgcacttagttaatgttatttctctcttctctcattaagccatatcacctcaattgtttctagccctcaaatgatcaatctatggttggaattatctcccttattttcttctctcataaagccacatcatattacttttaaatttgggtcattattctatatactatttaaattatgataaaccacatcaacttatataagtttctatcgtctagctatcttacacattatttctatttcttattatcataccaaactcccacagcaacacgcggggtttcatctagttactacagacaagataaaccaaagaatccaactaggaaaaaaataaaagagagtacatataaaactagcaattatatatcgcatgcaaaaaaaaaattagaaccctaaaattttgattgaaagtctatcagcattgtaaagtttgaaaccaaacattcaattccctaaactttagaatacattcacacaacctcctaatgtgattttacaaaatggattttatttaatttgtatatacattagcttagctttgatcatgtgacataagcattggatatatatgttaaagttttcacttaaatatttctttttgcatcttgtttgctttcacttacaagaaaagtacaagttgtatgatatcactgtacagcataaagttacaacctacaattgatgatgcgtaaaaatattgtaaagttcaggaggttggatatctggtttcaaagttcacggggctaaatggagtttaatttaaagtttagggggtatttagactttttccaaaaaaaatataaatgctataactggaatataagttgaaatattaataaatagttcatgctaaacataaataactacaatcggaaataaatattaaaacctacaggttaaattaatccattctacaggggaaaataagcatgatatccactaaattaaaactgataaaaatattagtgaagatgagctaatttctagcaggatgattcttacatcgatgttattactgattcttgctacataaggatagttcaaggttgaagcaagtgcgtagaagaagatttaaagcttagtcttctaatttttctctttctagtgaagttttctgattttctttcttattagtcttctagctttttttctattttttttatattccttagttataaggcttgggatccaagtactcatatttatagtggttggttagaccggatttcaatctgttacggaatcgctgaggccaaaatggtgagacacaggtaatcaggaattcaggatttttagatgacttacagattatagaatcatcaacgggacactgggatttgtagggattcaacatgttgatgtgttgcctcaggtacgggctccaatacatgttgatactagtaggctagtagctcaatcgtactctatttgtcccataatataggaacctagagatagaatattttatatagtaggaaaaagtatgaattacccactaatatatcgtgttcgctcgaattacccattgcacccgaaaaccagatattgcttaccctaaactttcaatataataccggacgaattgcccccctcgatccaatcaaagcggttttatcttgcgtggcgtacgcgtggcaatctagtcagcattttcttttttaaaatagtgggacccacctgtcatccctcctctaaccctcttcctaatctatctatctatctctctctcgcgcgcgcgcgggcacaaggcacgcacagcggtgcatgtgggcggcggcgcaaggcgagatgcaggaaccaaaagccggagctgggttgtgggaggcgtggaaggggtgcggctgggagggcgttgcggtgggcgcgtggggtggtgcgagacgcaaatgcaggagccggagggcggagctaggtggtgggtggcatggaggggacgcggctgggagggcgaggtgctgcggcagacgcgaaatcaggctcctcctccgcagtcgcctcctcccgcttctgcctcaactcctcctccacgtcctcttcccgacgccgctgcagcgtggccgggttgatgtcggcaaccgcatctgcagcctgccgtgaaggcggatggcgcgatggggaaagccggagcaggcggcaggagagaagccgccttcgccggtgaaggccaagcggtcgtcctcaccaactaattaagtccaagtcgtcgggtaaggggaagaggtccccgtcgccgactaggtccaaatcgatagccatgggtgcggctgggagggggaattagtcgcgctcgtccacgaccacacggggatccccctgccgccaacacggtctcagcagcagcgcgaggcaggctcaggcgaggcgcgcgtcacccacaccaccaccaccttcaccccgcccacttccttccggccttttccgcctcaaccttggctgcggttgtggcagccgatgtcctgccttcgtttctgacgtcgccgcctaccgtccgtccccgcgcgccgccgtacgcaccgacctcctgcacttggcaacgccatagagagagagggggggagggggaaggggaagaggagaaagaggaggtgagagactatgacaggtgggccccactatttttttttaaaaaaaaagaaaatgttgactgggttaccacgcatacgctatgtcggacaaaaccactttggattgggttgagggggtaattcgtccgatgttgaaagttcaaggtgaatgatatctggttttagggtttaggaggtaattcggccaaccacaaagtttagagggaggggtaattcatactttttccttttatagtataatgaatcatataccctcctgcctaaattttattcggttctagattactatattatggggcagatggagacatagagtaactcgcgctgttggcatgtgccatgtcagttctcactagttttgtgttgtgtggaacatttcattccacaagttgagcaccaagctaaccactccagcacaagttcgtttacagtgtactcccaagctctgtttactcctctttcacatgcttttactgcgtacagtggcaattcgcgtccaggctctagtatagccccttctggacaagaggttcaatcgcaacatgggccgaggcctactaatgtgacgaacgtacgtacgcgatgagagtattgatggaataaggtccttttaacttgtcgacgaatccgattttcatactttaactggaaaaccagatataataggtctatcaactattaaaaccggtgaaaaaggtccctcgacggttttgatggcgattttggttgacgtggcgcgtatgtggctagtttaactcggtcttgatctgacatggtgcttacgtggcaaattgatccagaaaaataataaaacccgtgggaccacatatcagtttcgcacaaatgataataataaaatggtgggacccacgtgggccccccatgtcatcctcaatcctgggtgggcggcgagctccaagctgacggcgcccggagcgaggccgccaccgccgtcgaggcggagagggcgtcagcgggaggagatcgcaacggcgtcggagcagccggcgaggaggtcggcgtagacgtggtcgaacccgaggagcgcctggagcatgcaccgcctgccgaggcgtgtcgccacttctgcgacgcggttgagcgcgtcgagcttctcggcgagcgtgagcgccaggagccacgagtcgtcgcctggcacgagcgcacgcacggcctgggagccgaggcagagcaggtgagcagccgcgccgcctcggtgtccgacagcgagcggatacaggttggcggcgcgcgacatggcgttggccacatcgaatgacaggatgtcgaccttcccgtcatccaccccctccgccgccgccgccgccgcgccgcgccgcccttgccgctactcgtcaccggcttcactttcctagacgacgacgtcgccatggacaacaccttgtgcaccagcgaccggcctccatggcgatttcttgattttcttcttggatcaaacaaagattaaccaaaaggaggctaaaaagtagtaagaaaaatatctccgcttttgcaccaaatccagctaaacaagaaaccaaccacgagcagtcaaaacagacacaccgatttttttcaaatcccgtcgatttgaaattcaaacctaaatcctctgatttcttcgttgtctcgctagtagcaagcagcaggagcaattaatggcggggagcagagctaaagcaaacaaacaaattaaacaaccaagtaacgagaaatggaaaaacaatggagaaaggtgaccacgaagacgaatcatggcctctcctgccgccgccgcgatctcctcccgctggcgccctctctgcctcgacggcggcggcagcctcgctccgggcgccgtcactgcagcgctcactgtccacccgggcccaaccgcctcggtgcgcctcgcctccgcgcacctggcctccgtagatccaaacgtggccggagaggggagaggaaagagagaggagcgaggatgaggggagagaggtgaacagagtggagacggggagagagaggaagaaaataaggggattggggatgacatgtggggcccacgtgggtcccaccatttattattattatgtgcgctaaactgacacgtgggtcccacgggttttattatttttccagatcaaattgccacgtaagcatcacgtcagatgaagaccgagtcaatctagccacctaggcgccacgtcagccaaaaccgtcaagggaccttctttacactgattttgatagttgaggaacatgttgtatctggtttttctgttaaaagatgaaaatcggattcattagcaagttaagggacctagataaacttattccgagtattgattgccacattaagcctgccactccaagcggcagtatggtcggtgccattggctggcccatcatcgtaccagccagtccagccatatacgagcaaggaaaaagtacaatgaagatcctgaacttgtcatcgagttaaaaaactttctcaaaccgtaaaacaggtatctgacgtctcttaactaattaaaaccgttataataggttctatgacagtattgcacccggttttgtcagctgactcagtataggtcccacatgtaagcctcttcttccttcctctctccttccctttccctttccacgggcgacgggcgtgcgcgggcggcggggacggagaggttgggcatggtgaggttggcgcggccggtgggggaggagctgagcgcagccggcggtcagcggggcgggagaggaggagggcgtcggcggccgaagacgggcgacgcggcggcggtgacggctgcgacgcagcgccggtgatggcggcgacgggcaacgcagtcgggtgcgtcgcgaggaaggaggggacgaggcgggacaagcaagccgccgggacatcctcttcgccgccgccggggggccgcctcgtcgccacgacggccagcggcagcaggatgggaggaggcacaagtgcaaggtggcgccggctgcgacggggtgcgtggcgaccgacagcgggggagaggagctgggcgcagcaggcgaagatgggcggccggctcatccccgctgccgccgcccacgcccgcggcgaacggtgaaggtgaaggggtagagcttgtggcgacggaacttagggaagcaagagcggagggcgacgtcctcggcggcggaggaggagaggctggcatccccacccgcgacatccccgtcgacctcgtcggcgccaagctcctcccccaccagccgcgcacgcccgtcgcccgtcgcccgtcgcccgtcgatgtagagcaccaagttcatctccgcctggcacggcccgccgcagaacgcctccgccgcctccgaatctccgatggcacaccgcacacctagcgcgccctccggacaagcctgtactgcccctggcacccgctgtagatctttacccggccaccaatgcaagaacacacacatccaagattgcagaacgtcaaaaacagagtctattttctacttgaactcttttttctttcttttttggctgaaattgtttcaattactgctcaagtttgatttcgaactatcaatgatgtgcttacatatctatcgttgaagcagatgatggccccggcaatgatgtcttcagtgtttcttttctgaccatggaagggtgttgctgcctcgtctgcgacggcgatggcgacatgcatctagatggggctgtgagcagcacgatgggcagagcccggtcgggaggaggaggacggcgccggagacggcgagcgtgaggaagccgacgacttgggtggagttgggcgcgtgcgtttgcaccgccggagcgtcgatgacaagtccgccgccgcgggcgcttaccttacccatggcgttgcgtcggacgtgcgcgtgctgctgccgatgggaagaaaaaaaagagtctgacatatgggacccacgtgggtcccacgctgagtcaactgccacgtaggacaaaaccgggtgtaatactgctctaggagctattgtaaccggttttaattagttaagagacactggatatctggttttgcggtttgaaaacgtttttttaactcgatgacaagttcagggaccttcggtgtactttttcctacgagcaatttactcctcgtgataggccttcaatggtgacactgtgacaggccagaccaaccgccgcaatctaatccatcccacccaaaccattcgggcccgcgtagcaaagccaccgcgctttttcactcgtataggtggatcatcatcccgctttatgcattgctattagcaatggcggagctagaaaactttttaaacatagacaaacttaaatatacctaatattcgctataattttataactttatttagaaaataaaatttcaatggtgtatttagtggcgagcccaggcggctacctggcttgcggtggctccgcccctagctactaaagtacctcacaattagtaaccatatatagtctctcgctagtgataaaaagacacaatacatgtctatactacttaaaggtaatagtgtcaccatcaaatcacggcgccaatgtcactggcgccccactcctgccacgtcagcttggctcgccgacacagtgccacggtggcgcgaggacggtgccaaaggtgttggcgccaccatgttagacgacggcgccagtctttctgttgtaaaaaaggatcatttttagaataagtttttccaagggtttatttataaaataagtttttcaaaataactaaaatgtaaaaaaatattagctttctgttgcagtgcttttgttagagtgcgcagcccagcccacccaggtcacattgggcctgctctaccacaggcctaaccggagccacaactttaggtcttgggcctatacaaccaaaaagactagtctgatgggtgaggaccgctctcaccttttaagtcgtactcacatatcatcaattaccgatgtgggactaaacccaacagctttatctcgattagaaaaaccataaacttgcaagcttttgtagtaattttaaatgagatacacaatacaaattatcacgagccattgacggaattttttatttataataattaataatatttaaattaaataattagtaattccttttgagtatttaccaaaataagaaggacgctattctaaacagcttccgcatcaggacgctcctgtaaacagcgtccgcggatggacgctaatccaaacgacgtccagaccggtgtagccacttcaaatgcagcgaaccgagcaaaaaaaaaaggaagaaaaattacggtggcgctagggtaggttgccgccgccgccgttgcctccttccaccgtttgcctcaacatcgggaggctgtagcagacgcccgcccccaggaggccctcacgaccgcccgcatcgattccagaggacactgccattggcggcttccaatttgggaggccgaaggttgttgtcctccccggaggctgctgctgctatctgctcgactcctgggagaccgttgaattccattatcctgataaagtacgtatgaacacaatgtatatagcagctgatcaatggtaattagctaaacgtatgcatgggcacctgttacctcccaccgaaagacataagtagatcaatgtgaaagacatgcatgtcttgcagttcacctgtcaccggcgagcagccaacgaacttgccgctcaagacgccgtggctggattgatggcgctgagtaatggacaaatccaaggcgccggcgtcgacaaggatagtaacagtggcgacgtggtttgtagggcgaaacgtacggaatacagccccccgatcgaaggcgaatacgacgacactggtgatgcctgaccctagctaggttgaacaacttttgtttcaactagaaagatagcccgcgcacatgcgcgggcaccttcttatataatgagtgaaattttattatgaatatttatatgtgggtgttttttattaaaatattttttattatattataaagttaaaagtattttgtgtgatttgaaccctgattattttcttataattacccttgtaacatttaaattctaaaataaaattactcgagaacatgcggttttgaattgatgagaaaatattgtgtcgaaacaaaggaggtggttcctataagaaaattcaggatatttaactccccagtaggatatcttacaaccaaaaaatccaataatatcaattttttgattgattgtattttactttttatatattttttcattcaaacagaactcgtaaaatgtttgaatttttctatttacagtgggttttaaatctagcaacatttgctcaatttccaattgtaaaggctgcctcaaggttgtttcactgctaagattcctaggtgcaacccacatgcttattggtatgatgttcaactggccacacatttatttttaacctattgtctatattggtagatgaatacctattatgattagtgacttcatagatcatatgtgtaattgggatgctatgatcatctttcttatgaatatttatttatctcctaataagatcgttttaaaagtatcaaggtcaatttgtatgtacatagccctcataggcatgttaagagaaattaattaagttagtagaaagtcgttagacgcctgacaggatataagtaatagatggaggtccatttgtgtcttttttacatatagataattttaattttagttgataaggagataaaaaatagagagaaaataatggcgcacgctgtacgcgagccgggaggaagggagatttcggatgttctttttttaaatgattaatctaacaaactaaaattatgtgtcagatgtttaagtcgaagctgatggtcgaatattttgttttcttgtcagaatttttacgattttctcttaaaatttaagagaacgacgtaatatcttaagagagtgtattttctccgatttaagagaacgacataatatcttagaagcatttataagatgcgtactttttactgtgttacaatgtggggggctatttttttaatattactcatagatctgttcattttacttttattatatataatttaattattatcaagttatatacgatgaaaaaaatatatatatcattaatttttatagttttaaaattgcttaaatgacacgcaaaagtcagaaaatgtagccccaattaatgtgacatttctctctttacagttgaattaaagaggacatgagttttaaaatgtaaaatatctaaagacatcagcagatcaaatattagcattataatttagatgctgcatttgcttaattgtttggcatacaatttttgcttttctaaaagaatgaaaataggagaaaaaataggtgaaaaaaggggtgaaagaattaagggggggaggggttgagcagacgtaagtacgtacgtacatgcaattgccaacagggcgaggtgggcctagggataaggatatgtttttttctaataaatctaatggttacaaataatggtccacaaagtttaataaaaatcaacagttatacgttgtgtccttttaagaatttctctaatttataggatgccacgtggcggcttaggagcatttataggatgccacatggaggcttagaagcgtttgtaggaagtttagtgttgattaattttttattataaatccttatgtggaagacttttaaggaaaaagtctgaattacacccttaaacaataagaacggtacaaattgtcccggttatatataatctgatctctcaccatcgttcgcaaacatataaactaatatattttttgttttgttttttcttttattatacatctgatttacctatgtatgttcatgggtaatatacgatggaataatctatattgtcaaaattatttgtcctaattattaacattatatagatgagaatgacataattaaaaagatataatgtggttctatgcggcattttcgatgatatgtgtatatgttttttctagcaaatactaagcacatactttttccttttttttggagacaaatattttttctcttagggtaggtgtgtgtatgtgtatttatatgatggatgagcacacgtttatatatgcgctcgtgattgctttttttaaggaaacatgattgccttatacatcattagtaaaaaaatactttcaaaaaatttagcgagatggcgtgaagcggtgctgcggccgcgtgaattctttgacaaactcgccaagggtggttgctactcatatgcacaatttgaggaaaatctcaaagctacaaagaaagaaagaaaaaactactcgatggagctgatcttgtacacattctttttttttcctttatgacatctcttgcgtagatatagatataaaataatggttgaaaataatatatccacgggttacgtataaataagtagctagattttgtttttttatatatatgatgacccttatatatatacagtacgtactcctgggtgtatataaccatttttctatatattttttcttagataagcacgggatatgcaatatttgatatttaattaatcttacgctgatggcatgcttagtttcgtgtgtcctagataagctcatccaatgagatagaccgaatgaagcttaagagataaaagggcatccacatggtgtaaaaaatatatatggttgttaattttccaaaatatatatatatatatatatatatatatatatatatatatatatatatgaatatagaaacatagaatatatgaaaatacattcttgataaatttaataatgtcatttggatatatcagtattacacaatagggagtgagtaaatttttaaaatgctactcaaaatttaaattgttttttaattataagtccaatttaattgtgatatacaatcatatagtctataatgttaattattaatatttttatggatgtttcaatgagatgtgctatttagaataaaacttaaaataacatatatttttacaacttaaaacataacatatggttaacatgaactttttagtttttcatctaatctaagtatataagaaggaaaaagaaaaaggacatagaggggatatgtacgtacatcggacatacaaacgtacaggtccaggggacacggccgagtaacgtgggattttttttagatagattgatttgttttttcttaaaataaagatatagtggttaaaaataatgggtccaccagattaaataaaaaccgatggttggatgttaaagctccacgtgccgatctaggagcgtttgtaggagcgccacgtggcggctcgagagcgtttgtagaaagtttaatggacttttagtatataatagatagatagatagatacttctgttagcgtattggtggcgtagtgatggtctgactgcaccaggaaggtggacgttgtttctagtagcgtccatgtctggacgctgtttgaatgagcgtccaagtctggacgctgtttctacccccgtccatcctattttggttaatcctcctagagaattactaattatttaatttaaatattacttattattataaataaaaaaattcggagccattgatctatacttaagtattggaagctatatgtgtttgtctcacattgagaattgcaattttaagcatgacatttttcattttacttttgaaggcaaacgacatccccccaaaaaaaaaactcaatttttggttttctcaataatccgttgtaattatagtatgtaaaaaggtaagacgcatcacgttggaccactcctgtaggtagatcgagccgtattgtcattccttttgccttagctcgtcttgattcaaacatccagggcaccggcttgcacggcctcgcccagcccttgtcattgccacatcaccacgctcagcgcgcaaatgacacggataaggtgggtctctcctccaccggatcgatcgtccttgcatgtccacgctgcttgtcggtccacatggcgacacaccgacggcgcggtagcctctcgaccccggtgacctggacggccaagcggcacacgtgcaaaggcgcgaccgagtcgaattgatttcgcgccggttcgacggagatcatccggggacccgatcacccaaaggtggccgtgctcgtgatcggagcgtggattttagccgggcgcttagccgggcggg

SEQ ID NO: 82867 - DNA, 719 bp, Oryza sativa
atgaaaaccttagaaaattgcatttacgatattgcgaaagatctatcgtgtgattttttacctccaaaattatctctcttttttttacccaactgatgtgtagggtattctttggtctctaaaccatagatgtgtaaactcaccgatgtgtagggtactctttggtctctaaaccatagatgtgtaaacttgaggtgtataaactttagatgcataaatttactaaaataagaaagtaatgcagtgccaaaaaagaaaaccaggtggagggatgggggggggggcgggctacccgatcgctatgggcgagcgagggcgatccctcgctcagtagcatttccggtgtacccagatttgtgctaggtgggaaaaacaaaaaatcatgtcacgccaagattcatgctaagcggagaaaacaaaatcatgttgtagcccggggatcctcaagtcacgcacaaacacctctcactgagttacgggcgtacgtgaggtactaagaattaagctagttacattatacatttatatgtgatttcagtgaaaaaatatatcgactagtacatagatactccgttacacttactccgtaggttcaagtgaaactacttatgaaaaaaaaaagatgatcttggttatagaaccaaataagagatacggagtatataacacttgctcaagtacctaggtaacttggtactcatatcatagggctgcaggaa

SEQ ID NO: 82868 - DNA, 647 bp, Oryza sativa
ttcgtatgggcattttgctggcagctatggaaatagctgctctagctatagtttcggatactctgcccatttcataaagtattcgacttggtttaacaacggctacccaatattcgggggatccctttcccgaacccatacgtgtttccgtcggtcttattgtaaccggtttgtcgggaaatatacgtaccagatttttccaacacgacgtgcatatcgtgtcattgctcttcgtcctgcttctatctgcctcgccgtaatccaagtaggttcaagtgcttgaagagcatatctaccaaaacaaatacaattgcctcggtaggattttccctttattcttcctctatgttgtttacgaaatctggttcttttggggttatagtcgatggttctctcttagttccatctctactgcaaaactggacatgagagtttcttctcatccagctcctcgcgaatcaaatgagaaagtgtgcaaatttctctaattccacaatattctaaaatattacggatagatacacattaataggaaaggttagggtttttaatattaaatttattaaaatactaaaatatatagtcaagaaaagaggatctagaatatatctagatgtgtatgtttatttatctatattctatattta

SEQ ID NO: 82869 - DNA, 656 bp, Oryza sativa
tcctgcagcccttttatggctaggttcgtccttagttataaaatattatgattttactatgtttttcatagattttataatagtaactaattataaaaccaatatttttagaggacttttacggtacattctactgcaagtatatattttggtatttgttaaaaatctggaaagacttgtttagtaatttgaaattgagactcgagatttattttattaggagtaattgtccatggatcttagtcatctgttcgcgctagcgttttttgtgatgccacttcctcttactattcatttgctgcttgctgcctgtcggctgccctttccttgctgctgccctgcctcctcctactgcctgctgccgccgcccggatgccatgcaccattgttgccgcctgtagtagctgcgcccgggtgccggaagccacgacccttgactgctccgcatcaccttgccgccgcgcgcctcgggacgagcccccagcggcccggcgcccttctgtgtcttcgactatccaccccctcccgcgcaaccgagccgtcgatggtggagttggagaattttgggcagacctagagttttgggtaaggaatgttagaagtcacaagaggaggaaaggaggacggtaactcgattcaatttccgttagcggcgg

SEQ ID NO: 82870 - DNA, 4322 bp, Oryza sativa
atttttttcaagaaaatcctatccagtcataggttctgtcattcccactgcttctcctttaatggttaggtttgaatctcgcaatggagcttccaaaaaatttctttccgagtcaatttctcagtttattaactcaggacgctctttgttattccttgaaatttgtatttcttgtttcaatcaaattacgatttcgaattctttgttatttttattatattgatgctttatcacattgctttttatgatgtattcatagaccatacatattggaatcctatatctttcttttttctcttccttctttctatcatccttccttttatctacatcccctttagttttgcttcacaacttagaatcctatttttttaaagaaaaaattgcagttgctacacgtatatgatagatttacttatttatgatagatgtatttattcatatagtgactgtttcttagttaggatctcgacaatacgaagcaataggttggttattagttcattttctataattacatagtagggttcattctatttttttaatcccctttttgaaccctaaaaaaaactaacgagtcacacactaaacatagcaattttattaaaagatttctcaattttcattaaatcttatagaaagaggtagaatttcttctttttttcagggattttagggaaaataaggctcttgtcattttttattctattacttaacagaatgggaagacagggttggttattcttcatctacgaatatccaaattttaactcctaatactccatagatagttcgaattggatagcagcaataatcaattttagatcgaattgtttggaggggaagtctaccttttttgatgcattcggcacgcgcaatttcttttcccgcgagacggcctgcaatttttacttttactccctttatatatgttttttagttaattcaatgacccctgtacatttgtcgataaattttctcttaaaaatttgacagatgtaattatagtacaatcgtagtgtagttacactgtaactcatatgtaattacactgtaacttgcatgtaactacagtgtaacttatatgtaagtttcacgtaattttgaatcgttagatctattacaagatttgtactattacaagatttgtactagtgaggaagaaaacaaatcatagcacacacatatgtgaaaaaatttgttcccaaggtctccattttatcgaaataacaagttacggaaagatttttgaaaattacatacaacttacattatagttacagtgtaattacatgcaagttatagtgtaattacactacgattatactgtaattacatccgtcaaatttttgagggaaaatttatcgacaaatatatagcaaaattatatctcattcatatgatcaattgaccaccatatctggttctcttacccagtttcactttcatagcacgtatgagagcacgcttgtgctttgatgctttctcgcgttgacaactcgaaaacgtgtttatccatagttccatgcccgtatctccaaaacgtatttctgatttacgctttcaaggtgtgcagcgacatcaaaatatgtatatggttcagtgccttatttgaggcaaatatttttcatggaagaaagatcaaactgcaccacatctcattcacatgatcaaattaaccatgtctgaaaacacgcttgtgctttgatacttccccgctttgacagctggaaagcgtgtttctccatgaccgaaagggtccaatgtccgtatctcggaaacgtactttcgatttacgctttcaagaaatggaccaaataggagtccgggctcgagccactcgactcgaccgattcgacaccgacgaaagagggcgaaaaccatgggctcctcctcgagcaacggccggaccgcgcccgcgccgccgcctccggctgcgcctgcgccgccgcacccactccacgtgatggacgccgacgaggaggacgagaacgtgaagcagctcagcgagtgcgccgccctctacctctccctccaggcaccgattctctcccgctccctttcccctctccctcccctgcgtgttctcttccccgcctcgttcttagtagttgaggacttgaggaggcgaaggcgattcctgtcctgctgccgcgcgcaaatctcttcctgacttaacagtctctgatcttgctgttcgcttggatcctttgcaggattgcctcgtggagtccaaccgcagctggaaggcctgccaagcacgtaagcatcgcgacaaattcgtcattcctttctctctctctatagtaggccttggcgttcatattggtgaactgaatgagttgctgaaagttgctgattgcttgctcagattggaactgatcaactgaatttgttgtcaaatggtttggaattaggcaaaaccttggatttgtagtgttgtgttgaatacccaggataactgcctcatgttacatgtgaatggtttctggtttatcaagtgttaatgtaaactcaggaatgctacgaaattttcttcttcaaaagagagtgcttatggtatagctgaagtgaggctcacttgcttatcacattacactctcagagagaaaaggaaatgtggggaatttttcttgcttctttgggaattgaattgttttgtatgaaattcttgcatatagataggttcttaatggcatgatatggccttcaatagcttaaaacgtgctagaatgggagttagaatcatccaagataaatctacatgtgaatgtggtttagcttcatgtctttcctgaaactattctaaggcttcgtgaagttatgtctttcggcgcttctttacaaccatgcgcacttgtgcgatattactgggtaattttctagtaaaagaagttgctgatccatgaggcaatttgtacacatttggcttacctaacagctcgcaggcccttaacaagtaacaacagcaggcatgcagatccaactttgccatatagcactaatgtcctaggctcctagcactgcacaaagtttggtcacacatttgcatcctagttgctttccaaaatcgaataacttacagccacattttattttgtcttttggctgtacaattgctgtgatgaggttaatgtttgctcaagtcaaggggctagacctgagttgagatgttgcaattttaagatgccttgcattgtgatccgagctaaatgtagcatttctttgaggataaaagtatggtagctatgatagttacatccatatttgtttaaagttagtgctgtcttagttttccacaagctggattctggttttattatcgtaacattatctcactttgttctaacaatatctgtgttgcttcctttttatggcagatgttcaagccttgaaagcatgtgaggcaaagagaaacaaaagtgaaacaagataaaattattttgcaatatttggcactaataccaggcaagtagaaagttaatatggtttgaagagttttgaaatcaactgacttgtttcttcaaatattgcgttatggctgttgccatcagcatcgaactgaacactatgttttttcaccagtctgcttttggaaggtttatcatattcttcattgaggatggcgacaccataggcagcgtgtttagagctgttagctgatgatggagaaggtctacagcatcataacctggagttaacttgttaaaagaacctgtagttagatttcgaccgaaaggacacaggatgagctcgccacgttaactgaacttgcttgattgtttctggtggcagtcgctgtttcttcacattttcatgaaatgagacaatatcagcattacatgcgcctttggataactgctgatatgagttcatagcttaagattatcattgttgctgagatgcctttaggcttttccaatacctgttttggctttgttttggggcgcacatggttcgccacatcgtctatacaagtgacatcgtagcgacagaatcagcgtcttcagtgacgcaactgccattgcagaccgagaacaccaactcctgccattctcccggtggctttctccatcggatagtttcttccgtgttcaattatgtacggatatgaacttctctggttatcagaaaaaagtagaactggaagtgtaaataggttacagccaaaagttttcgacaatcatcagacttggtatttcgcattattgacaaaccgcagagtataaattgctttctgaaaaatccgatacttttttaataatcacaggtttactatgactgcgcagactgttctattgcgggcttatacttccatgctc

SEQ ID NO: 82871 - DNA, 12949 bp, Oryza sativa
cccctcctcgcttcgctttgcttgcacacatcgtgtgccattgtgccctcacaccgtaggcttggaagacacgagtgcgaccgaggaaaaccggtggatggtccgggctaacatggtattggtagccgcggcgtttgcttgcttgcctggccgtgccaaagggggacttgcttgacaagctcggtacgtagattcagatccgttgcttcggcagagggttcgttcggttgaaagcttcagaaaagaccctaggccgtggcgagggtgtgtgctcatctttgggataatctagtttttaggtttttattaaatctgaaagtgatgtcactttatagatgactagagtttttacggtcatgccttgttgccccatttggttgagctcgacagtacgggttggagcaaaagaaaaagaaaggaatgccgtttggtacaaatcctagtgtcatggacaagaacaggctagcttgtgtgaaaagaataactagtattgctctatgctagtatcataatccaagatcttgtaaaaaaatatgtctttcatcctaaaatatacttcagtaactactactactactgtatgataccattaactttgtcttattcaaaaatattatgtaatataatttattttttgagttgttttatcatttaaaactttaagcatgatttatatcttatacattatataaaatttttaaataagacgaatggtcaaacatgttttcaaaagccaacagcgttatgtattgaaaaatggagggagtagattagatataactactacaaatatgagaacaatgcgtagctgagctagcagggagctatcgggaatacaggttttttcacagttttcttctctcttaaaactgaatgctaagctcctccttagtgttccaacaaaagtactatgaatctagataggggtatgtccatattcatagtattaggttgtgtctcagtatctcaacataagtactacaatctagataagagatatgtctagattcatattattagattgtctaatataggatggagggaatatcttagaccatgcatttgcatgggttgttgatattaaatgcattgaattaaatttctgctgaaaattatatgtgaataaaaagaaaatggttagacacagggctgttcggctgcccgagctgcggctgcaccgcagccggcacgaacagtgccgcactcactgtgcgcagccgcaactgttgctatcggcctgccgaacaggcccacagttgcgtacataaaaaaaacttagaagccgtagtccctaggtactccatacttagccaagcgagcacttcgtgcagtgtaaaataggagtatgattattaccctctggaatcctaaacatgggtaattcgcgtgtgtttgtaggattgttcagagctaaagctatgcggtcatagccttataatcacttttgctgaacaccaggttccggggcccagatcttgttttgccaactgttacatgttgacagtgagataatgaatgtgtttggttgctggtcatactttgccacaactaacgttagggcaaaaatgacaagaaatttgagtctatgacatatgggacatgttattgaaaaaagtatggcaaaccacaaatgtagcagtgaaccaaacacatacctaacaaactgtaacagccaaaagtgtggccatgaaccaaacaccctcgaagtgtgtgatctgtgttaagctatagttaatacagaatgtttagcattggaaatacattgatgatccttattaagcatggaagtgatctatggttcttgttttttatatgaggtggcttgatagatgttgaactttgttttaataattgtgtacaaatactagtagataacattgcatattgaaacatgatatcgatgtatgtgaaatggcatgtgcaaaatttatatgcatagatatagatatgaccaagaatagcccccccccccccccaaaaaaaaacacacacaaagggtgtcaaagatgagaaatgacgtgatttttgtggtggcttcttaatagcaatgacgaataaaattgagttatctagtgattaatgagaagcaatagcagcatatatctaataatgtaaattagatgattgtaatttgatgaagcataggagtgattcagtctcttgtcttatggttgatgtggtttaatgcatgttcaacttttggtttttaactatataggacatatatatcgatgagctatacccatatatagtatttgtagagtatgttgatcgttaaaactagggtatacatgagatcaaagtaaaagagatggaagacaaggattattgcacaagttcgagccctttaagtaatagcactatttctgttggtcaaagccggtgttgactttatatatcagtatcacgcgagtataatatttaggaaaaagtacatattaccagacattgttcaccttaaacttctaataccggacgaattaccctctcgacccaatccagagcggtttgtcctacgtggcgtatgcatggcaatccagtcagcatttactttaaataaaacggtgggacccccatgtcattagtcctcttcccctctttctctctctcgggggagcgtggatgagcagtgggtggcagcggcggcgacgtgcggggagcgttggaggaggcgggctacaccgacgagtccgtcgccctctcgagctccgcgccaacagcgacgaggcgacggaagcggcggcgttgctgatgctcccttccccggcgcgcgcagtggggagggcaaggcgagcggcagaaggcgctgaagaccccaagggcagcggcgggcgtggcgtctcgagctccctcggcttcttccttcttctttgtggccagcggcgggcgacgagtctaaggggtgggcaaggcggacggcacgcgtggtagggagtgcgaggcaagcggcgctgaggaccccgaggccgttgcgcctgctcactgtcggtcggagtcactaccgaggaccccgaggcccgaggcgtgcttggcgtctcgaacaccctcggcttcttccttcttctccgtggctggcacgcggtggggagtgtgaggtgggcagcgggcggcgctgaggaccctgaggccgccacatcgatgtcctccgccgcgcctgcgtccgctcgcctccaagtacagagagaaagaggacgaagccacccagccatggtacccgccgccgttcgccgctgactagtcccctctccccgctgcgcttgcttgctgtcgaccggagtcaccgccgcggcccgcactcgcgtccgctcgcctctaggctccaagcacagaaagggtggtttaatatgacatgtgggccttaattttcttttatttctttttgctaattggatttccatgtcagcgccacgcgtacgccacatagcacaaaacctctctagattgagttgagggggtaattcgtccggtattaaaagttcagggtgtacaatgtttgttttttttggtttagggggataattcggttgactgtgatagttcggaggggagaggtaattcgtactttttcctaatatttaagatgtcctagtatagtatcaatcggcttggcggcatggagccctcacacgtagtcaacagctagtgtggtcttctttctcgaatataaacttgacaaaattgaatgtctagaactatattgacttgtcttccgatggtgtgtccctcttctcttagagggtattgtatttatagagaagatcattttcctctcaaagtagaactctgagaaatagaacatgatacgaagtaaggataccttatcttttctgactagaactccaacaccttctattccgggaagataatttctttctttatccaccatattttcttaatcaaaggataccttctcgtataccattaggtctatggtatctccgtgtatcgtaaacccatgtataggcggtatgccttatccttacattgacaatatggatataaagttgtatcatgcttaaactctccattaccgtgctctcataatgcacccctaacaaatttttaaagagacataaaccaatagcatatccctgatcttacaagggtgtgtttgagagaaaataaaagaagagaaaaaaagagaaatacacaaaatgagatgagtcattaacacataattaattgagtaataattattttaaacttgaaaaatatattaatatgattttacatcaacttttctatagattttttttaaaaaaaatacatcgtttagtagttcgggaagtgtgcgcgtgaaaaaaaaacaagacaaatcttctccctagctttcatacgttgtcggatgcttctttaattcctattaaaaaacacttgtttaatattcgtggacaccaatacttttaaaacctggtcatcctcactccacctctagaccatcatacgtgaagggtgggtaacgatttgtttgagcttgttaccttaatgagttaacttagagtgttaatcttaacgagccaaaacgctagctcggctcgactgactatctagcttgttaatgagttctatctcatttacatcaacctttataattttgaattcacaattttatcatatgttaacgtactaataaatagaaattaataaaggaattactaaaatagtttccacgtaattagaagactatgctagttaatacaaactaaggatatagacatatgataacgttttgtagtaacgagctaactcattaaactcagcttcgcttggcttgttatgaatgcgagttcgagccgatccgaaccatgagctttgatgtttttccttcaccccaaccggtactccattaatttgataatataaaaatttaaactttataattattaagttatgcattgatatgaactattttcatctgaaccggtacacgattcatgcacagattttccagggtgtctaattagtacatagaagactagagttatcataactaatgactaataaatataatttatttttaatggactagatctaattagatttattggttataggatatctgttgatctctaagtgcaccctagattccatccatataatttgcaatcaatatacgtacataaacatacgtcgaaaaacattaaacttttttctatataaaaaaacatggagccttactatggttgacaagcctggccgctcaccacagttagtggcgaaccacgaagtacaacgtcccagctccgttgtgtggtcacctaaatttcgtcatcaattaataatgaagaggccgattagcctaacatggctgacccattatttcggcaacctcgcgacctgcatgcagccgatcgcacgatcgggtcagtagattagcacccgagcttaaaattcataaatcgcgacgcctccgccttcgctgttacggctgttcgttcggtaggtgcccccaccacatcaacgacaagtcgacagctgcgctgtgcaagccaaccccgcgaggctgcgaccgatgcgggggcaatacgctgccccgcaacgcgcgcgacgggcgcgcgcgcggcccagatcggtgggcatctcacatctgggcctcgctcgaggttgctgccggggcgcgcgcggcggtaggtgtgggaggaatttttttatttatacatttttttattaaaatatttaaaaaataattttttgttttgaaaatttacaaatctaatcacctgccgctctttggaagggcgacttttaaaaatcgctcttacagtgggtggcaagggatctaattgcaaaatttttatttgtgttcagaccctttccactagttttaattgcttaaaaactaataatgcttattcgatactccaaatgattttaaatagaaaagtgataaactataaagttatagatctcatcaagatctacaacttttatataaattttatctccatctaatatcgtttgaaatgtagatctgagattttttttaaatgtgttttatattttgtaacaaatatttggatatctaaaacagcttaaatgaaaaagttgttaactacgaagttgtagatctccttgagctctacaattttgatataaagttttatttcatctgaatttatataatataattttaaactgtaaaatcataaagctaacaaattgtgctggaaaatttgcatttaggtccaaagggcggcaagcgattagatttgtaaattttcgaaacaaaaaattatattttaaatattttaataaaaaatgtataaataaaaaaaattcggtgtggtagcccggtgctgtggatgtcatggtggtggactggtgggccggagggcgacgggcgcctctgcgctctgcggacggtgtggtcgcgggttgggagtcgggcgacgcggaacgagacggagcacgacgtcctccgcggccggactgcactgcacgtcgccgtattgtttttttccccttttttttacttcataagttcagttttcagtaagagcaactccaacaacatcttcaaatctcactctctagatgtgcatctagccagcttgacaaaaaaaaatggatagtcaattctgcctttcactccaacaacctctctattacagttctccactccacctgtgggtcccacgtgtcagtctccttaattatttttcacccttcttctccgcccctcctctctctcttcttctcctctcatctccgctggccaaacccatgcgacggtggaggcgttgtggagcccgcgcaacggagatgggaaggcggcgacgagggaggcggttggccggcgggagcagccggtgcggcgagggaggcaatcggctggcgggagcgacgcttgcggcggaggccggcggcaatgacgacgcggcggagggacggcgctggcggcgcgcagaaggacgacgcttgaggagatggcggacggagagagaaatgggtaggcccatgtgtggggcccacgattggcaaggcaattttggctggccatctttggccagcgaggggagctgtttagccagccggatggtcaagtcatctagttggcaaggttgttggagtgtgtttttcagccaaaattgctaaattttaacttgaagagtgagatagccactctcttggagatgctctaactagaatatacttagagtaataagtaccggatcctacattaaagcaagctgaaaatttcacattttggtccttttagaaaacttattatacgaatagacccctaaaaaaacttattctataaatgatccttttcgcgactccaatgtctttggcgccgtagtccaacatgacggtgccaatgatgttggcgccgctcccctagtctctcaggtgaaagttaagttacaaatgtgaaggggacatcgccaatatcattgacgccgaggaccaaattgtatttttttaaaaaaaaaatttgacctatttgtgaatgaaaaatatttacaaatgggttctcagcgccagcttcattagcatcgagaacttatttgtaaatatttttcatttacaaataggtccttttcaaatttttttataaactggtcctcggtgccaatgtcattgccgctgtcctccttcacatttgtgacttaactttcacctgggggcggaggggacgacgctaacttcattggcgccatcatgttggaccacggcgccaacgtcattggtgtcgtcatgttggaccacggtgccaacgacattggcaccgcgaaaaagattatttctagaataagtttttttaggagtctatttgtaggataagttttttaaaaacactaaaatgtgaaaaagccagtcagcggctaatttgttatcaaccttatatatattggctacttggctaggacgccatgtcgccaggaagaattcttttttctgtactgcttgcattattcaaaaccgtggtcaactagtcattcaaaatttagttaaaacagcaagcaactacaaatgacacgatgccatggaagaaaatagttgacctacacaaggaaataaacaaaagatattatcgcggaaaaatgaatagtcaagaatgacatgagttgctgggtagtttaggctctgttctttgtatagctagtactagtattattgtgggcacgtttttcaagcctttttgaaatacaaatttgtatgtatattttgttaggaaactataggcaaataaacgataaaaaacaatagattaatcacagaagatgcgagatttaacgtggaaaaccctcccaaagtaggagagaaaaaaccacgaacaccagccagcaaaatatcttctatatatcggggtgaggttacaacgccaaacggcggcttacaagaggtgtatatatatatgaggtggaaccctaaaagggataacaaagttggcctttattaagtgcaaataaatttggatcacaactcaacatatgtttcttaaacaaaactcaaataaatctatttttaaatttataatagttaatactaaattgtggctttctttggtaagcaaacatggaccatgtgtaactgcagtgcagttagtggactgtaatttcttctcagggccgcttatttcctgggctttttttatttgttgtgttatgggctgcttctttgtaggtcattcactttgggagtaagttcactagacgtccctcaactttacgtcgagtttgtttcacatccttccatctcttgccagacagaccgtaagagagggggtgggggtgggttggggggggggggggggaatgacgggggctctggcctctggctcacgatggtcgtcctaagcctcagggtcgcaatctcatcagagcaaaggtaaacggtgatggagcttgttgggcctttgaacaaaattttcggcacagctgtagttgccaaactcgaacgaattatgtagggatatttaactttttatcactttcaagatggcgatagctaagaatttacactccagtatatgatatatggatcattatgtgtctatgatgtttgggttcaataataaatactccatccgtttcagcttataagacgttttgactttagtcaaactcaaattattttaaatttgactaagtttatagataaatataataatattcataatactaaattaggtttatcaaatcaataattgaatatattttcataataaatttattttgggttgaaaatgttactacttttttctataaatttgatcaaattaaagcaaatttgatttttactaagtcaaaacagccttaaagtcaaaaccgctctattgctgcttataagagtagcaaatatagttaaatacctcagttatgtcacgcggttcagcactgggcattggcagcaaccgagggaaatcaaaagttccggcgtcgaagctgcgcggctcacggatctgcttatatctgcggcctctgctgtaaaaatactcagaaaactcggcgaatccacgagcagaagcgcgggcagaacgtgctaaacaatggtcgcctcacctcacctgctccaattgtcaacgccactccccttcttccgcccgagctcaagtcccaatccgagagagtcgatcagcggcagctagagcagagcgatggccgcgctgctgggcatcctcctcgcggccttcctcgccgccgccgccgtcctttttgcgctccgcctgctccactccttcctgtgggtcccgcgccgcctggagcgccggttccgccggcagggcatccggggcccgccgcgccgcccgctctccggcaacgccgccggctaccgcgacctgctcgccgccgcccagtccgcgccgctcgcgtccttccaccacgccgtcgtggcccgcgtcgcgccgcaccaccgcgagtggcccgagcggtacggccgcccgttcgtgttctggctcgggccccgcccgcggctggtggtctccgacccggaggtcgtgaaggccgtgctgaccgacaccacggggaccttcggaaaggctggccccggcggcaacaacccgctcgcgcggcagctcttcagcgaggggctggtggggctcaccggggaggcgtgggcgcgccaccgccgtgtgatcgcgccggcgttcaacatggagagggtcaaggtaagaaggtgtagattgtgttagaaaaacgtgtcattaatcgtgatgcttatacatcatgttggcaacttatcgatctcgataaattacaatggatagattctcaaacataagtccatatgtaattatgtcagccttgctaaaatgttcattactcatttcttatatgtaagttgtgtcatatgtgaactcagctactctccaaggctaggatcctgtatagaactgccaaatttgctttctaacttctttctacaattctactaactttgatctaaatttctatggatgtatttacaatggaatggaatttatccctttctttacaaatacgatgtgcttacgtattgatttattttggaaatgaaaccgttttcttatacttatttatttacgacgcttaaatggcactacctgtcaacctgtcatttgtaaatggtagttttttttttaaacgaatacgatgtgttgtagactgttatcttggcgaataaaccttccctttctacgggtaatattctgatgtgatcaatacttcaagagttgcaatatgaataatgcattaataaaatggtttcccactaagataaaatttttattcttttcaggcttggattccagaaataacatctatcacctcatccatgctggataaatgggaactacaagatgaagtacgcactgagtttgagattgatgtaaacaaagaattccacactttgattgcagatgtaatttcctgtgtggcatttggaagtagctatgaggaaggaaagcgagttttccaattgcaagaggagcagctaaaacttgttattcttgcaatgaggactgtgtatatccctggcttcaggtgaggtacctctgtctcttagcatgcttttcaaacaccatgattgagggagaaaattgcgacatctttctctaataggtttgtcccaactaagaagaaccagagaaggaagatcgtaaaccaggaaatccggaattcgttgcgcaaattgattgagatcaatggaaggaagtgtgaggattccaacaatttgcttgggatgatgttatccgctagtaaaattgacagtgaattcaaaatgggaattgaagaaataattgatgaatgcaagactttttactttgcggggaaagaaacaacagctaccttgttgacatgggcaactcttcttctagctttacatcaagaatggcaaaacaaggctcgcgatgaagtccttcaagtgtgcggcaagtatgagcacccaaaagcagaaaacctgagtgaacttaaaattgtgagtccatctattttatacttcttatgttatctcatttattgaatgcagcaagtaatactttgtttaatgtttgaatgcaaccaggtaaatatggtgttaaaagaaaccctgaggttgtatcctccggccgtgtttctcaataagatagccaaccgggatgtcaaactgggcaaacttgacattccggctggcacgcagctccagttgcctattcttgacattcatcatgatgttagcatatggggtgccgatgcagatgagtttgatccatcaaggtttgcagagggcaagagctatcaccttggcgcatacttccccttcgggattggccctaccatctgtgtcggccagaatcttgcaatggttgaagcaaaggtggcccttgcaatgatccttcagcgcttcgcgcttgttgtctcaccatcttatgttcatgcaccaatgcttgtagtcacactccaaccccagtatggtgctcaagttcttgtccataagatttgagacttcgatggacctgtgtgtggatttctgggtttttgcagtaagtatggtgaacgatttggaaggatgtttccagctcgtctgaactttctatcagaagtggaatctgctggagccatgggagcattttccgtgtacaaacaacacttagtacctgcagaaatgtacagaaaataaaatggtttgcaactcttcatgtttttgccatgtacaaataggtcttacttgctgaaatgtagtaatacacaaaataaaatggttcggaattgttagtattccagtttttctctgccttatttttggatcatctactgcatatgttgtacattttagttgttgggaattgtttgtccggctgatcaggcatccccactatttgggctggtgaaatccatatatcttagtttttttagaactatatatctttagttaaaaccatttatccataagctccacctcatcctagtttccaagacaaatcaaaccaaaggatcttaagagttaatcaagcttttaaaagggaagggaagggaggatattacattcattcaagcatctaaataattagcacgaaccagcagcacataagcacatctaaagaattttccttcgaagtcagattcgattaaccacatctagatcacatcaaatcttccggacaatggtcttgtttggatcctccgggctaataattagccctctaaaatcttactatttagaattattaaacgtagagtactaacaaaacccattccataacctcttggctaatttacgagacgaatctaacgaggtatattaatccatgattaacggatgattactgtagcatcactgtagcaaatcatagattaatatacctcgttagattcgtcttgcaaattagcccgggggttatggaatgagttttctcattaatctacgtttaatactcctaaataacaagattacagagagcccggaggatccaaacaaggccaatgtcattctctctttgattgatctcctctcttacgaccggctccagatcacgggcacg

SEQ ID NO: 82872 - DNA, 18501 bp, Oryza sativa
tttttttttaaaaaaattgccctttcagagaacgttaaaggacgtaaatgtaagtttttccatataaattattaactttatgattttgcaattttaaaatatatcatataaaatcggatgaaatcgaaatctatattaaaattgtagaaatcaatgatatatacaattttatagttgataacttttttatttaaagtcttttaggtgttcaaatattcgttacaaaatttataacctattttaacaaaacctcataactatatttcaaacgacatcggatgaagagaaactttatataaaagttgagatctacaaaactgtagtttattacttttccatctaaaataatttagagtgccaaataagcattactaatttttgtgcaattaaaactaacggaaatgatttgaatacgaataaaacatttacatttagatccgctaacactctctggaaggaagatttttaaaaatgccctcatgtaaagcgtgaggcgtctagatttataaattggcgtctagatttataaattttaaataaaaaatttaataaaaaataaaaataaaaaaatccgaagcgcgacgtttttcgcagccagatggactgcacgtcgtcgtcttgttcttttttttccctttcaaggtccgactgatgcagtattgaagctggttcaaccaccaacattttagaaagatcctaggcgaactccataacataggctctcaaaactaagtataaacttgtacttgtattatatacttatataaatcatatatcgttgaaaatgatatgaatacacattgtaaacacctaaagttacgatgtaaatttatcaacaagaacaaaacaaactcatagctcaatttccagactaaatagatgcaaatgagaagatcataagacctcactctaaaccctagccacaataaaataagatgtggccacatgagagtcagacgtgagaacacagccagccggtttaggcactaagcaatcacacaaccagctggtttgggcactaagcgatcacacagctagccggtttgggcactaagcgatcacacaaccagcctaaggccctaagacgatcctgccaacccgttcataaggatcagatcctacataaaaacaagagtaaactgcactcacgatacacgaacttacgtggtgggtgtaaatagatataataacttgtaaattattagatcctacataaaaacaagagtaaattgcactcacgatacacgaaattatgtggtgggtgtaaatagatacaataacttgtaaattatgtattttagtataacaacttgtctagtccgtgagaaccaggccaaaacaatccatgcattcaaaataatttgatgtggcgttgacacggatgccatgtcgctttccttcttggctcgtttcagttcatgtttgcatctttttgcacaaaagttataaaatcgtaagcatggaaattttgtttcgtgcactctattacactcacccatccctgaaatagttcaatgcaacatggacctaaatcgctgactagctacaagtgctcagagatattggtggagggtcgattggccattacactaccgttttaatacgtggcaattagtatgagatattgctaacaacttgtatgagatgaagctggcagctacacttctgtcgttgatcagtctgatcaccagccactctagttgtttcagtcttagaaactactactccacggggtattacaggatatgtgcttcttccactactgcaacctccatcttcttgccattacagcggcgtgcaactaattgtctcctcaaccgcatagttccggtgccacatcatgttattttcaaatacacggactattttggccttaatttatatggactacacgagttgttgtactgaaatacacattttgtaagttgttgtatctatttgcacccactatacaagttcatgtaccatgaatacaaatatacaatttactctaaaaacaaggataatctgttgcgtggttgtccccgatgttaaatcgactacgatctaacgccggggctcgctctgtcttcttctgtataaatcatgcttgtttacggtttacataatgccctgacatttacatctgctcgttatatcctgataatactagaagatccatgcagttttttgagtacatactcgatattatctgctatatgtcttgccttctagaaaatatttttcaggaacaattatgcactcgagtaggttgtggtcgagtacactctattatcaagaacattctcgacaaatgcggagttatcgcacccgacctaccaacgaagaccgacgacctatctcatagcaccgaccctggctggactactcgagaaaaggttgttaacggatagttcctcgcaaacgccgtcggtttgatcacccgacatgattgcgagcggacatccggatatgctataagttgggtgtgtgagtcatgctggccacatgatatgcacatgtaataaaccaactttagcacccctataggtgattaaaagactcctacttctggttctcgaaccagtaaaacgtagtgatctctctcgcctcacttttaagtggtcgagttacaactactgcttggtcctcgaccagcgatgcagcgtttctcccactacttccactttaagtggtcgagttacgactactgcctggtcctcgaccagtgatgtagtgtttcttccactactttcacttcaagtggtcgagttacgactactgcctggtccttgaccagcgatgtaacgtttctcccactacttccacttcaagtggtcgaattacgactactacctggtcctcgactagcaatatagcgtttctcccactatttccacttaagtggtcgagttacgactcgaccactgcctggtcctcgaccacgatatagcgtttctcccactacttccactttaagtggtcgagtcacgactactgtctggtcctcgaccagcgatgtagcgtttctcccactacttccacttcaagtggtcaagttacgactactgcctggtcctcgaccagcgatgtagcgattctctcattacccctgcttcaacaaagttgatatcaggtgcacaagatcgccaagtgttttacccagagatcccttacccagatgactcctagcgttgaaacctatcctactgtccctttacgccgtcttgacaaggcctccgaggaacccgagagaacttcggctggggacgcccagagccgataaggccttgtcggatccttcagagatgaaagaccatgtaagatctggtcatgtaagagttctcgccgtgcgtattaaccaagccgtataatcggaaatggattttccaacttcacggctgggggctaggatcagtgcttgttcaatcgaggcaggtcaaaggtccaagagccttatcttctgagaacgattctccgacgacaaggctgggagctagggagagtgtatgactctacaaactgactgatcggagtcggtaagagagaggacgctcatatacaaagcaatggtctgtacattcaattcactagtctgtcatattataacatgtcaccctttgagcattcgctcgggggctatttctatctaatattttttatgagtattgatttcaggaaaattctatttgacattatcgaagactccatgtctctatggttctgcaccaagattgactaaggcgagtacgacaaatgtcgacaaggctccgttgcagactctacgctttctcgatcactcgagaacggttgctggatcttgacaaggaatacggaatgaagagatggtgtacccgccgagataaaatttcttgacttcaatccaaattctcaattacagcaagacaggagacttagtcgacgctctgtactttctcggttgacatcagagattgacttagacaaaccctttcggtgcccacacgaggctgataaaggaagtctaacgttatctctaaactcaccgagaacggtcacgtgagctcgataacagttcctccaaagtctgcggttgagaatatgaactcgttcatttgcatcgaagtcgggggctactgtcagggttatggataccacatacctaatagtagttgactaaatctcggcaggatccaccacataccatgttttatatggaaactgacctcgagggagttccggataaggaaagacaaccagagttctacatggaaacgacaaggactactcggattgcatccatattggtttccctagttctacttggacaaggggacacctatgggtataaatacagggccccctgggaggagaggggacaacaatcatgggacaagacaatcaacacctaacgggatcaacacccaacacaatcaacatagaagcctatatacaccaagacacgccgccggatatcgacttcagggataagcaaggctaataccctacggtgcctccggatactgtcaggagaaacgaaagcgctatctctgatctcgccggacacggattcgaggaggaaggctaccctgttgtcgactacgagtcaaatcgtcagaccgccatgtcgacaacagttagattggctaccccaaatattgtactcgtgtgattatggtgaataagagcaataccggcctcggccaacaggatgtagagttattacctgacaattcaggggcccgaacttgtataaaaatcactgtctccatctcttttacctcagtcttgcgtatatcctaacaccgacgatccccataccatgcaaataccaaaattgcgacatcaaacgtcgatagctataagtcagctgcaaacatattttaagataaatgaggagagagaaaagcagcgggctacagatttgtatccagctgtagcacagactctaagacacagcgtgtgtatgacaggtgggaccatgtattaatagtgtagtatataactattgtataaataagctattagattagctatagataaattggagctagtagttgactatattattaaacttgctcttatggcagctgtattaccttcgtctgacttccggctcacggatctgtccatatctggagccgcctctgctgtaaagatactcagataactcgccgaatccacgagcagaagcgccggcggaacgagctgaacaacatattgccgcctcaccagtcactagctcctattgtgaacgccatgccctttcttccgctcgagctgaagtcccaatccgaggagaaaaaaaaaacaaattaatttttagagatgcaggcaaagatggaacccgggcaatcacctcaatgaatgcgctgaaaaatccttcatccaacgcttaaaaacagggccagtatgggtggaggagctacatgtgttcacaaagaaactattgccaacgttctaaaatacttatcactttgagtttttattagtaactagctgggtggcccgcgcaattgcacggctagcatctatataaaattatatattttttaagtatgattttacttaaaatttattaaatagttatctcgttgttttaagattttgaaaaaccaaaccttatcatcgtcgtgtttctaattttgtagtttttaaaagacacatcagttgctaccccttacttatgtcatattattttttattagcttgctcgatctaccgctgtttctatttattctccttggaacttttaaaaattggatctaaaaactattagagttcattgtcctgttgggcttatttttaataatttctagaagtctcgtcaaacgctgctattatattcctctacaactgtccactgcatcttctctttattatcattgctattttaaaaattgaacataagtatcatttaggttctttttttactttctagaagttccgccaaaatatcaactcctttgtcactgtactcctctacggctcgcccgctgtcgcccttctttattgtcattgagattttaaaatcaaacatgattatcattggggattttttttactttttagaagcccgtacatttgaaaattgaaccttatagtttttagagttttgttgtctcgttgggttttatgttttttataatttttagaaatcctatcaaacactaccatatactcctctacgacccgtccgccgcataatctttattgtcattgggattgtaaaaatcgaacataactatcgttggaattcattttttactttctataagaccgaccaaccatcaacggctctaccattgcactcttatacgacccgtccgttgcctcttatttttattgtaattgagattttaaaaatcaaatataattatcatagaagtttatttttttactttctagaagtccccgccaaccgccttgactgattacttcacgacctgcccgtcatatttccttttaatcatcaataggattctatttggtgttttattagtagtttttagatgtctcatcaaccgccaccactctgctcctctataagcatattacttaattaatctcatcatgtgttttagatggtcttttcttttaatagtcttatttttttatcaccaatttcagttatttataaattgtattcctagttgaaatcttttttttcctaatttcagaatttattttatttattattatgttattttgatttttgattttttattttcaattcagttgtttcaaaattatattcctattttttattccgaatattatttaatctactattgggttcttatatgtacttttatttcaatattgcttaaatttaattcctaatttaagttaattttaaattgtattcctacgtgaactcttattttcttttattttttctaattttgattttttatttttttattatgaattttaattaatcttgtattggattcttatatggactcttctttcaatattttttatttttaattccgaattttaattatttataaattttattcgtactccaactcttcttttttctttttctaattttgaaatttattttattattatttcgaattttaattaatttctatatggactcctctttccatattacatatttttaattccgaatttcagctatttttagattgtatttctacttgaagtcttcttttctttttctccgattaatgtgggaatttttagcccctaaacgaacgtggtgcctccttttaaagctgttttaataatataatagatgtttcatcattagttttattcagaaaactataaaattattatttattttctttgtggcttattattattaaaattactttaagtataatttgttttatatactccctccgtttttaatagatgacaccattgattttttctcacatgtttgaccattcgtcttattcaaaaattctatacaaatgtgtaagatataaatcacacttaaagtactatgagtgataaaacaactcataataaaataaattataattacgtaaattttttaaataagacgaatggtcaaacgcgtgagaaaaagtcaactgcgacatatattaaaaaacggaggtagtatttgtactaatttttataagatgaatggtgatacttcctccatactcataaagaaagttattttggacagcgacacggtctccaaaatataattttgacttcttgtttctataaaaaaatatatttattgaaaagtgatatatgtattgaaaagtttatatattttttttatactagagggagtacgataaaaaaaaagcgataactaatttatgaggaggtagttcaatccaactttttgaagaatttaatccgagagagtcagcggcagcctgcagcagctagagcagagcgatggccgcgcttctgggcatcctcctcgtggccttcctcgccgccgccgtccctttcgcgctccgcctgctccactccttcctgtgggtcccgcgccgcctggagcgccggttccgccggcagggcatccggggcccgccgcgccgcccgctctccggcaacgccgccggctaccgcgacctgctcgccgccgcccagtccgcgccgctcgcgtccttccatcacgccgtcgtggcccgcgtcgcgccgcactaccgcgagtggcccgagcggtacggccgcccgttcgtgttctggctcgggccccgcccgcggctggtggtctccgacccggaggtcgtgaaggccgtgctgaccgaccccacggggaccttcgataaggctggctccggcggcggcaacccgctcgcccggcagctttttggcgagggtttggtggggctcaccggggagaagtgggcgcgccaccgtcgcgtgatcgcgccggcgttcaacatggagaggatcaaggtaaagaggcgttttcttgaaaatgaccttagaaacatgaaaatggatgattatcgtgcttgtagatcatgttgggtacttcccgctctcaaaacaaacgacttgaaattattgtaactctaaaacatatgtatgtaagccttgctaaaatgttcattatttcagttcttagatgtaagttgtgtcacatgtgaaatcagggagtcagggactcctaggctttgtgtctgttacttcttttctactgacgttgatttaaaattttatttacacatctacaatggaatgggattcagactttcttatataacaatacgatgtgtattggttgatttttgaaaaattaacctttttatgcatcttttgtaagacataaattgtaagactctcggagtaagttcatcaccttcctgtagactatattcatggtgaattaacctttctttctgttagtaataatatatatatgatgatgtgatcaaaagttgtgctctggatatttctactaatcaaatgaattgccaataagaccaaagttttgttcctttcagggttggatttcagaaataacagctatcacctcatccatgctggataaatgggaagttcaagatgaagcacgcgctgagtttgagatcgatgtacataaagaatttcacactttgattgcagatgtcatttccagtgtggcatttggaagtagctatgaggaaggaaagcgcgttttcgaattgcaggaggaacagctaaaacttgcaattcttgcaatgacgacagtctatattcctggcttcaggtgaggttgcctctgcctcttagcttgcttggaacccataattttcaaatgccacagttaagggagaaaattgtgacgtctttctctcataggtttgtgccaacaaagaagaaccgacgacggcatatgctaaaccaggaagtcaggaattccttgcgcaaattgattgagatcaatggaaggaagtgtgaggattcgaacaatctgcttgggatgatgttatcggccagtaaacttggtagtgaattcagaatgggaattgaagaaataattgatgagtgcaagacattttactttaccgggaaagaaacaacagctaacttattgacatgggcaactcttctcctagctttacatcaagagtggcaaaacaaagctcgcgatgaagtccttcaagcttgtggcaagtctgagcacccaaacgcggaaaacctgagtaatctcaaaattgtgagtccaagttttgtatactttggttttcatctcttttataattttattgaatacaggcatacagcaagtgacacttttttaatgtttgaatgcaatcaggtaaatatggtgctaaaagaaaccctcaggttgtatcctcctgctatgtttctcaataggatggtcaacagggatgtcaagctgggcaaactcgacattccagctggcacgcagctccattttcccattcttgacattcaccatgatgttaacatatggggcaccaatgcagatgagtttgatccatcaaggtttgcagagggcaagagctatcaccttggtgcatactttccctttgggattggccctactatctgtgtcggccagaatcttacgatggttgaagaaaaggtggcccttgcaatgatccttcagcgtttcgcgcttgttgtctcgcgtcctatgttcatgcgccaatgcatggagtcacactccaaccccagtacggtgctcaagttcttgcccataagatttgagacttcgatggatttgtgtgtggatttctgggtctttgcagtaaatatggtgaatgcagcagacgtacatcgtgtattatatatctttgtgaacaattttggaaggatgtttccagctcgtctgaactttctatcaaaagtggaatttgctggagccatgggagcattttccatgtacaaacaactcttaatacctgcagaaatgtacagaaaataaaatggtttgcgattgtaaatattccagttctctcctttttatttttggatatccactgcatttgttgacatatttagtttacccgtttgataaggcacccatttttgctggtgaaatctatatatcttaaaaccatttgtgcatgagctccatctcatcctagcttaaaggatacagcacctctggtttacgcgatggcaaaaaagaagagtgcaaacctgcagcaagcatcgcattccgaccaatgattggcggaccttgacttgcctgctgtctcagggtggacgacggatctaattagccaactcgtcgacgtctggggtgttgttcatagcttacaattaatggagaacaaagaagacaagatcacatggaagctaaccagccacgacgaatacacggcgagatcggcttacaaagcgcaacttcttggcacaacaacgtccaatttcaatgccatcatctggaagtcctgggggccgcgcaaatgtaaaacttttgcttggctcgtcatccaaaatagaatttagacctccgacagattagcgatccgtgggtggccgaataactccatttgcctcctatgtcgaaggaatccagaaacaaccctccacctcctggcgggatgcagatatgtgagaagagtttgggcggcacttgcggactggacgctatgtgaacagataaaatcaacacagtggcatcaagcctcaacactcttcgagtggtgggaggtcaccgcatgctcaaatgaagcaccaaagaaccccctatgccgaaggaatccggaaacaacccttcacctcctggcgggatgcagatatgtgagaatagtttgggcggcacttgcggactggacggcatgtgaatagataaaaccaacacaatggcatcaagcctcaacactctccgagtggtgggaggtcaccacatgctcaaatgaagcgccaaagaagaccttgcattcgctaatgctgctagttgcctaggagatttggaatgaaaggaaccgcaaagtcttcccgcatcaggagctcccggcgaacagtctagtagccaaaattaaggagaagaccagaacatgggtcttggcagatggcttgcattctaggccgtgtttagttgcaaagtttgaaccccaaaaagtcacatcgaacttttctacacacataaacttccaacttttacgtcacatcgttccaattttcttcaaactttcaattttggcgtggaactaaacacacccctagctttttcgggccaaaggccttgaatctgtattttttttcttttgcgcttgcgcatgtacagttttacttcttctctatttaatgaaattggcagctcgccggttcgttcaaaaaaaattctcatcctagcttccaacacaaatcaaaccaaaggatcttaagacttaaccgagcttttaaaagggaagggaggatattacattcattcaagcatctaattaattagcacgaaccagcagcacacgagcacatctaaagaattttcctttgaagtcaagattcgattaacaacatctagatcacatcaaatcttcccgacaatgccattctctccctctccgacgaccggctccagatcacgggcacgcgccctcgcttcgcgccaagctttgcccttacaaaaacggcagggaaggcaggcggatcgaagcagaggtatgtacgtgcgcgggccatggccttgacggcgccattggagagggagggagagctagaggacgagatgaatcgatggaagagtcgtagagagacagccgcacatgctaatccccttcttgctgaatgcgtcgcgcgatcgcttcttgctcgaatggtgttcttttggctcctcgtcgtcgatcagtggaggcccagcaggcgccggagctcccgcgtcgccgagtcgtccacccctgccgccgccgcagcggcagccctagaggacgacgaggaggaggagaaccgcggcaacggaagcgcccgcggcgacggcgacatggacccgaacgccggccccgcgtacgcgtccgcgcccgcgcccgccgccgccaccttgacccggaccacccgcgtcacggctggcgccgcctgcccgccccgcggccgcgcgtcgcgccgccgggccgcctgctggcgcggagaccgcctggtggcgtggggacgggcgcggacgcggtcgaggcagtcgtgcaggcggagcacctccgtccccatggcgcgcgcgacgcgatcgcgagctcgcttgggtttgggttgggtcgtagcctacgaagcggttaaacggtggtggaggaggagggtggggttgggtgaagcgtggtggcttccaccctctctcccggcggcgtccccgcgcgctgatcggtcgcttcctctacgatcgcctggtttccacggcgtgcaacggtggcccccgcttttaagtcaccccccgctttcttcccgcacaaggcggccgccctacccccgaacggacgaaggcgcgggcgtcgtggaggcagccatgggaagaaaataaacgcggttgcgtcggacgcggggagatcatgcccggctgcccgcgtctcgtcgcaggtcgcaactcccgtgcgcgtgcgggccgcgagcgcgaggtccagactgttcggcgcgaaccgggccgtgtttcactgtttcccaatgtctgtgaagttcaatttaagtctctaaatttcatatctagtttaaattgtgtcgttgagaatcgaaatactactagatatacctcgtccgtaaacttgcaaaaccggtgtactcgacgccctaagctgtatagtgctcggttctagtcaacgtggcgagttgactacggtcaaccatgctaagctagcatgggatccacatgggggcatgttagtagccagctcttcttcctcctctttccccccttccttctaggctgggaggctggcggtggccgagaggagaatggcagcggtcgcgacgccctggaaggatggcggacgacagggagaggggcggtggctgcggcggactagaaaggctcaagcttgaactggagccatgcctaccctcgcggagctcatcggcaagccgcatcatctttctctccttgtcgagctcctcctacgcaatcttagcctcccgtatcatcttcaccgcctcgccacccctgccatccatgccgccggtggcaacgaggccgctcctcacaagctcgtcggacagttgctgcgaccctactagtccgccatgaccgttgcccctctcctcgtggggttaggtcacttaggagtatgtctctctccctgtccggcttgcagcatacacgtatccgcgctttgctcgcctgcgtgcactcgccaagcgatgactcgccctccctcgttgaggccacgggtgctaaagcatatggtgacgccttcttcgcacacctatgtcaccaccattttcgtctccacctcaccactaagcacatccacctctgttggttgcatcgacgtcgcttccctagctcccgtctctagtccggatcctattcctccttggagaccgaagctaccgcaaccattgctcggtggttagcgagcgtggagctgtcctccccactttcgcgtcctcgttcgccaccacagccatacttcgcatggtgatgtcttctccttcactcaccgctaaactcagtgcaaccgtttctaccctagccccggccgccgctctcatagaggtgaaagttcatttacatgtaggtcccacatgttttatgttttttatttttcttttactgattagcatgccacgtaaatcaaaacaacaatccatagtgttttaagtatttttatttaatacgtgagatggagtacaaaaacgagagatgcaaagtgaacttgctaaaacacattttctggttgattacagtcgcttgttgagccattggatcggtcataggattcgtgctagcatacttaattacgcgtaactagttgtgctttataggttacaggtcgctaattagcggtctactggagaactttgctactatttttttcttcactgcatgcactcgatcaagtatgagtatttgtaccgaccagcgaaacacatatgtaattaaagtataaatatgtaattagtatatattagtagtatatttagacagtagttacaccctacatacacaccacttacatatataattagtatgtaattttgtaacttacatatgtaattttagtacttacatatgtaattttgagacttacattgtaaatacactaaaattacatatgtaatttagtaacctacaatgtaaatacatgccgactaacttttgatgaaaaatatggtgttataaatatagctactcccgaactttattccttctctgtgagatatcagtggaaacgctcggtggaatcgggggagtatttgggagcacgcgccgacgcgcgcgtcgtgcgtgccgtcgtctttgtcgcggtggagcggagcgcgcccacttgcgcgcctgggccggaggcgggcgcgccgggggttcgggaatcccctggagccacacgtaaaggcgcgggcgggagggagggaggggccagctaggataaggcacgcgcggccgctgcgattggggcgcttgtgaacaccggggcgccacgtggagaggacgttacactccagccgccaaatttccactcccacacccgcgctcccctcccctctcttttccgtgatcgcacctcgcccacgcgccccccgccacacacaatctctgcagctctccagcttcgttggaactcgcgaatctctctccgatcccaggtaaagcagcgaacgacgtcacgcacgacgctgctcggtggatttcgttccttgctggggaaaaccatgcagagacgaaggtgaatgatctgcttttgtgtacttgcgtttaccaggtgaagcgcgagcttggagttggaggggagatcgatcagggccaggatgccgtcggtttcgagggccgtgtgcgtgcagagggcgagcgggaataacggcaggaggtgcagagatggggcggccgccgccggccgccgatccgtcgtggcgcagagagcgcggcacggcaagccggaggtcgccatccgctcggggtccggcggctcggcgcggggcgggcattgctcgcctctcagggcagtggcggcgccgatcccgactaccaaaaaggtaaaccgtgcatgccgcagctcctcgttcgttcgttggctcgcgcgcgcgattgctgtgtttgacacaccgttgactctcgatcgtgcgagcatctatcactcactggttcgactcgcatgcgtattgacgtataggagctcggaacacaccatcgtatagctcacgaggtagcactgtagcggggatatgcgtggttggccagcccattgagccacataaggcccatttttttctacacacttgaattcaatccggccctatggttggcactgtctctcatttatttatttactcctttatttagaggatgcgcagatgcatgcgttcaacatcttttagggacggagtacatatttagattcacacgtgtgatattggaagtgcgggcttgtgtgacgctgtatccttgcactataaaaaaacatctctgctactagtaggtcataaccggcatcattgttggtttttaaactggcagtgtgctaccgacaatgatacgattggtttagggtgtgaaccaatagtgatatatggagcataactgttaattctacttacaaacaaacatacagtgattttgaacgctccaaaaatatatatgcaatgccaatagatttgttgatttgcattcaccgatccaacaaacaacttcatttcattcatcaatctaacaatcaaaagtttgtaacaaattcacttcatttcaccaatccaacaatgtggtttcattgattgatcaacaatagaataaagtgtaactttggtgtgatgaacaacagctagcagaacaatttctttccagaaaatttttattgcatcatgcagcttctaaaaatagataaaagattgctcatgcatctcttctcctcatcaccttcaaagatgtagaaggtagcagaggagcacatcggttgataataatgtagatggcactgttagttgatgttgttgagcttgtgtccctgttggcaaatcaagtaagcacaacccccctcccccccaccctccataggatttggtccaagcttgggatgaccagatataattccacatagcctcatctctatcgcatgttgttgttaaacataccatgcgacgtccgcctccattgctttgtaggtatttgccgcgttggacagggaccgatgtcatcgagatccactcttaatcctgagagtatgaaggcatggaagggggcctccaccaccacctgcctaacgagattgaggtggtggcctatgggctagatccccctccccccttccaagcagcaagctcgtggcatgctatccgatcaaaggggagcaaggcggtggccccttgttcggagagtaaggaagtgacggcacatcagttggagggtagagagacggcacactgtgcatgaggagagagggagggaaaataccaacagtggtactatcattatcaatttatatcctaaattatttgtaaaaagagtacaactacatgttctaaatgagataaacctgcagatattggaaatgatgcatttaggtccacatgatgtgatgatagttgttctttgttcagtttggttagcatacagatagatatcgacaatatttttttaaagataatgaaagctacagccaattatacatacagaagttgctagtcaaatcaccgcaaattacaagatcacagcttgacaaaaacaagaaagcaacttagaatatcaacctaaggacatacacataaaacacctattgctaaaattcatttatgattaacaagaatctgtataaccaagggtagagatgggagaagactgctagggctgcaaccctactcttaagtctaaatatccattagaattgcactataaaattaaaaaaaaaatgggacaaagttatgtaaattatattagctgagccctaagcttagaagaattctggttctaccatagcataaccatttgttttggctaccaatgactgtttataaagattatcatcgattagggaaaaaggaaacaaaagtatgcaaataaatgataataaatcaactctctagttgagtagctaggctcataggtgcaaactgctgaaagcttaatcattccatcatttggaatcttgggggtaagacaaactgtaatgactctatctatatagagctagtgactcccaatcaatttggtaggctttctagttaccttagatatttctactttttatcatgcacttcacagaggcatctcagattctggattgccaagcccatggtttcaccaaaaccagaaaaacagatacagttatatgcaaagattttttttttcatcagtcccagactcccagtacatcaagaatgtgaacggaatcgagcctggaatccatggtgagacagggaccgaattcatcttagcaatctagcaacttgattaagcatttaagccggtaagctcgaccattaggcaagtggacaaggttgtgatcacgcaagtaaataaaaactataggatttaagtacttttcgccgcggctaaatccaagtgatcacgggccctttgacagcaatctagccaattagcacggaggtgtatcaacacatgcatgaatggaatatatttctccctggtgcagagaggttcatttcacttggcatcatcacggacctaagcaaacattaggggcatatgctacgaaattcttgtctgtccatcaaatgtttggtagcaataatattcccatgttcactcgtgcatattgctaattttgttgttttgttgacgtttaactcaaatcatggtttctataagttacttcatggtattttgaggaactaccaaatcatggtgaatcatatatgatcgaactaccaaatcggccgacagtgcaatatacatggttctgttctctggttttgcccctagttcagcccatttctagttagggcataaggtgttttcttttaaaagaactaggtgattctccg

SEQ ID NO: 82873 - DNA, 678 bp, Oryza sativa
tcctgcagcccagaagcattaaaaaaaaaggaggccatacggcggcatgctgttgcctgttggtgcactgcataatcccagtttcctcgcctgttcagtgtccccggcccggaaagacggagcctcgcgccgcccagatccacacacatatgcctctgctgctgccttgcgaggcgcgatcaagcctagccacacgccgaggcgactcgacgcgaggcctcatccgggaggaacacgtacgggtccgcatccccttccgcgcgctcgcgctgcacagcacagcgcgtgcgccgagagcgacgagggaggaagccctccccacctcaccaccacacaaaacccgcgctaatccccccgtggcggatagcggataaccagaagaaagacaggaggactcgaggagaggagagcgtgcgcgggctgcgatgatggagggggaagtggtggaggaggaggaggaggaggaggtgacggcggcaccagcgccggcggcgatggtggcggcggcggagttcgggctgaccgcggaggtgatggcggtgctgccggaggacccgttcgagcagctggacgtggcgcggaagatcacctccatcgcgctggcgtcgcgcctcgggcggctcgaggccgagggcgcgcggctccgcgcgcagctcgccgagcgcgacgccgcggcgg

SEQ ID NO: 82874 - DNA, 7672 bp, Oryza sativa
taatacgctatgacgacaatgcagcggttatcattgatcaaaaaggaaatccaaaaggaactcgcgtttttggcacgatcgtcgaggaattgagagaattgaattttactaaactagtttcattagctcctgaagtattataaatactagtagacaagatatagatcaaataaaaattagtagattgtgtttcacgtatatgctttagaatccaaaacgaaaagaaaaaagagaacatgttgattatagaaaaattaggaggaacctagaattagagtcttatgggcaaggacactattgttgatttactaacctctataagaaacacagacatgaataaaaaaggaactattcgggtagtatctacaaatattaccgaaaacattgttaaaatacttctacgagagggttttattgaaagtgttcggaaacatcaggaaagtaatagatatttcttggtttcaactttgcgacatcaaaagagaaagactagaaagggaatatatagaactagaacctttttaaagcgtatcagccgacctggcttatgaatttatgccaactatcaaggaattcctaaggttttggctggaatgggaattgctattctttctacttctcgaggtataatgacagatcgagaagctcgactaaacaaaattggaggagaagtcttatgttatatatggtaatcgccccacctatagttatagtacccaaattctatcttgaacttcctatttttcaaacaaaaatacaacatttttttatttgaaaataaaaaaagaaaaataggagaaaaaaatatgacagaaaagaaaaataggagagaaaaaaaaaccccgagagaagcaaaaattactttcgagggtttagttatggaagccctacccaacggaatgttccgcgttcgcctagagaatgacaccatcatcctgggctatatttcaggaaagatccggtctagttctatgcgaatactgatgggggatagagtcaaaattgaagtaagtcgttatgattcaagcaaggggcgtataatttatagacttccccataaggattcgaagcgtaccgaagactcgaaggataccgaagatttgaaggataccaaagatttaaatggttaggtttttcttttttttttcagggtaaaaaattcaaagttctaaaattcaaacaaagagacttattttttccaaaagagtaaattcatagtttaagaaaggaatactccctatacatttgtcgacaaattttctttttgacaaattttctttttgacagatgtaattataatacaaccgtagtgtagttatactgtaactcatatgtaattacactgtaacttgcatgtaactacagtgtaacttatatgtaagtttcacgtaattttgaatcgttagatctattataagatttgttctggtgaggaagaaaaaaaatcacatcatacacatatgtgaaagaatttgttctcacaacctccattttaccgaaataaatgttatggagagatttttaaaagttacatacatgttacattataattacagtgtaattacatgcaagttacagtgtaattacactacgattgtactataattacatctgttaaatttttggtggaaaatttgtcgacaaatatatagcaaattcagttgcgaattgtagccccaagaacgaagcagatgcaattggcaaccgtttcatgccagcgcgcagacatatatgatctactgggaaaccataacaggttgagagatgcccagttcctagtcaacactaatgttgacaatttaaggtacatctacatagcaagcttctttacactccatggatgtacacgaaactaaatctaggaaaaattcatcgcatgtagcgtgccctccaaaattcacttaggcaaaatttgcagttcaaatgctccttcgttcaggaaattgttcactctgaccgttgcagccatccaagctgtgtagaaatgaatcttgttaaacatttgacaacaaaactggctgaatattgaaggagcagacaacatttgacatgaggaaataccttccaagcatacatcacaaagaatgcaaccgtatctgctgaccagacaacagcgaaggatttcacgaagaacgggataatgacgttgattagagggaccagtagaaacaagtagttgagagcctctttctccttacttgagcagtcacgggcccgaagagaaggtatagctgcagaagtaggtagttgatcagttacagcatcacagaaaatgtatctaattcattgcatccattgaatcttattaacctcaacagcgacacagcatctagagatcaaattatgttcattttatcgacagcctcagattaataattaatattgagagacagattcactgttaattactacttgatatgacaacctcaaggatttttgttaaaggttggcaaagagaaggatatttcatcatgtttttccagtcagcatatatgcatatatagaacagctaaacagacaccgtgctagaaagaaaataaattctcagttgctcttagaactattctttatctagaactggatgaactgcactataaagtttatggctagtgaagcacgaattaaccccttgtgccagttgattcaaaatgttgtagcacaagagcactttcaatacatttttagccattgctgcttacgaaaaaagagcaagggcttggttgatgcatggatagatcataatccttgctgctgatgggaacaatttacaaacgtataaacttactgcacaacgacaagtaccacaaatcaaattcttacttactgaacatccagatggaccacattcccatcagcctccaaatgtccggctcattcgacgggaacacgagattgaaggaaagggctccacccaacagcatggaggcatatccctggacctcaaagatagtgtacagagctgttccaggcactgcagggttctttgtggcagtggacgcccttggtgcaaacgttgctgcggtcttctgaactgcctgctcaagaacacagcatagttatttggtggtgacctcatgaagtcatgttgtttgctgtatcagcaaaaatctttagcatttctaccctttaaaataacattttgagtttctttgtgcatatgggcctacgaccaaaaactagatgtatgctaagagcaggtacaataccaggctataagccagctatacacatattttaaagagataaaagaggagagataagagtagcaggctacagatttgtagccagttacaatacggactccaagatacatatgtatatgacaggtgggactaaacattaatgatgtagtacatataggtaactattgtatgaattggctattaaattgactatatataatttggagccgatagttggctatactattaaacttgctctaaagttaaatcacctattagaagactacaacatttctgatggctcaaattagtttcttcctgcaattcattgtactaggtttctatcgaattgtgaagttttcaagtgtttcgaattcttacagttgcctagtattatttgcaacaacttatgaattatatcgaacaagctgaatgggaaactgttttaaacactcgggtggacgtccacccgagagattagataccatctcctgagctgaatgcttagttcttagaccaagggacaaagaaaagagccgaccttcttgagctccttctcaatcttgggatcaacaggagccggcttcttctccgccgacgactcagcggaagaacctccgccactggccacctccccttctttgctctctcccacagcggaagcctcggccgccactgcaccagcggcggcaccaccaccgtccgagccatccgagctcgcccacgcaagaaccagcctcgccggcctcctcctcctcctccccgcgaatatcccgccggggacggtggccggcgggaacgcggagctggccgcggccgcgaacgcgcagccgctgccgagagggctgtacattgttcgcgcgaggtttttcttgtggggagggagaggagagatggtggaagagatggggaatggagggtcgtcgtccgtcctcccgccttcggtttgtgccgacgtggccgcggctgcagcttccgtgtttcgcagagaagcgtggacgttggttggtcgcttcctatagcagatagtatctcagccgtccaatttatttagcggctcccttcttgtctcattaccgttagcacattttacgaactattaagctatatgttttgttttgtgtgaaaaaattctatataaaagttactttaaaatatcaaatatatatatttgttaagtttataataattaaaacttaattaatcatgtgcatgtaatgagaaagtttttgtacaaattaatttagctattagcacatgattatttaagttttaattattacaacattaacaaatggataaatttgatagtttaaatcaacttacatagaaaattttcgtatgaaacacaccatctagtagtttgaaaaacatgctatcgaaatcgagataaaatatgaatcttaatgagaaaataacatgtgaaaatatatcctctcttatgtccgcctctctcatattgtcatacatgagaacactctcattcaagttgtcacccttgtaagcttgttccacaaggaccacactctggttcaatttccgcttattctctcttcccccgcgcctctccttccctattctggacaaggcaacgctccatctatatatattgtccctatcgaccgcctctacattggcggcgcttcggattaatcccattctatcacacccagaaatttagcccaaatttctagactattttgtgtattaaatccctatccaggaccagccagggtacacaaaacgacaagtaataaacagttccaaacgtaaataaagcgtaaaatacttacaggagaggcacttagtcctcacaccgaaacaaaagcaacggcagcagaaaagacgatcctagcggggcttcagctccactccacaggcaaaactcaactggggtctgagtcttggtcctctaacttcgtcttcagctcagaagcactacacttctgaaaagggggaataatagcaaaggctgagtacaaccaccgtactcagcaagccacaccaatgatgcaaacgtgcaaggggaacacaaggacggtttgtggctatttgcataaaggcggttgtaaaacattttattgagcaaaaccgtaaaactattgagtaattaaagtaacattaaatcttcactgatcaacactacaccacgttgaacaggcccaaccaacccatctgaactacagtgcattgagtcgatttattaaggtgggactaatcacggtgaatctggtcgactgcccataaccgcaggcacggctactcgaatagttttactctgatcagaggtgtacaactgtacctacaagatacagccccacgacacgtttccgtgcgccgacatgccaccacgacataccggaaagaggtcgtgacaggacccttcacataaccccctctaaccaagcacaccacacctcaggtttcacccccactcctcgcaagatagcgggcagtcccctctcgtgcctaggtgaatccggaagccgcataggccgtcgcaggacccatccaaactccatcacgcccacccttgcctggatgcgtcagctagaggaaagctacactacaagcccagccgttgcccacgctggcttatggtaagcatgataaattcttccagggtttcccgcgaaccggtccttaatcgccatgggcacgactagcaaaaccatgcacccacagcccaccatgtagtcgcattttagttggataattacgaccatgaagtatggctagatgtcttgagcacgcagctcattctgatactaaaaagatctaatactgtaattatcccatcaactgagctagtggtaattaagcatgactaagtatatagttctagctaggtcacataagtaacatgagctagtctatttattacccaaggttgacaaatgacagatatcaagtaaatatggcacaagcaaacagataggtaatacccggatcccatgtaattagcaagacatgcaattttatttgcaaacaataaaacatttgtaaattaggatcaaaatgttcaaggggaatgtgtgacttgccttgcttcttcacttggatcttctgaactcttttcctcgtgaccgcgatcttccgaaacgacggattctacacgctggcacacaaaacgaggaaaaaatctaataaaaaccaaggaaacagtacataaaaagtaaacaaacatgtagatctcaattttagatgaattttgtaagttgaatggcccaatttggagttcgaatgaattagatatgaattttagaagttttgagccatttaaatgaatttctataattaataccaatttattgcacaattattaaatatttttccaaaggaaatgataagcgctaacgtcagcaagaggaagggcgccgacaggtgggccccacacgtcagcgggtcaaagggggtggctcatggtggactcggtccaccgcagcacaggcgcgcgggcacaccacgtggaagaccacgtggcggccacgacggcacggcggggcgaggtggcaaaggcatggcgccgaggtggcgccacatgggacaccggcgcggggcggcgccagagccacgtagacggcccggatcaccccaaaggggatcgggcggccacagctagcgggagcggcaaaactcgccggccgaccggccggggagcgacggcgagcagcccagaggtcgccggcgacgaccaccggcgcgacggcacgcgcgggaggcagcggagggaggcagaggagggagatggggagctcaccgagcgcacaaggcacggaggcggcgcgggagagcgaccgacgacgaggagaggcgacgacgcttcctcggggaggcacggctacggcggttcaatggcagtccgcgagcgaggagtggcggatgacgaccggaagagcctgaggaggacgaaggggagattagaagagggagaggacgggcttggcgaagggcaacagtggccaaaggccgaccgtgagtagaggagctcaccttgcgcggggaagatggggttcgagcgacgattgatggaggcggaggggtggccgggctgcgggcgacggccgcggtgccggggaggacacaagcgcagcatggggtggaccggagaggtggcgcgacgcggccggaggcagcaaaagcggtgccagcctcgggcttgcggtggaggtgatgattcggcggtggatcgaaggagcggtatggtggccgggcttgcccgcgcgacggcgaagctagcggtggcggcgacgcggcgcggtgacggctagagcggcgagaggcggcggctggaggcggtacaggcggcggtggctcggcctcgcggtgggacggcgtttcgggggtggaagagggaagggaaatggatgccggggtgaagcgtggggcggcgatgccgatggtggtgacggcgcagtgcggcgatggcgagagcggcggctagaggaggccggagctcgccggagagtggcgacggctcggttttgcgt

SEQ ID NO: 82875 - DNA, 22780 bp, Oryza sativa
atttgggccgagcccgaaagggaggaaggggaagattattttcttttctttttatttaaattgattaaatgaactttgtattattataattatttcttgagctccgaaaattcgcggaaaaatccggagagtattttagggcacaaagaatattacaaaatattctcggccaatgatttttaaaggaaaatttcaaattctcccattatttcacttgattgaattgacttaacttttatttaatttctagaaaatgcattatttaatgatttttaatcccgaacgaaaatcggggcgttacacattcccttcatcccttccttaataacccatccgttgttctccatgttgatagcgcaacgacccaattcccttttctctttctctctctctccctacgttcttccatgatatgttgtatcgtggtgattagatcaacaaaactaaccatatatgtaccagcaatgatatatgtgggtatcaactccgatacttatggaacaatactctaatagtaccacacattatacttgtaagggcagtaacagtgcaaggcacgcatagcgcgcttctagcccatttgtgcgataaaattggcccgaaggccagtaggccacacaccccacagtgctcgtgacccacaatacgctatcaagtcggaactcccagtcgaacgaaaacagagttaattttccccacctgccccttcatgcttatcctctacacagaaaaaaatcccgtcacttctccccatctccgcgccgctcccccgccccacccacccccctccgctaaaaaaaatccgcagcttctcctcctcattcaccacaccacgcgcttctcctcccagatctgccgcttctctccccaaatttgacacttctcctcccaaatccaccgcaccgtttctcccaatctgcgccacttctcctcgcccatccactgcaccgcttctcccccaaatccaagcgcgggaggcaagaatcggtggggtgggagggtgattttggggattcacttttcggggcggcgcgaggaagcgacgaatcggagcgacgacctccacgttgcaggggcggagggggtttcttgcgctgcgcgccctcgttgcaacgaagaaactcgtctcccagataaggggcgagcggctaagcagaggcgcgagcctcgtcgacacgtaagcgagtccaatatggcaggtgaaggtaacatgccatgtacacgcactgggaagggcctaaaggggctagcaataatacgtgagtactagggattgatgaaccatggtgaagactccaataaggtacaaaggtggaattttggaaatgatggcgccgacaaggtaccacctacccaaactcccaaaacgactgaggctgtgtttagatctaggggtaaaagtttttgtcgtgtcacatcggatatacggacacacatttgaagtattaaacatagtctaataacaaaacaaattacagaatccgtctgtaaactatgagacgaatttattaagtctaattaatccgtcattagtaaatatttactgtagcactacattgtcaaatcatggagcaattaggcttaaaagatttgtctcgcaaattaatcgcaatatgtgcaattagttattttttagcctatatttaatatttcatgcaggtgttcaaatgttcgatgtgatatggtgaaaatttttggagtgggacctaacaaggcctgagctgataaagtatcgaggtaacatcgtggatgaggctatgccaacaagataccaaggatgaattgagagggcaacaacgtcgacaaggtatcacatacttgaaccatggatacttgattgggacgaagacacgaggatctggtatgcatgctcgtggcagatgaggcaaagtaaaggtgtctcaaggaagccgcgaatacggatcgatctcctataatttataccatcccaaaattgatatgccttacattagcagttcttaaaataaaccgaacacaaaagacagaaacatatatattcatccaaatatttggacacgatatgaaacaaacatgaacatttacatgatactaatttgagaacatctctgttttatactgtgcagtgatttttttccccgatggttggtgcgaagcaatttttctcaaaaggaaatgaaacgattgaaagctttccttcctgacgcgtgtggcacgattttatccgccggtttattttcccaggaaagaattcaacatttcaacttctggaggactccgaccgccgtgcctcttcatcgtcggtgccctaggttctccacgcccattgcccattactaatccggcactgctagctcaggtatacgccacgaaacccactcctacgccaaggtatccaccactcgcgcgcggcgcgcgcacgctcgccggcgacggcagcgcggggtgctccttgtgttgggcgcgctcggcgaaggtgtggcggtgtggcgcatggaggttcagcgggagaccgggcgttcctggcacacgcggccgtgtttggcggagctcgcgcgcgctcatggcgttgtcatgggggtggttttctcgtgttcaggttcaggcacgaagggggcgccgcgtaactcgccgtgaaggtgttcgatcagatgcccctctcagggcgaaggtggctactctggcaacttatcaattcaactgtcgcaacaaacaactggttttttttttttacagaagatcgcataaattcttctggagaccaacctgtctactacttagatttgcattgtcgatgtttctacgactacgactcactgataacttttgctttttgaagttttgtgaagttgacacttcggcagatttgattaataacaagacaaatgcagctgttagaaggccacggttcatcagagttctgctccctggatccttcgcaaagatggtccacagatgcttgtatactactacatgttctgccgttctgaatttcgtagcgaattcttaacaagtttgcaaggacagtgccggtcaaattggccatggttttcagcctcgttggcaatttttggcacgttaagctgtattgaggatttgagatctactcttctttttaagagctattgagatctactttagggagtggcagaacagggtttgtgagggctcgtgatttttctgagggcaaacttctgctgctgttcagatacgaagatatcgtcaaatgctcgaccaaaaacagaagataattcagatgacgaactacctcaactctgaataaaatttggccgccttccttctttagcccggcgagaaaaaggatggaaagggcctgaatgacaggctatggaaggtaagcagttttcagagacctggtatttgagtcattgtccgtgaaaattggtcttgatcattgacaggattgtgcgttttatgacagagaaaaaagttgggaagtaggataagtcggaggaacagtgcagattgcactgcaagtctttgagatgagaatgacccaagagacaggccactgaaaagtatgatgttcatctgacctgaatacctgatggttttgaatcgattgacctggaatgatttctgctaacttttggaaccgtgcatatgattatgtttgattgtgcagagatgaagaagcggctttgaagttttgtggatcagtcaaaatgggaattgcgagaacggaactgcaagtcatgcaggagacaagaatccaaaaaaagccacattcaaagtctgatcacgatgagtgaagtgcttatgggcttagccacagatttgagcactccgtttcatgtaagacagcactatctgattccactgcttcttacacattgtattttttgatttgctgctaaagcctcatgcaataccatctcacaatgcaaaccaggacttgatgcatgcgcttccacgggcttcccacaagctgcacaatcacactaaaaacgaagagccatttcacaacatggaagaaggcgattttggtcacaggtatgtcagcacacctgctatcctttatatgttgttactgaacattcctgatctggaattagtttatgctaatgcttggtttctaatcttaaatggaaacctaacatattacatcaaatcaaatctcaaatgattattctggtagcaatacccatgtatagaaatctcaaatagaaacagctctcacatgatagcagctgacccaacttgtattagtactttgttgttgaattttcctatctggaaaatgaggatcaaggaattaccattttgtgccactgacatgtgtgggtcaggtgggtaaatcctagtttcaatctaaagggaggttatatgatcaaatttcacaacgtagaagtatgaaaagtaaacatgtgagatgtaacaaaagagcatgcctataactaaggttagttatggccaacatacccacaacccttctcaaccatctcaaagtttgccaagagttaatacataatgaagaagaaagaaaaggttcagcgcatcataacacacagatcacagagaccgaacagactaagtgcaaatataaacagatttgaccagcccacaaagtagatgagggtagcaccacaacctgagatgagcatcacctaagcataatataaagtcttttgaaagaaattaattgttattgctcaaagcatttatcttgtcctgcttcttagcctttccagacttccacacggagttgtgagaaacagtttcctcgacaatctttggtgttgtaaagctgaagctttcaactgaaaagcgatctttgtactgcgggttggcctcaaggaacttatccacctctgcagtgcatcttacacgcttcccatttggcatgacatagtaggtatccattttagacaaatcacctctcataatcactagtctctcagttcctgctggaggctttggtatgttaggcttgtcaaggacccatatacggctgctatcatattcgatgtcagcagggtcttcacacgagcagtcaggtcttctactgcagtgccatggctcctcagtgaaattctcacgaattgtctcaaattcatccttcgtcggaaccttgcgccatttgtgacactcacaacattgaactgcatacatgccaatggagtctgtggaggagcctcgttttctctattgaaataagaacgttaccattcattactattgtatatcaagcaaaataatttttctgatcctaaaatatgcatttggaatgtaaattttaattctatcaggcacaaactaatggaaaatggatgttaatgacatgatgtatacttctagtggataggataacagaacaacttcccaacgcacaaatagaaataataaagaccgctacattgtttttttctttacagtccataaaagctgcttcttagaagttggaagttatattttgcatagagtccatatggtaaggccacttttggtataatgcagatgccatgtagtataaggcacacttatgtttggctgcacaaaagcaaccatagaaaaagattctgcattcagtttttagaaggggcagaaatttaaaaaaatcgcgcagcattttgtgaagaaatctaaaattgtttcatagacccagtgatgtgaagaaatggttcagacagctctaagtagaaaagtcctcattttcctctttctcttataaccctctacagtctccattccctgcagccccccttcgctaatgtataaaatgtcatcagaacttaagaactgcaaaagtattaaatagtgtaatacattaactcttatgttctcaatctaaagtatatgcattttttgttattggacggattccattatccttcatgcttctaaattcctcttggatctcaaacaaaattttgagaaaccaatgcaagctgatcttttttatttctttacagcccataaactcccgttgctgacaaacaaacttcaggcttcatgtattcacagcagtacaaagcaacacgcctacaatttctatccaaaatggcacaatttcagctcatcagattaagttaaggctctaaatcgatccttccctcacctgttcttggcattgacgatactatttgattaaagatttcatcctacggaataacctagtggaataaccaaacccctattctgaactctgaaaccgcatccacgcatatagtcgcaacatgcaggcgccaccatttggcacaatttctcaagccaaacaaccagatgaaaccaacaaccgagcatgctatggccaccaccagatacaccaaaccggatcggggattcggaggaacagaccaaagaagctgcggggggaaataccagtacgaggaaacgtagatggcgacgtacgatcgaggaggcgaaagggcgagaggcggacctgtgtggagggcgccgaggggggcgagaccggtgacggggatgaggccatactcgacggtggggcggttggccgcccgtcgtcgtcggcggcggcggaggttgggcggagcggtcgcgaggcgaggagaggaagcctcgggccgcgttgctgggccggtgtgtggggggcggaaacgaggacggacagcgggagtgaatcccgagagtagagggacggcacggcaaagcgggccttttcacggggatagaccgacagggttttgacccttgcgggatgcgggccttgcccagccatccaaacggcatcacacggcaatcatatcaccggcacacatacggtgatgtgcagtgtgcacctaccttggaggttgtgttcgggacactttcccaactttactctcattttacacacacgcttcctaaactgtgaaaaatatgttttttcaaaaaaaaaatacaaaagttactttaaaagttatattaattcacttttaaatttttttaagctaatatttaattaattatcgttaatatgtatagttattaaaatagggacctacaacgagaagttccggatacatgcgaaacaaagcatatgtagaaaatatccaaaatcaccacatgaaaatagctccagaactttgcaggattcgacatgaggtagaatgaaaaggttcaacacacaaaagcacatgtagtgcaaaacataacataacttctggaggtaaacaaggaaggagaagtataggtttttaaggtggctgctccatattgtcttaagtttttggcatcacctaaagtaacgcgtatgtagattcagaggtcacaatggtaactacttgctgctggaacttggaacttcttttgcgtctagttgcatacactgctcttccctctcagacttcgccatcacccactttgcactatcggaaacagtctccttaactatcttaggtgttgagaagttgaagctcgaaagtggtaaagtagcagcatactctgggttttccttcagaaacctatctatatcaggtttgccctttgcacgcttcccatttggcaagacataataggcatccattttagatagatcattcctcatgatcagtagcctctctgtcttcggcggaggcttagggatgttgggcctatcaatggcccaaatacggctggtgtcatactggatatcttcagggtgctcacatgagcagtcgcgctttttgctgcagaaccatggcttcgcggggtagttctcacggattacctcgaactcttcttttgttggaatcgtacgccatttctcgcatttgcagcatgtgatggcgtacatggtaatgaaacctggtttcccctgtcaaatataaatttattgttgttgtcaataatatcatgcaagacataattggaacatcttcagtaaacattgaaaacatgaaatttaagtactttaaataaacaaagggatgctagttacaaatatgtgtgcttctatgaaataaagtaaccaaatatcttcacaattctacaagcaaatataaaaaatccaacattttgttcaaaactactccaggaaaaaatatttgacattgggaaaactaaactattaagtttgactggaaggagaacttagaagaaaaatattagttatatttcagaaaagaaaattgaagtagaacataaagtttatgatgtatatggaagctatccagggaaacctagtagagaataatttgttgaaatagtgcattttcttccttgcaataactctcctcaatcaaagatataagtataaatagggtgttcaattctatattgttgttatacagtatatcacggctcctagagaaccccctccccccccctcttatgtagctaatacatcatagctaatatatgtacgcacgcgcgtgcgtgtgtgtttgtgtgtgtcggtcttataatataaggtatttcgcccatgtaaccatggtagggttctaggatatgacactcaaaacattttacgacacgatttgccgctcgctatgtctcactgacacaagtaagttgtgctaccaatgaagaacgtgcatatcataggactaatgccaagagggacctcataaaaaatccctatcatggccactctgcctcctatgatttggataagttacatgttaaggaagtgatgattattagttgacatgaatgatcagaacagacggcatcaacactcttgatctgtgtcacctggacatggaaacttgttctgaattcgagtcggatttgtaatgtcataccccctatcacatagaagaaattatacatggaaatactacttggaattcgaaagggagttagaatccaaatccggctaaggacatggacacatgttaagaattggactcaaatttctcatgtcctatcccataaaagaaattttataaggggaaatactacttagagtttgaaagagggtcggaatccaaatcggacttagggtgtctgattcaagaaaggaaaaaggcgtggatgtatgaataacactacacacatcactaatccatgagagcgaaagcgaaacaaagtagaaattaaaaatcagatcacataattacctcaagagccatgatggtcacctctagggtcaggagggcagattgataaggtgggggaaagtgatggctgatgatagtttggagtactttctagaggttctcagtatttatagagatcgctggggcaagattttcatactatagacaaaataatatgctttgtttgcaacaacgtaaccatttcacgtcacgaaaaataaaaagtatggtggtatttgaggtgcttctaaggattcgctggtatttcttaaacggttttgctggtattacatttgagaggtttagctgctattacctgtgaattcatttgtttttttaaagcataatcgtattcgaaaactatgtgcgaaggctctagacagttttccaagttttcttttttttttccttctccatcgaatatgacaaattcacctactcccttcgtcctagatttagatttttttttatcttggatggagtatgtgacataaaaccctaaatttggcacctaaagcgaaaataggaaaatatagccaaatttgaaaaggacctagcttgctacgcgcgacaagtctgactatcgtcatagagccggtcagacagacagtgtggggccggtctaactgacggcatgtggccagatagactggcagagtctgactccgtgcctgattttgtcgtttctcaagttcccttgcttgggctaaggttttctttagtcctatttggtttgtacacctagtgggacgtggagagatacctatggaaggcaagaccaaccccaaaataagagccaactacaagaaaaatgctttgtggagacactttttaaatgtttttacaatactgtagaggcattttaaaataaaatacctaagaagtgttttatggtgaattgtgtctacaaacaagacattttataaaatgtctataagttggtagaggcacttatagtgaattgtctctacaagcaacgagacattttataaaatgtctataagatggtagaggcatgtactagagatacttatggtgaattgtctgtgtaaacaaagaggcattttataaaatgtctacaagatggtggagacatttttcacaacaaacaatgggaattttataaaatgtctataagtcggtagaggtattttccagaggcacttatggtgaattgtctttacaaacaaagaggcattttacaaaatgtctataagatagtagaggcatttttcaccacaaataagaggtattttataaaatgtccataagttggtagaggcattctatagagacacttatggtgaattgtctctacaaacaaagagacattttataaaatatataagatggtagaggcatttttcaccacagacaagaggtattttataaattgtctataagttggtagaggcgttttctatagacacttatggtgaattgtctctacaaacaaagaggtattttataaaatatctataagatggtagaggcattttctagtgacacttacggtgaattgtctgtacaaacaaagaggtattttataaaatatctataaaatggtatgggcattttctagagacattaaattattaaattataccacaaccatatgaaacgcaaagagacattttataaaatgtctataaaatggtagaggcattaaattattaaattgtaccacaaccctatgaaaccaatgtaaaaaaggagtaaaatatttttcccttgctattgcaaatccttgagctcaagatctcttggacaaatcatttttatcttcaatgcactagcgaactcaaccttatgtcgttacttgtatgtttgtgctttgagttatttatatttagttcttcagtttacattatcattctaaaaagtaagtgtttgtacaaagtttaaaatatctcaagaaatgcatttacatatcaggtacattttaaagtgtcgaaagaatacttctacaagatataatttaataaaatgtgctgaaaatatctctaaagtgtctctaaagtaaaagttttctacgcaattttcaaagtgtctgtgtaaagtgtctctacactacaaaacaccagatcttagaggcaatttgcagaacacctctacaaaagtgtctttatatgaggtttttgttgtagtcgccatggccagttcaattgaggcacacaatctacaacagcgcaattagccaattgaatcgttctttcaatatcacatatactttttgcctagttttcagcctagttcatccatcttcgttggtttgctttgaaagttgtccgtcttcgtcgcgagagtgcgagtcatctgtgtaggtttgtccctaaaacattcggttccgcccacaagacgggtgtttatccctatttgtctaaatcggctccgttagttgcttttgatctataaacccatcttgatcaggggcttctcaagatcaaggtggttggagactccatacgctgcaaaactttaggtggattccgatcgtgttgtggcgtgactaaaaaggtgtcaacaactagttgtacgcttgtctggtttttatctggcaacgtcatgccttaagcgatgtgcaaaggtccagtgtccagtcggtcttccttttttacactaggtaagtaagaattggcctattcatgtggcattggttggcattcgttgtccatttgtatggctttattggaaagtgcttagatgttgtagtcttgtaggggaaaggtggagttagttttcctcttttgtattgctagtaatcgtgcacatgcgatgcatgtttcgcgatatatatccgagaaatcaaagtttggtgaccatatttagaaacaacaagtaaaaatccagttgagatcttttaggccacatcgatcggcgaatagccctcgcgtcgccctcccccgggcggctcgggaggcgacgcgcgcgccgccgctttcctcctccccccgccccctcctccacctcgccgccgcccgagcgggtgccggcaaagccgcggagccgcaaggacggcggcggcggggtctcgcctcgcccttcccacgctcggcggctggcggagctgtccggggcggcggtggtggtggccagatccgcgccgtttccggccagatctgaagggggggtggccggcggcggggactgacggtgacggtggcgacgacggcggcggaccacggcgactgaaggcaacgtcggcggcggaccgcggcgcgtccaggccacctgtagacccccgtttttataacaggaatcattcgtgtaaacagtaccatttccctggatcaagtagtctggtacacacgagttcatagctgaaataccaaaagcacatacacgagagtctagtgctaattattacatcataagcccgcaggcattgtcttaaatcatcggaccgagcggtccggaatacatccaaaagcagaaatagataaggcagcggaattcaggcagcggcatgccattgccacaggcaacgaccgtactaagacctactgagcgccatcgtcttcatctccctcctggtagtaggcatagggatcctctgaagcttcatctcccgcttctgattaattttatatttgcaagggtgagtaccaaccgtactcagcaagccatcacagcaacaatgcacatgataggtgtatttaaaggatggctatggttcctttgcacaaagccagttttgtaattcttttcacaagcctaagatctagcacagactgatcaaattttagtaccagtgttcatattaaacaatgacggttctgtccaccatccattgtgatcccaagaatagcttcccgccattgagtcgttatggttttctgaggacgtccacattcccgcctctcaggaagtggctccatcagcataaaaaaaatcatcatgcaatatcccatcccacacaagttaaagaatttaaagtctagccaagtgtaatacatgtcccggtgctcaataaccgcgagcacgactattcgaatagatttggtttactcacactgcagtggatgcacactttacccgcactccgcgactgcccaacacatgagcctcgtcccaacacatgagacgcgtcacggcaaagcttttcgataacctcgcattggcagtacccgctccatgaacttaaatcctcatgcaatctaggcgtccatgtttctagcagtgagaggagttctggcgctcccgggaaagagaagtctcacacacatattaaattatggttcaagttaagttctctctcacacacactcatggtagtcctaccaatggcgacaccgatgtagggcacgcctctcggccctacctcaacggctgtcccaccgtagcgcacctgcctcactcaggggtgaaccatctatgcagggatactgcctccgctcggctatctaatccgctaggtctatacccatacgagaagtgcggttgtacgggggtcgtttcatgcttaacttcatggctcagtccttaattgaccggggacgatactagccttttccagataccacccaaatcctccgtccgccccagtcgaaaacagttgtttaattttatttctcctttcacaaattatgtcatcaacatcatggcaatgtggcgctcatgtctccacatgccgcatctcaattaccttcccaaaggtaattgcccaagcatatagcatttgataaatatgagtatgcatgattctagaatagcatttctaagcaattgtcatagttgactagggactcatacgtaaacatggttacaaagatttaagggtaaacaataatcaaggcatggcataatcacaagtaggatgttcatcattgcatgcaattttatttgtaaacaaaacaatttcgcaattgggatcaacatattcaaggaatagtgatgacttgccttgctcaaagtcttgggggtcttggccttcacttggatccgcaactccctcgggctctatagttacgtgcgaaaattgatttggattcgattagaattcaaataaaaatccaaataaatccaaatggaagtcgaacgcgaaagtcgattcttttgtattaactttactattcgcgtactagggcaaacccaatttcgattcaaactattttgcaggtataaatgttttgttctcataagtttttaatttaatctacccgagcattatatccatataataggttagagatttctatcgcgagctaaatatcggacgaaatcctagaaatattatatgatttaatttagtctatgactaaatgattaaatataatacacggctaaaatccctagtaattaaatccgaatttctaccgtgaatcgattacttatagggattacccaaaaataatctataataatctataagaattcctctatttgtttagttattaattacatctaaattactaccgcgaattgatttcttatagaaattaccaagaataatccataatttatattaaatttcgcaattctacgactataactaatctataactaaattctaattattttaaattttctaaacttccctaatctccctctaatttcctatttatttccttttcctttttctttcctttctttttctttcctttttctctttttccctcttttccttttcttttttttctctcctccctcccggcttctttctctcttcctcggcttctccctttctctctctctcggctccctgctacccggggtggcgacggcgaccgaggaaggggagaaggcggcggcttaccaacggcggtggcggcgacggcggcgcgacgatggcgcacggcgcacagcgcggcggcacgaaggcggcggtgcggcggcgcaagggcggcgcgacggcgacggcggcgcaaggcggcgacgcacggcgcggcggctccggggcgacggcgcggcggcttcgaaggtggcggcgcggcggcacgacaacggcggcgcgtggagaaggggaagagggagaggaagggggagatggagtggggaaaatggggagggggtggagttttataggggagaggaggggaaaagaaagggaagggaaggggcgacgcgacggcggcgcggggcgcgaggcggcgatgggacgcgcggcgacgggatgtcgacggcggcggcgacagcggtggcgcgcggctcggggcgggacgcgacgggcggcaacgcgacggtagtgcgacgcgacggcgacggggcgagacgacgggcgagcggcgatgggacgggcggcggctcggggcgcgaggcagcgcggcacggggcgcgtcgcggggcgacggggcggcgcgcggcgcggggcgcaaggccggctagggcggcgcggcagcgatagcgacggcgacaggcggcgatggcgacgtcggcgcggcggcaggcgatggcgcgacgggacggtgacggcgaccgcgcggcagcggcggcgcggggctcggggcatggccgggcgcgtggcagagaagggtctagggctagggaccgaaatcgaacacctatgaggcaatgaacagtgacttttcctatttatcccgattttagtgtattttccatataaatttgattccacaattcctaattttgcatatatgcattttactcaatatttgtcttatcttaactaatgaattcaccctagattaatattactcatattttatttttatataatttatttgagttttaattagggttaattcttattccatcgtatttaaatttaattgatccaaatatggtcgcgataatattttatttatttctatccacacctaatctttattttaatttgtatttattttaccaatttgtttttaaggtttattcctaattaactattctttactcacgattaataatcttcgagatcaaatccagataaaatagacgaataagatcggcatgatgcaattaatttaaaaagtttttgaaaatccgtatttttagagttttgattttgtcggtcgaattttcagggtgttacaccaccacaacagggacctctgccgtgccgtcatggttgtctcgctccagcctggtgctgagtggcgcgctccgtcccccggacccgcgccaccccggccggatctggatgggcggcggctgctagcggcgaccggtgatagtggcggctggcggcggcggctggtgatggtggcgtggagatgaccggcggaccacggcggctgacggccgtggtggtgatggctggcgatggtggcgccgtgcagcagacgacgcgtcgacgccagcggcagcatatgaaggcggggaaggagttgggcggcaggaaaggaggagaccgggagcgggcgtggcgtgggcggcggttgcgtgtagcggtgttgcatggctcgggagggctccggcgagctcggtggctatgcggagtcgaggcgggctccagcagggttgctcgctggtggtgagcctcctgctcgcgatgtgtggatgtggatgcgctgacgtgtttggtcacgtcgaggtatgattgcttgtgagacgtcacggtctattccatggtcgtcgacgtggggtgcttgtctgagtaatgtgaagacgctggcaaaagccttgccgtgcctttggccggttcgaccacgacgacgctcttgggcgccgttaaccttcttgaaggcgtcgtcatggcgttctttcatattccccacaaatctccgggtgaaaaccttgttccgatttcggacgagcagcgacgacgttacgcgtcgtgtcctccttgggggcgtcgcttcggagaagttcctatgcatcaacgaccgtggatggtctttttcggttctaaagctttcataccttgacgttcggcgaggccttcgcctccttgggtccgcttcgttcttgtggtgggcgacaggctcttcggttgcttctgctgatgaagtcggagctgctcgctgatggggtgcggcgatgcttggcaacgatgacaagttgtagtctcttccaaggagttggtgctgaccgtgtgaaggaagtgtctctttggtggcttggctgatgtccattgttggatgtcggagctgcttttcgctctggcgactttcgcggattcagtgtcgctgcggttgtgaagtcggcgctgctgggtcgtttgggcagctagctcggcaacgataacacctcttctgtgatgttggagctgtttgggccacttttgtgttttagcttggcaatggtgttctacatttggactccgctgttgtttgctagttgtgtagctagatctcttgctttcttctgtgtggtgggttttagccggtttcccgtaattaaccgtgcagttgtatggttttcgggtccggtttttcttataaactgggtcaattctcttcttctaaatataaaagtgaaacaaagttccgccttaggtttcaaaaaaaaatccagttgagacaatacttcaataaaaaaaaactccaaaatgcatataacaatggccttctttccaagaaagaaacaaagagccaacaatgtggaatcaacagaggcgatagaaagaggaattggcagctttgcccgtctagtttggtcttatatcttatccgtgcctacacctgcaacctttgagttctgcatgccatgcacatcggtgccacttcggagttttgcatgctattgctctgcagcatttgttactgatcagtccatcactcgatcactcgcccaccacaccccactgccaatgcagggaagagaaaaagtgcatgataagtgcctactccatctgtcccgaaataaacggatttctaaaatgccatacaaatttagggcccctttgaatcgtagggtagaaaaaacggaggaataggaaaaacacatgattctgacaggaattgaagtataaaacagaggattgcaaaacacaggaaaaacacaggaatggtcgtttgattggagcgcataaaaaacgcaaggatcggatgagagagatagactcaaaggaaattttccaataggttagagctcttgctaaatttcctccaaaatccacatgcaagatgccattccataggaatttcataggatttggaaagcttcaatcctttaaatcaaagagacaaataggaaaatttcctataggatttgaatcctatgaaattcctatataaatcctttgattcaaaggggccctaagtagtgagagaaaattactaaaagtgttctaggtagtattagtgactggtgagtgggcaggtaagaggtggtgagtgtgccagtaagaggtattactgggataaaacccttttagatgatggtaggttataagaggaaaaaaattgatttattttgaaacaaagtttgaactctaggtgagtaggaagttgcaagtttaatggggatgggtcaaagcactctacagagaagtctgtagtatatgtggtacgtacgatcactgaagggagaaagttccatgggtgggtccaccttttttttttaaaaaaaaacaagaatacagtcttgaactgatctctctataaaggggacacaccagcagcaaacacgtacaatcctttgaaattcctatggaatggacaatcctatggagattttggaggaaacttagcaagagctcaaagctcttggaaaatttccttttaagtctatttctctcatatgattcctacgtttttcctacggtccaattaaacggtcatttctgtgtttttcctgtgttatttcaatcctctgttttacacttccattcctgttacaatcttatgttttccctattccttcgtttttcattcctgtgattcaaaggggccctaaatttcctccaaaacttgtatgggaaaatgcattctataggaattttgtaagatttattccttttattcaaatggttatataggaaaaaaatcctataggaaggaaatccttttgaaattcctatgaatttcctttgaatcaaaggggccttaagagcctgtttggttggtgctctcacctccgtgcctgagaaatttgtaagcctgagtggcattcaagtttgtaatgtaggttgcctggtcaggcagcctgagcctgtgcttgtttggttgtcacttgtgcctgagaaaaaaattcaattagatgtttgattattatgccgctaagtcaagtattaatatccgacacaattttttgcatttaattgcatctgacctacaaccaaattcatctagcgcaacagatccctacacaaatcaatcataaagcaaacaaaggaaaaaataatctaaaaacaaggggaacaaacaagggaaaaaaggaaaaaaagaaagcaaagattgcacccagattgtaaagtcaatctgcttactcaaccacgggcggaagaaatccttgcctggcgacacgacggcggcgctactttgcgtagacaccaggatcaacaaggaaatcatcaagaagagaaaaaagagagaagaacaggagcaaagagatccccagatccatgtcgcatccatcagaatagaattgcaaaatccatgcatccatcatagaagagcatttgcatgtgaagcatgacgcagcactccggaggggtcttcgtgtggctgcgatggcttcgcacgacggcaacggcggcagcctcggcggctttgtgtggagttatcatggcggggatgaggggattatggtgctaatgtgtaacgcgctgctgcgcctggagcccaggcgaccaggctaattccgcgcctgagttacatcaggccaggcaaggtggaaggagcctcagggtagcaaccaaacactcacaaattagtctcaggcatgtcttcggccaggcaacttgttgtcagggcagcaaccaaacaagctctaagtgactcataggaattattccattggattggattcctctgcttttcctccaaaaattccttcaatcctaaggaccagccagtcagctagctttgattgaagtgtccttcctccttcaatgaagatggatgtgatctatctttgactcatgtcattcctctccagtatgaagatgatgatgatctagctttcaactcgtgattaattcaccaaggacacacacctgagcatctccattggatatgatcaatcaactgctggttttcaacaacttggcttactatgttgtaggatgaaatgctaccatttcacatttcaactcaggagaagagcgatcgaaagaagaagatgcagggacttggattataggtaatcaccacctttattcgattcttcgtcgtcatcgctgtttggtacattaccatggcagttcaagcgaaattttcagaaaactaccaccacataggcttacatgcgaacatgcatactacatacaacggcgcctttgacaggcagcagagtttccaccattccatggctatgtatttattattcttcaccaggtgcaccaacagcaggcgatctggttgccggtaaagagaagggcgtcatcatcagaggagcacctgagctgcagctagcctagcaattgggaccctgccaaagagagttaataacagttagtgattgttctgtgaatttatgagtagagttctcgattttcatcactcaaccgacctgaaaggcgaacaagaaacatagtccagcccagccttcgcaaagaaagcgactgacagaggctctccaccatgttcaccacagatgcccacctgtttacaaaaaaagaaaaacatttcaatataagaaaccatggattctatacaaggtgatgtcctcagctccagtgaaaggctaaccttcaagttaggcctagctttgcggcctctctctgtagccagcttaaccagctccccaactcccctctgatcaagcacctaatatattcatcaacaggtatgttacatgatagaaattggtcagattgcaccaaatcagaagtcaggactcgagagttgggaaaagaatatgcagatgagttgctcacatctgtaaatgttgggaaataggggtgtttatcaagggaggccattttggctgtacaaatttacctcaaaggggtcatgctggaggataccctgagacagatagatgggaaggaacttccccacatcatccctactgtaaccaaatgtcatctgtgttaggtcgtttgttccaaaggagaagaactcagcctgctctgctatctgtcaataaatgtgcagccaacacagcactgtcagcttataggtttaaagaaaacataaactcatcatttgaactttgaatatttttataatcattcactatttcaagatcaaaatatcctttagggtaatatccaagattctattactagccatgttgcatgtacagttctgtctacatgttgaatgacaataaccatactgaagattttcaaaaaagaagggagctatcagttgtttcttacctcatcagccactaaagctgccctgggaatttcaatcatagttccaactttgtagccaatagtttttcccatgtctgtgaacaccttgttggcaatttgacggataacatccacttgatgccccaattcctgtcacagcaaaatactcaaatgtcaattgtttgaaaaccaaccgaaaagaacaatgtaatcaaatatattagaacatcaaagaaggtaaatatgaagaaatggaatgaaccatttcccggatgaagtcaatgttccattcacacgtgatttaatacttgcatgattctagaaattggaattcatgtaaatataagttatcatctaaattgcagcaccttcacagacagtcaattacacaagtcaggtactatgaatgaaaagaagaaagcaaacacatacctgaggagttccaacaaggggaaccattatctccggaaagacttgaataccctggttggtcatggttatagcagcttcaaagatggcacgggcttgcatttcagtcaattcagggtatgatataccaagcctgaaattgagtggtcccagcattagtaaaggaaaatgatgcaaatgtagattgttgctgcaacctcaaataaagtaggacaataaccaagtaaatgctctggaaaaggaaagacctaattcaacactgaatagcaaagtgcaaaaaccaacctgcacccacggaaaccaagcattggatttacttcggaaagtttttctactcttgcaaggacatcatcctgagctgctccagtttcagagcatagctcacgcaccatatcctcaacatggccttctggaaggaactcatgaagtggaggatccaagagtctaatagttaccggaagccctggaatgcaacaaaaaaccatttttaaacgcctgtatgaccaagcatgttgtgtgcaagatgcaatgaattaagactatgttgaatgaatcatacatccatcaatgtacccctttccataaaagaagaatcatagcagaatcgtgcccattaacttacatgatgcataatatgttaagataatataggcaatcttctaaaagtatattgcatcccttttgcaaatttataacgttgcatctacactagaacaatcaattaacttatatttaagaaagcaaaactgtttttgtttccttcaattaaacactagtgcatctaaattcattaagacatatatattattatggtaaaaatttcgcataccatccattgcacggaagatgccttcaaagtcagacctctgataaggcaaaaggcgatctagtgctttctgcctcagttcaagacttgaagccataatcatctgcctgacagccttaatcctctcgtctgaagcgaagaactatgaagagaagaaaaagagaagagggcatgaaattatctgcattgactagaagagaa

SEQ ID NO: 82876 - DNA, 10506 bp, Oryza sativa
acctagaacatggaacatactcacaataagcatttttgattgatgctggtgcaacagaactaggtagccttgaccttagtgagtaaataaaactaatgtccctttttcagctgacttcaacttgaaacatattttgcttaccttgagtttcctaacttcatccacccaagacatgaaagtttccaaatcaccactaagggctggtgggcagagtggctgcttgccaatgatcacttcaccagttgatccattcaacgatagccactcaccttcatgcagcgccttgtcttcaatcactacaatctgtagagacacagcaaattaagcaactatctgcagtataaaatggtaattgcaaactcgatgtgtgaaaggcagcctttgtacataagagaactcttaaatgtttgtgtggtgcaagaatctagtataatcaccttggacgcatcatttacacggacgcttgagcatcctgacacacaacatttgccccatccgcgcgcaacaacagcagcgtgagaggtcataccacctcttgctgtaagaattccaacagctgcatgcatgccaccaacatcctctgggctggtctctgtcctcacctttacattcataatggacaggaaaatgtcaagatacaccaaatgcaacgatgcaatgtggagttttcaagtgcagcttgaataaagctgtgataaatctattttttttcctataagcagctgtttaatattctaacatggacgaaacaaacaaatttgtcctagaaagacagatgatcaggacgtaccagaataacatctttcccttgggcatgccatgcttcagcatcctcggcagtgaatacaatttggcccacagcagccccaggtgatgcaggtaagcccgtggcaataactttgtctttataccctgatgggttctcaaactggttttcataacaaaagattaaaagtgagatatcaataactgccattaatttagttgtgaactgaaactcaagtacgcaatgtccaagacctgtgcagaaactagcaggcaacaaaattttaaaacaacagttaccaacatcaatacttgtgtgattatgtttgatatttgttagttatgataatagtattatactttactacacaagacgtaatgagataatctctgttgtttgctaaaactcattccaaataattcaaaatgctcagagttcaagtaacaaacactctacctattttgtggaaaaatataacataaagattttgatgttcagaattaaagcagacatgcgtatcaaatttcactaatagatcgcaaacacacatttaatctttgattattctagcttactattaagtattaactgatttattctaagcacgcaatcgatgtggtaacttctatgacatcaatacaccaacccaacaaaattgttctaaaagagcaacacggcattttgggataacagaggtattatgaaattgtacgtgtccatttatgtggtgcatgagtttatagaccattagagcctcttagttatacaatacctgaggatgaagaagctgatccaggtgacctggttctaccatcttaagtgctgtgcggcgctcaacaaggccctcgttaaccatgtctacagcaatctttacagcaccttttcctgtgcgctttcctgttctgcactgaagcatccaaagcctattttcctgaacagtaaattcaatatcctgcattatacatgaaaattaagttagtctcccaaaaaaaaataatggaggcacattacctagttgctaaaccaagagcatgatcaagacgtttcaaatcacttatttctgtgtgcaagctattggaggtaatgagatatcaccaagacaatgctcgagtatatgatcagacgatcgtgcttccttttaagtttcagtttgagggaaaagtaggacacttatgcctctagaactgccttaatcccattatctaataaggtattgatgcataaagcaaattagaatattgtaccatcatttctttatagtgactctccaaaattttgcagttctcaacgagctcttcataaggctccggcatgtggtccctcatagcatcaagatcctctggagttctgattccagcaaccacatcttcaccctgcagaagaaataatattgcattataagaaatcgttcgggtatatatgaattatcgccgcttgcataacccaatacgatcagcaggaaacatattgctcatacattgattcatacacacaaaccacaggtgtgcaacagttagcagctagatgcaaataggagcaacagggtgtgagccatacctgagcattcacaaggaattcgccgtaaagcttcttctctccagtgcttgggttcctagtgaagagcacacccgtgccagaggtgttccccatgtttccaaacaccatggtctgcacgtttacagcagtgcccttcagcccagtgatcttgtttatgcttctgtacttgattgctcttgggctatcccatgagttgaacacggccaacacggccagctgcagttgcttcttgggatctatggcaagcaaacaacacagtacattagcattcagacgccaaaagaaaaggctcagtttcatcaaaacactaattaatttcagatatcacgaagagtgaaactttatgggcataccagagggaaatggctctcccttagcttcaacatagacatccttgtactgtgccactagttctttgaggtcagtggcagtcaggtcagtgtcgttgtgcagccccttgactgctttcatggcttcgagcttctcctcgaacagtgcatgaggaatgtccatgacctggaaaagagagagaaaaaaattctaagaactgatctctgtagcattcaagaaccaggaagcattcatgacctgtaaccaatttttgggctgaataaaggcaaaattcccctctattgagtaacaactaacacccatcacaaattcacgattctgcggctcatccttgcgacatcctaccgaaaccctctggccttatcttaccagcgaatcgcggccaaggcaatcgaagctggtataggtctagcatccatgatgggctcaggcgcggtccgcagggcgctctcctccgcgccgccgtcgccgccgccgccgccgccgcggcggcgcttgtgatgagtcgaaccatggctgggattggtaggaggagggaggtggtcgagggctcgggacgcagtggagttcgaaccacttcgactccagcgaccggaccggtccggtccggtgcaaggtgaccgaccgaccggttgcgcaccccaagcaaagggcaaaagttgtgcagaccgccgagaccggtgtggtgaacggtgcgcttgaaaaatataataaaacttactgttttttactctaaattaaatttgctaaaaaagaataaaattaagaacattttttccaaaaaaaataagctttgatgaatataggtgaaaaaaaagtaattggttgtatgactggagtagcaaccaacttgtctttgaacttctaggaagacagatatttccatattgcagatgttatcaggtactatgttggaggaccctgtactgattaatttaattattacatgaaataggagtatatgtgagctgagctagtaaggagtgtcaaattgtactgctaaccacccatcgccttcaccagtcatcctttccaataaaattaaagaactatggtcaaaatacggcaatagtgccgtacaggtctcctaagaaaacatcttgtattctttgtacgaggagatcaaatattgacagcaagttccatgttaatcccttgctagcacataatcgcatatacgatcgagagggacatactatctcttgtttttttttccttttttttcttgacacaatactaaaatattctccttgtaacttttctaaagtcaaatactactaaaattattccctattttctaatagtaaaatagagccacaaaagaacaataagctttgggaagttggagtgactctagtgcggacaaattccccccacataggatgagacggaagaaccgggccccacccaacgcacaaaagtatgcgcatccgcagccaccaccgtcgcgtcgctgacgcagcataaataacttacccaccacgtcgatgcagccgtggcagtgttgacgcacacgaaagtagcagagaaaaagtaaaattaagctcgtgagctccgacgagctaggcagctagctgccgagtcagcgagccgggcgagtgtgatctgatgaggagtacgtaccacgttgccgaacatgtcgaggaaacggcggtaggagtcgtacgcgaagcggtcgccgctcttggccgccagtcccgccgccacctcgtcgttcagccccaggttcagcaccgtgtccatcatccccggcatcgacacctgcacacacacgcacgcacggatcgatcagcaacggagatcaatcgatctgtcacatcgccggcgtggcagagaggaagagagagagagagtaaatataagtaagtgatacgcacggcggcgccggagcggacggagaggaggagagggcgggcggggtcgccgaggcgcgccgccatgtactcctccacccactggagcccctcgacgatctcctcccacagccccgccggcagcgtcttccccgccgcctggtactgctggcacgcctccgtcgacaccgtgaaccccggcggcaccgacagcccgatgctcgccatctccgccaagttcgcccccttccctcccagctgtacacccccccccccccccaaccaaccaaaaccagtgtaaaaaacaatcaaaattccaagttcataacatcatcatctcgtatcaacagcgattatttttaccaggtccttcatggccttgttgccctcgctcttgcccttgccgaagtggaacaccctctgcacacgagcacattgagccggagccattagtgaccggtgcaagtgcagtgaggcactgaggctttgtgcaaagcgaagctggtgaagtgtggtgctcatggcggagaggccaagcccccctatttatagcacggtgtgtgacggtgtgacccaccgggagacgtcatcgcacgggcggctcatgcggggggaggaggaccagcccggcaaaaaattggttgggtaggtggatttttgtgttaaaaaaaggtctaataatgtaatgtaaaagtagtataaaaagtctaatactgcaatgtaaagtacagcatggatagcttcttctgtggatgtgaacaagaaatttgttagacgtgtggtgattaaaatgggagcttttttgagcttttaagtgtgagtgaattttggatacgcctgtatcaaaaccaggggaatatgtgcagtgcccacaagaaattagacgtgttatagataaaatgcaagctttgttagttttaagcgggaataaaattggacttgtctgtatcaaaaccaggggagtttgtgcagagcccatcgttaattagcactagagagaaattaacatgtacaggaggtgtgcacgaaattgagcagatcatgaaaatgtaaaatggttagtgtgacttataataggtcgaaaatgcaacgtaatgtgctccaacaaactagagaagagccaaatatctttacaccaaagttacttttgctcgtgtgagcaacgtacgcttcatcggttgtatgtttctggtgctcaccgcttaagcagtgtacatatgacatgggcacatagtaacactagtgttgacacaaacatttttgtccttaaaaaaagttggggtcaacaacaaattatgtcaccaaaggcatccaagaataccactaccacgcataatatcccagataaaactccaaaattggtttgatggtgttgttttgtttagcttcgaccactgcttttacggctcaaacttatcaccacaaaacacacgcatcaaggatcagtagcaatgtactggacagtaacgtatccattattctgattcactgttcattattgctcgagtgatctctcttagctcgatttgagccagtcacgccacttcatcactgatgtattctttatactcaaatttgttatataaatctttgcaaatgcaaatggaaaatcaactcgaaaaggaaagcactatacaataagtaccaggttgtcttgccaccacggaaactctctagaaattggtgtcgccaaattggcattcaaatattcagaaacaaataaagagagcttttgcagcagaaatggccaaataaaatggcgctgggcagtagcctttctgtttcctttgctcagcgattgcgttatgtacactgtctgatagcggtgcaggttcagttgagaaccaacacgtccagcccaaaataaagtagttgtgcatttacatcatttcatcatttgccacttgttgaggtgtttggtgccatgaacttcatgagactagggaaggggactaaaaggcttattaaagcaaaaaagcacaggccatataagccttgcttgcttgcattaggatggccccaaaaaagtgctaatctgtttttccttggagttttatcactctttatatgagaaaggtgtgtacaaactatagcatcgatccagctcacgtttgtcacaacatatctcacctagcctatcctagtaaaagatgctttgcgaaagatttgaagattgctttagttcattcaaatgtaaggttaaccatgtaatatgtttctaatttgaaataaatttggtgagttaaaaaaacagaaaataatcagggatcacatggccggtttgattaagctaaaaataatagttctgccggtgtgaacgcgcaaaattctccaagcaagcggacactttgggctacctgcaagagagataagacgagtccgaggcgagcacacgccatggccacgcacgacacggatagccacgtccgccgtggcaggatgggtttcccgacccgtcttgcttgtgccgttgtgcgtgtgactgcgcgtatcgcgggatggatttgcagctcagctacacgtctggtccgtccctgctggtcgccgtgaggatatgattctctactactcctgtaaccctcttgcgacagtgaacgatcgtttcgtgaccgtgacaccacattcgagcgtgccttttgggggaaaaggagttggcaattcgctgtgctgcaggtgcctcgtttttcagagtgacaggtagactatactacgccgcacatacttaggatcgtgttacacgtagtactcaacaggcaaatatcgtagataattgtgtcaccgaaaatatatccatggctagcatcggttgtccaattagtgataattcgtcaaatagcgtattagcgtataaaaaaattatggttaaaactttgagtgatgtttcggtgctctttattggtattgtactaccggtagaaatgtttggatagttcgttattaagagtaaattagtattttactaatatagtgattaggtaactttgtcatttatgttttttggtctagatggatatgtggtcatccattgcattgacatcgcttatattccatcaaaaagcaaagaaaaaaagagaaaaaaaggtttagtcattactaaataatgattataccccatcatacctattgttttacaataatgcccctccgtattaaatctgaatcacttcaattaaaagaaatcaacgattctgattgtttttgactatcagtagagagcgccgtagtagggctttaaaacttttataaatgtgcttttagtgatttaaatattaatgtaaaaatacaataaaatacctcaaaatcaactataaaagtaaattttaagatttaaattttggcatcggtatgttgtagggtaaaagatgcagtccatgtatgtataattttctcgacgaggagttgtgcttctcccaaaggccttgatgcaaacgtaaggtgaaaattgcgggcgtcgtcagagtatgtgcgtaggttgccgctcgtcaaacggcgacgatgaggctgctgctgggtgaggtcgtggaacaccgcgagacgacaagccggagccgagctagtgccgtgtgccgagaggcgccggccacctgcatctggtggcctttttgatagtacgttgttcagttctgccgcgcggccgggctggctcgacgcgtggccgcgcgcgacggcatcaccaccgttcacccactgcaccatcgatcaacgcgcgcccggcccggcgcggctgcgcgcaacgcatcgcgtcgcgtcgcggccccgcgcgcgcgtcatgggctttggacggacgcagcgcggaaggggaaaaaaagtggaaaacccgcgggcgcggaggctggtattccgcttccactccacggcggcggcgcagctagcgcacgcacgcgcgcgcacggcgttagcgcgacagggcaccgcgcggcgcggcacgtgcaaccgcacgagtgcgcgagccggcctcacgcagccacgctagctatagccgctatatcgtggcgcagcatgtgcgggtagtgaaaactaaagacgatcggcgcgacaaagaaagaagaaaaaatagcacaagcagtaaattcttttttttaagactcaaacacaaacagtaaattttttttaacgactaacacaagcagtaaattcgttctacgtagtagagctggaagatatgtcaacgacataggctgcgtttgagcgcaggagaaagagagaaagatagttttgtttttcgcgcgcacgttttctgaactactaaacggtgtgttttttataaaaaatttctatagaaaagttgctttaaataatcatattaatccatttttgaagtttaaaataattaatactcaattaatcatgtgttaatggctcacctcgttttacgtatcttcccaatcttctcaatccactccttctcaaacacacccataatctcttcttacaaatgaacaatgaaaaagacgcttgtttgttgaaaattaagctatcggatcatgtcaaaattttgccaaggggaaaatttccataagaaacgtgttgcatgtttttcattacctgggcaactccaagtgcacttctaggttagaagatggtaagggataggatcataggattatccattgcctcagccacagccagtttgcattgccacgtttgaaccacccatttccccccattattggaatttagtagtataactaaagcaaaatcaaactagactactttttatataaaaaaaatcaattgcctagccttttgtactcctaactcgtattgtttgctaatacctttttcctaagtcagcaggaaacctagagtaatcaaactttaacatttacttttacgaatttgctatatatttattgataaattttcctccaaaaaattaactgatgtaattacagtacattcgtagtgtaattacactgtaacttacatgtaacttgtatataactttcaaaaatctctcagtaacatgttatttcgataaaatagaggtcgtgggaacaaatcctttcacacatgtgtgtgctgtgatttttttcttcctcaccagaacaaatcttgtaatagatctaaccattcaaaattacatgaaacttacataaaagttacactgtagttacatgcaagttacagtgtaattacatacaagttacagtgtaatcacactacggttgtactataattatatctgtcaaatttttaggagaaaatttatcgacaaatgtataggtagtcccttacttttaaagcaacataaaaacgactaccttaattaaactaggtgggaggcccacgtaattatacggctaacacccatataaaattatctaaattggtttacacattatttttttagaaaaattgttagaattttaaaaaattgaaccttactatcatcgggttcctaattttatatttttttaaaagtcacaccaaccatcacctccttactcctttgtctgctcgatctgtcatgacttctttaaaaatcttgattaccttgtaatttttaagtttattatcttattgagttttgttttatagtttatagaagtcacatcaaacactatctatgtactctttacagcccgttcattgttccttctctttattctcactagtatttgaaaagctaaaccaattcattgttggattattcttttacatcctagaagtcatgtcagccgctgtgatcctaactatctgccacaactcttaatcattattaggattctaaaaatcaaatataatcattattggggctttgttttataatttttatattatatgtcccattagacgatatcatcctactcctttacggttcacctgctatctcttatttattgtcatttgccaccgttgtattttagatggaatgtttttcaatatttctttttaatttcaattttataaattatattcctacttaaacttaaattttattttctaattttggaatttattttattaattttgaat

SEQ ID NO: 82877 - DNA, 1074 bp, Oryza sativa
gcaactgccatcgccaaacctctcctgctgtcggggcacgccgctggccagcgctgacgctcctctgcgcgccactggtcgcgtccactctgcccttgccctcccgccgtcgctgtcggacatcgcctgcccaccgttgtcgctaaaatgtgggatagagggagaagcgattagagatagaagtgaaggaggggatagagaggagagatatgagagctgacatttaggcctgagggcatttttgatatttcacatgatttatctctcctcttcaaccagaaattattactttaatacgtgcggtgtccaccagcaaatatcaaatttttaggagtattttttccccaaaagtcacttcgtgcgtatcctagagctaaaaccgttaagtcacgatgtcctgtagtaaaatttctctattctaaaaatgtttataatgtaagacggagaaagtagcaaagatgtttaggtgtgtttgatttgggtacacactgggagtgggagtccgggagtctggacccgtgagcccctcaaaccaaacgcctccaaaatatctgtttcatcccaattggcattttctcccacaaatcaaacacagggagtttcaatttacatcaggaccatgagcgtgcacgaaaccagtggaatttgcatgcatgtgactgtcgctgaatacatcgcactccagtacagctggtaggcacgtatattacgcatgttccttcacgtacgtagaatgcccacgtttctgtacatccagctgaagtacgattatctggcaagttatcccaaatctctcggcgcgtttaattaacgtgctcggcgatcttaccctgagatttttctcttgtcaacgttgcgatagatgccctgtttattaatttcctttcggagcaacattggatatgttgcgtacgggcatgatccctttggacacaagctgaacaatcgaaagcaggcccgcaaggacagagcaagtggcagtgcatgtgcgtagttaagagtggtcaataagatcagaagaggttggcaactaggcgtgtcaacttgcttaacaggagaaggggggtccactat

SEQ ID NO: 82878 - DNA, 16555 bp, Oryza sativa
  unsure (1)..(16555): unsure at all n locations
atatatcggcgtggtnaattaatggagcgggtaaataaantacgtctctactttgatgctgattaatatataaatttgntgtaattatcatggcttttttatatnnnnnnnnnnnnnnaaaagggtttgatttcgatntccactngcnannnacnaaaaaaatataaaaaattaaaaagataagtcacgcataaaatattaatcatattttcttatctaacaataacgaaaatacgaactataaaaaatatttatataagacagtcaaagttagacataggaacctagggtttgactttttttttttttgaaacggagggagcaggcgcagtacgaggcacgcggaggcacgcacgccactgtgctcgcgcacggctgacacctgccctgccgagtggcagtgtggcacaactcacaaggcctgcctctgccagtagtcccctgacctctcactctccccctcactgtctcggctgctagcctgaaacggtgcaaacctactgctgttactgacgcgtgattgcgtgtatggctctttaagctgcccccgtgagatgagatggtgtggagcagcttgccttgccgtgacgcgaggctacaattcaatggttgacgagaacggtagcgcacgcacgtacacgttgggggaattacactagcaaccggaatgttgtgtcagaagtattgccggttccacggcacacatttggtcgtgcaacacgtccataccataccggtataccagaaggcgtgacaagctgacggcgcgtgcaggtgatggttgtagcatagcccatcgccttggcagcacaatgcctactctctttttttaacacgcatatcacccgtacccatgcccattgttaccgcgcgatgcatccagtgttcctaactgtgcatatgtggatatgccaaagttcatcaatgtttagcacaggcacgcaaacactttataattgggtgaatgattgttacagtagcatgtgatgcatgtgataagttcagggatcaggaccactgacaaacagtgcattttaggacaaaaggcagtgttttcccgtcagatgctaccttccaattgatggagcaaaaactggctctgaaactcgccatattcaccaatacgtcttcaccggtttggaacttgttcctgtcgcgcatggatatttactgccacaaggatcaggtgagccctatctccacgctcaagaaccacgcggagcaaatactagttgtcagaacctgagttactatcacattgatattagtgataggaacattttgggaccaaaaaatggggattaaggcagggaaagcaataagggtttaccatgcgggaagcttgatcacctcaaaagggcacgaaatacaggtatgattttaagcaaaataacttgcagtcaatcccagctagtcctgttccttctaaattcctttttctgcgaaagcactttcttcttcttgagtctcttcctttcagcggctgcagcactgaaatgaaatacacagcagcaactgaataaacgagtgtaattcgacaatttatagttctcaagtgtgagctagagatatgactacaaagattcagagttcgcatatgcaaaaatgtttctttgatctcctaaaaactaacattgcacaagttcaaaggttggctaatctcaaccgctactaactgtttgcactttggagagtaatgcggtatcttttatagaagcgtatgtagctacttgcacacacttgttacatttttttaagaaagcagatctatacacacttggtgcattcaattacacaaatagtattattaatctacaactggataataaaatatcaaacatcatcagcacattgcagaagtaatgatgactgcattggactttctaaagaaataaaataactgaaaacaacggaaattgaagggagcagatgggagaaaaatagcagcttacatttttcaaccctcctctttggctcttctgagggggtggaggtacataggatgcagcatcaatgattgcctgtaagaagatacttgtttagttaaaaagctaggggagcacaataacatgaaagcctctgcaaattacttcctgacaaagaactgaaatgagtaaagcatacctgtattttctgcaaagcatcttcaatgtttcccctaaaaggataaattgtgtcagttgctgtccaaacaagacaatcaaaagaactgagtaacatttacttttgtgtcctagtttttgtagaagatatcacaagctccccatctttatttatccggttcttttcctgtgtataccaagcaaatataaacaacctcttgagacaatacagaaaaaatgacaatgaagatttgcaaaagaggaagattttttttataccgtttgtaatatccgttctttgattctctcaccaagccactgagcctcttttacattgaaccgcatgtcgacctttgtgttaactgaaaatcgatatcaagtattttagaacaaagaggcgaacataaatgggggaaaacacggaacattgattggatagcagggcattatggtcattatttgaaaattctgaagacaaggtgtatgctttagaaccaaaaaacaatcatgtaatcatgctgagtagcaaataaaatatgctactaaatttttgaacattttaaaaataccagaccaatcccttggtcaatgctgaagtaaggctaagttcttttcagaaaaatcgaacgagcaaccttcttttttttttccgttagcatatgtttcccaaactgctaaacggtgagttttgtgcaaaaatttctatataaaagttttttaaaaaatcaaatggatccatttttttttcaaatttatattagttattacgtaattaatcatgtgctgatgagctttctcgtttcacgcgtgactgaaaacctcatcctaactgcccaagtgaacacacccaatattaataaaaaaatgttgtgcaaaaggaaaaccaatgttatagtattacgaaaagaggaagtatgaaaacaatgattcacgcaaacaaacagattaggaagtgaaagcaagaaacctttattgacattctgaccaccagcccccccacttcttgcaaagttaagagtaacatgatctgcaaccataaacagggtagatctcaaaacaggttgacaaataatgcaagtattaacacaatctattaataagcttgcagcttatcaattcctcatatctttatttcatcctttcaagtctatgtacattaaatacacgtcaatcaggaatagaaaatgtactatgtgaggagatgtgtacaaaaccatttacattgaaacatcttgatcaacatataacaaaatgtgcattcaacttttactatcacatagcaacagttagacaagatgttccaatacctgttagatcaatttatagagatattcctttcaaaaatttacagagacatgctactgctagatagagagtattgtacagagtctttcttattattagtagcgccaattttgctacagtacacccgaaatttgtgtaatttgctgatagacatcgaaaaaatgtgtcacggatgaaaaacatcctaaaaaactggtaattttctagaggacattttcggctcaattggatagatacattcttaagaaagacgataatgcccctaggaccacatgcttcaaacatggtgttagagtaaaaatttagaaattatgcaactctaaatttgccatcaccccaagtacattacttgcatacattatattccatcctcgctccagtcttagctcaaaaggttttgatcctaggggcattctcggctttttgaggaatttcaatctccaattgaaccgaaagtgtcctccactaaattagagtgtcgttcggacataacacgtttttacgatgtctaccaacaaacaacataaattttgagtgttctctaacagattttgtcttagtatgtatagccatacagcagcaaacctaggtgcttcttaagctaatttagctattagcatgcttttcaaactattggttactgtcaacaaacaggattaacaaaatgcaagtcaaatcttgttcatagctagaattcaccacattgtcacctctaaccaacatataccgttaagctgtcaaaattatccttagcacgaaatggatgtaggaagtagaatatacacctgagtcacgaagtataactcgataggggctactggctaggcagagataatgatgagatatgagatccccaattctcaccgagcagactcatcgaccgtttacacatagtacttcggagtagagatattagcctaagctactgaattttccgtttgaccaatacaatatgaataccaacaccagctgtttgttaggatttgacgtttcaattcttcatatgtaggacatcgattgagcatcattaccaagcatatgtgtaacacaaattaggggcaatagtggagttgcagattattacccaaagtgatcttgggggcggggtcggagccggccgaagcggcgcgctcctcggcgtcgcgaagcacctgctgggtcagcgccaggcgcgccgacaccttcctgcccccgtcgtcgccggcctcagccgccgagcaccggaggcggaccagcgcgccccggcccacgccgagggcgagacccacggtgggggcaggcgacgaggggccatggaacaggagggaggagacctggcggaagccgagtcgcaggaaggtggtgctccgcatggcggtcgccattagccttcgtgtggaggacgccgagcgacggaaattgggggccacggctccacggcgaagctcgaagcaaggcaaggagagaggccgaggggaggtggagattgatttgggcctatgtgggctttccgctgtcatgtgtgttcgctaatgggcctacacaattcgaatgtgtgggccacaaggaatagaagagaaagcaaaaccaaagcaagtgcagggccaggaatgctgatgggcaatcgatcgctatagggatggggtagcaatagatctactcccctctctctccctccacccctccacatggtttcttttttttttggcaccgcattactttcctattttagtaaatttatacacctcaagtttacacatataaagtttagagaccaaaagtttataagtcaaaagtttatatatccgattcaaatttgaatttgaattcaaatatttttttatatatagtatttctatacatctaaagtttatacacctaaagtttattgacctaaagtttataagtcaaaagtttacatacccgtttcaaatttgaatttgaattatatcctattcaaatttgaatttgaattatatcctattcaaatttgaatttgaattcaaatattatatatatagtatttctatacatctaaaatttatacacctacagtttatggacccaaagtttataaattaaaagtttacatacccgattcaaatttgaattcaaatattttctatatatagtatttctatacatctaaaaggtgtattatacacctaaagtttatagacccaaagtttataagtcaaaagtttacgtacccgattcaaatttaaatttgaattcaatttttttatatatagtatttctatatataaatttttctaaccttttatttttttaaaaaaaattgtgtggtgtataagagaagaaggggaggaggaaggagggagaagagggaggagtatagggggagggggaaggggagccgaactgattacccagcgcgatcactgacgatcgatcgcccattagaaggcccgtgcagggcggttaagatcgttcgagtgtccaatcaaagagttggatatttaatcaggcatgctgcatgcactcctacaggttgagtaacgtccaaggttaaccacaaaaaggcgagatctcgcttttgtatagtaatggaaaaaaggcaatttgcataggttgctcgtgccaaacaaaaactgtctttactcaacaaatcaaagctacaaacacgaacgaaatcaacataaagttgggacaaagtcccccgtattcacacaaaagtaaaaatgcaggtcctgttttaaccacacaaatacagtaaaaaaaatggtcgtgtttgttttacctatgtaactacgctactgctctgattattacaaccatccaccgcgtctgtagcactcccattcacatcgctacagctactccccaaccccacagacccgttggcgatgctcccgccatctctgtggccgccggtgcggctgctgctgctgctgctgtagaagcacaccaccttgcacttcaccacgccggcgcaggcgacgtacacgtggaaccccggcgccaccatcatcttcacgcttgccggctccagcttcccggcgcgcccggcggccgcgtcctccatgaaccgcgagtcgaagcgcgcgccgcggtcgacgcgcaccacgggcagcggcgggtggacggaccgcgcgaggaggcgcaccccccacacgcccttggcggccaggaagaacgcctgcagcagcggctccggccaggcgcgggcgcgcgcccaaccgagggaggaaaccacctcgctcatcttggcgtcgcagaaccggctcaggccctcgctgtagtgcttggtaccgtggaggaggacctcctcccacgtcagcgccgcgatggagtggtacgccgcgaggttggcctcgcagcggcccgccgggtccgccgtgtgcacgtcgccctcggtgtcgagctcgaagtcggcgtggaacgcgcggttcaggaagctctcgaggttcgggccggggttcaccgggctgcggaggtgattggagagagcccgcgtgaggctccgcacggcggctcgcgctgtcgacaccgcccggaggaacgactcgacggggaaggcggcggccgtgggagtggggagcacgcgggcctcgaggcgcgcgagcttcatctccagctcggtgagggagtgcttcagccgcgtggtctcctccagcgcctcgtcccgcgtgcgcgtcgccgccgcgagccgccgcgagaggtcggccgcggccaggcgccactgctcgctctcccctccgtccccaccggacgccgacgtcggcgacggcgacgaccacggcgtggatcgtcgggtgagtgacacgaacagcgagcggatgaccgccccagggccaggcgacgccggcgcgtggagccgctgcttgaagcggcagtcagagcaggacaccgccgcgacgtacgccgcggggtccgctccgcctcctccttcgctcttcgctcgccgcggcgtattcttggcacccccgctccccccgcggtggttgtggagtggcgtcgcgacgtgcgcgtacttttcgtccaccttcgaggccgtcgtcttgccaccgacggcccgcctcgcgtcggatacctgattattacgccgcattgttgaagcgcaatccttgaaaaaacggagatgctaactagcgaggaagaggacgcttactgctgcggcggggaagggagaggaaggcgagggagaggagaccatggctggcgggcgatggatcgagctcgagctcggcgagctcgctctaccccctgcctgggcgcgctggccaactacaccaaggacaactccgtctggttgcgattagcggggagcgtggcgagtcaagtaggggttttctcgggttcagaggggcggtggtgcctgtgcctgccgtgtgctggtggcgacaggcgaggcgatggcgctgtggggcgcgatgcggggcggggcgatggtggtggtgtactggtgcggtggtgcctgcccgcgtgtgtgacgacgtccatttttttttgggttaacttcacgccctcacgggggtggaaggagtggcgggagtgggacactgcggacgcgggacatgaatgccggtcagttcggtcgctactgcgtttaatgccatgacccatctccatctctcgcccccttctttctttctcgtctattttttctccgcgacactcaaaaaagttctccatttttgcgagaagccgagagaatcaggctgtgatccaaagtttagatctaaatttcagtccttttttatcacatcaaactgtcatacacatataatttttcagtcacatcatctttaattttaataaaaatccaaactttacgctgaattaaacacagcctcagagaagaagttatgggattctggaaggagggaaaggtttgcacatcaactcgtgcttcatttgtctcgcgctagctaccgtatgtcgtttgtactgcgtgtcaaagaagtcaaccaaaagcccaatcaattctctagacataattatcttaaaaaaaattctctagacataaggctgtttagttggtgaaataaaaatttttgggtatcatattggacgtttgactggatgttggaaggggttttcggacatgaatgaaaaaattaatttcataactcgtctggaaaacgcgagaaaaatcttttgagcctaattaaatcgtcattattacatgtgagttaccgtagtacttatggctaatcatagactaattaggctcaaaaaattcatctcgcaatttacatggaaactgtgtaattagtttttatttttatctatatttaatgctatatatatatgtccaaaatttgatgtgatgtttttgcgaaaagtttttgggaactaaaccagagccataatagtactaagtactaaaactttttcctcgtagctaatcacaggagtagtattacagacgaatactgttttagaagctgtactcctagctaaattgagtacttgagacatgcgaagacgggatctataaactggccagccgtgatcctataggactatagtcacggtgagacattgctactacgtaccatcccagtggcatgagcaagaaaacaagcgtcatgagttcgtggagggacacattaagagcggttggcgagtcggttacatgcatcataaatccggagctccatcggtctggaccggccggccggccagccggcgctgtccgcttcaaccgctgaatgaattgaacgcgatccgtattccgcgtgacaagtgcgtggctcttcgttgtctctcctagtgaccgcgaacattgcaaggcgccggtcgaggtttaccgttctccatttgtcggttaattgtaccggagtcagcagcggtaacgacgtcaccggtgacaacggactatggtggtgacttcgcctcggcagatttcacgctcctcctgggagtccatcggcatcagatttgttcagacttctcacccaaataaaaaggaactcgttcagactttcaggctgccccagtgtgcagtggaaggagctcctctaacttagggtgtgtttagttcacgccaaaattagaagtttgattgaaattgaaacgatgtgatgaaaaagttgaaagtttatatgtgtaggaaagttttgatgtgatagaaaagttataaatttgcagaaaaagttagaaactaacctaggccttaaagttagagggacatgtgtccctgacaggtgagacccacacccacgagcccatatgtcagtgactgatgtcccactaacttaagtgagagaagcctcatccgtgtgcagtgcagttcaattcaagaccagagctctggcaaactgctgtcgagatgaaatcacccgtagactgctgttttcagcggttgttaccatgccagcaaacgagcgcacagttgaccaagtcaccgagaattaggactcgggaggatcttaaattggatattttaggacttgttagctttattccagtttttaatttcactaaattttaataaagtaacaaattaaataagacattatcattactatcttatcgaatttggtagttctaagagtttcatcttgaaataaacactgccaaaaatctagttaacgccaaaattttgaaaaggttaatcagagcaacgaagtaagcaagtccttataatttctggatatcgtttaatgttttattgtttccagtcaatcgttatactaactcttactccaataaaaaacactactatatagatagagtatactgtataaatagcatttgcatggctgatatacgtacaagaaaaagatcaacactggaatgaactagtatttaaaattgtcaaaaagttatccttgactagtggtctcatactacgatcaagccactcacagaatattacgcctacagtcactggaacggatacccttatctcaatcgggcggtaagccccatctcaatcgggcacagcgtccgtcacaggctagaagtcactgatgtgaagagttatctcaatcggacaaacggccgtcacggatgaatctatctcaatcggaccctaagtaaagcccgtcaccgataactctgacccagacgaccggtcaaactatagcccgtcacagatgacttacctcaatcgggccacaattagagcccgtcacagatgactactaacatttatcgggcctaaactagagcccgtcacagatgatactcatctcaatcggggctaaactagagcccgtcacagatgactgctgaccttaatctggcctaaattagagcccgtcacagatgactatcatctcaatcgggcatttagttatggcccgtcacagatgactataatcacaaaaaaaataaaatttgttttttggctagcctcaggcctttgctagccatgcccgctgcataaataacagaaacaaacacagatatccaatatccccagctccccagcatcacccattcatatacatatgcattcacatacacagacatcaatatatttcacacaaccacacatttacagccatctcatatttcacatccattcacatatttcacatccattcaaatatttatcatatttcacctgcaaaaccgagttaattagatcaaatatttatttagtaagtcttaacataaacatatgaaatatatacataaatataagcatcacatttacatcatcacagttgcataataagtgttcatcattgcctaaacataaaagttcaacattgttcatcattttagtttaagcctaaacatttatttggggttaattatttcgcagaggatgaagctggctatctcctcgcgaacctcctcaaagctggtaggcagagacttgattattgtgccctacattgtcataattccagattagttgatcgatcatatataagtgctaaaatgtagttagtctatcacaattgagaccaccgacctcaaactcagccaaagtcttcaccttatctctatacagaaggcgcatgttgtggcacacatagaatctgcactggtcacctatttgttgcttcaccgggaagtcctttttgtggatgagggtgtcatgtcctatcttcctgaggcctcctctttgcacgtattgggcccacgcttcatctatcactagttgaattggggtccaatcatatgtgttcttatcaattctggagttcaggtagtgacatgtactccacttaggtgctatgatcagaaggatccaatgggcactgcggcattaatatagtgaaagttaattaagtactgaaggaatgtgtcatgctgttgtgtatatttagataacacacttactattgattataggcgcacataatgtactccttgtcttggcgggaccacaaggtgtcgtagatgtagttgaccattccttgacggtcattctgaagatttgtgacagtgaccacttgtggatcaaggaaggcaacttccggtgcattcttctgacaccattgccaacttaacctacacacaggataaacgatcttgtaagcgagttaatccgattgttattaccagattgagttgggtgacaatacttacaaggagtagcacttaaggaggcttgtgtccaccgctcggagcatgtagaggtcgaatagatccttgaagtcgacgacgatatcatttgttggaccaaggaatggctttccatcatgctctccaaggatatcggtagctttattcggcttcctggcgttagatttctccatgtagtatgcgtgaaggtccttgcaagcggtgcccattgcggcaagcacgtcatctctaaccaatggcatgcctagatggaactcctgtggagcagcgtatttcttcttgacctctttgcccttagtctcttcctggcccatgcccagatctagcttccttggagctagaagcgaggactgcacctttcctccccttcctctcccctttgctttgggtttatcgagagtaattctctgaggggaagagtgtgccttcctgctctttttcattggtaggggttcatgaattgccttgctgtcagcctccgttcggtcctccccaaaatccgtgtcgtactgcaactgcacatcgtaagattgtgcatgacgatcttgagcaggaggggctgaaagagcaaaggcgggtctctttggtggacgaccgcctggtgcagtggttggcctcgctgtaaccctgatctcaatgaggtccttgggccattggatgaaggtaccacaggcatttcctagtgagaggacctcgtcgtttggtggatactttagtgggaataactcgtattccggcttcaccgagtcgacttgaacttttgcacagtcgcccctgagttgcgctccatgcactcttgtctttggggtcggcttgtacgcaagtcccttggctgctggaaccgtgaaggttggcatcaccataactgtgagggtgtagctcgttggttcctgcgatagattaatcattttttttagaatattatatatcatatggattcgttaagtctttcatgcattgtggatgaaacttttaccgttatgtggtcgacggcgctgtcgaccgatgttgctcttcgtgcgcagcagcagcggcggcctgggggttctgttgctcttctcggatctcttgcctaatcttggccctcatcgactcgagcttttcgtagaattcagatgtcagctcaactcttatcgacacctggatcttggcttcaaggcgtgcatctttcttcgccttgttggaagtccgcttcttgtactgccacgcatagtctggaaatccatacttccagggaacagaagacccaacgccccatgtccatccacggtgttccttgttgcccaacgctttcatgaggaggtcgtcctcgcgtctttgagagcaggcctcttgcgaggcttgttgatcggcaaccaactcctttgcattacaatttagtggggttaaataaactgcatgatcagaaacaatgcgaacatctagttggactacacacttactatagcttcgtatactcgttgatcttctggatttggcatgatgattgtgccatcatccttcttctggtacctggtcctggcccagttcctagcccgagggtgtgggatatcgccaaacacaagtggtgtgttcgattcctccgcttcttcatcctcacgctgccattcctctttcttaccggcatattcagcggtgccaaaccgatgcggatgctggttcttggtctagagcaagcgatatgcctcgctactagctctggactcgggggtcgacttcttcacatggaattcctcccagacctgttccgtgatccaaggaaatttctctcttggatctggattcgtcgggttgtagacgaactcgccgactagcttagtcttgaaattcttccaagcattgcccataaccttgaaagcagcccgcctaagacggtcctcatgctccgcagaataatcgaagctctccttgaacgttagccaagcaatgtccttctctgcggccggcacgagcttgatgtcatcttgcagaatactgaatttctgcctacctatgaccccgcagatagacctaaatcggctcaatattttctttggagatgtcggcaaccctacggcgtccatcgctgttatgcggaaccgttccttagggattttgttcccagtcctaggagtacgtgtccttgaggacccactagttgtcgtcgacattggttcgccttgctgagacatcgtctactttttttcaaaataacaaaaatacacaattcaatgctacaatctattacaatgaattgaatgtaacttataaataaatgaagcatataaataaactaaattgcacatctcacagtaatagaatgaattgaatgtcacatataaataaattaaacatataatcaaatcctaaaatcataaattcacctcataccatctattcatccacatatcatgcatctatcactaaattcattaatgcaccacattccatctattcatcaacatgtcatcaatcaaaaaaaccattcgttcaccacatatcatcaatccctaaaatcatctatcactaaaatcatctatcactaaattcattaatgcaccacatttcatctattcatcatcatgtcatcaatcaactaaaatcatctatcactaaattcatcccaacatccacattttatcccaacatccacatttcatcattcaccacatgcaggtagcagagggcggcgcgatggaggactcacctgaggtcggccgggggggctcagtggtggcggcgccgggctcggtgaagacggcgggctcggtgacggcggcggcgggctcggcgaaggaggagttcgcggcggcggcgccgggctcggtggagggcgtcgccggtctgtggagacgacgccgggctcggtggagacggcgccgggctcggtggcggcggcagcggtgacggtctcggtgccggtgccggtaagggaggacggcggcggcgaagtacgagttggcggcggcgctagggttctaaggaggcgggaaattgtagcgggacttagaaaaatttttgatccgatctgagaaaccctagttatagtagagtgatgagtcatctctatcgggcttggccgtagggcccgtcacagatgactcatcggtgacgggctccatactaatgcccgattgagatgacattcaggcccgtcacggatgactcatctgtgacgggccataagataatgcccgatagagatatctctatcgggctttaactaaggcccgtcaccgatgactatttttccatttttccaaacaagtctttatatttgtgcgtacaaaatatatagctgctgtataataattcattttatcagtcataatatattttcatattctaaatgatttcaaatcgaaatatggtgaacaacaaaattgtagaggttatcaagatctacaacttttattttagtcatttttctatataacttttttcccaacaacttgaaattgattttgaatatatgacaaatctaaacagcatttgtaaatactaaatgatttcaaatgggaatatggtcaaaaacaaagttgatcctctcatcaagatctacaacttttattttggtcatttgtctatataactttgtttccaacagcttgaaattgattttgaaaatatgacaaatctaaacagcatttgtaaatactaactgatttcaaatgggaaagccataaaaagcaaagttgtacgacttatcaagatctacaacttttattttggtcacttcttcatccgacaaagtgatagtatcaatgtttataaaattgacatatatgtgttgatgtttatgaaccagatgagagaaatgtgatttttgtgaataatataattatcactttgtcggatgaaaaagtgaccaaaagaaaagttgtagatcttgatgagaggatcaactttgttgttgaccatattcccatgtaaaatcatttcgtatttacaaatgctgtttagatttgtcatatattcaaaatcaatattaagctgttgggaaaaaaagttatatagaaaaatgacctaaataaaagttgtagatcttgatgagaggcgggcgctctgttcatggcgatatttacgttctaaatcatttggcaccctcaaattgtttatgacttatttagtcaattattctacctcagctcttttttttgttcgcacattttttatgacttggttggaaaaatggaaacttagtcatcggggattggtccttgttaaaccctcttagtgatttttcaattttttttgggcattattttattgctcggtacctgtggttttatccgtaacgggccgggggtcctttcttttggtcatttgtctttcgaaccctgcttcttctgtctttcgtgacatgccttttctcttggacgaatggcacatgcccattccccttttttttgaaaattttcagttatctacgttttaaaaattaatctccatgtgattttttcatcgcacgttaaaacgaaaaaaactctttagcataggattaatnccccctttccctttctttaaaatgcgacaatctatttttttttttggttttttaaaacctccctcttcccatttaaattttttttgtccaaaaccattatattttattcgcttattccttgttgccttttttccaaaactttaaatttttcccccctcttaatttgggc

SEQ ID NO: 82879 - DNA, 660 bp, Oryza sativa
gtctccgcggccggacgcgagggagatagtaatagagaagtgggtgggccttatgggctttcgattacatgggcctctttgaggcccatgtagttggggctccgtcgtaattgtgggccattacggttggcccggagtgggattccctcctcctcctccttgcggcccatatgtttgggctgcacagcgtacactggtgtgtacactggtttgagaagagaataaaggaaaaagtatactgaaggtccctcaacttatcatcgagttacaaaatcgtcccctaaccacagaaataccgggtgtccctcaactaataaaaccgttcactttagatcattcggtggttttgaccccggttttatctgacgtggcggatgagtcagcatgagacccacatatcagcgtggccactgacaaacgacttataatattaaatggagagaaaaagtattaattatttaaattttaataaataaattaatataattttttaaaacaactttcatatatatatatatatatatatatatatatatatatatatatatatatatatatatatatatatatatatatatattaaaaaaagcaggacacacactcactctctttctctctctcatcattgttgaataaagagagaaaacccctgattcccca

SEQ ID NO: 82880 - DNA, 2008 bp, Oryza sativa
gtgcatctctctcctctctctttctcctgtgcaagaaaaagatccaagctttgagcaccgcatcaatcgcttttgttattccagcgagtttttgggttctttgtgtgatttggatggaaggtgatcggaacctctatctctctctctctctcatcttgtttgttttgtgggcgactgttcttgccttcttggttggggatgatcagacattcagaccatcagatgaatcgatttctttgtagagcagttcttgatttatttatttattttgcgctaggtagtagatcggaggggttcatatgattcttggatcttttggttgatttgatttgatctttgttcttcacatggatgaagcgagttttgtgtgtgtttgagcctttgccctttgcttctctgtctgcggaagaaaatactcgtcttttccccttcacttgttcaattttttctcagttttggtggttagaaagaaaatctttgtttgcaaacttgattttctttttggaatgctcatctgcaacgagttgcggatttttttgttttcttgctgctctctgaagagcaagtgcggatcttgcattctcggtcggatctctgcgtttctttgcaaccatcgattccactgctttgcttcttgtaggtttctttggttcgatggaactcgctttatgcatgttctttcacttctgttcttgtgaatccttcgatgtgactcctgcggtttttttcaactatattattttgttttatgtgctgttgatttcccttccagtttactaattcctactgcattgtttaatctttacaggtgggcttcaggactggtggtgataactggctgttggtaaggtgagggttttactttcaaatgtcatctgcaacaatttcatgttgctcaccaattttgttggactgtgtgtgggctgtttcttggtgcttatggttgtgggattgagtctcctgggtttgcttccacttagacactagcagtataatgcacataaagttgggcaaataagtttaatcatgcacataagttgaatttgatgcacatttttcattactttgatgcacataagttgggcaaaattcaagtgactgtcaagtcatattctgttgcctattgaacctgcaggaaacatggcagagaccagaggcgtgggtgggcgccttgcggcattggcttctaaggtggactcgaagatatattatctcaaggatgtgttggttgagtacatggacatgaaaaatgtggttgctgaaatagcagaggagagggagaggttccagcttgaacagcgtggttcgtggccttctcacgaataatgttgtgcttcgtcgattccaatgttgaactattatttagtaaaggtgtcatatgtaacttgaaatggttatggcaggaaatgacgcacttctggaagcaatgaaggaggagcttgtggcagcaaacaacgagctcgaagcagcaaaagaggaaatctctcgaaagaacaatgagctagagtctgtaaagaaacagcttcaagagagtgaagcgagaaatattcaggctgagcagcagagcggcattgtggttgagcttatgcaaccaagaggggtaataatctatagttcctgcccccaaattattcataatttcttcatggcattgactaaccacattatgttttcaacttattttaattcttcctatttagccatgtaacttaacacctcacaaatgtctatatttttcacatcatgccttagcatactttttgtactaataaagtaataactagcattttttttttgcttggagcaggtgcaaacaagatcgatgcaaaaacgcaaaaggccattgcaaggaccttcgggctgtgaggctgatgaccaagagtatacgagtcaaatcaatgtccaatctccacgttgcttggaatcgatgagaactcctgatgtatggaacattttgtttagaatatggattctcaattcttgatattttcattatgggcctaccaga

SEQ ID NO: 82881 - DNA, 1205 bp, Oryza sativa
caaggatgggaggaaggccaccctgcgtgagtgtgttgagtacgtttgcaatcaagtgaagcaactcacagtgaccaagcgcaggaagtctcgcaggtacaatgtccatggattataattgctgattgatctcatatatttactgcttcggtagcaattgtttttatagtaacaaaatgtgggatacaaaatcattgctactggtggttaactgattgtatcatcactcatcagggtggtcaacaatctttctagcactgatcagaaattcacaagtagatggcagttttacattttacaactagcagatggaagttttaatttttgaaaattagcataatggtactttcatgttttttttttagttttaggcctttagctcgctttgattatgtttagtcaccttagaagctgaaacctaccgccattcttttaccatcaagtgttcgacgagtgaatgctacgtcaaacattgcagcctatatgaaacactttccttcacccccataaaatcttataaggaaaaatgcttgtgtgactgcaggggaagttgacctgctggtggcaccacaacaacacaagggtatattgcaagaatgaacttgtaaacttcacttcaatttcttactgcgtgatgttgtgaattttactacctttttctttctacgaataaaatccttgactctcactttttctggtagtaactagaaatgggactgctcattcttcaacttatgctattggagtacccacactctccagtacctttgccttgatgttcattttagttcccacaaatcagttctcaagaacatgttattgtcaatgtatatgcatttatatttttaagaatatttatacgttgagctcatttcgccatattgttgtttttgcaggtggtgagggctgagttttgggggcagtgtaggactaatccatgaagttcctgagcaagaatggaagtcttagcttgcttatgtcttttgtaaaaatgtcatgactaggaagtaggaatctctgaagaacctgatcgtatgaagcaacggatggaaaactatgaactactactactactactactagtacatctattttgtgttttgtaaaaccaagttgtggcttatgaccactgtactgcttgtgcacccagctcattacatgctatagtatgtatttacatgagacctatagttaatgtctgagtg

SEQ ID NO: 82882 - DNA, 1001 bp, Oryza sativa
ccatttgggcgccgtgcatggcgccgccggcgtatgatccccaagatgatgaggtggtggtcgcgcgtgcagacgacgcgtacatgttgcctgcagcctccacgccgccggtggcgacggcggcggcgagggccgccgcaaggatcacgacagcgcgcggcggcggcgatggcaggtcaagccgccgcatcacgcgcgccggccggcgatgagcaatttcgatggcccgtcgtcgttgcttgctactagctagcttccgttctggtttgctgctgtcctgccgcgactttgctgcgtgtgatatcactcctataaatagcgatggaagggctgatcgagcttcctgaatatggttccatcgtttcgctccggaggcaggccggagtgtagtggtaccctaccccaccctcccttacgataggagttttttttttctttatcttatctttttttatctgtttttttttcttgacccctggcaatggccttttgacagtgtgcgttgtgtaatcaaattttgttctctttttctaacatatatattgacgtgtaatctttttgcgccttcgcgaaaaaaatgtgtttattggtacggtttattaaaatgtatctctactattatgaaaattgaaaatattttcatcggaattttggtacgtcatccgtgtttgaatcggttttaattttatgtttctgtcaaatcatttcctttttttcttacgccgctatgacgcgcgcaaattaattgggccagcatcttttcacacgctccttgccgtacgcagtgattgggctcgcgacagagtctgttttccacacgcgcctttgtgcgccgctgtgattggacccgcaacaccctcgctctcgtgattttcaacatgtccgattgggcctgcgatgccctcgtgagtgtaatttgccttgccacatgtccgagtgggactgcgtcgccctcgccagcgattcaaaaattgaatgttttttttgtcaaaactatggta

SEQ ID NO: 82883 - DNA, 1312 bp, Oryza sativa
gaagggcgccgctcttcatattatggtatttttagcattagtcattatttgtgataaggcctttcaaaatgcatatctataaatctatgccttttttaactgtactgaggaaatatgctctcgtcttatcacaacaaaattccttcagtttttctcgagtttcttctgaaaagttctgtttgctaattcctttagttgccacaccaaaattactgataggctttattgtttcatacagggaggtctcgttcccgttctcgctctccccactatcgaggtcgtccacggtcaaggtagatgaataatgtccatatatcaatcctcaagccattcaccttgtactcatgaatccggtcgcttttaaaaggtcatactctcctgctccaagacggcgagatgactactcagcttccccaccgagaaaggatacgcaccccacaaaatctcctaggcgtcagccaaaagaacatgatgaagagaagaagcggagatcctactctcctgccagtagagatggcgaccctcgcgatgctgataacggttatgagaagtaagcatagtatttcatacttccatcactttttccttaaatgcaatatttgttttcattattgcaatagggccatttacacaccaatctggtgttttacgagtagtaaccttctgtagacttgtaaagtatgatgaatatgaaaggatgtgggccttagggtcacttgaactatgggcagcattttaatctttgctgcatactcacgacagattttgttagtcttattctgtattaattaacaggaatacatagagtgaaagtgctaactatggtttatgttcttcacaggaggtcgcccccacctgacagcgatggatcccctccacaccggaggtctcctaggcactcctcagggtcgcctccaggatcccgctctaggtccgccgatgtttcccctgcccgcagcgactgacagaactttgaaccaacgaaatgggatagctgcatgatctccacagcacctccaattctagtcagtctccatcttccttcctggtccaaccaagctgtttcaattaaaccgaagccctaagcggcgtgttgtattattgctaagtgtgcttgccatgagtttggtatggcacatcgcctgtttgtgtgctcatatgttgggagtccaggatgttgtagtcttttgagagctgctttgtttggtggtcatttgctttttgctgaacattaacttgaaacaatgtgacattggtgttgtgtactaccactagtgagccttgaactgggtaaccgcctatttccacatct

SEQ ID NO: 82884 - DNA, 9243 bp, Oryza sativa
gcgattttcttgagccaatcctgacgggtgctatcatggcagacattgatcaattcaataacatggtccataaagaagaacaccagcccaactgttggtattttgcaagtacaaaggttggtggtagttttgtagaagggctcaaggtacgagtgcaatgagttgacggctgacttctctgtggaactcagaacccagtcccttggtccaaataccccttcaaacttcttgatggtgttatccattgcattaggggcctggatgaaaaaggttttgttttcatttaaatgggcattaaagacatagagcatgatggaaaatgaattatacgaagtatgagctgtatggtaccttctttaccacatcaagcatattgtaatcaccactccagtttgatgaatggtcaaatggaagtttccatgagccttcttgataaacttcagtccagtgcataaaatcttccatcatgtcctggtttgaattggtctcaagaacaaattcacggatcttggacaatactggcctcacattttccaggccatcttttatgataatcttgagcatccgagcagcacaggggatgtaacagaaaggaagtttacgggactcaagctcctgcctgagctcatgacaagcatggattgcatgttggctgttgttatgtgtgcaagcaaggatctttgaatcaatgttaaactcgtgcagcacattcattagaacttgcagaatctcagggccagtgcatgggtatgggatacggcggacatcaagcaaaactttccgcaaggcccagccttcatcaatccagtaacacttgacggacaagtacacaatctgttcataagaagtccaaaagtcaagagtaatggagaaccgagagctaacgcactgaagagatgccttaacatcctccttcatgcttctgaacacttgaaggacaatttcatgagccttttcttttggccatagctggacaggcgggttcaaatacctgcaactgtcgataagcatactatcttcgagggtggaagttggaagggaggagctgataagccacctcagaagtaaccagttgacatggtcaatatcaattgctggtttcgctttaggttgatgacgaactttagatacagtttgaggttgaggttgatgttgaacttgggattgaggttgaacttgggactgagattgagcttgtgatcgagttcgcgctaggggttgagatcttttggctcgagaaaccatgctggtaggcgttgtactttgagttgcttcaccctcagaaagttggcagtaaccagggtggcggttattaagatgcttcccaagattccctgcacacaacaatgtagcatattactgaatgtggtgttcagacttgacagttggaaagggtgaaaataaggcaactaatactgacattatctactgactgaaactgaactagagttgtgggcatatgtcagaaagaaagattgaatcttcttggagacagaatttgcaaaacgcccttcattgttacagtaaagtgcttgtattgtattgtattgcagagtataataaagtaaaatcgtttcaattggattggatgggcgttaagagtaacagatgtatatgtataccggtggcagtggtcatgcagtagctcttcttgcagagcttgcagacgcgggacttgccatcgggggcagtatcgaagaactggaggtagagggacttcatggtcttcttcttgggcttggctcctgggcaggggcagaggaggtggccgccatcccggacagcgcgtcgtcagggtctacgctgggcaagagagtcatatcagtgagagttgcgttccccatatcgatcctctctgtggcgttgcaagttacagtagagagtgtcagcaagaattgaaacaaacatacttgtgcaaatccaatctgatgatggtgcaaatcttttgacaaggtggtgtgttgatttagcagagagatcagtgtgagcatgtgattcgcgtattgattgattgtttggttctttctactactcctaattgcggtgcagatcggagaaagcagcagcgggtgtggggtgtaccttggggagcgagccgaaggagtcgccggagagccgagccgcggcgagagctgacgcagcgcagactgcacgtgcccaccgccacaggcagcacaggggggagcgagccgcggcgccggcgccgatgggagattgggatccagccagccagccagcgagctagggtttggttttctccctgaatcggagcggctcacccagccggctcgtctctgccttactactccttccactactggttttggttgggttgggccgagtcgagtcgcttttacctttggacggctcggctaattcaagaccattttccttttttctgatttctcttaataaatactccttagtatcttttttgtgattaaagatgccaaaatactgttcgcgcataggaagagtaatactgtacatgttttgtgatgaatcttttgcaaacaaaaaaaactaaggactcctccgtttcgattatggacggaacaagcgaaacgacatatttgtaaatagaaaataatttgtaaataaaatttatatatatatatatatatgttctagcaatctaaaagtaaatgctgaaaaataaactacgatgaaaaaacctcaaaatcaactccaaatttaaaattgaaaattcaaattttgacttataagtataaccataagccaaaagatgaggctataagcttaattggccaatatccattttaatctcatcaactgaggttactgaattcttaacactactgtgctagacaagaaacaggtcaggaatacaagtgtaaaactttgacaaagtaaaacaaaaatcatttactactacatgtgttccttggtgtctgtcaatccaacaacatagatcatctctgtacaagtacaaccaaatggcacaaatccaggtgagaaaccgtgcccctccctgcttcacttgatgttcatgtcttcttgtgagtgtgtttgtgtcgcacaaattttgacaatttaaccctttgtaaaaactaattttacaaatgaaccgctgccaaaacttatttcaaatctgacctttttgctcaacgctaaatcatgtggcgcggaacttagacacctcagcgccacgtcagctggcgctgaatgccgtgccacggcggatgggagactaagtcagcgtgccaacgtacattcagcgccatactatttggcgctgaggtgtctaaattcagcgccacacgatttggcgttaagcaaaagggtcagatttgaaataagttttggtagctgttcatttgtaaaaatattttttgcaaagggttaaattgtcaaaatttgtgtttgtgtcgtgtgtatatgtacccagacagctagccagctcaatctgtcagttgctcctttggtaaaacaaattcatcggattgatccaatcagtgagctcctaactcgcactgcagcctgcatcatcacaaattaatttgtgatgcatggtgacttcattttctcttctttgcctttgatctttttctccatagcacgcccagcggaagggtgaacattgggaaggggattttaggcggtggtacgctgcaaaatggggaaaaaaaaggatttgatcttccatcggcagcaatatgtaagaagtgtaaagagtactatgcaggtaatggcagagttcaactgaaccattttgggcgtgttttgttgctcgcatccccctagtattaactactccatccttttgggtaaactagagtctgaattcatttttttctgaaagggtgaagctttagctgcaggatttcgccttctgaaaaccgttcctccctgagctgaaaatggtgaggaggatttgtttcttctatctaactattctagttgtatctcagataattgggagttgattaggtgattgctgattgagaagagaattaacaggtggtagtacaggatagtacttactgcaaattgatggtctcgatttgggtgagctcggcgttgaaggaaccgtcccgtgccgtggcgtgctgcctgatgccaagaaccctgcacccaaccctcctcattcgctcgtacgggttcgtcgacctgacgcaaaagcaaaatttcaattcagttcagttcaagttcagtatatctcaagagaattcagttgagttgagttgagttgagttgaggaatcattttgatgttacagttagagttagagtagaggtacctgtagaggaagctcttgtcgtggaggccgacgacgagcgtggtggcggcgagctggttcaccgtcgccaccaccgtctccccgacctccccctcccgaaccactatctccaccttcgcctgcataccatttcacaattcaacaagatgattaattgcttctttctttctttgttttgagttgacccaactaccaccattgattgattgattggttgattggtttacctccgcgatgccgttgcagagctccctgaaggcgagggcgagctggaagccgccgaggcgtaggctgcgccgcctccgccgcgacctcgccggcgggcagacgtgcagcagcgtgatgcagtcgccggcgcggatgaagttgcgcacggcccactgcagcgccgcgcgggcggcgcccacgtcctccaccaccaccaccaccctctggctctccattactttctctgtcacacaaacacacgctacctacctctatcctctagcctgagattatccatccatccatccatgaaagcatcatcaagaagaactcgccatgaaagctagctcctcaagaagcctctcttcttgaaagagacccggtgaagtgtgtggaaacacaaacaagagtagtagatgacaacagaacggactaatactagcagtggcacagtgctaattagtactggtacgtagttaacttaagtgtgtgatgtgctaagctactgtgcgtgtgtggtgatgagtagctgagctagatacaatggtgactgatggaggattagagtagtagagaatcatcagctgtagatggaggactaaaacaaatgatgaggtggccatgccatgacacagacacatttgacatgggaccatatacctgaggaggaagaagaggaaatttaagggtcccctactgtttctctcaacatgatactcctcctctctcatcctaaccactacttctacaattcaattgaaattgattggatccctagataatatactagtttaacttccgtctatgtcatgactcgaaccatacatgtatatatggcttggctgctggtttttgcttgccattagcaacaacatctagctccatgcgtgcatacaacatggctcttgtttttgtatggttttgtcacgcaatttggaggttaggagtggattagttcattggtttagggaatcttgttaacccgtcttaacaaatttcctatcaatacaaatcgatggactgcgacgtgtcctacctgctgcctatgtatgcgcattagtttagtttagagaggacaatgtttagagattgtgattgtgagacgatcaaacgagaccgggtgcagacccctctaatttcgtgtctggttctattttttatctctttttttattgctggattggatgggtttacaactggaagaacttatgtcgtcgtcgtcttagctagtgtagcagttgatcgattaattaggtgtaaccgcttaaaaaacgtccggtgatggcagcggattatatatgtcatgctagtgcttacggatcagtaattattagtggcatctttttttttgtttgttagctaccctatgctttacatctaaatatactgttgtgatgtatacccattaacactgattgagaagctaattaagcagctgctgttgtttgaaagaaataattattacagtattaagctgtgttcagaagcaaagcagtgcttcctcacgaaacacgaagcagcaaacacacgacgcatacaaggctacagcactagatatgtcggaggtaggaacaaaagggccatatgcaatataatgcagcttttgcctaagcttgttcatagttttggttgcaagtgttgtcttctctccttggcttggcacgcgactgaactggagtagtatttttctttcctggggcaccgtctgcatcatctatagcttccttgtgtacaagaaaataatgctgctcgtttggtgcagcagtatcgccgtgtttagttctaaaatttttctttaaactttcaactttttcatcgtatcaaaactttcctatacacacaaacttttaacttttccgtcacatcgttccaatttcaaccaaactttcaattttagcatgaactaaacacagtctataacatcatgtgaagtttggtctaccttttgaaagcagcactgaaaagggagaatcgccattgtgcactgcgtgctttctcgtgcctaatgtgttgatgcacgtgtgcctgttgccatggtattggccggtatgcaaagtcaagccataggcaaactgaaccacacaccaaggaaaagaagaaaaaaaaaggatacacttgaaaaacggataagccaccgacggacggagtgcaaccccacagccacaccggcggccgaccaggctcactgtttgtacttcactgtgctctcaagtctcaacacaaaagaaaccgccacactggtacctataccacccaccagtttgcagttttgcacaactctgcattctgtctctgttcagcaaaatcaaacaagagcggatcgcaagaacaataggcataaaaaccgttgttcaaattcaacagtccatattaatatgataaacttgatgattaagcacttcaaattcaaagtcaaagcaatctctttagcatataaaggtacaaaaacaaacaacacagctaagtctagaaaagagacaaaagagtcaccgagtgagttaagcccagcatggtgtaccaggaatgagatccgcctatacaaactaaatcccactcgcatggtaacaccctaaagagtaagaggcacactttgcacctactatatatgatgatagagcatcagctgcccccatctactgacaactctaggggtataaaccaccggacatcaaacctatacggcccctgccaacacaaggggcacgctaagttccatttatttggacaacagtaagagctggtgcatcatggtgaaggatacagcaccagccggtatgactgacagtacatatctgctatcatcatcagccccttcagtaggaaccacggtgagggtaagaattaccctgcccaccccttgctcccatgcttccataccctctgccaccgtagtatgacccacgggcgcgaccgccgccacggtaaccacgccccccaccacgatagggctggcgatgccttgggaaatcaccaaaagtctgcacaaaacaacaatcagcaaaacagtgatggtacaacatcaagaaagcaggtggaccttgtacctctgtatctagtttgcgctgttcggaaaatcttgacctcccgttttgccctccacgtccaaatgttccactagtgagggaatcaaaaaagtcatccttgacataaacaggctgcattgaggttgaaagacatgttttagttattgctgaaacaaacaaaaccaaatctatgtccaacaaaatgttatcattaaaccttagcagctagctcaggattttctgtttcctcatcctccaggtcttcatcaaacacatcatcgcccagctcaccatctttgtcccttgaatgggatttcttaccaagatgaccccagacttcatctttgttaaacttctcattcatggccatgaaatcaaattcttcagtaaaatttgttactgactgcgaaaactgcaaaacaacagactcaaaagtattaatacttcaatcaataccagatgctctttaataagcagcatcataatcatataaaaacatgaaacatgatcaagatattcccttacaaggaaacaacatgaatcattccaaggtttgtggagtgtcattttcttaagggcatcttcggctaagtttaaaattaatttggttgctctataaactgcagagcctcaaacacatgtgccttagacttttactcaaatcactaaaccaaagagagaggcattatggcattgccttgagttcagcaaaaaatattcaatattcctccattccaacggaggcctcaagtccaagcctttggaaaaataggaaccatagatttagatgcatcatgttttcagttccttcacaagtttgtagatgctagcatgacacacattgttacagccaacagttttttgaaggtattgcataaaaagatgtgtgcttggagttctttttacaagttttaccaggtcatctttaaaaaggaaaatagtttgatttcacaataaaatagttttagttatttaagtgttgtctgtgggggaggaatagaatctgttaaagatagaattactattataattaaatgcgtagcatacaatagcaaggggagctgcaaacaccagggataacaaaaattgtaagacaatagttaaagacctacaaataagagcacaaaagttaaagagatactcaaaaggtataaagtgtcactcataccgcgctgcctctacctcttccacggcccctgtagtggtgattgctgtgtgaaccagctccattgtactgaaaaagaaaacagagaaataacatactgaagggcatgcgtactaactacaaacaaaggaacactgaaggatacaagagataatcaagacatttactactagcacatttgtgatgttaatatgacaaaatggtgttccaaaatcaagcttgacacaagaaaagatgtaaaggatagcaagtgaactttcagtacggatacagaaattatacgattaggaaggcgtatccaagttttcaagatcagggtagatattgcctacttttctttcagaaggaaaattttcacctcaccttgacccatagatcataatttcaaaattgatccgtgctattataaactcgacgaggatatgcactgaaatactatgtatcactaatttatgtttgagcatatgtttgcagacgagtaatgactggttccttgtcttagaagtagaagaaaagaactaagaccagcatgttgattttatcaagccaaaatagggaagctcagctcactaactcaaaagggcact

SEQ ID NO: 82885 - DNA, 1432 bp, Oryza sativa
tggttatacacataatgagcaggattagaaaaaaaaaaggaaaatattttcttgtaaagcacaacacgggtgtagaaatgctgatgtaccttttgaggtgtttgtttcggcaatggcaatataggctcattattttcaggaagagcacgtgacggtggatcaggtagcaatggttctacaaccctagtttttgattcaactgccttgaaatctttgctgctcatctgtaaaggtgtctgcatggactgagatgatgaaagcatcgatggagcattctgcagtagttgacctgatgatgccaacaaaggtacgggcatatccatatgggctgagctagatgaagcaacagtcgaagaaactgcctgtgacactgattggtatgccaatgttgaacctggaatatccgcagtcttattgctcacaagcgaactaaaattatgtggggccattgcactactttcagcaatggatgttggcaggctagctaaaggaagggtggcgcccacagatggaactggaggagtaaacaaaggacccatgttcggcagaaggggctttgaagtttctggagatagtaagttagcagaagaaggtgctgttgtagtgggcaggatacctgaggaagggccttgggtagtaccaggtggttgcagcaaggggggctgcagttctgacagtttttgtggccctgacgatagagtgggattcaatcctgcatattggagaccctggggaactgataatcctggctggagcaaaggaggttgctgcaaatgaggtggaagcccaccaggtggataatatccctgccaatacattgggggaactgaaaggcctgatgcatttccagcagaaggtggagcagaggatccccatggaacactcccaggttgatatagaggaatattgctctgaaaacttggcctctgaagcccatattgagctgcctgggagctgaggtctggcaatactgcacttccagcagaaggcaaacttgaagaagccgatgctggctgagagtagtgcgactgcagaacagaattgcatgagttgtgcggctctaagaagtatttttcaatgtttttgtttcattgcggtacctgtattatggcaggatcattgtgcggggcagctggttgtggtggtggcggtggaggtggtgatgacttaacttgcaaatcctggagaaacaaataaattggccttaggtagagatatggtgcaaaagcatgttaaatcaaatagatagaagatagtgaaaaggacattttacaggaaacatgtccttgaatctagatacaaattggatatatgcaaccgcgaaactgaccaaacaaaaacacttcacagactggttaatgctaccatagcctaatatgatgttactatcagctaacttaacattttgacgcagtaaacagatggcataaat

SEQ ID NO: 82886 - DNA, 20545 bp, Oryza sativa
  unsure (1)..(20545): unsure at all n locations
tggtgctagcaggaatttgcactccatctttcttgcgcccttcggttccaaatgatcgaactagagaacaacaaatggacagacaggtgtaaaacaaacattgggatgaacaaagcgtctaacagtgctggaagtaaagcaaagcgtagtcaacacttgagttgtacggatacgagaataagcatcaggtggcttaaaaaatcttttaagaaaaactagtcgcgaaggtcaacattgttgcatcccagaaatttcaaattgaataacacgtagctaggttgggggctgagattcacctcacgggggaaccaaatctagcgctgaatcaagcgaatctgaggaaatgagagggggagcgggcgcggggggcgggatggaattaataccattgcgnnnnnnnnnnnnnnnnnnnncggtgttgatgttgtagaggatgccctcgtacctgatctcgctcttggatgtcaaactgatgaggctcccgatgtacgagtccggcgaggccgccgccccgccgccgctggagccggccgcggcggggggccccgcggaggaggaggtcgacgacgacggtggggcttccgccgccatggccgccgcgggcgcgggtgtgggcgagggccgggagctagggttagggatgcgatgcgatgcgaaagagggagaaacgaaaccctaagcggctgatccgtttgggatgtgcgctttggtttggatggtgttttagcctattaaacgggtcgtttgggttagtttgggaattggacaggacgtggcttccatcggaggcccatatgttgccgttttcttgctaccaatgcaagaagatgcctgatcaaatttacctctacttcgatttagtttagtcccttttaaatggcttagactttagagagcccaaattacaaaacaacgaatgaatagtttgctttttcatgatttaatggtaggccacaatgaaaaataatgcccccaactgataacctctctaaaactctatctgacagcttcccatgtagccaatattttttttctcaatcatttcttatcattattattattgttgttgttgttcgttatgatagtgatataaataataattactatttgttgccttcttttccttgatcctttatttgatatttgtttagatatataattgtgcaattactcgtgtttttaaattaaaatattaggttgaaacgtgcaagcccttataaatgtcatgtcttattcaatggactatctttttttccctgattacacggtaggtacacatacaacaccgccctcacgcactccgctaatgtgtcctctaacatatagaagagacagaaaccaataatacatggttgagtttactaaagttgtattgaaagctcgttctactgcctatcttttatgttgttatccttgcacattaaaatttcggaggatcaaccgtcgtgtgtccaaacttcctaggcagttttatcccacttcgattctccaaccaggatgaaatatatgtgcgcactcaaaacgagatagtaagtcattagcatatgattaattaaaattttatcatttagaacttgaaaaatgaatttatttgatttctcatagcaacttctatataaaaactgttcgtacaaaataaatcgtttggcagtttggttcattcagccattatgtttagcagtagattgattatcttgtcaagttgcagaaaatcccaggtacgtcgtcctacgtagcaagcagatggattatcttatccaatccagccacgcctcgtcactcgccacccacactgcgcaagcgcaacgcatatgccaaatcgccatccttgcgatgtgatgcgatgcgatgcagctctcacctctcgtctcgccagcaatgtcgcaccagattctccacacctccaaccccacgctgccgacgccacctcagccgcacaaccaccacccgccggtgccgccaccgcccaagctcggtcgccgcgctgcgctcgccatcgcggccgctccggccatcctcagcgccacacccgcaccatccagagcgcaggaagcagcagccgccgccgcggcgccctgcatcgccgacctgcccgtcaccgccaaggccttcctggacgtgtccatcggcggcgagccggcgggccgcatcaccatcggcctcttcggcgacgcggcccccgccggcgcgtcgcgcttcctgtcgctcgtcacgggcgtcggctaccggcgcaaggagttcgtcaagatcgtgccgggctacgtgcagcacggcggcgtggtgtcgtacccggccatcccggcggtgaccgagcggctggcggcggagatgggcgccgtgcgggcgcaatgcggcggggagaggagcccgcacgcggcggcgggggcggtgtcgatcgtggtgagggacccgagcctgccgccgcccaagcccaagctggtggcgcgcggcgggaagctggaggtcgaccaggagcaggtgggcgtggtgcccaacggcaccgagttcgtcatcaccaccggcgacgcgccggagctggacgcgtcggcgctggtggtcgggagggtcgtggacggcatggacgtcctcggcaagatcgcagccgtgcccaccgtcaaggataacactgcctctccatacttcaggtcgatcactctcactccagctagctgcttgaactgcattttgttgcatcaatcaaactgaatagtacttgcatctcagctaattaagtctggattagactgaacatgtattaatatcactgtgattgtgcagagtagccaagttgatcggggacaagagagcagtggttgcagagcgagggttcaaccgcccatacaccaagatcctaatcaccaattgtggagtcattgaacagcagcaggagcagtagagtgctttgtttctgccttgcctttcatgtctctagtttgtgcaaagggtaattattattggaactctgtttgcaagaggattttgattactcatggactgatataggcgatggagaggattaaaaaggattgtgaagagatgagagtctttgtaaaacgcatgtcacactgtgcttacagaacaccaacttatgttattaaaaagagatggaggatatattgactaattatcacttggggggaatttaatgagaaggttgatgagatcacgggcgacgccgcatctgtctttcatcttctggtcgacgtcgaccatcaccgagctcaccttggcggcggcgaacgccgcgtcgcacgtgtcagcggcgccactcgccccggacaccaggcgcgacgcggcggcgtagtcgccggagccgaggctgtcgtgcgcgtcgatgtcgaggtcgttggcggcgtcgaagtaggcgccgctgcaggcgcgcagcgcttccccctccggcgcgccgccgccgtacctgctggacctgtcgttgatgagggccccggcgtcgctggctgcggcgacggcgaggtcgagcgcgacgccggcgaggtcggagacggtggaggcgtcggcgctgtccgggttggcggtgagcacggcgacgcacttggcgttgtgggttttgttgcaggtggtggcgatgaagccggcgtcggccatggccacggggacgatggtcgaaatggacagcacgacgacgagcaccatagtcgtcgtcgtcgtcgttgcgtaggtcgccactgccattgctacggcatcagtgtcacttccatggtgcagtgcatatatagtaagtaaggtcaagaatggtgatggcgcggtaattaatcccgttgattttgtagaacgcgatcaacctttccgtccgttgatgggaattggggaattccatttgtttgggccggaagtggattgtggcttacgtgcagcccatatgggaataagatcactttgactccctcgactgaccaccgaatctaaatcatatccctcaaccgcaataccagaaatctcgacccccggaacttgcaaaaccggtgcaatttgactccctcgccggttttgggaggtggtttcgctgacgtggcgcgtggcgcctatgtggcgatattgaccgagtcttcggtccacgtggcgttgacgcggcacttacgtggcagtagaattaaaaaatatgcgtaggacctattagtcattcacacaaaaagaaatgtgggcccactgacatatggggcccacatgtcagtcctcttcctcctccctctctcccttctctctctttctctccatctctccccttcttcccattcggccggtgggcgagagggcagcgagagcgagcggccagcccagctcaacctcggtgggtaggcgacggcgcaccgctggggtccaccgacgatcgcaacggcgcacggacgaggggagcggcggcggccattggggcgcagtggaaccagagcggcggcggccatcggagcttcttgggcgccgccagcaccgagttggcggcggtcaagcagtggagcgacgcggcgcacatgagcaggacgaccctcggccttctccagcggcctcctcatcaccccccgtgccagtcgcttcgtcactaacgacgaccccgcgagccgtcagagaccacgccggtaaccgcgaggacggggatgacgagcggcggcaagtcgccgctgccgttcccctcgtcctcccactaccgcgagccaccgccgtcctagccgccgattgcctcccccgatccggttccgatgccgttagccgccctcttgcccgtcggccgaaggggaagaaggggaaagaaagagagagaagggagatagagaggaggaagaggactgacatgtgggccccacatgtcagtgggcccacatttctttttgtgtgaatgactaatgggtccacgcatattttttaattctactaccacgtaagtgccacgtcaacgccacgtggaccgaagactcggtcaatatcgccacataggcgccacgtggcgccacgtcagcgaaactacctcccaaaaccggtgagggagtcaaattgcaccggttttgcaagtttggggggtcgagatttctggcggttgagggatacaatttagattcggtggtcagttgagggagtcaaagtgatcttattccgcccatatgagttccgtaatctgcattggcaatccgggccctaaggccgacttatatgggccgcccggtgaagaaaaagcggaggaattagggattgtgatcagagtccacattggatcccttttaatggtagaactccggggcggcggcgacgcggatggctgccgttggttgtcaacgacagcggcggcatctgcagctactcctagctagcagatgattaaaaaggtaattatgcttggtattgtgatcatcaattgtactcatgtgggggatcgatggccatggctatgatctatacttactattctagatgggttggttggaaccatgtcaccctaattttgtaaaatttaagactagatatattggaccgcacgaccatttcatctcttctcatccatcgccagcccagctgcatctacaaatcgctagacgccatacacactccctgtatatactagtatcttttttgcattgacatctgataaatcgccagctatttgcacttattgattaataattaatttgtcctttccttcccaatccaaaacggcatcatccacgtagtacatactcctacacggtacgcccagatgatgaagatccatatatacccaacaatacctacctagtgccatcgatcggtcaatccttccttgttatcctactagatgatctgtagtagtagtagcagttcacttaattacgctgaatgtgaatgtactagcaccactgggacctagtaccaccaataattaccttagcttgggtctaacatccccaaaaggcagtcaagttctcattaccagtacctcatcatcgtcttaatctcactacccgtaccctacgtacgtacgtgcatgaatactgccagatatgcatccatgatccagccatggagaaatcaagctatcagactagtatcagcaaagcaaagcaaagaagcataatggcaacaatggaacgttccaaagctccatccatcaatgcaatgcaatgcatcatcatataggactcactctgtaactctgggctagcaggttgctcacttcagagcagtatactgtatactccatgatcagtgagcagtgtatactgatgatatactagtattaccaagttacatacctgtactgaatggaatgatgcatgtatgggccaatgcaactcggaaagagaggtccggtccccaacccaaagaaaatcattgtaaatctgggatccccacacatgacatgacatgggtgcatctcatatcgatcgcccaatcgcaagcaccgctcatgttttcgcatgcatatggtcccctagctagcttgctgctctccactccaacactctctactgctcaaccaaaagcacctcatccgatcccatctgctctcttcgcctgcatttcctctcaccatctaccgtcctactgctctgttattactcctgctaaacaccaccacgtcttactgtcctctttacctggagtactcctccttaatgattcttgagtcttcggcaaattctgctgcttatcgttggcttcatcaatgtggatggatgttaatagtagtaatacgtatcatcctttttggctgttgaggcaaagcagatttctacccatctgatcctgatattcttttggcgtttcaaaagagagaacaactaggaatggtctggatatggaacagtagtagtacacaaaggactgcatcacttaaattcagaagcatccaccaccactaatgtcttccctaggccagttaactgtctaacagtcaactgacaagtcagtaaagaaattactcctcctacaccattgcagtgcaggcatggcatgtggttagttaccgaaaaacagtgagaactactggtgctggtgctaattcagggagccagaactaacagtaacctgcatttgcacactgatcagaattcagaaaagaaagacggttaaagcactctctaatcatgatgagtactctcctcctagatcgtctttggttttgtttctctctttctttctcagccttttgggggtggttttgtttgcagttgcagaggtatcgatggcactagtacaattgcaggagtaataataaaagaccagccgatgggtggcccatcatcctccatcgtcttttgcagaaagagcagtgcaccaaaattcagacagatccatacaatacagatactcctactacaggggtactagtcgtaatgacgagctgattgatccatcatcacgagtcaatcatacacttaaaaggagtcgtacaggaatcatggctcgatcaagctgacactgattggtttgcttaatgatagctgctgctaattgaaaagccctaattgcacgggctctttttttccttcctttcattcttcagatgcagtggctgctgccgtgccggttactactactgttgagcaccagtagcattgcgtttgcaaggctttcagctgctggatgcacaacaatatgatactgttctgcctgtgcataatccagacatgtctggcgctcgttggcaaggaggatcatcatagatttctgggttatttggttggttgccttacttgactgatgggcatgtgttgctgggatatccatgtagtactatacttgaggcaaatatgaggtttgactcaagtgtccgaaatggcttttggtggactggagaggaatcgaactgttgcaactcgatgctgagcgaaaggagaagaagatgaaagaaggcggcaggcatcgcgtcgaccgtgccatgccgtctgccgctgccgatgcccccaccaccaaaatgttcgtgcaatttctgcaatgctccgtgcaatggactggaggaagcaaagcaaagcaagatctctgtttgcctcacctcgatcagtgcctggctggatggatggctgcctatgctatctcgtgcatgcatgtctctgtgctgtccttgctcctcgatcagtttgcttgctcatccatcctctgtcaactgtgattttgtgatttgggccccgtttagttcctcaaatttttttcccaaaaacatcacatcaaatctttggatacatgcatgaagcattagatgtagataaataaaaaaactaattacacagttagggaggaaatcgcgagacgaatattttgagtctaattagtccatgattagctataagtgctacagtaacccacatgtactaatgacaggttaattaggctcaaaagattcgtctcgcggtttccagccgagttatgaaattagttttttcattcgtgtccgaaaaccctttccgacattcggtcaaacgtccgatgtgacatccaaaaatttccatttcctcaactaaacacacccttgcatttggtcgccatctcgacctgttaatttctcaacgaatgggtttttgccctcgtctccgatctctcgccggtatagcacgcttcgctagcacaacaaggagtggtagctcgagtagtcagcctgcagtgtcgttacgcgtagctgtgggcatcagatctccattttttactcctccactactcatcaccatctagtgataggagtatgtgtaggatcgataggatagcagcagccagcgttgcatattgcattgggcactgtgattgatgtgtgatgcgcgcccacaccgcaggcacagccacagcccacagcagccgccctaaaaaccaacgattcacatgccccctacccctactatacttttctctgcaaagcggagtaaagccgagtagctctcctctcttcttctcctcttttactctctgctttctttcaccatgggcggctgaagcttaacataagcatacaaacaatttttttgagaaaatgaacacaagcatgaacagttaaacacacatggtgttcatgtgccacaatgttaggagtacaattgaacccacgtcatggcaggtttataggctgccggtgtttcgccttcacagatcgattctaaactcttgaggcatcctcattatttacatattatttaaacagttaaaaaaatatttaaaaaacaataaaatgaattaataataaaatccaataaatcactctacatcaggtcataattaacttatacaagttgcaaaaagaaatttaactgtaactatagatatacgttacctaactatagtttaattggtttttcataacttgtagaagttaaacctctatgtttgtagagtaaggatgtgttcgaatgcccctcttcccaacccctctcattcgttttccatgtgcacgcttttcaaacggctaaatgatgcggtttttgcaaaaagtttctacacgaaatttgcttaaaaaatcaaattaatccattattgaaaaaaaaagctaatacttaattaatcacgcgctaatagaccgctccgttttccgtgcggaggcactatgttcccaacctgaacatgtgaacacagcctaaatctatcttcttttttttaattactatttaaataatatgcaaacaataaggggatatcttttctagagattaaaatcaactcctgattataagtataccgtttattagcgacaaaaataatttatatatacaacttttacttctatatataggagttcttagcaacttaaagacaatgctgaaaaataaacaacaatgataaaaatatcaaaattaactttaaaattatgttttaaaattttaaaactgggttgctgctgataagccgaagaccaaacaatgagaacgtcgatgtattatacaaaaatgccccatacatttctgattgctcccatacgatttgggcgggggccaatctagttgtcaacttctactactgctaggaggagtagtcacatgatccaatctctcctctcctcgcctacaaaaccaaagccacactccttccttccttgggatccccagacccagtgcagggttgcagcgctttgcataggaatgtctcgccttcctcctcctcctcctcttcttcttgcagctcatcgaaagccacatagtataatattcgccacctaaaagcccaccacatccatccatcttgcttgccacacacccaacactccacacaagtcagctcagtgaccgccatggctgctgctgcctgagctgagcgaggagtactatattgcagcgtccagaccagtccaggtctgcttgctcggcagagtgcttgttgcgccaaacaatgaggcaaccacagagcagaaagctcctgcagctgcaggctctttctctgctgctcttcatcatcgccctgcacagccgcctccatggctgctcgggccaaggtgaggcggcggacggctcggcgtccacggcggcggctccaatggaggagaaggagaagagggctctctacgcggccatcgagggattcgtcggcaagggctggaatggctccgccctctatcctgacccctgcggctggtctcccattcaggtttcctttctctctgcacacaccactactacacagttcttgatactagtcgctttgagcaaatttctgttctttctgtgaggcaaattcatggttcaaaggatcttgggagggcagggtgatctgcactagagatttcttcattaagttatgcaccaagagtgcagcttgagatatttgtgcaattatttttgtttgaaagatccaaattttagcagtatccttgtagtatgttccttctttgtttcaatttcatcttcttgtgtgtagcctctgtgttggtgaagtgtttctgcattttgcggctgccctgtttctcaactgtggctgagtgagacctctgaaaacattgggtctccgatgttactcgatataggagattctcttggacaagaactttccactcacatgaaaagaatctctctgatttgaaatctccatgttttcttaacatacaggtactacaggagtattctcatgtcttctcttttcatctcatgatattctcatcccttggttcttttgctgtggagatgctccctcttttttccactacatttcaccgctctgtcttcctttttcccatccctgcactttgagctgctgttactcactcataagcaacagttgctcacgactcgctccttttatggcatggatctaattaacacattagtatttgccctcccagaataccataattacttacattttgatgctgatatataaaactgacgaggaaattggagctgctataaaaaggagcaaatctctgttactacattaatcaaattctgtcaaccatgtgatccttccatgtctgttactaccagtagtgtactacccaaaaattctgtttactggcccgtcatttggtacctttccatgtgtgtgaaagtggtgacagctaacatttgtactgtaaattccaaaattcaggaaaagaaaagctttagctccttttattaaaaagtgtgtttgtgaattcaaattgaatggagaaaagcaattaacaggatgcctctgaattttgttgcagggagtgtcatgtgatctgttcaatgggctgtggtacccaacagtgatgagcattggcccagttcttgacaactcactgcggtgctctgctgatgccaagttcagtccccagctgttcgacctcaagcgcctcaagaccctctccttctacagctgcttcccggcgaccaacccgactcccattccggccaccagctgggacaagctcgccggcagcctggagacgctcgagttccgcaccaaccctggcctgacggggcccataccggcgtcgctcggccgcctgtcgagcctccagtcgctggtgttcgtcgagaacaacctcaccggtgccgtgcccgccgagctcgggtctctggtgcggctgcgtcggctcgtcctgtccgggaacgggctgtccgggcagatcccggcgtcacttggtaatgggcatttcgccgagcagctgctgatcatggacgtcagcaacaactctctaaccggctctctgccttcgtcgctaggtggcctcaagggactcctcaagatggacctcagcaacaacctgctgcagggtagcttgccgccggagctcgccgggctcgggagcctgacattgcttgacctcaggaacaacagcttcaccggcggtttgccgtccttcttgcaaggcatggcgtcgctgcaggacctgctcctgtcgaacaacccgctgggaggcagcctggggcagctcgggtgggagaggctgcgcggcctcgcgacgctggacctgtccaacctcggcctcgtcggagccataccggaatccatggcggcactgaccaggctgaggttcttggcgctcgaccacaaccggctcaccggcgacgtgccggccaggctcgccgagctgcccaacatcggcgcgctgtacctgaacgggaacaacctgacggggacgctgcagttctcgccggcgttctaccagaggatggggaggaggttcgcgtcgtgggacaacccgggcttgtgctacagcaatgccgcggtggacgcggcgcacgcgccgccgggggtgacggtgtgcaaggtggccggcggcgtgggggacgggaggaagccggaggcgagctccagcctcatggccacctcgtctgcttccaacctcatcaatggcttctgcttcttcttgtggatggtggccacgtctctcttgtagccaaagacagacaccaactttcagaatcttcagatagatggaacaacatgaaatgaagaaactgattctctcttagtttagcttggctagtgactagtagtgctgttcttacttttggctctcttttttgggtgtttttctgatgatggaaaaggaagaaatcctggtggtcacagtaaacactagtctgaaactgtgtagtgacgagtactagcttggttgttttttttgggtgtaattagcatgtttctcatgtgatgtttaattacgggaagtggataatggatataaggtaaactgctctccttgtctgaaaatattttgctctgatgtgagagtatatatttactagcttggtaatcatgcatgagtcggtagctagatagatcttgacagccgtatatatgagttggattagctgaggtctgagattgggctcacatatgcatacgtatatcatttatcattgtatttcggtattgctatatatatggcacatatttttttaagaaaaaaacagtcgttttcctggcggtaggatctcccttgattttcatgattttcatgattagcttcccacgctgattgccgatttttgtcgaggtgtatatcaaggatgacttgatgacttgattactttgttattaatactcaaagggacatgtgattttgtgagtaattattttctactttgctagcttctttcttttctccaaacggacatgtgatttgtgagcttccctcttctttttatcgtgattacatcctaaacatattaaaattatatatgtaatttagacacttacatatgtaatttttgtacttacatcctaaatacactgaaattacatatgtaatttagacacttacatatataattttgggacttacatactctatacaataaaattacatatgtaatttagagacttacaatataaaaacataccgactattttttagtgaaaaatatggcgccataaatatagctactctcttgtatttttgttttgcaatactagcattttagcttgacccaagtgctagataactagacttaaaagaaatctgtatatgaaaatttgagcaagtaaagttgccttggtagcatcaaggaatagcttgagcttgatgctgatgctgcacataatatgcctgaatgtattacctccgtcctagaacagtaatgtggtagtagtggtttggattgaagtagctcaagagatcaattaactgaaggagagcaataggaagaaggaaagaaaaagaaagagaagtgctcctagaaacaacacatgcagggagaatagagggatgatgatgatgatgttgctgttgctatcgaagaagctgttggctgatgagcagagcacggaggggatgaacgatgaacgatgatgatccatggtactgtatggtggtcggatccgatccacagcaccgattgatggacagtgtttcttcactgcgttcaaaatctgacaggcaccattgaaaggctcaagactggagcagccggtactactccagtagcctgcacaccctgccactgccgccatctactggtactagtggtagagtagatacagtactcatgctactctgcttgccagtagtcttggctgacatcttggatgacatattgggctgtgtgtttagatccaaattttttgattcaaacttcagtacttttccatcatattaacctgtcatacacatataatttttcagtcacatcatctctaattttaactaaaatccaaattttacgctgaactaaacacaaccttgactgtcatcctatggagtgtcaggagtagtttttgatcaataattgtcctaggcccttgttttagttccaaactttttctttaaacttttaattttttcatcacatcaaaactttcctacacacataaacttctaacttttctgtcagattgttccaattttaaccaaaattctaattgtggcgtgaactaaacacactaatgacaatggcaggaaagaaaatttggtattgcaatggcaacgtccgtatagtgtatcgacattgctattggtattggtattggcatcgtcattgcaagcggtacattggtattggtattgcagggaagggaggagcaatgaagcaactacgagtagctaggatgcaatgcaaagcctagaatagctagaggatggatcagctcgatctcctcttcctctcttctctcgccggctcgtccgtgcctcccggcatgttctcactgtacactatgctacagtgctaaccataggctacaggctttttgggcgtgactgatcaattatcaacagcaaccagtaaatctgtttaggctgagtttagttgttttggtaaaaaaaaacatatacaaacacacatttcaaatattaaacgtaaactaataacaaaacaaattatagattccacatgtaaactgagacgaatctattaaacctaattaattcgtcattaccaaatgtttactgtaacaccacattgtcaaatcatggcgtaattaggtttaaaagattcgtcttaacatttacatgcaaactgtgcaattgattttttttcgtctacatttaatgcttcatatatgtgtctaaatatttgatgagagggaaaaaatgaaagttttttttcgtgtacatttaaaatctgcagtttgcaatgcaaccatacgtgcaatgttacggacgggagagtgtgaatgaaaacgttcaaggcgcaagtcatgccagacgtcgactcactgtcactcactgctctgcccgatgatgtgtacttatggcttgcttgtactacaccctgctctctgctggcactgagcacaagcgtactgtacactactgggagtattttcgtttcatttcaatcgtatcttattcacatccatccatccatctgatgagagccggccggcaggccgggacgccccccaacagaacctatctagttagtgaaataaaagattttggtgtcacatcgaacgtttcaccatatattgaaagtagtttttggacatgtgagttactatagtatttatggctagtcatggattaattaggctaaaaagataggtctcgtgatttacatacaaactgtgtaattagtttttttatctatatttaatacacatctatgtccaaaatattcgatgtgaagtttttggaaaagtttttgggaactaaacagccccaaaatgtctgtccatatcatatgcttgctgctcggctgactgaaacctgtttcctcatgcgaagtgagagtaacgaattgattccattgaagccgccattttttgttttatcaaaattttgttaacttttaacagtattatatgctcctaggtgtttgatttgttattatttttttacatacgattagttcaaaacttcaaattctatgctgctaaaattttagtgccaaaactttcatgtggttttagcacaaccagttttcctttttgatatgacaaataaaaaactccaaaccaaactaaaagggtgtttggcttgtatactgacattgtctattgttatcatagttttcttaccaagcttaccaaagcttaaggttaagttaacaaaattaacaccacactttagtaagcaaagccactactagtaccttgcacaatttttgagacaatggcatgtaagatcaaggtgttagaaaaagaaacttatcacaaatgtgacataaaccaaacacgttactaactcaatcaaagctgcctaagttgttgacgtatagcaaagtatggtagcatgtgaccatgaactaaacaacccctaaacgcgtaattatgctatggttcttgaactgcctctagtatgagaaatttttttttttatcatttgagtgaacggctacccgtttattacatgtcaactaaatatttaagaaaaaaatcaatttataatttttttactggttacaaaatttattttaatattttgttacaagttgtataagttgattttgaacttacaatgatattctctggtagtagtacatattaaggttgtgttcatgtgtgttgggaactaatctttcacacacacataaaacggagctgcggattagtgctgatgccatggttttgtagcggcagacgccagtccaaagcaatccttgctggactggttgatgaacggacactgcagtttctgatgccaaaattccaacacactttactgccacttttgttgcaaaggaacggagtttgttttacaagagaaaagcaaagcaacaaaattttagctggcttataaagtggaaatgcaaaatctgtgtgccaagcaaatgctcctccacgtgagcgatgataatgaacggactataatttccgaatgaaagggcccatcttttaacttaggcttatatttatcagccaaaatttaaaatttaacataaaatctgaagctaattttgaggtttttaatcgaagtttattttccagtcgtcgtttttagattgctaaaaatatgtatatgataattttatccgcaaattacttacggctccgggagaaaacattgtgagagatgaaaataaaacaaaaatgcagggggttgtttgtaatttggtattgtaactcctcgcgtggcgtgcttgaggctgtccgcgctctccgccttggtctcctctcctctcctcgctttccattccattcaaccatctcaatcaatctcaatcccaatcccaatcaatccctctctccatctggtgctctctatctgaggaatccgaatccgatcaggggaggcgaggcgcggcggtgatcggcgatgacggacacgacggatgacatcgcggaggggatatcattccaggcgttcgaggacgactgccggctgctgggcagcctcctccacgacgtcctcctccgcgagctcggcccccgcttcatccacctcctcgagcgcatcaccatcctcgcccaggtatcgtatccatccatatatgatgatgatgatgatggtgattcgatccaattaacacggtgcgtgcagagcgccgtcaacatgcgctccgccggggtggaggacaccgccgtcgtcgtcgagaagcagctcggcgccgagctggccgccatgtcgctcgaggactcgctctgcctcgcccgcgccttctcccaccacctcaacctcatgaccatcgccgacacttaccacaggtgcttgccctacacattcacattctcaaattgttttattaattaattggaggatcacctcttccgccgccattagaatctgcaaactcacttcataaatcatcataatgtgtttatcttaattactccctattaacctgaatttatcatgcatgtacggccctcaacacatttgttgtaccactccattttcagaatgtgctacataccattttttttgtctgaatatgtgttactacaacttactgctagtgatagtgaggactgcattatcatatttggcgcgaacaatttgaaagccaaacactgaatttacagtttgtttgtcacacttcaattaaagaatactgataacaacacgggagttgtcttctgtttggggtacctatttgtcatatttgggaaatataagtatacctgttcgtgatagggatgctacattacagtagcacagatgaatctttgattgcaatatggaatccaagaattccggtacatatgtgtacggcattacaaagtcggtccaccggttagttgtttccatgtgaccctcctcagacagaattgattgaaggaaccttacgctcgcacatggtagcttcattgtggtttcctcagatgttttgtcgtcagttgtccgactgtttttggaacctagcaaggccattgagcatcgcacttattgtcgcaattacctcttattatggtagtatgtcaagttttagaacagctgagacttcatgcatatgcttaagaaataattaccatcagcatgttgcagacttgcagtacatctttttcatttcaggaaaatgttagtgttgctacgttttttatcacctgaactagaatgtttaccaattttgaaaatcacccaaatctagagcttggcatttttatgtcttttagggttcgtaaagcacgcaatttcgccgacctgtcgaaatcatgtgatgatacatttgccaaattgattcaaagtggtgttagcccggaagaactctatgacactgtatgcaagcaggtaatttctcacattaagcacacatttttcatacattgtatattatgaaagttgcacatcatcaaatttatctgtgtatcttgtaagaaagtcacacatgatcaaatttatcagatattcgacctttacaggaggttgaaattgttctgacagctcatccaactcaaatcaatcggcggactttgcagtacaaacaccttagaatagctgtgagttaatttcaatagtttcatacttcaaccttgatattgctattttgttgtttcaattaccgatgaaactgtgctgcagcaccttttggaattcaacgaacgtgctgatcttagcctcgaggataaagaaattctaattgaagatctggtataacttcaaaggatcttcatagttttatttttccttttcctaatgtgttccaatctttctaactttgaattatgtaggtaagagaaatcacggcaatatggcagactgatgagttgaggcgccataaacctacacctgttgacgaagctagagctggttagtaaccatctattttctgtttttgttactgccagtattctcatgattccatcttttcttttgtaggccttcatattgttgagcaatcgctctggaaagcaataccacactatcttcgccgtgttagcaatgctctaaagaaggtataaatacattgattggcatttgttgaattccacttccgtttgactcattcacgagcggatataaaccctcctacaatgcttttcttatagaacactggcaagccacttccgctcacctgcacaccaatcaaattcggttcatggatgggtggtgaccgtgatgggaatcctaatgtcacagcaaaagtaagatccacacatttgaatttggtcgttttattatgccttctcagtattcactagtatttcctgtacattcttatggtgtgttgcgtttttctaccttttgcttatgttaatttcgacatgatcaccattctgaaagactacaatgtttcatttctgagctgcaggttactagggatgtttccattttgtcccaatggatggcaattgatctgtacatccgggaactagacactctaagctttgagctatcaattaacagatgcagcgagaagcttgcaaacttagcaaatgacatcctgctcaaaggttatttcatgatatatccaagcttaatccatttcaatctcaacagaagctcgcctgccaccatgaattgtggcgcttttcgaatgcctagttagttagttagttcattagctagtataatgcatattattggttgtggtactgttccttaaacagtaaggtgcactgtaacagcactcttattatagggattgtaattttagtttatatattagatatttcctttcagtttataactatcttataggtccccttttattagttcctaccctttgggctctagcacctttttttttttttgacgctgaaaggtagagagactataccttataaccattttatttatggtgggtggggtactagcacctttatatgaagggacattgctctaattatcgggaagcaa

SEQ ID NO: 82887 - DNA, 12107 bp, Oryza sativa
atcatcgaaacatttaaatcaaattctgcactactattgaacgaagaacacactattattttgaagcaacgtgctgcaatttgcatgaggcgatccccaggtccattctactactctgcttgggaaaatgaaattagaatctgtttagtatttgatgcgtacctacaacattgaccgtagcattgaaaacattgaccatagcaacaaggcccatccttaatcataaccattttttatgaagtaagaagagtttgtttaggagtgtaccagaaaccagctagtccacgctacaaagatgtttaagcaatctcctcagttagttcttgcacttagtcggtgcaaaaaaaaatgcaaatatttattttagagccagatcatcaaatttttgttgcaaagccgaagctgccgaatccaacttaattttttttcctttgggtcaaacattttgtcaagtcagatgggcaatccagattcataactaagccatgtgcacagatgtgttctacacagctaaattccaaagttttttcccttctctattacgcaaatactagtataattgcttcaggcaaatgagactttgtttgtttatttgctatctttcgtgtagggaagcatatgaaaacttttaaacttgtgcttttgaactgctccaaggtaaaccaaaagtttctactctggatgatagaattgtttatcagagagagcaaaatcacacatgtactgtacagaagaagggagggaccatgctgaatagtacttcgtcttatgttggtgtaaattaatccatgagttgctttaaatacatagcttaggtgctgtgccagattaagcacttgctagttgctactagagcaacttttctcactatggttgcaccagaaagcttctgcttccttcttcgtcagagaatcagtcagtccttaagatatttcttttgattcatagtctcatcagttgtacaagacctaattataagccaaaacagcttaataacggtaaaaaaataatttatagataaaaaattatatctatgttcatatagactaaaaagataacgatggaaaaaaacacgatgaaaatattgtaaaattaattccaaaattaaaaaaaataaaaattcaaattttagcggccgatttttttaaagacaaatgagactgtcccagatgaaaactgaacctgtaacactactttaaagtgtgaattaggtggtgttcttttcttctgaagataaagatgaagtttaattttttttacacaaaatgaggtgttattaatgtatgattgattaaattttaattactacaaacttgaaaaatagattaatatgatattttagagcaacttttatatagaaagttttcacacgaaacacactgtttagcagtttgaaaagcgtggcatgaaaatctatatctcatccaactatttgatggtgttgttgtaatttgtaactagcgatacggtgagaatgaaggtactgatacagaaagtttattagatatggtatggaggtgctactcctaataaaacacaaatacgaaggggtggaactggaaaagtagagaatttcacacgtcaagcattctacacaacgctagtgtactgactttttcaaacccccccagcatggcactggcagaccagacactgcgcaatagtagtagcacactagcatgtactactacactcctaatctctctctctttctcgagtggaatccattgatccattgtgtagtgggagagagacttctctacgcggtcacgggttccccagcggaggagaaagatagatagagagagcaaagagcaaaaaaatctctcttttttcttcttgttgtttctgcagttacctttgtcttgccttcaatgccaccgctttactgccggatctgaggaaagctcccatccttgctgagttcttgtgctgcttcttccacaattcttccttttgttgagaattttgccttccatctgcttaatcggtgacaaaggtggtgggatcttgcttctcttcctgcaagaaaaggctcgtttttttgtttcgccgtttgctgcttgctcaggcaggaggaaggcgatgctgttcttgctgatttcagtcttcttcttccggtggtcgaggtgaggtttgttgctacttcaccttcgcttcgttgcgctctgcggagagaaagaaagcaaaggtggtggaaaagaagcgaaaattttgcttgcttcctctgcaaatctgaggaattttctcgcagaaagcctgaattccctctgaattccggtgcatggaaagatcgtcccctccatttccaagaagaagaagatactagtagcagctgcagctacactctagtagtagtggctactagtactagctagcctccaatggcgtcctcaccgtctccctccccgggcaccgcaactcccgccaccgccgccgccgcgccttccaccgcgaccccaacacccgcgacgcagcccaatgccacgccggccgacccctccatcactcccccggccgcgtcccctccccttccctccgccgccacgccacccccacagcccgattccccgccgccctctccgccaccagctcctccggtcgcagtgccaccgccggccaccgtgccaccgccgcctgtacccgttgcgtctccaccaccaaccccgtcagccacattgccgccgccgtcgccaccggcttcagtgccggtgccacctacacctgctactacccctccaaagccgtcgcctgtgcagcaacccccagtggctgcatcaccacctccatcgtctccggctgatttgccgccgcctaatccgccggctcgctcagacacgccgccggtagtgcagtcacctccaccgccgcaccggagatcgccgagaacgccatgggctccaccgatggcgccgtcgccttctggaagtcctaccaagccttctccagctagtccatcaccaattgctggagatccaatcatccctacacccaataacccttcgtcgcctctggcgacgccatcagcaccaggctctggtactcctgtggtgacgccatctgcaccagtctctggccctccatcgccaggcacggctccagccacggcagctgatcgatccaacaagtcattaagtcccaacacgcaggacggcagcgtctcgtcgagcgatggtggaatgagctcaagtgcaaaggcgggcatcggtgtagtcgtcgctattcttgtgcttagcttggtaggagctgcattttggtacaagaagaaacggaggagagcaaccggttaccatgcaggatttgtgatgccatcgcctgcctcgtctccacaagtgttaggtaatctgatgaaatgcattttcagaaatcgcgcacctggaaaattaaaatcagtttaagttgtattactagtaggtgatgaactgagcaagtacaactcattttttgcccagggtattcaggtaaaactaactacagtgctggcagtcctgattacaaagaaacaatgtcagagttcagcatgggcaattgtcgattcttcacttacgaggaattgcaccagatcacaaatggttttgcagcgaagaacctgctaggggaaggtgggtttgggtctgtttacaagggttgcttggctgatggaagagaggttgccgttaagaaactgaaaggtggtggtgggcagggggaacgtgagttccaggctgaggtggagataatcagtcgtgtgcaccaccgccatctagtttctcttgttgggtattgcatttcgggggaccagaggttgcttgtctatgattttgtgcccaatgacacactgcaccatcatcttcatggtatggtggtaaccttcagcatattgccgcatgagagctctgcatagttctagttctgtctgaaaactgtttaattgatctgcccttgtaggacgtggaatgccggttttggagtggtcagctagggttaaaattgcagctggctcagctcgagggatagcatatcttcatgaagattgtaatattctttctggttctgtaccttattaatgtgatcatttgcacttcattttcattacatttatttcccttttgcaggccatccccgaattatccaccgagatattaaatcctccaacattttactggataataactttgaagcccaggtaacaacattatttagataaattgggagaggcgttataatgtgaccattgttactaattggctgctattcgtgtgttaggttgctgattttggccttgcaagactagctatggatgcagtcacgcatgtaactacacgggtgatgggaacttttgggtaagtaaattactgcctgccttactgagggcacaagagaacatcgtacattttcatatgatctaatgattatttgttatgcagttatctggctccggagtatgcttcgagtggcaagttgactgagagatctgatgtattctcttttggcgttgttctcttagagcttattaccggtagaaagcctgttgacgcatcaaaaccattgggtgatgagagccttgttgagtgggtaagctatatcagtaactagaaatcatttttttttagataatggaagatgagtatattgaaattagtatgttcaataagatttttgcccctgtatgatcaaatgaaagcaaatggagaaatatattttatcaactgtatttgaatagccaacttgactcatttcaaagattctaataacgtaggaattcacattgagctgttgatctctgcagttcacattttttaactgtgtttttattaggagtcaatccatatagttagccactggttgaaaagcgttctgatataaaatgtggactggtcaactatgaacatctgctgaaatcgtgttgtaaatcagtctaaagaggggatccttgtgtaacttacacaatcacttgcaggctaggccattgctcacagaagcaattgagactggcaacgttggggagctgattgactccaggctggacaagaacttcaatgaagctgaaatgtttcgaatgatcgaagctgcggcagcttgcattcgacattcagcatctaggagaccccggatgagccaggtataggactgaacataatctcatcacatctgattgaacctgaacctgttcattttaatcacatctctcctttcaggtggtgcgtgttcttgatagcttagctgacgtcgatctaagcaatggtattcagcctggtaagagcgaaatgttcaatgtggcaaacacggcagaaatcaggctgtttcagcggatggcttttggtagccaagatttcacaactgatttcacccaatctagctgggatagtcgtagtagagatgttgatgcctctggttcgaggcccttgtaatcatagtctaatactcctctaattagctagggtattgttgcattggatttgtttcatctgattttgttttcttcttttttgtggccatctctgtcaactaggagtaatgtatatcatgcgtcccactaagaaaagtgtatattgattgcactgagcgtgcctgattctacaaaatctgacagacagaagatttactagtactagcccttgaaggaaccaatgaattgcctctgttggtggtgactgaacctgcatattccactctatatttcctcaaatttgtcctttctgaaccagttggtcttcaaatatgtgcctcccgaagcggccattgcctaggaattgatttggtgcccatctaatctctttggaatcctgagcaaaatgcatctctagaactgagctgagctgacatgacaaatggagtaaatggaattatgcgtgatagctgcatcagcactgagctttgagtggagccagtgcgctttgcacatgagagaacatgcgaaatggaatatatttctgatgacgacacacaagtgggctcctaactctaagcctgaagccctgaacacgacacgggcaatcaaccctgaattgatttgaattggattcagtagagaagatgagagaaatttgaggtctggtctgggcttggtttggtgtcctttacagacagaagggcaaggagccaaatttgacccgtggatataactgactggacaccaccgacaactactaatcgtgtgcaccattaattgacctcaagaaaaatgttgagagcaacgcggcaaaagcaatactaccacctgacttttgtgtgatgcgatgtgtgccatgactggcacggcaaaattcactgtagatcatacaaaatttctgtccaagataaggtagataatttacagcagattgatggttcctgtaaacaaagggaaaaggagcaaaatttcgccacgcagtacagtagagggcatgtgatgtctgaactctgaacctaacatgctcgctcaccgcactgctgacttagtacgattaagatctcaagttattttcccattcataaattgccagattggagtagggccaggttctgaaccatcccagtgattctgcgatgcttcggttgcacgtatatgccaatttgtgtccagggctattaatcattgtaaagagttgcacacttcgacacttcacattgggatggcagatggctcatgcctctctaatctttgtctgaactactaggagagtctcataattaggcatcagagattcagaatcacccttcacaattttccccattggatgactcaatttaccaaatcgaaaagatgacaagaagacaatgttattgctccagaagtccagatcgggtcattattccaattgctagctagtggccatggagttttctatcccggcgcataggtggcgttctaggctacggttagagggctcttgaagttctttttgtccctgctattttggataatgagtttattttttgtttctttcttgttggctgtgtgcactctttgggtgcagaagctggaggtgctctcagaataattgtatcacttgatagaatttattgagattaataaagcttccattatctaaaaattagaaaattattccaattgttcattgcagattttagtggcatgagatgattactgttgaagagttatcaagcatcaagagaatgcaaagtattcctctggccttcttttcccttattattgctatggccgctatacaagttatacaagactcgtgcggtagtgcacagccatcttatttttacaacgttccttctatcattgtacatcatggatgaacgcccagtaaaattaagtaatataagatgaaaacatagagctactgtactttacagttcagctttgtgctatttttgctcgcgccaacttcacaacgaggaacgtgtaaatagtgatggttgcctgcatcaagtcagatactttaacaaattagtctaggtggctattgtatttcctttcaatgaacacaatgaccgcagattgaaaatgcagaagtctctgatgatacattgcaacttacacaaaactatacatgaataatcagtacaacaaataactgcatttttttttggttctcagacatttccagagaagaacaaacatgggagggacttacatgagttccacaacaagggcataagcaccaccacctccattgcaaactccagcaaccccaatctttccatttttatgtctaagaatctgtggagcaaaacgtgttgatgtttaacaaagaggaagattgcaacattttgcatgctaaaggtgcagattaaagagagaaaatggcgctgacagataattaacatgaagtaactaaatccaaacttcagtacagccatgaagtattttgcatttgagaacaacacgtaatattttgatctgattttgaatggcctggtagcataccccgagcaaagtgactatgattctcgcaccactgcaaccaataggatggcccagagaaacaccaccaccacttaggttaagctttccctgaaatttacatgaatgttaatgagatcttctggggatacctatttgctgaatgtatagttacatagaatctaacaacataccgaaggaataccaagaagcttctggttggctaaagcaacgacctgtcaaagtccagaagtatgcagttcagtctagattcacgcttcaggtgtaagtactgtctaaattgaagaagacaagaacatacggagaaagcttcgtttatctcataataatctatttgtgaagtttggagacccgcatttgatacagcctttggaatagcaagagctggagtagttgtaaataattcaggtgcctgtgcttgaaaggagttagtataatgagtataacagataaagagcactgtataacaagaggcaaggttagaagataaggttgagagatttgatacatgaacgccactatttgttagcatgaataaataatgggtaaagttcctttcagcatggatttgtttgataatcccagtaaaataattgttcaacagataacaagtcatgtaagagttacctgagcagcatccgcataccctctgatccttgcaataacttgaaggccaagactcttggctttctgtccactgactagcacgattgcagcagcaccatcactgcgaattttggaaggtaaacgagaaggaagagaggtgcactacagtcacacatcaagtaaacatgcatatagcataatttgactttaaactagagaaaataaagtttaactttgaaagtagtctagatttattaaatcattcaagatggaagtgctgttctactaaataaaaaaaatcgaatgatagaattcaataaacaaaggattaactgcaaatgcgttacttcagaatatggtaatgcactgacatttggttgcatgttaatactactctgcaaagttttctgttaataagtcacttagagaattgttatcaaataagtaaaccttatactagaagaattgccggcagttacagaaccattcttcttgaaagtcggcccaagtttcctcagcttcgctgaattgaactgtgcaaatagacacacccaaagaaacatgtcaggtctgggaaaaaagtttaattgttgttgtttgcactaattcaatttttatttttatttttttggtttgtgctgttgccttccttttttatactatatagaataatttcttgagaatatgtaaatggtgaaaatgtcatgctacacatcggcataaatgaactacttccattaggagaaatcattagtagactacctttgcaagactctcatccttgtcaacaataagtggtggtttccctctaccggaagaaatttcaacctgaaaaatccagaatgttttatgaaatctgtgccagtgactgaagtgttgatatgtcatgtagaaaaccaattttaggtcggtccaaattatatacccaccggagcaatttcccaagaaaatgtgccgctatcacgagctgctattgcacgttcattgctctggatagcataaagatcctagaagaaagaggtgttctttagtccaatgttagctcctagatataaacaaatatgcaagcgcagatgcaggaacattgacaacctgctcctcccttgaaatggagtgttgatccgcacacaactcggcacacattcccattgggaaatcattatacacatcccacagcccatccttgagcatcccatcgatgaggacgtcgtgcccaaaccgtgacccccgtctgcataacatgttgacattataccataagcaagcaagaacaatggatgatggcttagttcgccgaaatttacagcatcacttgaggatggtaacgaaccttgctgccgcgacatatttgggggcattggacatgctctccatcccaccagcgacaacaacatcatgcatcccaagctgaatagtctgcgccgcaagcatgacagctgcaagacccatttttaagtagcactagatagcaaagcaaaagccgatcctcgagtagcagaaacaagtaacaactgaaaaagagagagagagagagagagagagagagagagaggttaaaatagcgaaattacccttcatccccgaggagcaaactttgttgacggtggtgcagggcacagtgtcgggcaagccggcgcctagggcggcttgcctcgccggggcttggccaaggttggcgctgagaacgttccccatgaagacctcctgcacgagcgccggctccacatttgctctcctgagagcggctggttgtggggaagcatggccaaatcggattcagagaggaagaggagaagaaaactgagaggagcactggagtttaccctggatggcgacggagccgagcttggtggcggggagggaggagagggagccgagcagggcgccgatgggcgtgcgggcgacgcccacgatgcagacgtctctcggcttgagcaggtcagagtccgagtgcggaggaggagccatgatgtgatgtgcttctccgccgcgccgccgccggagtaggtgggggtagggaggcagccgccggtgaggtcgacgacgacggcgtggagacgtggagaggtgaagcggcgtgtcagccttcttagttaaagcaacaaacaagatgccgtattgggcttcgattctactaccatatgtggggccttctattctcctattagaattttttttttaatttttttattaaaagttttacaaaaataattttctatttcaaaaattgacaaaagtagtcgcccgccgctctctgggagggctatttttaaaaatcgccctcccagagggcggcgaatgtgacgtggcagacggccgtttgctctcgggcgacggccgtcaatgaaatttgcaggcggcccccttgccgccctgggggagggcgattttacactgtgcggggggccgcctgcaaatgggcggcggggggcctggaattttgcagacggcccccttgccaccctaggggagggcgattttacattgtgttttatttgagaaatagatatttttataaatagaaaattgttatcaaatcttttatattgaaaactatacaagattaaaatctcccagattggtaaaatacaattttattatttttttagtcttacgcatacaaaaattcaccaccataattaaacattgtaatgataagatagataagaagtgccatcaatacacggtacaaatttattgatcccgacaaatctagcctgcggtaacctatcggccccttctaggtcggtcaatatgcattgtattctcgtggtccttcaatcgttgatactctacttgtgtttctgactctgttatattttggccatgatatgatggagtgacattgtcgatccatcgagtaaatccacacatcgttggattgccctgaaaaaaatagtaatgttattcagtttgggtagaaattttgtgcaaatcatagcggattttggaaacggttagacatataacgaaatcgttgtctacattgtggcagacaaaatatctccttccaaatgtttgttctgcaaaggaggtagccacctggcagcgatctctgcacccacactttggacgctcggaccatttaggtaaccctaatggattgttcctccagtctaagcttgcaatttccacccgacgttcgtactccatccaagcatgaatgaactgtatggtcggttacattctccagatcaaactaaactacatcttacaattaacactattgtctatgtctcaattcatactattatattatgtgctctggatctacacatatgtgctgtgtgctacagatctgctaaaatatatggaactaaaactaaaacgcaacatatagtactcaaacataacatattagtacaaatgcaaaagaggtatgagagcaaacctgtgatgaagtgagcgaaccagcagggcttcgccgctccccttctgctgccctcccctctctctctttcgttttttttttggatttttagagattataatgaaattttagagaggggggacatggttatactgggggaggcaaaaatcgccctcccccagggcggcaagggggccgcctgcaaaattccaggccccccgccgcccatttgcaggcggccccccggacgccgtggaggcgggctacccc

SEQ ID NO: 82888 - DNA, 3840 bp, Oryza sativa
taatatccttttcatagggcagcaggcatcaaatcaatggctcgaatgggaggcctgtatacgatcatgggccaggaattatagtcggaatagcatttagctgtccatggtctctggacctggaatagcatgatagttggacatgcccaaataaaacggagataaaatttaggacacttatggcaggctttttaacctgatacacggtgtgtttggtgtaaaaactttctatatgagagttggtgtaaaatgttatattaattcatgttgcaagtttgtaataaataaaaatgaggtggtcacacgttttgtcttataggttgggcgtacagcatatcctttttattttcatgttcattttcaggagattcagacaccatcaaagactagtgcccatgttcctccgcatagtgtaagcgggccttctctcagggcgggaagggggcagcctgcaaaattccaggccccccgccgcctatttgcaggcggccccccgcacagtgtaaaatcgccctcccccagggcggcaagggagccgcctgcaaatttccatgcccccctcgccgcccatttgcaggcggccccccgcacagtgtaaaatcgccctagcggagggcggcaagggggccgcctgcaaatttcattgagagcgaacggccgtctgccacgtcacatttgccgctctctgggagggcgatttttaaaaatagccctcccagagggcggcgccctcccagagagaatagccctcccagagggcggcgccctcccagagagcggcgggcgactacttctgtcaaattttgaaatagaaaattatttttgtaaaacttttaataaaaaaaattaaaaataaaaaaattcctcctattagagaccggcctgtcatattatgggcccttctaatatccttttcattagcccacaggcctcaaatccatggcctcaatgggaggcccgtatacgatcatgggccagtaattttagttcgattcgcattttgctgtccatggtccctggacctggactagcctgatatttggacatgaccaaataaaacggagataaaattttggatacttatggcacgctttttaaactgctacacggtgtgtttcgtgtaaaaactttttatatgaaagttgctctaaaatgtcagattaattcatttttcaagtttgtaataattaaaactcaagtaatcacacgttattaccatctcgttttgcgtaaaacacttaatttttattttcatcttcattttcaggagattcaaacaccatcaaagactagtgaccttttttttcctcttcttaattgcggccattttctctgatccgaaatatttctaaaaacatgaccctataaatcaacaaaaaaacaaaatcataattcaattaggactccatccaaaataataattgtgaactcttttaaaaatatataaaaaatccacatattattctgtgcacctcctccccgccccggcgatcggtgcatccccaagccccccgaaatattcatgcaaacaagaccctataatcaacaaaatacagaatcataatttgattaggaatccatccaaaataataacagggaactcttttaaaaagacaagaaaaaactcaaattattcacaacataaattcagactatttcaattgggaaatccaaactttcagcttcgaacttaattgaatgttcaacatgagaatgactgaatgagggggtacctcaccttaactacccagttaaattttacaaattccgactagtctaaaaaaaagtttacaaatttcagaacgatctcgagtggatagcaaggaactctatgcatgtgttgcttgactgagttagcgattaaaatgtgattgtcactatcccaatcatcattacttaatgatttcacaatcgatcgatcaatttttttttattttgagtactagcagatcatagtcacgtatcgtaaacgacacaaaattttgacactatttacatttgtttcataaaaaaacccacaaataaaaattaaatgtgcatgcataagttttttgaaaggagaaactctgaggaaaatgcaacgtgttactaagtttatatgtgttgttttcgtgcagaccaagcgacgagagaagcgtgtgtatattgtcatgagcttagttgcagggtgagtgacatgtcaccttacgtttcaccaaaccaccagactaacctaacagaagattactctatcattcaaccgacgcgtataacaaaagaaaaaacattttctacttttggtttatgttagttttagtgttgcctaatcttgaaacgcaagtaattaataaagctgctcgtcactgtcggatcttcttaattggctgagcaactgggactgcagatcgatcgatcttctgctttgtgccgcagcaaccaccgatcgactgttgatcaccctcacgtcaaattcaccaattatgcgtatgaaattgacagcttaattcgatttcattatttcaccacgaagcgagttgaaatttggtttggtctccatcacaagatctgtgcatgattagctgatagagctagccagctggagcagtagctcgatctgagtgatcgacgtacctgcaaaaccatgagatcagattgtgttggtacagtatccgagtctcacacctaattgaagttgaagtctctatagttccaactcatgttggtacatccatcgtccaatgcatgaatgttggtatatgaacaaatcaacacgtttgacacatcataaaaaatgaacaatttttaatagccatcttgtcaatttaaattcactgtaatttcaagaaagcagcaggataatacagtgatatatactacttcacttttttgatgcgtttgatcattcgttttattaaaaaattacatacttatagtttattttgttgtgagttattttagcacttaaagtactttaaacatgatttatatatatcttatacatttatataaaacttttaaataagattaatgataaatatgtgtttaaagttaacggtgtaatatatttaaaaaggagggagtacttggtttcatttaatatccgatgtgataatttggaccttcaagtcctgtttgttcagtgaacgcgtggaggacgaagctattggtagtatgtccatcttcttctttttttgccggttaatttgatttggctcggagaaaattaaggagaatggcaatgtggtgcggtagaaaaggcagtggatcgtcttctcttggaggagatggatcaaacgggttggttgtcgtgtcacctccattctcacccaacttccttacctagcaagcttccattgccatggcgatggcggcaccagcatacgcagagagcgagctctatatactagcaactcgtgtgggagagcagagcagaagcagaagcagagccgaaccgagctagacgacgaaagaggagagggagaccacgagatcatcgacaatggcgctgctccggcaatggcgccgcggcctcgccctcgccgctctgctcgcgctccacctcgccctcgccgcggcacagtcgcctgcggccgcgccggcgcagcccaccccaaccccagtgcccacggcgccggccaagtcaccgcccgcgccggccacgcctgctcccaccgccactcccactcctcccgttgcaccggccaaggcgccgccggtcgcgcccgccgtcgcgcctgtcacgccgccgccaccgacaccgaagaaagcaccaccaccgccggtgacgcccccgccggtgacacctcccccggtgacacccccgccggtgtcgcccccgcccgcgaccccgcctccggctct
